United States Patent 7,868,149 (PLANT GENOME SEQUENCE AND USES THEREOF) - sequence listing, part 81

SEQ ID NO: 43142 - DNA, 14338 bp, Oryza sativa
tctttgacatcagcaaatgagaaggtcaagaggggcttacttgacaaggttcatgctttatatatgtctgatggcaacctatcattcgataaaccagttaagaagagttgctatatccgcagtgtaattttggacaatgaaaactgtaccacttttccaccagtcttgttgaagtttgaatttcttggatatcttgaaatccatggagttgattgcaagaaacttcctgaagcaatctccggctgttggaacttgcagtcacttcattttattcggtgcagcggatttgtgatgttacctgagtctgttggcaaacttaagaagctaagaactttagagctaaattatgttattgatcttgagagtttgccgcagtccattggtgattgtcaaggtcttcaatccttgcaactacatagctgtaacaaacttcaaggcatgccgacttcgataggcagaattgagaacctaagggtgcttcatattacgtcgtgtccatgtatgcaaaaactaccgtcagagccctgtggggagtccaacaacctggagataatcaacttatctaattgccacaacttccatggcctgccaagcacatttgcctgcaaagcattgcgtactcttaatctttacaataccaagattaccatgttacctcaatgggtaacttcaatcgatactctagaatgtctagaccttggatattgccacgagctcatggaatttcctaaaggtatagcaaacttgagaaggcttgcagttttgaacttagagggttgcagtaaactacgttgcatgccatcaggtttcagacaactgactcgtttaacaaagatgggtttgtttgttgttggatgtgatggtgataatgcaaggatctcagagcttgaaacccttgatatgataagtggtaagatgaaaattatcaaccttaaatatacgctggatccaactgatgcagataaggccagcttgaagaggaagaacaacataaagtatctggagttggactggtctcgaggtgaaactgaaaaggagttagtaacagatatggtcatggagcaagacctggctgtgctgaacgctcttgaaccaccatcccgaattgaggaaatattaatatattattatggaggtccctgtttgccatggtggatgaagaagcaaactgattcttcttgctgggaaagcacaatgttaaagcaaaccaatccatgtcagcttatttatctaactagaatgacactacatgaaattccaaacttgaagcatatgcaaggacttgttgagttgcctttgctgaattaccttgaactatttggattgcctaatttggaggacatgtggaccacgacaggaggtgcagaaatcaggggtgatgaattgcaggcaaaatactgtttccctgccctgtccaccttatggataaggggctgtccgagattgaatgtggtgccctacttcccatcatctttggagagactttttttaagagaaagcaatgatcagctgctatcttcaggcagcttctcccatctccttcctccacttgcccatgaatcttctccttgcagcaatgcgcactcagcggtgccccgactgaaggaactaactataattaaaatgacaggatcatcgtgtggttgggatttcctgcagtaccttgatgcactagagtacttcaatatttttggcagcaatgacctaacacaattacctgagagcatgcgaagcctcacctccctccacaagctaatcatccacgactgtcccacctttggcatgctgccagaatggcttggagaactgtgttctttacagtccctgtttatcaaggggaccccaatgatggacagtctccctcaatcgattggctgccttacgtccctcacgcacttgactattgcatgcgataatttgaaacagctgcctgagacgtttcaccacctcacctcccttcgagaactcgacttggcaggatgtggtgccctgactgcactgccagaaaacatcgggaaactctctgcacttgaagcactatatgtcggaccgtgctctgccattcaatgcctgcccgagtccataaaacaccttactaatctccggcgattgaacatttctggttgccctaatttggtcaagcgttgcgagcaagaagtgggggaagactggcagcttgtctctcatattcctaatttaataagtgactaaggctctgagggcagcatccgacccttggtacgttctggagtacctgtcactgatttgctacatcagcttgtgtttgctaatgttctaaggtccctgctttatttttatgtatgagtattgagtttacagtagtctcttatactggtactaaaagcacttgtatgcttcgtatttcaagtttcaacacagtcttgcctgcctctcttccctagagtgtggttctacttgttcctcccaatataacatgtcctctacaatcgcactcctgttttcttctcgtaatgatagatttcatgccgatgctaataaactacgcttcttgcgtacaggttttcagattggagaaagtgataagaaggattggactgtcgaagactgtctgctgagtacatttcttcttctgctggaccattcagaaaatgcttccgtgcttcttttgtactgtatgctgatcatcttagatctataccgtttaaagagtgtggagactacaactttactctggatctcgtcttttgtacttctgtatattggtcatcttactctgctagagtctggtctcactacacgcgtttggttagcatgtgacatgtttttgctacttactcttgtggtttctgtgaggagtcacatttgatcgatcaattactcttgagcttcctggaagcggtggtgatcaagcttcttttcctgactaagcgatatcctaaactgtacaagggaaggatatatatatttgtagtctgctttactgccatttcatgttttgctaaattgtcaattccttatcctcagattcatcgtaaaaaagtatgttttgaaatcatggaaaaaagtctaatcataaaagttggtgattgcatggccctttctttatgtatcattttaggatgcaggccgtggcaccttcgtaggtcactacagtagttcatttgaattcctaaaagcttatgaaaacattcagctagttcaagtgtgtgttcactcctataaacattgataaggacagaatgaaaaggttttactcctattaacattgagaagataactggacaaaatgcaatctgaaaaccgcatataagcaggcaagatgttctatgaagaatcctcatatcgtccttggccgattgaaccggaaacgaaaccatgccaattctatcacgcaaactcgggtagaaaatattaaatccattaaattcttcttgcttgacttgaatagattccttgaccaccttacacgggagcttggccccaacaaggccaaatagcaaactaaccaaatcttatctttaacttcttgtcttttaacttaaaacatatctatctcttatccatagcagcatatctcctaattaaataaaagcaaccagccattgcggccggtgctacagtaaccctgcagataattagcacaaagtacgcctagataaaattcattaatcccaaattgaacaggagaatattattcattaatcccaaattgaacaggagagcaagcatggtacgcatggcaatagaaagaagggtagaacggcggcgataatattggacaaagcaaaacattatgctacttactgtaaggactgaactttctgaagttctgaattaactaagagcaaacaccatatcaactcgtaacaggacaagaaggcaacagatcaaggaaactaaattggaggaatcgaaacaccagtgccaaattaagaagttttgcttgtattatatcatgtccgaacatgtaagattgggctgaatgccagttctaaacataactgaaacagaaaagatgctatttctttcgacactgtacagaagttaacccctatgttttttttctacaaggactagagggctacgaacttgtttcactgaaactgctggctttgtacacggagcacctactatcagctgaacaaatagaaccaaggtatagaattgttacatggctggatttaagatctggacagcacaatcagacatctggaatctatagcgacaaagcatatgcaaataacccatctatctaaactgatcttcatgcacaattgatttggttgagcaaactgttgcacatatcatgtatgtggaggcctcggcaacatagagttagccagttcttcattcaactttacaggaaggggtggcatctgcctcattatctcaggaacatcgcctatcctgctataaaattgaagaaattgttgttacataattgcagtttcacaggacaagtgatgaaacaacagcaactaacttaatcaataaataacatctgtatttcaagatcacatggaagaaagtgttcggttattaaaatgtagcagaaaagcattgatataacaaggaggggactaaaatgacattgcaacttattgatatagaatttaggccagttagaaacttagattccaaagtaaggggactacttggggtacaatctgaagtggagaagaaatgaatttactttagaagactcaggaatgagagaaaaaaaaaacataagagccagataaacaatcatgggaagacaaatctggtactcaaatcccgagttattcaagattgtacaaaaagcaaagtagagaatcttactccttcaggactgcaagtatattatccctagtttgacataaaagagggatgttctcctgcacctacaataaatgcaatcattattagaatattgacagcatagcaaatatcaggtgaatgtgacaggtatcagtcatacctttgtgaaacaaaacaatcatacaaatttcggaagaaaaatatttggaatacattcttttaatatagcatacattcaaatggctgctcctttccccaacgtacaagtatataaccatcatgaaatgggtactaataaagtaaaacacctacagttcaatggaaattgcattatgggtttcctggacccgtggttctattaccaagtgaaattcttctagaaccttgcaattattgatagaatgcttgtccatgcgtgatttacgggcaacttaagaaactaattgcaacactacatcttcagcgacaatgcataagaaactaattgcaacactatatcttcagcgacaatgcaatgtaaaccacagccaatgtagatcataatagccaaaatattattcatataatcttatcatgctggggctgagtgctgaaaaaataacagagaagatagaactagaagtacctgcatgtttgaaatattggtatagatctggttcaagatctgtgcattgtgctcaagaatttgaccagtttggcctccaattgctgcaatgacatggaaagcactgatcaaatataatatcttaattcaacgcttaaaatctcaacatagtgataattgttatattaatgaagatgcttctaaagttacagcatgcaacttcctattcctattatatttaaaagtaaatagtactctactactggatcacaaacaggataacatcatacagtataaatatttgcaagcatcatgttctactatttactctattttaaattttcatacatgctctggaaaacttcaggtttggacaaattacaaataagttcaataatatatattttacataataaagcagcatcaacaaggtcgaagagaaaaaaataaagaaggaacaaaggattaaatagccacatgcctggaaccataatatcaagaaaaaataaaagcaaacaaatgagacaagaaagtacaaaatatgagtgctagtactaacaaaacacttacttttgtatgacacatcatcatcatccatgggaagaactggaagagaatatggagcagcattaggtcgggccactaggtgagctggcccttttgatgaagaatcattggctctctcctacaggttagtaaaaaaatatacattttaatcatgcaagaaatttaaaaacaatgatgcttcttttaaaacatctattcatttttacatatttacatccaaacacctatgcatttttacatatgtgaaacactgactttgcatgtgccaccttctaggttgctaaaacacttaaaagctagtaatctgccttttaaaacttcactagaaagaaagaatgtcggttaccgctttcatgaaatcaatagcttgccaaatcaggaacaataatagtgataaaatagggaatcagtagacaagtgagccagatggtaaccttcttttctttgtttttcttagatgactcttccttccttttcttgttactctcctttttctgcaagagatgaaaaagttgatgagattatataacaatatttgttaggcagaagaactatagtgcatgtaatatgaaacatcagaatgtttgaaaacaaaattcactagacataactatctgttgatggcaatactggtcagtttgcatggttattacaagcctacaacttcagttaatttttataataaaaaacaactatgatgcatgacttggaaggattcatttctgaaagccgactgattttgaaacagatgatgtgattttggcattgatgtagtgtggatgtagatttaatcgtattcactagtgaagaagataaaagatgatgatcatgatcatgatcatgatataataataataagaacagtaatcatgatgaaagttgtaggtggtgctcaatatggtattagtaatggagatgctagaacctagcatctatgttagattcactatataaacctgatactccctccgtcccaaaatataataacttttagctctcaaggtttatcccaaaatataacaacttcttgaccaacattctcttctcaaccaatcacaaccctccaccattcaattttctcacctacctccacttctcaaccaatcacaaccttctcccatttaattctacctactttcttaatacctgtgtccaaccctaaaaatccttatattctgggacggagggagtaattgcacaaggaactagtaacaggccatccggaaaccattggctaagcatagcaaaaaacaaagtgaaattacttgattgatttaaacaattaagcaactaataaacataatgagaatgataaaataataatatgaggtactgaattatctcaaattggttgattggcatgggatgcttgataaacataaaagaacgatgtattatagaatttttgggtgggaaattcggatgcgctagatatattacttaataagacaagctgaagcagtgaaacataaacccatctgtcaattatcataaccacaactttcctgtatagaacgagctaaagcaaaataaagagcaaacaaatatagaagtacagcaggtgatcagaatccaacttacagccatccatctgcaacgcagggccacatctcgcactgtcttgtcaggcagattcatagcaatttttgcatagcgaactacagctgcatccgccgcatagctacaataggtgtagtcagaaagtaagattgattaacttaattgttgctacatataagtgcaggacattggaggatttgagctagcttaaatgaggacaaaacaaaaatagtacaattcaagaattcagattccgtacaacaattgtggtaatgatggggacattaaccaagtgcatgaggccactacatttattgccagaacaacaaagaacagatagtgttacatacacactacgaaccagaacaaggtggctgcacaatatcccacggtccgtcagtcccacccgaaacggatagactggtgttatgtgaaactaaatttaagtttaccctggtgtaaagtagaaatttatgcttaagtcagtgcattgtgaaacgtaagtcaatctaaacggtgcaagttctcaaaaaaaaacaaaaatctaacgagtgcaaactgtaatttactctattaaatacaagcctccaccactgcactgagtaataaaacgacaactgaaatcctactacaggccatttaagaattcatctagcaaggaaaccctaacaaacaacatgataaatgcatgcctacattttgcagaaaatgtgcgtgttccacaagtcatggtactaatttccatttgggcttccaaattaccaaccaaactccaacgccataaccgatggcagttatccgtttctatacaagcacttgagcattaccatttccttgtcctgttcgcaagtcatgcagcaactggcatgacctgagccctaacagtaacatcgccattgcaactacgacaaaaggaatttcatcctagatagattatatgacagcagctacaactgcgaaattatactcttatcataaaggacagaaaaccttctataaccacttgctcatgaatgacaacaaaaaaccttgcagatattgaatagaagatggggaaaaataacctagccaagcataactactccccataaggaagcatgcaaacattcctacccaaggataacttgctatcattcactagtaaaggaaacaagtaaatattccatcctagacgggaaagtggagaaactatagcaaacatgtagtaaaataattccattctagatgagcagtggtagattagaaaataatcactaaaaccaccatacccacgatccaagaactccccaagatcgatgccatctacaacgctcttccacctcctaaccagactatcaatcaaaagtagtagaaagaacggactattccagagaatcctccttctacgagttattagacgaagggaagagaaaccctagaaaactcacctggccagccctccttcgagcacggcctgctcctcgggcgtccaccggacggagagccccgggtcgtggcgcagcgccgccgcggtgctcgcgcccggcggctgggccagcgccggcgcgggggaagggttgcggtggtggggcccgcccagaagcacccccgtggggtcggcgttcgcccccatctcgccgcctgccaccgccgccgccaactcggcaaccccccctcaggccaggggacgacggtcccgcccaaacccgagggaatctcgcgaaggcgcgcagggattccgcggaatcagagctctgcgcggccgggcggcggcgtcggcggcggcgagggtttggattctccggtggcgcggccggcggcgagtcgggggacggggagcgaggaagggagaagggaaacgaatgaattttgggctttttattttgtggggggtagatggatggatggcctggattggaactcactgtgagtaactgccttcaatcatgaaaaaacggtaagttcctgccttcctgcttcagttgagtcttcctttcactttttttttttgctagggtaaatatgaattgaaggcttccacttttatttttccgcgtatattttttaagcgtatgtctccattatatgatatatacgcgttccggtttatatatagatcgagagttagaacacttgtactacttgcctcatctatagacgtgtgtctgattaggtaggttgatatatagacgcgtgtttgactaggtacgttggtacggagatgtgtgtccgactagatacacatgatacatgaccccacctcatcatggggtcgacgttcgcctccatctcgttgtctgatatcattgtcgtccctgggagacgacggtcctatcgagtcttacctaaatcactcagagaggcggacgaattctacttgtatgatagtcaaatcagagcttcacgcacccttggcggtggagacaatgagcgtttttagactatccgaaggtggacgatggcgaacgggggacaagaagtgagaaggaagcgtgagatgaatatgtgcttttttgggggtcttggggttagatggatggctagagctcactgcctccaatcatgcaaatgattatatgtgaatttctcgtttagtcgcatctccatttcgtttgggtaaaggggtaatgtgaatatgaaggtttacgtccgtgtttctgtatatattttatgtttccgttatacgttgcatcccactctaataggttaatatatagacgtgtgtttgactaggtaagtgttacatctaatatttgtctgattagatgcacatgaagtatgatatgcggcggcggcggcggatccggaaacggaggacttggtggccgcggatccagcgtgggggatctccggatctaccatggcatctccggtgataatgacgataacgatgggaggggcggagccagcaccagtccctctcccgtgcacatcccgcagcccctccacctacaacgacatgatggttgcaagcgactacgacgacgaggatggtgttggaggcttcgagcgacgatgacggcgacaaagaaggctgtcggtggcggctgtgagcttctactgttagggtttcttgttttttttcgattttctcttttcgcagtcgaacgaattaagcattggcatgcataaatccgatttttcgcatggttgccctagctgcatgcaaaaatccgattttcacatactttttcgtgcatgtggcaagagcaaccgcatgcaaaaatcagttttgaccgtatgccaaaatcgattttgtagcagtgataggatgtgttctaacttctaatctggagttaggttgggctatcgtttatcgtgaacatgtttcctaaactgaaaatgataagtttcgtgaaaaaaaacttataaaagattcttaaagaatcaataaatccattttctaattttataacaattattacgtaattaatgaatcgtgtgctagtggcttgtttagtttccgcggtactcccttctttttcatattatattgactttttttctagtagtttgactaaatttatagaaaaatatagcaatatttttaacacaaaacaaacatattaccaaaagatatagaatgttagatttaatgaaaccaaattggtgtcgcagatattgctaaattttaataaatttaattaaatttaaataagtttaactaatgaaagattaaatccttttataacatgaaacaaagggagtgctacataactaaatagaactgctatatcaaacttagtgctatatagtgttatatagttgccttatcagcgattagcggttacacagatgggtgaaaagagcttaatatgctgtcaatcatggaattgtttatttatttatttcggtaaggttctatcagtttcatttctcctttcctttttctttccgaggatagggaaattgtcatgtgaaactgcaattttagcttctattattattattattattattattattattattattatcttttgaccagatagtatatattattaattattggatggcgtgtgcatgtatatacatatgttgtgatcgtagagacatgtgtctatgtaggtatacgaggtgcaaaacgaaaaacgatgcataattaaggtgtataggcaagaagcgtacttgatgcatatctaattgtttgtgttatttagtgtgggtaaaatgcctaccgtacgtggttctccagcacaatccaaatgtttaaaattggtaagtgctctaaattggaatagaaaaggaaacggtgaactttatcatacgtttccaagtatttcaattaaacttggtgctattataacttataataaatcttgctagctccttgatgcgaaaaaactcaattttttaaagaatacactctctaaatatggtcatttcctattaaatctggatatatgggaagtgccaaacagcaaatagatgtatattttgaaaaaaaaatgtttcttcactcgaaggtatccatttggctatgtcctcatataactatgtacggatcaaaatatattctcataaaatctattggctattgcctcccacatggcgctaccatatttagtccgggtatttcaactcccggattcacggtcctagttgcatacccgggaataaaggggttgctaaccgggagtgtagatgtattctcccgcagtgtgatatgccccaaagacaattatagaaattataatactatatttatgtatttataataaagtgttccttaatatagataacttactattgatcaatgagtatgacttattcataatacttcttatgtatgttactatttctaaataatttctaactaaatgtcataaagtaaattgcacctaaccccacctattatatctaaattgcacaaaaccacaggggttttgtttggtacgtggcacataaccacatatattatagccataaagttctacaaaaccatactattgatgtttttgactttcatctagttctataatcatatttcaaatttatggttctttatccatcatataaataaagtgaatatatatcacatccatatgagtacagttttttcaaaatttgacacatgagtatgttaaattggttaacgatgtagttttgtgaaatttattactataatacatgtggttatgtgtgacgtgataaaatccttacgattttacgtaactggaccataataggtgaggtttttatgaaatttactgttgattgttcctcttattaaaataatctatgtaagtattatgtacagtattataacttgttttgtcagttagggcattttgagttatagttctgtaaatttgcactaattttttttattataatgaatggtcaaatgtcatgtccaaaagtcatcagtgccataaaatttaaaacaaaaggaatatatgtgtgtgcgtgtgtgttttagcattacaacacattttgggtcagatgatagaaagtaaacggtatggaaagtccatgatgaatactgttcggttttaaagtatacggatgatttttaaacgttcgtgaaaattcaggatgtaaagtagacttttcgcacatacaaactgttggcagttggtctggctgttttgcatttcagtattgccaatttgcagtcattttcggacctgttattatttgctatttctaaccttgtcaaatttttacaatagtgaaaattggccatgtcaatttaattttttttataaagatcaactagggttttgttttactactgatattttattataaaataaattaatcatcaatgtataatattgaaatccgtataaaaaaacttggacatttatatttttatattttaattggaggccaaatggtataaatgctaaaaaaaatgttaaccatgactttttttcacactctgtccaaagtttaattttaaggtttacagcctcagcatagcatgaccattaattgctctgatgagatttttctcaggtagcatagtaacaagctcggaataatacatcctcttgccaattccccgagtaatgtttcaacggcaatttccaaccacacttttttatcgccatatgtattagagtttttgccaacaaaaattagtacaggttcttatactttattaaatattttttctgccctggcgttgaactgtgatcacatgatcattgaaaagaccttcagccaaactatcatcaagttgctccctgtcctctggatcaaaatagttcaataatcaataccaattaccaaaggtgcatgcattgttgctggaaacaacatagaaaaaacagccaaacattttaatattgttctaaccaagatttgccggtgcgtatgcatgcatcaaactatatgaacatcagtagtccagatgaggtgcctaagcatccttttgttttcaaatcctctctcctaagtcaaaatgttcaaataatgctaaaaaggataaatagattagttatagtagtagtacacgaatgggttctggaagagattctccactcacttatttaatagagacttgtttgaccatcatgcatcaaccgggtgcctgtatatatgttgccatcgtgtttgttgacctggttagccaccaaaaaggcagacgcgtttaggaaacggtaaacagagatcgcacgttagtacactgatactagaacctgacataattttcataaatcaattatgaaaagatgaacaaaagtgtaaattctaaatgatttaaatttgtcaaaatttgcctgaaatgcatgggaaaagagatccatttcagctagtggcaagaagattcttctcttctttgctctgtcatcagcaaacttcaaagaactcatctacaaggattaattagtcatt

SEQ ID NO: 43143 - DNA, 1057 bp, Oryza sativa
gctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgt

SEQ ID NO: 43144 - DNA, 2351 bp, Oryza sativa
ttcgcctcgtgttatgaaaatagatgcacaacggagaaacgaattttacgtagaaaacccttgcggaaaaaaactatgggcgccgaccggcaatgatcactatagagtagatgattacaaacgtaggggaataacaatgagaacgtcaacccttcccgtacagcttacaagagtatatatagaggataatagaaagacacctaataggatagacatgactagaaaactaatccgaatatattgtgggcccaaaattcggatcacatatttaacaatctccaccttgagacgaatttcctcttgtagcataaaaacatcaatcaccaaaaaatacctcatgtaggtaaaatcaccgcgcgccaaatagtctctaggactatgctgtcacacccaccaagcttgagcaaagcttaaacttagtagcaggaactggctttgtcatcatacttatcttgcataccttgacatcaccttcagcaatcacacctcgaataaagtgatatctcacatcaatgtgctttgttctctcatggaacatttgatcctttgtaaggcatattgcaccttgactatcacaaaatatattaatgcaagacgtaactccacaaagctcagtgtacaaacctctaagccaaatagcttctttacaagcttcagaaatagccatatactctgcttcagtagtagacaaggcaacagttgcttgcaaacttgccttccaactaacagcacatgctccaatagtgaaaacataacctgtgagcgatcttctcctatccaaatctccagcaaaatctgaatccacataaccaacaagttcatctttagatctcccaaactgcaaacaagcactagatgtaccacgtaggtatctgaaaatctattgaacagctttacaatgctctttgccaggattagccatgtatctactgacatcacttaatgcatgtgataagtcaggacgagaacataccatgccatacataagtgaacaaactgcacttgaataaggaactctagacatgtactcaatatcataatctgactgtggacataaatctgaagataatctgaaatgtgcagctaaaggaatactcactggttttgcatcatgcatattgaaacgatgaagaactttttcaatataacctttctgactaagatataacttgccagaatgtctttctctagtaatttccataacgagaattttcttcgctgcacccaaatccttcatctcaaattcactactcaattgtgccttcaactttgctatctctgatttatcttttacagcaatcaacatatcatcgacataaagaagcaaatatatagttggaccatcaacaactttgagataaacacagccatcataattggatcttctaaacttctgagaaagcatgaaagagtcaaatctcttataccactgtctaggtgactgcttcaacccataaagagatttcttcaacctacagactaggttctcttttccaggaacaacaaaaccttcaggttgctccatacaaatgtcctcttctaactccccatgtaaaaatgcagtcttaacatctatttgctctagttcataatcatgcattgcaacaatactaagtaaagtgcgaattgaactatgcttcacaacaggggaaaagacatcattgaaatcaatacctggaatctggctataacctttagcaactagccttgctttgtatcttgcctcatcacttggagacataccttcctttcttttgaagatccacttgcaacggataggtttcttctcctttggcaacttcaccaattcccaagtataattctttcaagtgattccatttcatcatgcatagcagttatccatgtattgcaatcatcagaaacaatagcctcagaatatgtagaaggttcggcattaccttcaatttcttctgtcacactcaaagcataagcaactatgttcgcttcttcaatatatcttcgaggaggtttaatatttcttttgggcttatcttttgcaatagaatgttttggagactgctgaacaatagaagaatctgaatcttcaataacaggtgcatcttggttaatagcaacatcttctttttctggtgcatgccctgaactgatcaagtgctccacctgcacacttgctttctcatgattctcaacaggaacattagtagaaggtttgtcatgtaacataactgattcatggaagacaacatttctactaatcacaacctttttggtttcaggacaccataactgatagcctttcacaccagacggataaccaagaaaaatgcacttaatagctctaggctccaatttaccattatcaacatgag

SEQ ID NO: 43145 - DNA, 6275 bp, Oryza sativa
agatggcgcgtgcgaaagcggcgcatagtggggctgatgctgcttctagtgcgtcccctgcggcgacctcgacggaagtcgtggccgttactaggaccaggaggcggcgccacgtagtcctatcgcccgcctcatgcccgtccggcctccgtcccccgacgccctcacttggggggagctccaggctgagatggagagcatccttcaagcgggcgcccacggcgtgggccgcgagatcgaggaggccagggcggcggcgtcgtcggcaaaccagcgtgccgatcagctggcgcgtgatctggcggaggcccgcgaggacctccaaaagattaaggggctggtagctggaaacgagacgcagcggcgcggactcgagcactggatgtcagagctcgagggccatctgacagctatccgaggttcgctgcggacatcgttcaccggcctgcaccaactcgccggggagtgcggcgtcacgacttcgatcctggcgcatcctaacgagtggtcgttgatgtcgtcgctcgtggagctggctaaggcaatggaggtgatcccctccagccacgcggccaggattggtgaggagacgtctaacggcatctacatcggggcgtgccatgttcttgcgtgtatgaggctggcgcatcccgacttagaccttaaagagactttggatcggggggccactgatgacgcgcgtaaggacacgatggaggaagtcggtgacttgggggagtccgtcctccccctttttgaagagtaggattttcattttcctctatactccttaatcaacatgctgtaatgtcacgcccggaaattcactagtaatttccgaacttatttgtgcataaaatcctcgtccaggaatcagccgaggtacacaaactgacaatttaatatacagattcatcaaattaactaaaacgataaatacttacttatgaggcacttagtcctcatcatgaagaaaactgcagcggaaaataaaatctagcgaagctccggctccactcccacaggcagctcaactggggtataagccaaacgtcttctccttctggattctttttcttcaactgaggttgattgattattgcaaggtgagcatatgacatactcagcaagccacacagcaaatatgcaagtgcacaaggataccaaaggatggcataatattggctcatttgcaaaagcagcatttagcaaaacatttaagagaagtaaaacagtggagtaattaatcaggaattttaatcaacactgaacagcacacccatgctgcacaggcccaaccatcctgaacaaccatacccggctgtacagatctaactccaaaccaggagctaagcaaattattaccagttataacatctatagttatggtgagaggtgtgggactaatcacgaaaaacattgctcaactcgcccataaccgcgggcacggctattcgaatagttttactctggccagaggtgtaccactgtacccacaagacacagcctcaacatcatgtctaccatgcgtcgcggtactggtaagtacccgaatagaggctgtgacaataccctctgcataacacaactcaccacagtgcaccattcctggatcataatcacccccttataaaacaaggcatggactccccagcgacccccgtgggcttatttccgccacttctcagtctggtgctccgcaatgaatcatgttatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagaaattaattaaccaatcacgattgaccatcgtgaactatcattaagccatcattaaataatagtgagtcataagttatcccaatagtatgctaatgtttctaagcatggctaagcaatcatatctaatatctagctgaaccaatatataaagctcaactagtcaaattataataacccaaggtatcaaggaatagagtaatcaatgcgaataggccataacaaaggaataggttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctatcacgcaaaatgaggaaaaagactaataaaaaccaaataaacaatacataaaaagtaaacaaacatgtagatcataattttagatgaattatgagacttgaacggcctcattctgatttcatatgaatttattatgaattttacaagatttaattccaattaaacctattaaacggagactattccaaattaattaaatcatttacaaatgatttataacggagataaaggattaaagcaacctccggaaaagattggatcttatttggtagatgacatatattaaaaagaaataatatgccactgaaaagaggagaggatttatattgattttggacagctgagattaaccttgaccgagtcgactaagatcggatggcttggattgatttggcaagcgggcctcacgagataccgactcaacgagtcaactccacgtgacacgggatcacccaaatgatcaaccgaaaccggcgaacggaaccggcggctctgaactaaaggacgactcaacacggacgaacgaacgaagcacggggaacacctcattcgaacgaacgagcgaacgactcaacaacggctgcggctaaaccggtggactagaaacgattcacggtaaagccccggtacgacaaacgataggccggtgggaaactagggttgcacctacggctacacaactcgactaaaagcagcggctaggtttaagcggcacacagctgcgacacggcggcactaagacaacttgactcagctaggcggcggctcagcggacaacagcgggtacggtgcacggcaatgaccggctcgacgctaggaccaaacaatattagattgaattaagaccctagggataaagtacaccggtgaacgacaaaggagcggcggttgccggcgaaccacgatacgacctcgccggagatagagcggccggctgcggatttggagggcatgcacacgtagaggacgacgaggcgaacccaacggtactcaccacaacgacaatcgacgtccgacgacggccggcaacgacggggaacgggcggcggctcggttgaccggcggcggcgaagaaggacgggcggccgggcttcctcactcctcggcgcacctcttggcggcggcggtaagcggcggcgacggcaggggcggcgctgcggcgcggctgcaacccggccggcggcggcgacgaactaaacgcgcgcggcgacgaggctacggggcactagagagctcgggagagggggcaaacgaaagaggaggactagggggtcctttatatagccataggaggccgggatcgagcccacatcgacgggaaaaactcgggaaagtttatcttcgccggaaaaaggaaaggatttgatccgcgaaattggaaaggatttccatataaaattttggggatttcttggggaaaaggaagaggagattgagaggattccattcccgcaaccaatttggaaataggagcaacggggaggtcggatttggtggaggaagcggcggctgcacaggtacaggacggcagctcgggctctgtccaggcttgaagatgaacagtgccagggaggcaaattagacttttggctgggcttctacttcttggcccgattgaaagagggacacaaagcagactttggaggagggataaggccagccgaaaggaagggagaatgggccgaggacagaagctgaacttttcctatttcggcccgaaaaggagaaggggattttaaatacttttccaattaaattaatcactgaaatgatctttgaattgttaaaaatacttccaatgctcaaataatttcaagaaaaatcctgaaaatacttggacacccaaagtatttaacaatattaaaaccagaccatttaatgattaatttaatatgtgggtaattactgaaatgctctttgtatgattaaaattaggaattgagctccgaaaaatccgagaaaatttcagagagttgacttaaccatggagaatttaacaaaaattaaatccatccatgctttatattagggaaattttatttcccacatttaacttcacttgtaaattaatgaacatttaatataaattctataaataatttattaaataatttataaatcctgaaacaaaaatcaggatgtgacaaactaccccccttacaaagaatctcgtcccgagattcggaacggctagaaagaaaaagggaataggtaaactgcagtctatcttattccataactccgataattattctaaggctttaaagaaaactactgctgctttgaaactggtggctgagttgtaacacttgaagacacaactctagaagacgcaactggcactgcattggctcctgtgacaacaatgttgttgacctgaccttgcggctgctgatgcttcggcttcggacactctcttgcaaagtggcctggcttgtaacagttgaaacatacctgctgcttccttccactactgttattctcctgagactgatcctgctgaactggcaccggctgattagcttgctcgatgttaacttcattgctttcattagtctctgatttgatctcaccaccgatgtttaactgttgcgactgtccttgaccagcgaaagaagattcaccaatttggagtggcttgatacgctgcctctggctactaccttgtgcctcctggaatacagtcattttccttttacggttgtccatcctgttcttcttgtcttcaagtcgaattgctttgtcaaccagctgctgaaaatcagcatagtcatgagagatcaacataactgatagctcatcctttaagccttccaaaaacttctcctgcctttcctcgtcagtacgcacatcttctggagcatagcgagctagacgattgaactcatgaagatattccgtcacggtacgatccttttgcttaagtgcccggaactcacgctttttcaaagcaacaacacctgcaggtatgtgtgtcttcttgaatgcttccgtgaactccgcccaagtgattggttgtccttctgctctgttcatccggaaatgatcccaccattctgatgcaggtccttgcaactgatgtgaagcgaaaacaactttctcctgatccgtgcactggagcagttccaacttcttctcaatagtgtgcaaccaatcacctgcttccactgggttggtagtgctagaaaaggtaggcggcctcacacgaagaaaatcagctaacttgttttgcggcggtggagcattattgttcccttggttgagctggttctgcatctgttgtatcatcatgttcattaactgagtctgttgagccagaacttgagcaagagttgggttcccttcattgttattgtttccacttccattagcacgagtgttcaccatctattgcatattagagaagatagaaggagagaggttacactaaagacaagaccttaaccaggttaacactgatctggtgtgtgtagaccattatattgttcaagttgattaagcaagcaacctagtataattacacactcatcattgaaccactccaatgacgggaatgcaaccatacctacacacaagcaagcaacaaacgttctaccctactaactattcttcaaggatagtttggcggcataggttctaaggtaggatccaaacttcattccatgttgacatctgggcacttcagttcttcctcgatccacttgactgacctccataagttgaccacatcagcattttctagtttcaacaactagtttcagaactactcaagttgaaagagagaggggagtagacaatgaaacaatttgcaaagaattctagataaggaagaaaggagaaattttcacaaatcatgttttcggaaaatttgtccttaaggtttgaccatttggcttatcctacagtcgagatggctctgataccaacttgtcacgcccggaaattcactagtaatttccgaacttatttgtgcataaaatc

SEQ ID NO: 43146 - DNA, 57188 bp, Oryza sativa
gcttgtggttggcacggttaatgtttcacaacagtagctcgcgaaccggtccttaattgccatgagcacgactctcaaaaccatgtgctcacaacccaccattatcaagttttagttggcaagaaattaattaaccaatcacgattgaccatcgtgaactatcattaagccatcattaaataatagtgagtcataagttatcccaatagtatgctaatgtttctaagcatggctaagcaatcatatctaatatctagctgaaccaatatataaagctcaactagtcaaattataataacccaaggtatcaaggaatagagtaggattttcattttcctctatactccttaatcaacatgctgtaaaactttctgtaggtccgaactgcttttatttaacgagtcgtttcccttgtttccttagcatgtgatcccgagtacctttgtcattgtagatatgttgatgtcgaggatgtccagcagcgcgggcagcccgatacgccggtagtcgttccggcgctcacgcttgagccgcatgtgccggaggtggaaatcggtcaaagcccatccacggagacaaatatggcgatgacgtccttaggtttgtgtcttgattttcttcgctcctcgtgtttggattgacttaattagccgtgttctcgaaagagaagagtagcttgacttagtcctttccgtgttgggcagatttcaagaacgcgttggctaactgagatcgttgaatccagtattggaagacaaaactcgaggtggccgaactcgaaaggaccatcgtgggggcgaaggaccaggccgtggaaactctccgaggtcgcgaggtgtggtttaactcgtaccttaagagttgttgcacggccatggtagaagtttgcagggagctccgagttccccgcggagatcccgaggagtccgctgctggttatatctcgtggatgaagggggcctgcgcacagctcgaagggattggcaagcgcatcgacgaggccctgaagcaggagtgtcgtcgagcgagccgctacgccgggggacatgtgctggcttgcatccgagatcaccgcccgcctctgcacctcgagttccttcgcgaagggttctcttgttctcggaggacatccgcggagatcgacggtcttgcgcagtcgatggcgttgcttgccgagaaggttttctgctccatggattggcgttggccgtcctggtagcttttgtatcctgtagaaaaacatctcaagggagcatgtaatatactttgaagtattcatgacttgtaagaaatccttgtaaaataaaaatgaaatctatctaactaagttttcttacttttggtatattgtgtatgagtgttttctcattctacgacttcgatcagtcacttgagccatacactctccctagcccccagccttgtcgtcggagaattgttctcgggggataagactcttggacccttgacctgccttggttgaaaaagtgcagagcctagcccctagccgtgaagttagaaaactcaatttccgattacacggcttagttaatacgcacggtgagaactcttacatgaccagatcttacgtggtgatttgtctctgcataatctgacaaggccttatccgctctgggcgtccccagccgaagttcccttaggttcctcagaggccttgccaggacggcgtaaagggacatgaggatagatttcaactctaggtgtcgtagtggtaagggatcgttgggaaggaacactttgacgatattctttacctgaaatcaactttattgaaatcgtaagatatcttacaaatatggatactattgatttatacataaaatttacataattgatcaatgtttcaggagtttgctaactcgcgaccatcgccgtctgcactcttgaatgcgcccggccgcaagacttgcgtaatcgtgtatggtccttcccacttgggtgagagcttgttgcacccagcttggctttgaacccgtcggaggacgtaatcgctgatcgaaagtgtgcgtgctctgatgtgcttctcatgatatcgacgaagggcctactagtagccggctcctctgacggcaactctttctcgatgttcctcgagtagattcacatcgtcgcttcgctgctcctcctgctcctcgtcggagtacttctgtactcgtgtgctctgatgtcgtagctccgtggggagcatagcctctgagccatacacgaggtagaagggtgtctccttattggatgttgtcggtgtggtacgcacggcccatagaacagagggatgttcttcgacccacttcttgtcgtgtgacatgagtctgtcgtagacgcgggtcttgatcccttgtagcactatgccgtttgcccttttgacttgcccattgctctaggggtgagaaatcgaggcaaagcaaatcttgactcccaatccaatgcagtaatcctggaagtcggcactgatgaactgggagccgttatttgttatgatgcggtgaggcaatccgtatctgtagaatatccctttcataaacttgatggcattatcggccttgatttcccccgtgggcgtcgcttcaatccacttggtgaacttgtcgatggccacgaacaggaacttgtagccgccctgtcctcgtgggaatggtccgagtatatcgagcccccaacacgagaacggccaagtaagagggatagtctggagcacttgcgatggcagtcttgtgtgtttgctatgaaattgataggcttcacaccgctgcaccatgtcgcaggcgtttttgagcgcggtcggccaaaaaaaacccttgtcaaaaagcttttcctaccaacgtccgtccgccggcgtgtgacccgcagatcccttcatgtatgtccaggaggagatgtttgccgtcgtcagacgagatgcatttgagaagtactccgtttggcgcctttttgtacagatcattgccgatcatacaaatagatcttggcttgtcgggttatcttctcagcttctgcatcgtcctcgggcaactcgtcgctactctggaactcggtgagtggggtccgccagtcgtctgtggtctcgatatcggcaacgacgtgttccgcttctgtagcccccgagctgatgtcggggacaaccgtgctaccgtcgtcgcttgcctctttcaccgatggctttgtcaggatgtccagaaaagtgccaggttcgagtggctctcgtcgggacgcgcgccgtgctaggtagggatgaaactggttcggatagtttccgtccgtccggaccaattttcggatacggcaaaattcggtcggaactatccagaatttctcagattcggaaacgaatacgcataatttttctcggatacgaaaacgaataccgtaagggtgatattcaacggaaacggaaaacgatcggaaactatccggtaatttttcccggatatccagagaccttcatcagccattcatcagaatcagcccaaagagcccaacccagcctaactatgtgtgttatgcaaaccctagctcgctagcaacacagccaacaggcaacaggcagccgagccagccgactactcctattcccccgagtccccgacccccacgcatctcggccggcggccgccgccaccgcccacaggcgcctcgccccttcgccgctgctgccaccgcctcaccccttcgccaccgctgcctcacccattcgccgccgccaccgcctcacccctttgccaccgccgccgcctcaccccttcgccacagtcgctgcctcttcgtcggcgtcattgcatcggccctcttcgttggcgtcgtcgcgtcggccctcttcgtcggtgtcgtcgcgtcggccctcttcgccggtgtcgtcgcgtcggccctcttcgccggtgtcgtcgcgtcggccctcttcgccggtgtcgtcgcgtcggccctcttccgcctcttcgctggcgtcgtcacatcgccgtatcaccgccactaccggtctccgcatcatcgtctcgcataggcccgtaagcaggttcgtcggatccacattcattttttgtgctcctcattcactgagccagggagccctatatcagagtttagaccatcgagttgtgctgttgtggtgctccttattcatttgtttttttctttttgcatgtgtggtagatctgtgaatctgtgatgaattcctctcatgcaagtagcagcagcttcagcttgtgcagtgcgtgtgtgacagtcatcttgtgcaagtaatgtgtgtgacagtgtgactttgtcagtacgtgcaagtttgtggatgtttctcgttatggtattattaattattgatctttgcaaatgtaacatgctctattagaaaaaataacaagttatatttcttcgttgatttgtgaaggtcagtttgaggggcttttatgttcggattaatattcgttaccgtattcgtttcgattcgtattcgctccgtatctgtattcgataatattcgattctgttttcgtatccgggtttccgattccgatttcgattccgagaaaaaaaaatatgaaaacgaatatgataaaggtagtttccgaccgtatccggtccgttttcatccctagtaggtcgtctagttcgatgttgttcttacggtatacgtgtcggaccttgatcccatcaaacctcttctctagcttcctgacttctgcgaggtacttagataactcggggctagagcacttgtagtctttgtgcacctggttcgcgactagttctgaatcccctttcacgattagtcgcttgactccaagtgtggctgttgcttttatcccagcaagtagtccttcgtactcggctgtgttgttggtcgccctgaagttgaggtgaattgcatgcttgaactgatctctcgatggtgatgtcaagatgaaccctgccccttctccttggctgttgagtgcgccgttgaacgccattgtccatgtctcgctgtccgtttgactgtctgacctgttctcaggcatagtccagtcgattacaacatcagtgaggacctgggacttaatagctgttcgtggcacaaagtggacatcaaactggcttagctcgactacccatttcgcaatgcggccgacaacgtctttgtttctcacgacttctccaagggggaaggaggaaacaactatgactatgtgggcttgaaagtagtggcgtagctttcttgatgtcataattactgcataaagcagcttttgatctgtgggtatcttgtcttcgcatcgtggagagcttcgctgacgtagtaaaccttctctctcttgacaacaatgacattactcacagaatatggcgtggcagcgatatagaggaataattcttcattaggttggggagcaacaagtacagagggatttgacaggtagcgcttgagcgcgatgaacgcatcttcggcttcctgtgtccacacaaatttgtcttgtttcttcagcaggacaaagaaaggttgtcctcgctctcccatcctagcgacgaacctgctcagtgccgccatgcatccagttagcttctggatttccttgagtcttgtggacgacttcatgttctcgatcgccttgatcttctcgggatttgcttcgatccctctttcggagacgaggaatccgaggagcttgcccgatggtactccgaatgtgcacttctctgggttgagcatgaggcgatatcgtcggaggttgtcgaacgtttcccggaggtcatcgatcaatgagtcgcttgtctttgtcttgacaacaatgtcgtcgacgtaggcctcgacattgtgtccgagctggtcattaagtgccccttgaaccgtgcgctggaaagtgtttcctgcggttattagtccaaacggcatcttgacatagcagaatacacagaacggcgtgatgaatgctgtcttctcctcgtcctcttttgccatgctgatctggtggtagccggagtaagcgtcaagaaagcttaacaactcacagctggccgttaagtccaccaattggtctattcgaggaagagggaagtgatccttgggacacgccttgttgagatcggtgaagtcgacacacatcctccacttcttgttggctttgcgcaccatgactgggttggctaaccactctgggtggagaacttatctgatgaagccagctttgagaagcttgtcgagttcttctcatatggcttgtttccgatccggtgcaaatcaccgcagtttttgttttactggtttggcatcgggtcgcaccatgagtttgtgctcgatcacctccctagggactcccggcatgtcggacggctgctaagcaaacacgtctgcattgtcgcagaggaaggtgatgagcgcgagttcctatttctcatccagtgacgccccgatcttgacggtcttgtcggggttggcactggagagcgggacgatcttgattgcaccgtctggcttcggcgtcttgttggttttgctcactttcttgggcggctcagctatggcaggtgggttgggagtgtgctcgaccatgtcgaggctccgcttgtcgcactgcaccgccagtttcgcgtttccctgaatagtgattgttcccttcggtctaggcatcttgagcacttgatacgcgtagtgagatacggccatgaacttcacaagtgcagtcctcccgatgatggcattatatgctgtgtcaaacttagcgaaatcaaaggtgtgaaagtgcattaattcccctagtggtttttggtgattaatgacaaatgtggttaagggtctaatgagtttattgagctactttcaggtgcattagtccaaggcgtggaagaagatgtcgtcacctagccgttatacatatacaactcgtttccagctcgttgttagcctctcccaagtgtttcttgccttctccactcaatctagagcctaattcttgtgagaaagagagattgagagggagagaagaagatttggagaggtgtgaagactaggaacttgggtgagcacttggaatatctcgtgggctgtcatctcggtgcttattactcttggagatgatctcctagacggttaggtgtcgcccgtgacaattcgttgcatattgtggatgtcccgggtaagtttgtgaaggatctcctctcctccgaaagggaacgaggtaagttaatgaagttcttatgctgagattctagaggttttccaagtagagcaacctacacttgtggtggatttctagaagtaggttgagttggatcttggtggtcactcaattctagaaatttgtctaggagtgtttggggttgaaggctgtggatttcctctggggtttttgcacatgtgaggcaaggggttaatcgagacccagctttttggagctcctcaacggagagtaggatcgcaagatccgaacttcgagaaaaaatcgctcttatctctttctgtgatatttctgtggatgattctgtgatctatcctctgcttaaaatacctgtgcaccttcttgtgaagattggcttagtctcctgttttgaaatttgaatttcatctctgttctgttaccaggaagttcctgtcctagaacaccggaagttccgggcctggctggccggaagttccggagttccttactaggaagttccgggtctatttgaattttaccgccgcgatttgtttttaagttttcagggacagcctattcaccgcccccctctaggcttcatcagcgcgttcaaggtgatctgttcggaagttgtttacttggccgaaagtcatgggtagcgtgatcttgcccaatggcttggacgacgactcaggagtgattccatgaaagggttgatcagtgggtgtcaactcgcttcgtgggatccccatcgcgtccaaggtgctagcgaagagtaagttgatggagctgccgccatcgatgagaacccgtgcgaccttgatatcctgaatagtgggctcaaccacgatcggatatcgccctggagtaacggcagtcttggggtggtctgcttctgagaactcgatcttctgctctgaccacttcatcttggacgcagccccctgccatgtcgaacaaacttcgcgctccactttcttgtactctcgctttgaggagtacgccgtggaacctccgaagatgtgcgaaacatggagaccggagtctgggtacgctgagtctgagtcctgagtagtcgcttcggcggccttctcgactacacgtactcgcttgcatttctccaacgccagttgcttcgtgagtgcctttttaagatgaaataagtctccagagagtgcttgtccgtcttgtatatagggcaccatattttcttcgtgtcgtcgccttgtgggtttgggtgcttgggcgggtcaacgtgttctgctatgagaacctccgtttgcgctttctgtttcccactcctgcgaatctttttcttgcttgactcaggcgtgtccttggctggtttcttctcctctcctgtcttcgacttgtcgttcttgcgtctcagagcgtcgtccgcgtgagcgcatcaattgacaatctcgaataacttgcaagcagttgtgatatgccttgttgccaattcctgggttgtgtagcgatctcggacgctagacttgaaaacgcggattacagaagcatcggtgatctcggggatcgtatttctgcactcattaaatggttgaatatagtccctcaatgattcgcccggattttgcgttagcgcgtgtaggtcgtccttgatcgcgtggcgcttgtatgttccttggaagttagcgacgaactgttgccacagatctgcccacgaagaaattgagtagggcgggaggtgaaccagccatgaacgtgcagatcccttcaacgcaaccggcaaataattcgtcaatgcgttgtcgtctgctccggcagcatagagtactgtagaatagacctgaagaaattcttcagggtcggtgcttccatcgtatttctctattgctcccggtcgaaacttctcaggccatcgaacatctcacaaagtacgagtgaaagccttgcacccaccgccaggggcagtaggttgtcggcgatcatatgctcatcgtggatgtctgtccgatgatgaagatgacgaagatgacaatgatgatgatgagtcacttggttccggggcgcgatttcgagtatgatgctcgggttcttgcaagcctcatcgtcgcccatagttgttgtcccggcgtcgatctccgtcgtcgtcattgtcacggcgtcgacctcaactggtatcgcgcggcacccgctgctcgcgtttagtatgttcgcggcggttgtggcgatcatcacggtctcggttctcgctcggacgtcctccttgttcttcgttctcgcgatgtcgtgaagagacacgatgttgggaacggttttcgttatcttgagtgagtcgcgcttctcggcggccatttagatggtcacggagatcactggtgccgcgaggtggaggggtagcttgacgaggtggcgtccactgatcaggctgttccccattagcgccgccggtcggcggttgttctggtggtgccctggcggcggcctctgcgaacgcgttattgaagttagccactgattcccgtagtcattctgcccattgatcaagatcagtgttcaggacgggatcgaaagggctttcgttcaatatcgcattgagggttctgatatgttgggccggtgtcggtgtaaccgattgatccgccgttcccgtgtggccgcctccagatgtgttggttccatcgatagcatacacgtcgcgtggtgtacttgtcgatgatgaggcctggacttcgagcagatgtaggacagatggctcatagggatcgatatcgattaccctgacgaatcgatctgatgtagtcgccgcaccttgttccttgtcctcatctctaggagagattcgtgaccgctggaccttagggggtgacgtcttaatggcgctgagaaggaccttgcagctggagaggtcgtgagtctttgccttgtggatgggacaatagacatcatgagttggagaagtacgttgaattccacgctctttgcaggcacggacttcagcttgtacgttgaggaaaaccgaacaagcttgcaaggtgtgcttgctagtcctgtggatgggacaccaagcttttgtcgccccggaagttgtccttgtcggctcgtacttcttgtgggaaggataagatttgaccacattaggatctttctcaggcttggatgttgtcgattctccgttctccacttctgcgggaggatcttttgacatggagtcaaccggggtcgtaaccacgccgttctcgctcccgataattgctgggccagtcgagattggcattgtggtgtagagcgggaagacgatttcgccgacttgagtccacaccagcatcgtcgaagttgaagctccttggttgatgccagtgttgacgctatcgtcgagaaggcttgaaatcataatagtagaaccttgagcaccaagttcccctacctgatgcgccactgtcgacaagggatacccgtagaccggatataaagggtattggggtccgttggtacgaggatcgacgtagtacgacatcaagcaaataaaagataaggattatactggttcaggctccttggtaggtaatagccctaatccatttgatatgagattatatgatggaaaccacaaattacaaagggaatagcagaactcgatgataccgacgagaccgtagtcaagttggtccgactagatctcccgacgacttggctcctgcacgctccggctccgtaggctatggtgggtgtattggcggtgatattcgatgtcttaggtcctacccagggggtcccttatataccgcgggtcagttgatctccaagtaggactcagagatatcgtacccctcacgatacagtaaagacccagtcttgtctgagtagaactccttccatccgtagataccatccctatcacgtgatagattttcttaatgtatacggaatctatccgtatacgcgcgggtataccgtatcagtgtacaacgcacatccaatgatagagggtataccttatccgtaaccctgatagtagctcccgacttctgcttaaatgagttcatgttaccgatcgcggcttctgatgtcggaattgttgtcactctcatctagtcgatctcgctttcaaaaatggattaatctgatttttttaagtaactttcgtatagaaattttttacaaaaaaatacaccgtttagcagtttgaaaagcgtgcgcgcggaagacgaggaggaggagttgggaacctgcccaaacgaacagagcattagagagttattctaatatgcaactctgcatggtagacaagttcatatataggagttgctgtgcataattaaatttgcataacgaaacaaacacagctggcaatggtggcatcatcactgacagtaagcaaatgcatgctgcagtttagcaccaagttagtgataaatcgagcttaattagcactagtgtgcgcatcttggtgcaccgaaaggttaggtcactgcagtcgcttgcttccccaaggagtgactgagtgagccagtgacccagtgacccacacgatatatgttggagtcggaccaaaacattcctccagatgtcggtgcttttatagagactcttctcccttttttttatcgcaccacaatttaattaacaccaataaatataattaatatgagtcttttatgacttatgaggtataaaaaaaaaactctgttgagtttttattagcttgataattctcatatctccctctccctatctctctccgaggggtaaaatttacaccgaacttagataatatctctctaaaatggaattaccagcatagtattaaaattaaaaaaacaattattatctaaacatttctaatcatctaaaatgtggtcaacttatcagataattactccctcaacctagcttgaaacagattattggccaaattataagtggattattaactacactattttagaaatagactaaatattttgataaataaatgtaactgatagcttctaagacatctaaataaaacagtggaaggaagttttataaggaaacatggaaaaaataatctgtgacaataatttggtgaagcaggtgaaaataataatgcaatataatgttgacataaacccaatgtttgactactcatcttattaaaaaatcagtgtaaatatgcaaaatatatgagtgataattttagtaataaaagaagtcacaaaaaaataatgtaaataatatttttaacattacaaatagtcaaatggcatgctaaaaatcaacagtaattacaatttttaaaaagaggtagtagcattatgagaaaatcccgtctccaaacaggcaaacatgggttggccacctctttgtcgaccagctagaatttcctttccgtaaaagccataaatcattataaactccgtggcttgcatctttgtgatatgatgcatctcttcttctttatccttttaaaaaaaagggcttagaaaagtttattaagcattattgtctggtatataggggcattcaaattatgtcttggtcagctgtattgtgttgaccacttcaccagaatgtgataaaataaacaatggacttgccaaaaaaaagtttgactggtccaaaataagtacggaatatttgatatataagggcattcaactgcgtacagaccaaacttccccaataaacaactcaaaaagatgcttatagtattagcaattgtctgctctctatgcattttgcagttatacttggtatttgcaattttgtattttgtcccccacttccccagaaattgtaagaagttttaatagcctttgatacgcacatgcgtgatggtactacactcgaatcggtggtcaagggtctcttattccactataaatagtgtagttttattagaattgctagtttaaaaaactatgtggttcaatgctagtcaataataaagggggttggggatatgtctcatcaccttatttctcattttaatttatttttatttttattttttaaaaataaacttatggttgtatgtcttatgacagaaccaacaaggaaaatagacaaaacaagccagcaagaaggctaatcataccaacaagtagcattttagtacttacatatacacaaccctaattcgtgatgtttctcagaattgtctttgacatgttaatggtatagataaaataccctttctatctataaatataagtatttcaagcatttaaaatttaatcataaatacaagaattcttagagaactacttatcctatcaatcagtattatttaatttttttatcttacctcaatcaccttctcatctctaatcatcactcatttaaagtgaggtacaaagttttatcaaccttaatctttattaaataacccaaaaataattatattcatgtagagacagtacgtcacaaaagtgtcatctaattaaacacggttacacgaccacgtatgcccatttgcctacaagaaaccaagccatcaactagcagccttgaagttcatacccaataatttctcaaacattacttttgtctgtttcttaagcattgtttaccaaacaaaataaaggcaaagagaattggcagaaagaaacatgagagaacacaacaacaatcctagaaagggcctatccgtaataaatggttgtttagattcaggctaatttttatccatccgaaatattgctgacctcgaatatttggttcgatacgaattttcgctcaaagtagttcaaattgaataatactaattttggttatacaaaagcttactaatctctactattataaaaattgaagatatttttgccggtactttagtatgtcatccgtgtatgagttggttttaacttcgtttacattttgaaaatacatatccgtatttgagtttgtttttaagtttattcgcttttgtaaatacacaaggagtcgtataagatctctttaaaaaaacttgcatgctaacttgaggctatcgaactcctagttgcagctcatgattttctaaaaaaaatatgggtctaagagaattctcacagtgaaatttcaactcaactaaatcataaaatatagtaagattaaaataactttccccgttgcaatgtatttgttttttttctaatatttaaaaaatataactggctcgaaaccaaataagctctcgctaaataggaagaaaccaattgcaataaataaattagtccaatgcaataccaccttcgtctccatttttaacccaccctctctctctctcctctcatttttctctcccacaaaggcacaaaccgcgtctccctctccctctctccgcccatccatcctcctagagagggagcgcgcgcaaggaggaggaacaagggctcctcggatcgggaccagctgaggtgagcgctcgatcatctcccgttttctctcctcggatctgaccatctttcttgcctttgttttctttcttttttcttttcttcttcttcttttcccctacctgttcttggtcgatcggggatttcgctgccgtgaggctgacccttcttgtggtgcggtggtggcagtgggtaggatggctgcttgatccccttgattttagtattttattttatttttcagattagatgcgtagtgtagctcgtacctcgcattgcccgcccaatgcgtgttcttcgttttctttaatttggataatatatggcactgaatttatcaagtttaaaaaaatgtcatcgtattttgcttaactttgtcaccatcaagtacacctagaacgaaaatttccaaaattagacggaacattccgaaatatcgtattatagaagttgccctcgcgtatcttccccctttcccttggcgtaaaagaaaatctccggtgtcgtctcctccgctccttgttcccaagacgagtcgcggctgaacaggggaggggaggggatcctggtgagcatccacatcctctttctgattcatctctgtcccaccgggagtacttttgtctagaatttgcttgcgttccttctcttctagatctggaagaagctcttctcttgttaattttacagagagccttaaccttaataccagtaacagtttgtttgttcccccaaaaagtttggggattcaacgagttgtgagtttctggaattggagggacagaggattggcatgttgattcttggtccgagcatgtttaccaattggcaggaaccggcatgcggttcagcactgaactgtagcaggagatgagtttcttgcctggatctggagccatcatcagtgaagaaaaggaagatttcttcaagaattcaatcacaagtgaggtttatgcggttccactgttgacagggatagggataatgccgcatgatgggtcgttttcagtacagagtgcacactgatgaacgctgtgggttccattgttccacctatggaaattccacggtcgaggcagagagaaaatggctcatgtgtggtgactggtggttctgttccactatgttttttgttctgactttttcccctcatctgaagctcgtgttaaggtcatatatggtttggtagtcctaattgtcatgtattaatggccagatggattggtagagtagtatgtttgaatttcctatgttctaatagctgaatttgttaacttggacttagatgtagctacaaattatggcctagaacagctatatcattatttcccgacctgacagaggaatctagagcttggctgcagatttagttgaatagtgtgatagtatctctgtgttttttgttcattgcagtgatgtatttagtgtttcagtatgagctatcattgattacaaatttacaatataacatatttgaagcgtttggacaatgtgatgacgaggatatatttgacaaatttacaatatgctgatgtacttgtgtttcagtatgtgctggtaacagaaaaggcataatcctatcacttgttcactgccatgggagctgatatacaatgattttttcctattgatggaaaataatatgatgctccagatttatgttagaataagatgcttctctatttattaaaaaaatggaaatataactaggcaaagccatgtaatgaagaagatatggatgtttgtcaatattcatgcacattgtgtttgcataatgaaccaaaccatttttagaataatctcatttaacatatgttattgattggcaggtgcatgcttgaaaaatgtgaatgtgtgtaacattagtgtttttgtatgttttaggttggataggtattttaatgaaccattgtaatagtatgacaggtccatgccctttaatgtcatgtaatattcgtacagtagaggataattgtttgtttccagtattcagaagtgttgattcaactatttgtccattattaaaggtctactgtaatttagaagtggacttatttttgctttcttggtaaaaacttgaatgataatttccttgagtaagatcaagacgtatggagcttgcaactgatgatatctagactaagacggtataatttagtaaacctgtaactgtattattgcgatgtttcagtttagctttaggtaatcaacacatgtgcatatcatatttctttaagatgtatctcgccaagcataatttttcagtggcaacttgcaattgagttcttgttgagttgacctattaatttattatcgcgccatataggcatatgtgtgttgaattgaatgcttgaagccttgaagcatgttattttcataatgcaatctttctagctagtatgtactatgtagtactagtttgagaatatatgtgtttcctcatcttttttattttatttttctattggacaggatttgaacaagtcagcttgtcgccaccatggttcttgattcattatcatctcctcacaggaggtcacagaacacattttttctatcatccccaaagaagcttcaatcatcgaaggatgatgttggcagttggtctgcactggttgagcggcatcgcttcctcttgacaacactagtggttctggtctttctgtgcaccatctatctgtactttgcagttaccttgggggcacctgatgcttgctctggattagcgggcactgaaaaggctgtatgtcgggcaaaatctgctcttcgacatggaaaattgaaatttttctagcgctgtcgtgcatactctcgaagaccaagttactgaggcttacaatgcgctcttcaggtcacccacagcttattcttcatacattgaatctgtatattttgtggtggatgtattgctttgtattcatgttgtactttgttgagagacctgctattcaatagttgcaacaaatctgctagtgatagagagaatttatatgttgtgtaaacggtacaaggtaggtcatcatattattttttgtcatggtgtactaaaaacaccatgccattactaatccatccaggagaccctgatactgtctccatcctggcatactgtaattcatttgaaactgcatgatactatcaagtgttagtagtgattaccaagaaatttcacaatcttagcttgttctttggttcatttttgggtttctatctcttttcttgagatgctgcggatgttcgcctcgtcatcgtcaggctgtatatctactgtaaaatttggggcatttgcaaatttgcctccggtttttccaattttgcaaggatgccactcgaatgacagttctagtggtattttgcaattttctagtggtggttttgtaataacgattcaaagtagtggtgcttgtgttcagtcttctgccgtacagcagcaaaagtggttctatcaaaaggtactattcccctgttccataatactcagttccacaatgtaaaactttttagcattactcatatttatatacattgtgaaacggaggaagtataagcaatccaagcatttaaaatttatcttaaaatataaaaaaatttgtgcctcatacccgtaataagggacgtcttattttactctccttggtaatctctgaaaacccatgggacagggtttaatgagggatgccagtccttttacttactctctcgtcctaaaatatactacctcctacttactctctcgtcctaaaatatactccctctgtcttataatataagagattttgggtggatgtgatatatggtataatagatctggacagacggtctatctagatccgttgtactagaatgtgtcatatcaacccaaaatcccttatattataagacgggggaagtagtaatctagtaattgtttcatttcaagatatatacaattgaaagatagcagaagtggctcaaatctattgacagatagtagtgcagacagtggagggccaactgaaacaagatgcttctgtcgtcttgccatgtcagacactaagcaagatgcataatcttgtgaccactgcaaccaccgatgatagatgctgtttggatttgctgtcaccagggacttaattatggggttaggctttgtttggatgctaagaagatccatgacactccactggagctccagatccatcacacatcccctgcttaaccactgacattgatagtgatagctcactggtttagggtttaggttttgattattcaataatggatatggtctattcagtttcaccccttcggtttgcaatttattttacctttctcagctttcttaaagtccccaattggcccaattcggcattcgggtgttttgattaaatttatgttttgcaagctttcttccggttttgttcgtgtaactttagccatgtttacgtgaaactttagctgtaaattcataaatgagccaaattagtgaccagaaatctcacgaatctccgctttttctatggttttgtagcacctccaactcttttaaaacagggcctttaatattgcttggattcgtaacgaaatttggatgggcttcaaacacaacaaattacagcccagcccaacaacacatagcacagaagaaggaaaaagtacaccgaaggtccctcaacttgtcaccgagataaaaaaacgtcctcaaactgcaaaaccagatatcgagggtcccttaatttactaaaaccagtcacaagtggtcccaaggcagtatttcacatggttttatcctacgtggcgctggttttgtccaccgtggcgctttgaccttggtcttcgttgctgagtcaccatcgccacgcgaagctggtgggacggagtggggcagcgatgagcggacacgcgggcggagtggcggcacccgaagccggcggggcggcggagccaagcggaggacgccagcctcatcgtcgtcatcttccggcgtagggcggaggacgccagcctcatcgtcgtcatcttccggcgtagggaggaggcgcgggagctggagccggaggcggaggaggggctccgctagaagccgctgctgtagaaccgggagcgcatcatctcgagctccagctccgacgccgcctcggccgcgtcagtttagccgcgcccccactccgccgccgacgccgccttgtcgtccatcatatcgaacgttgacgcggccgcggtcatcgccttggcactccccgacagcgactcgtccggggcggccctcctgcagccccaccgccccctgcggcggcctcggctcttgcgccgccgcttcatgacccgccgcatgacgccggcggggaacctgacggtgacgagcagcaggatcgccgctcccttcctcctcctcctcctcctcctctctctctcagggcggccagcagcggtccacttcgtcctcgacctcgccggcggcggcgagctgttctccttgccagcggtggcaggggcatgggcgagagaggatgagctcgaggaggatggagaaggcagtggagcggcaccgcacgggccgctgcttcccccgccgccagcgcccgcccgcacgccgctcctcccccgccgcttgcgcccgccggccgtcccccgtgcaattgcttcccccgcctgcgcgcgcccgcaaccacctccgcctccggtactgaagccgccattgtcgtcgtctacttgtcttcatccacccccaaaccgttgttgcgcctagatgtgcgccgccgtgtagccacccctttcccctcgggcgccgatcgccgcgccgcgccgatgcgctcggccattgcccaagcggagccgacgccgccgctggcgccccctccaatcggcgccctgaccttctcctcccggcgccactcccttccctccctccctcctctgcccggcgccgccccgattcctcccctctgcgccgcctcccggccgccctaccaagccgccgcaccgcgcagcctctctcctcctacgcgtggctcctgcgcgcaaccgcgccgccaccaggctctctctccctgccgccaagctctcccccttccacgctgtcggccccctcttccccaccgccgccggccatcacctgcgtcgccggcgcccatcctttgctgcgcgcgcgtgacagcgtgcgtgaggaggaaaaaaaggcagagagagaaagagaacggcaaagagaagaaaccgtgagaaagagacaaaattaaaagagaaaggaaagaaaaaggaagtgggacccccctgactcctcctccctgtgaagccatgaagggagagagatgtgacgtggcaacttgacacgtggggcccacgctgactcagctgtcacgtaggctaaaaccgggctcaaaaccatcgaaggacctattatcaccggttttggtaagttaagggaccttcgatatctggttttgcggttcgaggacgttttttaatctcggtgataagttgagggaccttcagtgtactttttccacagaagaaagtggaacgaaagcccaaccaaattattatccaggcccagccaacggcgaccacaaaccgagcagataagcccatccacagatcgggtggctcccgtttgccgcctaacggcaacctccccacccaaaaccaaacgccgtcacctctcaaccccgccccaactcaaagcctcttccaaatggccctcacagccgccgtctccgtccccttcgccgtcacccctctccgccgcctctcctcctcgacgacgacgagggctttcagcttcagggtgtccgcggcggcgatggcggcggccgcgaagacggcggtgcagccggccgtggtggtgggcggggggcgggtggggcaggcgctgctctccatgggcccgccgggagcggacgtgctcgtcggccgcggcgagaaggtgccggaggacgcgcccggcccgatccttgtctgcacccgcaacgacgacctcgacgccgtgctcgacgccaccccgaggtcgcggtggcgcggtacgttcgtccctctcccggctctcctctcctctcctctccgtctcccgcctggcagccgcgccgtctcctgctctgcattgcttctgcttgttagctgctctgcgattcaggtcgttcgtcagtaactcagtatgcgtttgattggtgcctgtggtgcatcgcttcgttttcacccgaaaatgcggacggcttggacgaatttaaccaagttgtgccgtgaattggagtattgttgttgaacccaatttctcaaacttgcttagcagttgagttcagttcagttcttctttttgtttagtatagagtttgctattaactgatgcccgatagtccaatggaaaaaaagtccggatctatttctcgaatgggtggtcttgggaaagctggtcatagttgatgtattatgaacgcgattgtaaagcaaattcgtttggtgactttcagattggatcagctaactgacaagaatgctcagtaggtttcaaaaaaaaaaaaaaaaacaagaatgctcagaattccggatattggatattagacaaacagacatatagtgcttcagaagtttaatccttagcacagttgtcaatacatttctacgaacgtcatccttcctaaatagtataagtgttcactttcttcttatgtatgagctgatgtagcatgagcccatttccctcccagtattggtgtgtgcagtgtgctggtactttctgagctaacactagagcagatttggtgtttttccagaatggaatgttggacccttggtttgagagcaagggactagtggatgcgaaccaggtgttggcctactttgccgtgtcgaagcttggtgagccaccagtggatgggattactgacactaatcccgaggggctgactgctgcatttggaaactgggctccagccgtggctactcgcctgcaaaatggcgggcttacctgcaaggtgggtttacacagttacattagttgtacttctagctgatgctcataaattgcaattctgcatgccttcatcacagattaccatcatttctactaagatttgactgtaaatgcacagtaaggtgaaggaccattgataacaaagtgcgtagcaaaaatgcactcacatctttgtttgtgcttacagcacattgtaatggacagtgcgtgcacgtcataaaatactcaattgattaacaatatattcttgtcatgtcatgtgtaagattttaaataaaacgaacaaaattccaacggtcaacaaaaaataatgaaccctgtgctgttatatactgacaagcatatccattagttgtaagtaatcctgttgtgattgcccactggaaaatcaggtacttgaaaaagaagcatttcagaagcaaatgctagagaaactgatctggatttcagcattcatgcttgttggtgcccgtcatccaggagctactgttggtgcggtcgagaaagaataccaatctgaggtaacccttattccttaaactttaatatatattctgtgtttctttctctccattaatttgaagcttagaaggcagtaagttcccaacacaacaaatttgtgaggaatcccttcttgtcataacacagaatcttcgagatcctctgcaatatgctggtttctaccaaggcatatattaattgcaagcaaaaagaaaaatgaaatcattatttcctgattgtacttcctgcataaaattgtctattgtcttccatactttattcgtccacttaagataatagctatttatgatttagtttactttggtaattttgatgggagtgcctgaagatagagacacagttttacgtgcaagacaggatttgtcaagagcaggaatagtgttcacacgtgaccaatagtaaccagtgaggtgtttgttatcttagagataagattatatctactcttgttaactatgtccttagttttatagataaatttcttgtgaatcaagtcatctcatctataaaaggaaggactaaatctcttctcattgaccagacatgagtaaacaaacaagtcccctgtctctaaactctaggttattcttgacctacgtccccaaccggtgtgctactttgcctagccgccatttttactttaagttgccaccatctaatctctcttcgatgaatactatcccaattgtgtgaatcaaggttcacaacataaaaaaaaaacatattcatttatattttgttctcacaggttgccagcctgatagcagaattagcatctgctgcagctgaagaaagggggcttacatttgatgcaggcatagaagagagactttgcgcatactccagagctgttgcacacttcccaactgctgtaaaagaggcaagtcctgcctatcataagctatctatataacaattaaacattgcctattctagtgccttttaaattaaaatgtaagctttccatggagcagttcaagtggaggaatggatggttttactctctcaccgaaaaggcgcttgcacaaggaaagccggatccatgcccactccacacagcttggctcaaggagattaaggtcatataaagaacttttatgtacagaagatgtgtggtttcgagtcatgttgatgttatccatatagagaaaatcgcataatctgataaactacgttaggtgcctgtttgatttgagtttagttagcctgttatattagtaatttacatgtcacctgtgtcacaataaacctttctatgtgaaaaattgagtgctcaagctggtcgttataaacttataatggtcaaagttcgtgataggcaccatatacatataatgtttgctgttactagtatctgctggctatattaacagtaaatgctacgctacgtactactgttatgcttctgtactgaatagtaactatgcaatatctagaccatccaatcaggatccaactgtggctacagcaactgctacagtgtttggcttattcgtggaataagccaaacggcatatttgcaaacaagaagtaatttgtgaattaaacttttatatacgtgttcttagcgacctaaaagcaaaagctgaaaaataaacttcgatgaaaaaccccaaaatcagcttcaaatttaaggtcgaaaattcaaattttggcttataagcataagtataaacgaaaagatgaggctgcactggatgccaaattgattattaccgagacacaacttatgatgcttgaataacttacaaccacttttatccttttccaatagtctcctcacacagtaataatcaatggttccctattattctctcctcatcctcttttaacttttgaggtgacgcctcgtgtaggttattttccccagtagcattatacagctaaactcaaaccttctccacctctgcatcttcagctaaagaactattgcaattatttcacgccagaatgacaagagcacatttcctttacttctcctgatgatcacacctccacagagttacatgaatagttggtaattattcagattttgcatacatgcaacaaatcttttgcataatcttcttttgtagatgatcaacttggccaaaaaaggcaaatctccaaggctcaaacaaaagcagtaccccgaaccacagccaaaatccgaagaccagcccagctaatacggagtaaaaccagcttaggatttcaagttcctggctgtctgtacttccccctatcaatgctgatgtagaatttgaaccatctgaacatgaaatgttcaatgggaagccacataacccaaagttgttgctataaattgatggatctgcaagcgtccggagttgataaccagatggtatctcacctgataaatgattgttggacaaatttagtgaactaagagacatcaaatttgagatgcttgaaggaatagagccggagagttcattccaagaaaaatcaagagactcgaggatcttcaaattgccaatctctttaggaataatgccagatagatgatttctcgacaagtttaggaacctcatgctttcaagattgcacaactccgaaggaatctcattggagagatagttgcttgatagatcaatacctgccatgagtgcaaccgttccttggaaagtttggttttgcctcttccagtttatgccaattcggtctgtgtatgtgtaatcaacacgcccatccaaaatgtggtgttggactttccaaggcaagttcagttcagtttttggttgtatcatggatgtaaaatttccaaaacttctcggtatcgaacctactaaattgttcatagctaggtccaacaattgaagatgggagagttgtgatagttccttcgggatactcccattgaacacattagatcgcagaatgagaaacctcagtaagggattgcaagttccaatccatgagggaattgtgccagtaaaatggttgccaccaagatctagaattattagccacttgcatccctttaggaccattggatatcccccagtgaggttgttgttagcaagatgcaccgattccaatgatgaattagggtaagccgacatcggaggaacctccccagaaaaggagttgtatgacaaatccatgaataccaggtcctgcaagtgccataggcaactagggatctctccatggagatgattgtttgacaggtccaagatttccagagaatccagctgacaaaatgtcaaaggaaattctcccgagaagctgttgctggccaacacaatggtcacaaattgcctactgccaaaatcacttggtatagtgccactgaacctgttattgctgagatcaaggccatagagattcctgagggatgatatggatgcaggaacctcaccctccaatcgattcgtgccgacgtcgatggttcgcaacgctgtcaggttgaagatttccggtggtatcacgcctgtgaagccgttggagaagagatccattaccaacaggtctgtcaggttccccacggaatttggaatcggccctgtcaagaaattatccgctagctccagtgcctgcaagcttgccagccttccgatctccgccgggatctcgccggtgagcttgttcttcgccaggcgcaaatacttcagctttgtcgtgttgcagatcgtcggcgggatgctgccggtgatcgagttgttctgaacacggaattgtgtgagttctacccagttcgtgaacaattctgaagggatgtcactgttaagcctgtttcttgacacgtcgaacacggtcatcttccccatggcggagagcgacctcaggataggaccgtacagtccattggaggacaggttgaggtagctcagctgttgcagcgtcgccggcgacaatggcaagacgtccagtatgtggccggcgaaggcgttgtcggaaaggtcaaggtacgtcaggttgctggccctggtggagacgttcgctgccacgacgccggcggtgatgttgttgcggcggaggtcgagcttcgcgagcgccgggaacgcggcgaggtcgagcgcgcggagctcgccgtggagccctgcgccggggaggctgagctccgcgacgtggccggcggcgtcgcacgtgacgccgcgccaggacgagcaggcggagctggaggtcgccggtgaccatgtggtcagcggagacgctgacgccgccgccgacaaggtggatttccaccggaggagggattctgcctcgccgtgctggatgatcgtcgagctggaacacggcggcgtcgacagcagcagaagcagaagggagatgcggagggggatgatggattttgatgcgtgtgttcgtgaccggagagccatcagtggcacatcgtgttcttgggattactccctacagtagagtagacggatgatgaactgacagcgggtcaaagatttggaaggagtccatcttgcgagacttgtggtactagacaattcatcctcatagttcctgtgctactgttatttgacatctctatcgaacggataacgcgttagttagagcaggtacaatagcatactgctagctataaacagaagataaaagatgagagagaagactacagatttatagccagctgcagcacatactctaaaatacatgtgtgtatgataggtgagatcgagatatggtgcaattgttactacaactgcaactttagcagttgcagtgcagccgatggatcaaaaatcaacggctcagatgacaggtaaatactgttcataaaatactatagcaaatttgtactgtagcgattactgtagtatcaatggtacaacaggatgacagagtgaatcggagcgttggctccatcgatccaacggttataatgtgctccgactgctaaagttgcagtcgttactactacatcaccagatctcaattcatgatatgtgggactagatattaattgtgtagtatatgtttataggtgattattatatgaattagctattaaattgaccatagatgatttgaagccaacagtttgctatactactccctccatttcataatgtaagactttctagcattgctcatattcatatactctctccatttcaaaatataagtcattttagcatttcttatattcatatatatctagattcattaacatcaacatgaatgtggaaaatgttagagtgacttacattgtgaaacggagggagtagatgttaatgaatctagacatatatgtgtgtgtctagatttattaacaactatataaatatggataatgttagaaagttttagtattaaacttgctcttatgcctctctcgttgttgtgctccaataaactctgtttaagacagcacatgaatcctcttcgctccaatcctaacccccgtcacattctcccccatctaatcctaaccccaaatcaaagtcagatccatcaccatcgtcatgacggccgcccaaaaagagaggtagatggtgctgaccatatctaacttctcctcggattggtaaggggctgtttccccgaaaacttttcccaaaaacatcacatcgaaactttggacccatgtatggagcattaaatacagataaaaagaaaaactaattgcatagtttgtatgtaaattgtgagacgaatcttttgagcctaattagtctatgattaatcatactacagtaacccatatatgctaatgacggattaatcatgaaattaattttttcattcgtgcccgaaaacttcttccgatatccggtccaacgtccgatgcgacaccttaaaattttcatttttcaactaaacaggccgtaagtatctgagattgtacacgttcctggcagatgaccatgtgattagaggagacactctgcgtccgccaccaaccagccgacttttgacacgcaattcacaggacaacacaataaccattgtactttcgtaacgacgaacggattcttttcaagcaaagcaacaaagatttatcctctttcgtggaagaatcctgattgttgaaatggcaaagataaacaacacctcggatcgacggaagaatgctgaaaattaccccaagtaccaactatatgataaaaaaaaaataacccacatgtagcggacgagagcctagcaatcaactgattgggtccaagaacatcagtgtctatcagtgtttatcagtgtctaatcgacaggcatgcgaaattttctgagcatgaagcccgcgtacagtagcaacgatggcaaggtaaagcaagtaacaacgccgcgggaaggtgattttaaagcaatgggactacctatttcagcaggatggtcagcggacgaagaaagaggcaacagctgtaatatctttccacgagagatgcagcagttgtgtccaccagatcttgggcgtacacaaaagggacagatacccaagttgcagtcacgagaacttaagacacagaaagaagaggaggagcatgaaatgtgatttaatcaaatcaaaccgatgatacccacaaataagacattaaaggagaagtgcattaataagggaggatatgtcaattgtggtcttgaagatacactcgatgtgcttatggatgtgaatatcgtgtttgagctccccctaattttttttcaacacctgatatagaggtcacaaagctcgttcttggttcaaataacactttgtctgagaagctaaaaaaactaagtgagcgcctaaattaaaggctctaattaacatattggttttatagtggttgatggaggttaatatttgtcacttccattctattctaaattaggccgaaaggagagtgaattaatgaaaactagcatagggcttagtggtttttatgggagttggctaaggctaagggtgtttatgtctatagagattattgttggaagtaaaaaaccatgcctactacttttttgtgttgttgatgttaagtgtagtgtaatgttttattaggtcgtgattggattcatgataattgttgcatcacatatactttacatcaatgtttgatgcaatggattaatgctaacatggaggtggttaagaccgataactcagcttgtatcaccttgatagacacaccggttgattagcggaacaacaacatgcaatacttgataggcagatattatcagactatgattaatatagtactaaggatggttttgtgccgatacaagctaaaccggttattttagctcgacttaataatctgtctttgtaagtgataagtaaaaaagatagtatttagtggttgccaatgcgtactgagtattatttagaaaagaaccatatgcatgaaacttcataaccaccatccaaagcggattctccgcacatcaccaaactcctcaattgtttcatgcatattattctttgcagaatgatactccgcagtacgcttttgcaaacactttatactatcttttttactcattatttattaagtcgagctacactagctggctaagcatgtatttgtacaaaaccatccttaccaatactaacataatcgtaggccagcaaatctctaccaatcaatcattgcagtcgtattgtcaatcaaccgccatgtctatcaaggcaatgcaagatgatttgtcggcctcaaccatctccacatcgacatccaactattgtatcaaacattgatgtatagtagaggagatacaatagtttgcatgaattcaatcctgacctaataaaatattatacctacccataacatcaagaacataaaaagcagtaggcatatagtatatatatactttcaacagtaagtttcatagacataacacaacaccttagcctcagccaactctcccaaaaaaccattacactccatgttagtttccattaattcactctccttctggcctaatttagaaaggaacgaaagtggcaaaatatcaataccatcacctccatcaaccaacatacagccaataggttaaaacagaggctttaggtgctcaccccatttttctgaattttcaaacatagcattttttggaccaagaatgagctccacgacctccactctcatgtgtttgaaaatcagccggatgctcaaacaccatcttcacatccatgagcacatcctgtgtatcttcaagatgatcgtcgacatttccttcttggtacgcttctccttccatgtcttatttgtgggtgtgtcggtttgatttaatttgaccattcctcacgctcattcttttctctccttctaaagttctcgtgatcgcttattctgcccacattgctttcgtgtacgcctaagatctgggttttggttgcgtccctaatgaaaggatattgttgcctcttgaagaaacatgtttcttcgcccgctaaccatcctgctgaaattaatcattccattactctatactccctccgtccaataaaaaaaaacaatctaggataggatgtgatgtttctatgtccagattcattgtactaacactactatagaaacaatttttctatacaagggccctataaggttgcaggctgaccataactggtcgcgccttcgaaaatcaacctatattttcacatacggctccttaagaggtccgcatgcaaaaatctattttcgtatgcggacctctaagagagtgatatgcaaaaataagtattttcctcggtgggtctcttaaatggtcgcatgaaatgtattttcgcaggcgggcctcttaaatattcgcctagaagtctgacttacttccttttttccctcagcacttcaatttttttttgaagtcatcgttatctcctctcatctctctctctctcacctccttcctcctcatattatacttctctcccatttctcaccttttcttctctctccctcaactcccctcctgggaacggctagtggcgggcacacggtagctagccggccgcccccgccgttgacgcgagggagacggccctaccccgccctcgagagcggcggtagcgggagcgagcaagccggtgatcggatccattgccctcgccctcgggagcaacggcggcaggcagaggcaacacgacgacgacgaccagcggtgttggctgcgacgggcggtagcagctagagttttggaagaatcggggagctagggtttcgggctatattgctttttgatattttttttatttttttttgccgaaactattttcacgtgcggtcagcttagatgaccacatgcgaaaaaaatagcaatctttgtagacacatgggtgcaaaaggaccgaaggcccgcatgcgaaaatctattttgatcctttgaaaaaattcttctttagtagtgtaggaaacatcacattttatcctataagttggttttttatggacggatggagtgttaccttcccatgatgtcattacctgccttgtcattgttgtagccgtactggtaagtgggcattgcgcttagaaatttccatggctccgatgcacacggatcccattggatgattgcatgctgcttcttgcctgcaggcaggggcggatccaaggggtaggcttcatcaggctcaagtttgccttccgatttttgcaaaaaaaattcaagcatatagcatttctcacatgggagcagttggagaaagcggggagaagagaagaggcgaataactgcgtccctgtccacgcgatgaagaagaacaggagtgatagagctgaaccgatatgcactaaacgacccaattaaccaatttagcaaaagcccattaaatggcgagtgattgccggcgcaacggtgacgagcgacaccggagcgaggctacgttatgacctgagctcatgagagatcgaatcatataaactaacaacaaatacactaataactccagatagtttgagaagaaattgggggatcgggtggagaacaagaagggaacaaaggaagaagaacaataggagggaatcagattcaattcatttcatttatccctctcctggtacatgtttcttgcattatcatggtagtaagactgactagtgggaccccaacgctggatacatttgtttagtacgagtatgacattatggccgagggaagtggactgcgccactgcagcccgcaagtgtgggtgtcgatttctaagatcggcaataaaatttatagggtgcgctagatgctagaaagaaatggtgacacagtgatttatactggttcaggccctcgggatgaggtaatacctagtccaattgtttggtggattatctttgtatcgagtgttgaatgaagaacgtgtgtaaccctctaggggtgctgtcgatccccttaatatagcagcagggtgaccggcggcaaggaggatgcaatatcccttacaatccgggctcctgccatccgtcaagatatggcgggatatgtttctatctccttattcctcaccatttatagtaacagattacatgggcttgggcccgtagcatgctagagatctggcctttgagtactgtgatgggctaccccagtacgataactcccacagtgggccgtgcaggcgtgccgggccggacaaaccaggaggcaggagcctaggaagtgctgcttccagcttgcttgctgccataaggccctatttgtttcagctcaaggccctatttatttcagcttagaattattataatctagattattagtagtaatctgaaataaacatgtagattattataatctataagacataatagtataatctggtaatctcctctaagcgtgttttttcatattatttggtggttaaagactcactatccttattctaccataatccagataaacaaccaactcatagcttattctactatagcttattataatccagcttatagtaatctagctcaataatttagattacatataaaacaaacaggcctaacttgcctcgttgcctgctacattgcttcttgcggcatgcggcttgcctcggttgcctgcatccagtgagcgagctctgttcagttctttattgtctagtgaaaaaatgaggctgtgaggggatttatcatttacatttcgtagtatttgatttattggtagatttgcaaattgcaatggagaagaaaatagcatagcttaattactttacaagccattcaactgatacatccccaacagacgagagcacaaatagaccaatccaacaaaacagataccaatagatgattagatgaagtgaggagagcatatttattgaatggtccaaattgagcaccaacatgtttttccaaaaacattggatggtaagatttagagattctttcaacgaaattggctcgataaatttgacattggaatatagtgtaggaaaggatgttgcattttctttttcacatttttccatttgatacttaaactaccggttcatattttctgataatggtatgcatttagccggtgccgtacagcaagtctgcgggatcgcgtggtgccacgtggccggcatgtgggactgacgcagtaccacgcgagcgctgcacgggattgtttcagccatcaatccgcgttttggtgtcgcgtcgaataatcgatcccacattatcatcttgcggtacatgtatatttttacaattcttttaaaaacacgtatataattacagaacgtcagaaatcatgtatattttaattttgttttctagatttcgccatctatcaaagagaaagaagtcttttgcaaggggcatctttcaccaaaaatttcactcacagcttaaaatttcctcctccgcccaaaaaccctctcgacgctccgaaccccagcaatggcggacccgccgtccttccgccgccacccgcaccccttctccatcgacctcatccgctggctcccctgctcctcctcctcctcctccgaccgcctcctcgccgccgccgtccacgacccggcggcgccctcctcctcctcctcccacctgcacctgctcccgctccacgacccctcctccccgctcgccgccctccccctcccctcccgggccgcctccctccgctgctccccatcggtcctggccgcggccacctcctcggggtccctccacctcctcccctcctccctgacgtcccccggatcggccggggtgtccgtccctcccggcgccgggttccacgtgggccccgtccgcggcctcaactgcgccggcggtgggaaggagtgggtgacggccggggaggacgcagggtgcacgtggtgggcggtggcggggatgggagggtggtggcgaggaggctgtgggatgggaaggggatgcccgggtacgaggccgccaggtgggcgtcggcggcggagttcgccaccggtggcgccggctgcggcgtgcagtggtgggacaggaggaagggggacgccgtggtggcgcagtgcaagggcgtttggtgagtgtgagaaatggtggatctctcctgttcctggttgttggttgatgtgcttgtaaatgctagtaggagtagtacattattagtggttcaattaggatcaaggaaatcttctttgcttgtgattggtgagtagagactcaatgcgcgcacaatgatttgattggtgctagtacattacatgttgtttgctctgtagatatgtatgttcctgctgttgttatgaacatgctagatgtatatttatggttatggttatgctcattgttgtcatcacgtaattaggtcgactgctacggttatttgcttatgggttgatgaaaattttggcaaggagagcttcctgtaactctttgatgggattctaacatctcaagacatctctgctttcctaaaatttggtgcactcgaatctgatatggatgaaatgtacctgttacacaggaatttgattcaaaaaatttcagggtaacaagcaactcaattcttgaacttctctacattccatttctgaaaggctatagctcaatagttatcgttctatttttagaagctcagcctaagctttactagtgcagattttgattaattgtgtgatcctcaaagttcaaagttctgtggtttttttaattaaattgcagattttgatttgtatgctgataattgcaaaattcaaagttctgtggtttttttaattaaattgtcagatttaggtttaaaaataatcatgcaacaaatcatatagattcatctctactctccagtcttcctcaaaaagcatatggactcctacgtcataagaaaaaaaagataaaaatgatttaggcttgtgattatttttattatcatggtgatgaatcgagatgtttcatgtttggcggatttatttgctaaaacatcaagatctgatgtcccagaaaataggttttttttttctgaatggctgcacatcttgaactcatgtgctagacgattcaggttcttttatataatggattgttatgttaagtggaatacaaggctggatggctgaaccttatgtgctagtatgctgcagacaatgagtggtttttgtatcactacttgatggaaaagcataaaacttctgaattactgttaatatctaattcatgatcaattgtaaacatgtaaaggtaccaatcttagcaatgtcatgtcatataattatgccagcgtttatattattccagaagttggtaatgtgccatatttgcttgttatgctgacttgatgaccttgtgattttgcaggggccgtggcattgtcactggtatggttcattccattgacattcatccatcaagaaagcatatctgtgtggtaagttcaatgtcttagaaaatttgtgttgacttgcgtgaatagaagaatttaaaaagtgatgagtgtcatgggccaggagtcccaggcccaatgggaacaatatccccgccccacgctacttacgtatctcagttagatagagtcagagtctgttgggattaggttagagtcctcgatctatataaagagggatcttatcccaggtcagagaggcattagattgagttatctcttaggctgtgttcttccccccattttcccaacccacctctcttgttttccacgcgcacacttttcaaactgctaaacggtgtgatttatgcaaaaactttttatatgaaagttgttttaaaaaatcatattaatccatttttcaaaaaaattagttaatacttaattaatcatgcaataatacgagcttagttttgcatgccgggctcctcccgaacacagccttagtgcccaccggccctgcctttcctgcacaatgtgctctagctccgttgcgctgtttaggtccagggccagtcctgttacttcctctattataatccaatttatcccccttcaccccctttcatctcaaataatcctcgccctgacaatgagccaaggtatatagcttaatcaaacagctgaatgttgcgtacacaccaagaagcctctgtttggactttggaccatgaagttggtatgatagggtgtccgctgttcactgagagtgatagtttctgttttctccaaaaatcttataaccaaatagaatacacgtaagaggaaacaaccatatatcagtgtattgacaaaatttcagcacaggtggaaatctggatttgttctcaaagtctttttttcaaaagaaaaagtatatccatgtcggctgttttattgaaataattagaactccttcagagttaatggcaactaattccttgataatatccttaggtcagatgtatttactgatttcttgcagctcttcttagttatgtacaagggtttccatgttattcataccccccccccaaccccccccccccccacacacacacacacacaaaaagggaaatggcaatgtaactaataattcattgtaatgaatgaatgctgtcgagtcattggctacaactcttgcttcttatatttgccaaagatcggaaatttccaatcagaacaatctttgctgtgacaactaaagtcagttatctgtattgcttaacattgatcaagttatcttctaaaattatcttcaaattacatattgacatgttagtatatattgtgaaatcctagtgttgacataaatatgttatatcatagttaactagggatatttggtcaggaagcggttatgttgcacttttgtgcatctgtgctgtacatgccagagaattaagatgtctataatggtggagtggacctagacgactttaggggtacgttctcactgtttacatgatgggggaactgtgggagaatggtgacagttttaaacctgggatactggtctctggactgtctaccaattagtgtcagaccactcatgttctcacaactgccaaatagacctatactggtccatcactgcggaactcagagttgagatgagttgaaaagctgtgtttacaggagagtcataactgcaatttgaaccagctctgatgtttttaggtgggagggtcctcagggacaatatttgcttgggatctgcggtggccgcagcaaccaataccactctctggtttaggccttaatggaacagcacagcctgtgtctgagagtgaggtctgggaggttctttttgacaattacactcagtctactgatatcatctcatctgcctcgacgagaatattacctgtgatgatgtgctcagaggatgggatccttgcagtcgtcgaacaaggtaagcctatatgaagaaacttgtgccattttttttgttggctattattcaaattgctgaaaaagttacctttttgttgcagatgagaggccccttgaattgcttgctgaaccttgcgctatcaactcctttgacatagatcctgagaacccttctgtaagttcaaggtttctccagtttgaatagttttttctttattggaaatgagatattaaaattgttttgctttttgcgcaggatgtggtttgtgccctggaatgggaatcaattggtgtactaacacgtggtagagatacaatggctgaagaatgaaaagttctatttcgttaaaaatttcctgcatggtcttccttaaattgtgtggggcaactatgccaagataaacgtcttctaggaatgacactgattcaagtcgtccaacttatgtctggtgctggagtaaattgtcttgcgactttgggtcgttggttcgttgccttgtcggtgtaattgaagatcgtggaaatttgatgtgaaagattatcgttcctagtttcctacatgtgtaactgcgctttacgggagttgggtgttccattcttgaaatgcaagttggaatggtccaaaactattttggcaagttctttgttgtagacagtattttggtgctcagggatgggtcgactgttgtgagaactttttgttccatgtgctcccaagtcatgctaatgatggctaccatacaaaatttcaaacggaaattgattccggcaccgagatgccattaaacctttatctgttattatcgaaaaatttcatctgctgcttgtagctcaggaaagaacgcaaacctttttctctctctgaaaatattgaaaaatttggcaatgtcggtttcaacattcttggataggatggtaattttttttcctagctgggacagcaaatagctccggttgaactttattaaaaccggggaagagctacaagtgtattatgacgaacaaggctgaaattttattagaatccatttgaaaattttaaattttggttttcaaaattgtggtacattattttattcccttggatttattagatctgaaattgtttttgccttgagaattgcatcttttaagagcaaagtgactgaagcttgactggttaggtttattgtgttgggaataatccactcacgttcgagtcttagatttgacaagtggtagacaatgtatctgttgatagcgagacgcctacggtgacttcgtcaatcttaaaatttgatggcccatttttctgaatgtactcgtatgagtagggtgagcgtgcattgtaagaatctccatttgtaaatatgttttaaaaatatgggcctgtttggtacagctccaacttctaaatttaactccagaagttgagtctggagtggagatgtggagctgcctaaacccagctccacaactctagtacattttgtgagagagctccacccaactccactcccagttttagtggagctgaaactgtttggctgagctcctggagctggagatggagttgtgccaaacaggcctatatagttaaaaaaagaaaattaatggaactcactatcaacaaattaaataaatggatataaaagaggccgacaatgtatctgtcgatagcgagacggctatggtgactttatcaatcttaaggtttgttggcttattctttcaaatgtactcatatgggtaaggtgagtgtacgtgcatttatagtggtgggtatgtgcgttgtgagcgtctccgtttgtaaatatgttttaaatgtatctttatctttactattataaaaattgaagatgtttttgctgatattttggtacgtcaactgtatttgagttgattttttaagtttgttcacttttgaaaatacatatccgtgtttgagttggattttaagattgtttccttttggaagtataaaaggagaaattttttaaaaaaaactcgtatgctaacttgagatgaaatacagactcctaatcgcagctcataattttctaaaaaaaaatctaagcgaattcccacagtgaattttaccctagctaaaccgtgcaacaataataaaattaaaagagcatttacctgttgcaacgcacgggcattttttatagtatagttaaaaaaagaaaattaatggtaaactcattgtcaataaattaaataaatggatattgaatataacaaaataaaaattcgggatgccttatgttaaaactagagcatcaccaaccgtgctttgcttctttcatagtcctgatttttttgggattttagctgaaaaaactgccccaacaattcctcttctctttcttacgagaattgacattcccttctctataagtcacgaatcattatcgctcccaatgttccgtctaaagagcaggaccaccacccgagaaatggggcgagcggaaaggtgattctggatgagcgatcacggagtaagatggtatgaaataaggtttgggtgaagggaggttcatccttttattttagtgagttaaatttagtctatttgttggaagtatatttttaaccttgaatacttattagaaaatctcgaaaagaaagatttagggaagagattattaggcacatgctctaaggcatcaccaacataacacaaggaacataaatcactctccacaacctcctatgtgtgcttcttcccacgtgtattgttctctccacattttgcacgtgctattggaagccgacaccctcccctactagtggagagcgactaggactgaaaagatatttcatgggaagttaattagggaactgtagaagtcaattttttttcttatgaaaaacataaaatttaggcattagaagctatattgggcataagttggtgaagctctatgggatgtacaccgaatttctccttttttttccttaaaaaaatcaatctaacctatgagcaactaatcaatctcacttgtactctctcaatccaaaagcctaagggcatattactttttaaatgggattaatgaaaaattaactcatcttgcatataacaaacactaaggattactcctatgtatgcatataaccaatgagtattaagataattgcttgagttccaataattcagcactacaaaataataagacaacatctttatttaagtctaggatacatgaaggctataaatatgcacatctcattagaaaaaaatatgcttaaaacttttggaacaaaataataagacaacatcttcatttaaatctaggttacatggaggctatagatatgcacatctcgttaggaaaaatatgtttaagacttttggacggaagggtacaaattgcatcttgtttcactgtgaatgaagactcatgcttttatttttcctcttctattgctgttcaggtaagatttttctacgctattagatctacaaagatataaaggcacaagacattaggcgttagaggtgagattaactaatttttttagggaaaaatggtaaaaactaaaatcccgtgtggataataaattataatgtccaaaaacaaaatgaacggtcatcaaacatcgaactatgtgtgatccggcgaacgaaatcatcatagtactagtttattagaaaatagaaagagtaattttctctacagcaatgctgctcaaacaataatatcaaccatctaatttaaatagatggaagttatagaaattctagatatactcacagcatgagacatagtgttagactgttagtaagataaaatttacttcatccgtttcacaatgtaaggctttctagcattacccacattcatttagatgttaatggatctagacatatgtgtttagattcattaacatttatatgtatgtgagcaatgctagaaagtcttacattgtgaaatggagggagtagtatgtatagacttttccttttctcttttgcggggatagctagaaagggtaatttgatgcacgccacagcggtaaaatggggggaaacaaccgcagcaaattcgttcggcatgtaaaagcctcaaattctagtattctacaagcaaaacatccacgaaaataactcccccacattccaaaaccaaccacctgctagggcccacctgtcagccaccctaccaccccgcccgctgctcccgaaatccgcgcgccaaaagactccacatacgaagcggcttcccgcttcactccccttcccaaaaactccttctcatccaaaacttctatttttccccccccaaatctcatctcatctcatccccctcccctccctctccgtgcgccgccaccaccaccgccaccgccgccgccgcaggagcaaccccgaggagacggaggagggaggaggcagccgacgccgccgcgatgttctactcgcacacgatccttgcgcggaagagcccactgggcacggtgtggatcgccgcccacctcgagcgcaagatcaagaagccgcagatcgacggcatcgacatcccctcctacgccggtaagccctcccctcccctctctcccaaagacgcgctctttcttttcccctttgttgttgctgcgcgggtagaaaggcggcgcctttcagcggcggcgggggtagaaaggataagcttttttttttttttggttcctccgtgcaactgggatttgttccggagttgtgagtgaaaaatgttttggggttagcaatggggtcaagtgatggtacagagatttggatcccaatctgcattctgcaatttgggacaggaaggaagaaggtttggatagttttttttagagcattttgctaggggttcgcagtatttatctggttatcagttagaatttcgtgtaaatgattgttctagtggcatgattattcattaatgacaaaagatacaacaaaatttggtcttttagttatgggaggttgtggtggggtgtgcaccggagacttttgggtggatttttgcaggccctatttggatgctaaacatttcaagaatgacagcatttgcatatccagaaggaagaaaaaaaaaagaacgaccaaacccaattttttacctcccagtacagtataatcacttgcggtggaacactgcctacttgagccactctatttgaagagtaattcatatatgtttgttctacttatatgaattacacaaataagtttatatgttatccagtcaaatcatagaacattgacaaataaactggcttgttgtgcttgcattgttcttttagtacattatgtaacagtttttactttattctgtgattaactttacatatttaaccttgcaaactcaagaacaaagtagataagccttatgtttaggaagcttactgatggaattttattagaacaaaacatgttttttgactggaagtaaaacaactggattaatattgcatatttgggcatagatgtctatactctatgggaagttttttttattctctttgggaggaaagtgtgacaattttttttatttcaacttcgaactgtgctttgcaagaacttgtattataatggcatgctgaataggtcacatttttctgcaggtcgcttacccttggcaattagtttgtgtttgcttagtgaggtcatgtgtcgcccttaggtgttgtgcacgtgagcgtgttcttgggtgtgtttgtcagtttaacctcctctttttctatctattttcttcttaaagaaatgaagttcagtcctcccgcatttttgagaaaaataggttacatattttccttagttaagtattgaacaattttctcatatacattgaattttccctatgctttactctgcaacctaatgccatgtcttctaatgcatgagttttattttttcagaatttatcatgttccctgaagttccaattgctctgaggttgtcagggcatcttcttctaggtctagttcgcatttattcatggaaggtaaactacctcttccatgactgtaaccggatgctaagcacaatcagaaccgccttcgcttctgtacaagtagatctgccccttcatgcggatcatgcgccttttgacaccatcacattgcctgatacattccgtcttgatgacataaacctagatgatgcaattcgtctgatagagtgagtacttttcttctcatatattttctccgcgtcatacaacctcaactaatattattgtgttaactttctgacagtacgccagataatcatcggaagagtctggaccagatcaccctggctggtatacgaagttcaattagtcaatatatgtattattatcattccaatgcggatgcttaatgatttcattttggtgctgcagaaggagactatctgatgattgatcttgatgaggtattcctcactgacttgcgctttttgcaggcttgtttagtttgcatgttttttaatatttgtgcttataaattgtgtaggatgctagagtagagctatcagctcctggacaatcttcacacatgggacctgaaccaactgacgaagagtacgtgtcatgttttttttccttctaatttctattttggtggactcatgtccgctttgcttatcaggagattgcctccatttcacatcgattttgggccaagtgacaatatggatgaggaaatttccgtagatccttcccaaggcaacaactcggaggcagtgaacaccagtaacataaatcaggcagataaagcaccagatttacctgaaataatgcgtgaagcaccatttgagggccctgaacttaacttgccagatattgatgaggtaaacaatgatcccatggatgtgactgaggaatcttcaccatttgtgtccaagaatatcacccctccggcactggaacgaactatatcccctggtcaaggtggattatctgggacatccattcccaatgcacgaggaagtacaagcaccacatatgacaatatagaagatgttataccaatggatattggttagtattttgcttgttgactcatcttgttctttccagttttgttttctgccttcattttttcataagacctaatagaaataagactacattgcaattccaccagcattacttatgtgggatgctagaatgttgtgtaaaatgtactttcccttgatgttaaacatgtcttctcatccaagttcttttccttctgtgattttaggaatgcctgattttaggattgaaccatctccacctcgagtacaagatgagatgaatgcacaaccagtacaaggtgagataaacgcacaaccagtacaagatgagatgaacgcacaaccagtacaagatgagatgaatgcacacccagcacaagataagaggagaattagatatgacaatgaaatagtgttctccaatgcgtaagttcgactttacaaattatcttcttaagcaaagttcattggtggaaataacctcaaattaaatattatatgtttaccaggacttcgatgaatttttgaaattcatattgtactatgtcttgcctgggcgttttgtttaaaatctaccaaatgacatcttcatttctaccatgtcctgtctcctctgatcctattactctgtcccctcacctacaccacccttcgaatattgtttttctaaacagcttatctataaatagaataattctatgtgtgctgttatcaaccggtaattaactcgtctaataattttgatatatttgtatgggatttgttctgttcaaaaatacaagtcaggctatgaactttttaccatcgtagtgctaggtgtgatggggattaattgcaacaacagtatgatatctggtggtactatactgtattagttacaaatgataagacctcatactctcttgcacagttatatgaagagacaaattgatggcggtgaactacatcgtctggtcagcaagaggaggaaactgcctcaagcagcggtggatgtgtggaaattcaacaggattcgccaaaaggatggtttcttgcttgatcctttggtccatggtaagctaccatactctctgattccactagtgatggtcctttcacttctgaaacaatgtcagctcaaatttgctcttcctttcagggatgtgcgctaccctacgtcaaacctacgagagaaccttcccccatgtgattgaccctgaagctgagtcaggatctgtcgagcatactcctggggtagctaatgacagtattcaggatacacatgatcatcaactctccccgaagtctcctggaaacacagatgcacaacctgaacatcagttcaatcaacaagctccaagaaattcagatggacaacctgaacctgagcttaacccaaagtctcctgtaaatgcagaggcacaacctgaatctcagattaatccacaatctccaagaaatgcgatggacagcctgaacctgagctcaacccaaagtctccaggcgaagcaggcacgtcacactttgatgatatgcctgagatccctcgattctcgccacaaaatattccatctccaataagagacgacaattctcctttcaaaactcctggtgctggtggaactccgaaatcaagacttggagaaactcctgcctctgggacaccagcagatatgagttacatgtcacctggacaagactctgatcctcaagtttctccttttccatttaatgatgaacttgatggagatttgcccgagattcctagcctcatgagtactcctggagtaatatctaccgcaggtactggcaccacaggattgggaagcatgtctgctaggacaaggtatgggataagttccaatagacgatttcattatatgttaccatttgagtgtgaattctgacatgtttcatactgcattgtagggctgtggcacagtacttcaaagatcaaatggcttcggctacatcagatgaccaacctggtaaatttatcttgaacagaatcttggaagggagacacaggaaacaagctgcacgcatgttttttgaaacactggtaccatttaaactgcaagttacatttcccttttggacataatttgtagtcactttccacactatgtcttgacatatcgtatgtttgttctttctgtaggttctaaagagttatgattatattgatgttgaacaagaagcagcctatggtgatatagcagtttcagttaaaccctcactctcaggagccaaattttgaccaattcagttgcttagaaccacatataatctcatttgatccgcgggaaggagctttggtgggatttgcagaaatggcctgaacaatggattcttatatgcgacatggctggctaatctactgcaatttgctggactccaattactagaacaagtaggcactccatgccatttaggtttatgttgcagaatactgtagttgtaaagctgtagcattagtagttgtcgaaagccaatacatcttgtccagttaggacttcagatggtagtccttgcctatgctttcttggcagaaagcaaagtgaacaaggaatcagatgaagataagaatttttcttacttttgctgtttaattacatggtagtgatatgttaaatacaagtcgaaaaatgttggatgactagcataagacaattttataaatgtcagtgtacatagtctgatatcttcagtgtgccagagcgcagagtctgttcagaaaattttcatgcaatatgtgttctgcaatgcaccattatttgttgtatttgtctgaagtttaccttgcatgattttattacttcaatgagatccaaaattaactgtccttcaatggcaaggatcacccttgcccattatcaatcatacaatggaaccaaacatacatttttctttccattttcatcatttgttttaatttttacttggtaataaattttaaaattaaaatgaaggttttgagaagtttactccttttgggtttaccccagtgcaaacttaaggtcaagccaaatggccccttaataaccttatattatacgtgtcattaatttgcttcggaggttaaagatagatctgattatgagactacatgttaattaaacactctatctttagcttcagtattattttgatatgaatatagaataaacatatttattattcttaattgaatatattcatatgttcttcctccacatacatatggcatttctagctcaacaaattttatatttgtgatttcttagtatctattcaatctcctttttaatgatatatatgatcttccaacaaatccatgatttactgatctatgttcattttgtatcaagattttatcaattgagcatgcacacacacatggatgttgggacctattcctttgcacaactcaaaggaagacattagtcctaataaatcgtttgtcatcctccacttgatgaccaaccggttgcctatgaaagatatgaatgtttattgagtattcattaacaccacaagtatcatatacttgcatgcaagcttaagtgcaaagatccaatataaataataggtgaacaacatgtatctagaacatgcacaataaatgtataagatttgctctccctaaatatattcatacaaagaaatatataagagaggcaagtgtatgcacaagtagagaagaaccaatggggtttatcctatacacatggagaaggtatgtagcaatgataaagacaaacataaacacatacctttatcatctccatgttcttaatgtaaagaacactaaataagaaaatgctcaagtaaacattagtctcgcacttatataacaataacatggaaatcatatatatgaatctatcaaaaagtatgagataagaagtgatacatatcgctttatctccatgcatttcatctttgtcatgattaagatccaccaccaaagaatgcatatctaccacatctcatcatcggggaaaaacttctcatcattttcactttcatatacaaataagacttattgtttttatttccatatcacaatgagactaaaaaaaactcataggaacattagtctctatcggtgatatgggcccgggggtacccagactatgaagaagggcctgcccttggtggccacgtggccttcccccaagggggttcggcccgaggcaaggcggcagccgttcctcacacaccccggggtcgggtcaccccgacccccactgcgcggcgccacgtgtgccgcgccagacgggcgctcctagtgcccacctaaccgcacttaaggcggtctgagcgagcgctccgcacgcagcatttattgcggcgtggtgtgtcaggccggtctgtgaccgatgattgacatggccggggtagtgcgcctgcgcgctggttgcatgtcaggcgtcctgccgcctgacacccaccgtcacgtcgcaattgtgagaggcagatcagcctctaacgtctaccggagacagtttgcctaatccgtttagggcagggttcccatctcccggtacaaatgaggacccaaaagtcctcactctttaaatgccgaatgacggctgtgtctcctgtgtcaggcgagaggatttgatgggccccgcactgcagcaaggcatgcgagtggctttcaaggcaagcaacgagacatgtgcttagtatgattatcctccccagctaggctcggtggtcccctgtggtaaccccttgagatatgaaaggaggtcctggcctactgtgggagggggatgagccattttgactaagatagtctcttgcccctcatcatcaacacattctactccaacaaggagatcttgtaatctctctctcagtgagcatagcacatgagtagggtattacgcttctcagcaccccgaacctgtataaaccaccgttgcctttcccccgaggggttgaaccccctctcttgcacactggacagcgaaaccctcaaaactacaatcaccgcccccggccgaactgaaaaaagggaggggggggggaggggggcctcacggttcactggtggaggagtacaccctccgacagtctcatataaatagattcgtcattaatcaccaaagtccaaaaccaaactaaagcacttgaacttacatctatgctttccacgatagtgagcagttgcagcagcatggcaatggcgtacaagcgaagtgggagagctccaatgcagcagcaccgacgttggaggcgcttgagatagaacggacatgatgcggcgaaactagacctccctgctatgatgcttttgatttgtaggctgctcaagtttgttgtggctgcactatggtaggagaggagagcagagagcatctcagcatgcatgagcaaaagaaaaagacagctgtgacgttcgtatatatagaggaggaaaggagaggtgaatacctagccgggagttgcacagacagtgaaaaatggagctaaatgatgatagtgatgtagttgtttatattgaatggaggaaacgaatcatgatgtggatggggtgcaggtgcttacctgccatcgaagagaagaggaagcaacaatgttctggcaacgagcaggaaggaaaagaaggcaggaatgacttgggcttccggaaacgacgacggtgctggaaacaggacgaccatgacatggcgatgaaactcaacctcgtagtagcagagcagcagtgggaaatagcgtctcgacctgtgcaaacaccaaatggtgaacaaggaggaggaaataatgaagaactagaatgtggtgcatgtgcttactgcgacagaggagtggtggcacgatggtcgcgcaatggtgctttaatgtcccaagacgacgatgggactggaaatggaatggtgacaatgttgcgatgaagctcaccgaacagcggcggctttgatttgtatggcgctcaggattgccaagcgtaagcatgttggtaggagagcgaagtagagaggcgacgacaatagcacatgaaagagcagtggggattcaccaccgatgatgacgttgaggtggtggctgtcttggaaacaagacaacgatgatgtggtttgtgatcaagaccgagaaatggctgcatgatgctcgtgcgatgatggtacaaattcatgagacggtggtgctggcggatggcagctgcagtcagaggagatggaagtggagacgccgacacaggagttgtcgacaccaaggagcagtggcggcttgacggaagatggcactagatctagggaagatgaagccggcctcaaccatggtgctcacaggcagtgggtgaagctcctatggatggcgagatggctcgagctcttggacatagtagaggtggcactctcaacaaggttgcaggagaaaatgatgatcggcctgtgccctctcaggctgcgacggcggtgctggctcaatctccactctccagggtagcgcctcgtgctctccaagcgatgatgagcagtggcagtaacgacatgggcgatggtgtgatcgtcgaacaaaagggagatgaaggaggtgtgtagcaggtatttatagaggagaagaggagagacgaacaaccaggagatggagaggtggcggcagaaattagagaaatggttttggcaaattgaagagcattcaattttttgcattgaagaggagaaattgatggcgaagctagtgatttgtagagaattgtaagaggaggctgcttgagcaggagctcagtgtgcttgacttgtgtgtcaaggtgtagaggtggctggaaaattgaaaaatggatccatctcatcaattttattcagtttttatcatttaaaagagatatattgattagagagaggaagggattaattaatgggagggaggaattggaagagacggcactgcttaatggatgagcatgacgtggtttcttgagggaggaggaaggtgagtagcctggagatgaaaactcacttttttttaagataatggaagttttattaagactctgtcaaatatactaagatgatacattccaactgagcctacccccggcctctgcataaaatgcacacagccaataaaaggataaaattaaaccctcatcacgaaacatagatattagtgactatcaatctgtagactagatcgccacccatgctcctgggtaaaaacatctcgtgccacctggtccaaatgtcgagataccaccgcaatagtatcccgcaatcccggtttgtggaggatagcccaggtacgtagccaccgggtaactagagtaataacctgtaaaggagaagacactaacttgttataaaaaataaccccgtttctgcttaggcaaatggaccaacagagagctgctgcacccatcaaaagcagatttctcatttctttaggaacacataaaagccaacgcccaaacatatgagtaacatttcgaggaggttgaaagttagaggccatatgaataacgaaccataccaaacgagatagatgacattggaagaacaaatgctgaatggtttcatccttatgacaaaagcaacattttttactacctttccaatttcgcttagctaggttatccttggttagaattactccccgacgtaagtatcaaaggaaaacttttacttttaacggtactttaatcttccaaatacgtctattaatattcgggacgcccgtatgaacaagagctatgtaatgtgaattgaccaagaagaccccattgggggtgagattccagtgaaattcatcttgctcttgtgtcaacaccaaatcagctatgcgaggcaataaattatgccaagcagctagttttgctccaattaaatctcgtctccatgaaaagtttggagggtttgtttgaaagatttgtgatattgtcgattgtttatgcctaactatgttatagagacaaggatattgatctctcaacgaggcattacccaactacttatctttccaaaaccttatttgagaaccgtccctaatacgaaaagacccaaaccgaaaaaatcttgtttggccttcataagactagcccaaaaatgtgagtctcctgctttccaataagactgagataaaggttgtgatcctaaatatttattacgtatcaactgttgccacattagcagttaaaaaaattgattcagctcatcaaggtgatttgatttttggtattggtggagaaagaattgatgggggagagaaagtggttagtcaggggaattggaggagaaaacgtctggctaggcacttaagtagagtttgaagaagcagaaatgacgtagccatgcgggggtagacggtggcacatgggaacatgtcggcttggggtggacccaagtgctggacgaggtggagaggagcagtacactaggcttcagcccatgcacggatagagaacgagggagagagacacacacagagaaagagaagcaaggatattaggaggcaacgggcggagccggaaagaaaaggaaaaagaaaggaagatgtgatgaaggaagtaagaaaggatttttctattgagaattaagatttttctaacaaactcaaaatttggagaattttttggatttacgattcttaggatttgggtgaattcatgaaatagagctccacttccaaaactcgaataaaaaccaaataacttcaattaacaaacgataaaataaaaaggtaatgtaattaattaatttagtcaaattaattaattatgtgaatttttgttaagctattttagatgaatataaaatagtgaaagaagtaaagtttcttgcaaagttacagcggccacgtcatcaacaaatcactgtccgtccgatttcccatccacacgatataagccgtcaaatccttatattggtgaaatatctttttggtctttcgagaaacctatttcacaatgaggtcctcctatgtccttatggttttaaagaaaaaaaaaagcatgtgatcccctctctcgtcttctcgtcgtcacaccactgccgcggctcctctcgtcgacgtcccaattcaccacccccggtctgcctcacctcttttcccgcaccgacgcatcctcctcctccctcttccccaccaccagcgcctcccctccctttcccctactatcgcctcttcctgctcaccccgccgcctcctcccatctccacctcctcctcctatagtccccgccactagcgccgctacatcctcttcgcccctactctccaacccaatcccttgtcgccacggttgcttcatctcaatcgcccaactgtcacctcccgcatggttccataatacgaaggcttcggttgtatttgaggaagcagcagcagcagcagcagcagacctccctcactgtgttagctaagtgcccccccccccccacacacacaatgaccgacatcataggtagtcactcacacacagatcaacatcatcaagctaattaacccattgtacatgtagttttgtccaccatcatcacatatttggatgcttcattcagatcttattattatgttttgcatcagcaggcactacatggctgcagaatgcatggtaataagatcatcaacaacggtaatggcagcgggggtagacggagtatgacggagaaataggtgctctatactgatcagcgaacagtgcaaaccatggtgaagtagtaaactttgcagattgctttctgagtttgcccatgaatatagatgtgagtgttggaccactgatttatgaatgaaaaaggcaatcttaactgatctgtaggaactatatgggaagactattccttgcaaattcaacaactaaacacagggctaagtcacactcaattatatataatggatttgtgtgatcaagtaggcagttgaattatttcttgtgatcatttatggtcaattttgcttggacatatgtactagaaactgttcaattagaatcaaagttacaaattcatgcattgcaaagatttgtgttttctatggtatgtgctgaaagaagtctttgcttttcacgcattgtgaaaatgtgaattcattagttcctgaggttgacacagtggattatgttaattagtttgaaagtgtttaactgtcataataattggagttgtgaatcctttgtgactgctctactatcaaatgttgagactagacactgcattgtactaaattcttcgtttgttattccatgatcaacagatgggaggaagcatcaagttgtactggagatttttgagcagctaggagtatttaccttcataaatatgcatattcagaatttctaaactcgtgctctaaagaagcatattttatttggctatcaattatttggtgtattgtattatatatagttaacaaagtttttagccataatgatcatgacaatcatcaaattctattctttcaaaaactgaaacttcctacaacagttgatccactgtttttgtttacacctcttaatgctctttttgctgctataatagataatagaagagattgtggagtagcagatactaaccactccatgagaaatctcaaaattaacttccaatcatatgaactttgaaaaccaaaagcaaggtgttgaacatagtatttgaaccttagttggaaatattgagatttatagttctaatgagtaattgttagccaagttttgtgagtttgcaaaaaaaaaagggcaatatatatatatggaccttttacataggcatccaaagttgtgcaacgcttgactaaatagctagtaaacatgaatgtgaattttcaaaattagacaaatttaagaaagtgacacttggccaataattattacaaagttttagatatctaaaccaatataaaaggaactggttttgaaattgtgcaataactaagggttgatatatctaatcttaaatattgctaccaataatatgggtaggacttgtattttgatatttacccccaaatctctcctaagcatttaacctgtccatttattatcttttctttaaattatcatttcaatattaattctctttcgtatgaattaagtcagattgttcatttccaccttcaagacaagcataccacctacttaatacccacaaatattactcacctaccatgtgacatggaggaggctccgacatgggctactaacgtgtgggcccatgatggtgagccccacctattatggacccatatccctttgattttacgtcagaggagctgcatccatatgacattcagctgaacatcttttcagtcatattaaataaagtagtaaaagccattgatatgtgggcctcacttttctttggactcacatgtcaatgactttaaataccctctacctggcatcgtgttgtcttttcttgatatacgtgtaacacatttacgtatgttgttggtttatttttgtatttttactataagttctatgaacaaaacggcttatcgagaatctatctattatatactaaaagtccattaaactccctataaacgctctcaagctgccacgtggctccctcaaaacgctctcatattgccacgtggcactctaatataatagagaaatctgaccatcgattttcatttaaatcggtggacccattattttacatcgttagatctattttaaaaaccaaaaacctcccaccggccccaccacctctgtgcagtacgcacgtactgctccatctgttagtacttttttttttcgtttgttcctttcttttctttttccaatcctaattaaaattgaac

SEQ ID NO: 43147 - DNA, 14610 bp, Oryza sativa
atatttgtgcttcaagaaataaggccaaacttttcacgaataatcatcaacgatagtcatcatgtactgagcacctctaaaagatgtcttacgagcaggcccccataaatcagaatgcacataatcaagaataccttcagtagtatgtgtagatgtattgaacttcaccctcttatgcttgcaaaagatgcaatgctcacaaaatttgagcttcgtgatgctttgtccatctagcaatcctcgcttgctcaattttgccaaaccaatttcactcatatgcccaagacgcatatgccaaagattagtagcatcggaattagataatgaatcagaaactgtagcaacattacctaatatagttgtacctcgcagatggtacaggttggcagatttaatatcagctttcatcacaacaagagagcctttaattaccttcaaaattccgtctccaccggaatatttgtaccctttgcaatcaagagtacataaagagatgagacttctcttcaaatttggaatatgtcgcacatctgacaatgttctgatacagccatcaaacatcttgatctgaactgttccaatacctgcaacctcacatggtgtatcatcacccatcaaaacagtaccaccttgaacaacttcataagtggcaaaccaatccctattcgggcacatgtgataggtgcatgcagtatcaagaatccactggtcactagtttgtgcacaaccagcataagcaacaagtaattctacatcagacttctcatcagtaacaactgcggctttaccttcctcttctttcttaccttttggtacatattttccggttctcttgtctttgtcctgcagcttccaacactcagagatatcatgtccatctctcttgcagtatttgcatgacttatacctgtctctggattttgatctcccacggtagctacttgagcttttatctcttgattggttctttgtgttcttctcctgttgcatgccccgaacaaccaagccttctgcttgtgaatttgaaccttcagagggtaccatcttcttcatcttttctttggcatgcagagcatcataaacttctttcaaagttagagtatcacggctataaagaatagtatccctgaagtttgcatatgagctaggcaatgaacacaatagaataaggcctaaatcctcttcatcatactttacctcatagactcaaggtcaacaacaatttctttgaaagcggagagatagtccatcatagacccatcatcttgtaacttgtgcaaaaataatttttgcttcaggtgcatcttactggtcagatccttagtcatgcatatctgttccagcttcaaccacagcccagcggctgtctcctccttaagcacctcctgcaaaatattgttagatagatgaagatgaatatatgacatagccttacgatcccttttcttctcatcgttggaccaatcctgtgtcctcttgtcaaatccagaaagcgcatcatcgaggtcttgttgtgcaagaacggctcgcatcttcacttgccaaagtgagaatcttgtgtctcgatccaggagcggtagatcatacttcaaactcgccatgggaattaatcctgaaatttgctagaaagaaattagggtaaacctagcaaaaacgcgaaacctgggtgcacttcctgtgtgcacttcctgtgtgcacaaagcgaagtatgtagatttcctggtacacaagctttggtgcgcttagcaaaaaaaaatcgccaagaaattccttctcaacaggaacgatgtagtccctgacttcctcgggtcgcgtgccctacagttgcagtaggccggccctttttcctcctcacggctgtgcggttgctgcagcttctgcttttctcgcgcgggtgtgtgaggacggcgcgactcggactcgacggggtactgcaccgaacagattgattcggcgacgacgaaagcgaaacaggcggcggcggcggtgtggtgtagattgatctccaatgctctgataccacttgttatgaaaatagatgtataacggagacacgaattttacgtggaaaacccttgcggaaaaaaaccacgggcgctgaccggcaatgatcactgtagagtaaatgattacaaacatagggaaataacaatgggaacgtcaccccttcccgtacggcttacaagagtatatatagaggataatagaaagacacctaataggatatacatgaagtcttactaggaaactaatccgaatatattgtgggcccaaaattcggatcacatatttaacacctcgcgtggtggcgatggcttcctgaggagtgaggacgctacgcgacagtggccaccttcttctggaagctttggaccgcgggataaatgggctgaatttcactatgtgggctgctacgtcaccggtagattcaacatctgacccattcattttttgtattgtgcagccaacacaaacagtaagttgagtctacagttgcagcagcaacggctgcatacagtggctgtaccagccagccgaacaggtccattatcgattggaaatcaggacagaattcccatagcatatatactacgaggtgtctaggtgtataactaattttttgcgtgggtttgaaagtcaaattcgtgagaatcacgtagaatctctatattccaaaagatcccttcatgggtgacgaaatgccaatttactcccttcccttaatattacaagtcattttgtcttttcttaagtcaaaattgttgaaaatttgatcaagtttacataaacatataacgacacttataacactaaattactaaatcagtttataccccgcacatgattagtttaggccacgctgcccaaccacccaaaaaaaacatgattcagcttgagcttaaaaaaaagaagatttggagagagagacaatatattttaaaaaaaatgatatcgcgttggggattgaagacgggacctcgggcttaaaataacacaccccttaccacttcaaatgctaatacagtctccgatcaaatatacattggtgccaaccgtgcacaaatcatttgaacgaagccttttgattcatacataagaatctgaaccttgaggtgccccgtaagctgatctaaaatagcaccctggcatctgttgcaacacgattttcagaaaaacctcagaaaattttgaaccctgattgtcgacaacattcagttatgtcacttcaaatgctgttttatactcgttccgtttctaaatatttgatgccgttgatttttttaaatatgtttgaccgttcgtcttatgcaaaaaaaatttaagtaattattaattttttttcctatcatttgattcattgttaaatatacttatatgtatacatatagttttacatattttacaaaagtttttgaataagatgaaaatatcaaacgtgctaaaaagtcaacggtgtcaaatatttagaaacggagcgagtatatattttgaaccaaatcgtcaaacgtgaaaagtgctcctgctagtacccagtattaattgcaacatccttcaaaactctaggatacattgacagcatttgaagatcaaggaaaaaaagagacgcaaacatttctagcaaggcatattcacagctctctttcatcatgctaaatcagcctgtcattcaaaaataccaaaatgctaaatcagtgtcagcctgtcaccaaattatagtgttcaactcaaaaaaccgtccactgatacagtgaaattctatgcattctgccaacagaaggaaaagtagcagctgtatgtacaacagccacatctagaatgtaacagatcaaagttcaaaagctatgcttccataacagaaaggtggacatggcaaggacaagaggtacaacactctgtaattcctcaagaaggaaaacaagcagctggttgcacaagaacagcctcatctagaatctaaacagtagcaagttccgaagtatttcttccataatgcgaaggcagcatcaaaaaggacaggatgtctaacttacgatccgtcttgtgtcacttttgctgtcaacaaaagttggggtgaagccttttggcactcgattaactctttgcatttattttcaaaccattcgctctttccatcatcatcaaacataaaagtgacagcaaatgtttgaagagagcctgctttggacagtaaaaacttcataaagcacatttgattttcgcggtgcttggcaccagtcagggacacatgtttgaggcttgcaaacaagtcactgcttatctctgaatttagggagtcttcatcaatcttttctttatccaattctgtatcaagagtctacaaaacaaggccaagtttcaattaactcaattgaccaagagatgtctttaaattgaacatagcagttgaaggtgtgaatctaacattacctgaatttcaaggtgctcaatatgcggagcaaacttcagtaaagaatctattgatagaacacttgagagttggccaaaatctatgttcaggctggcttccctcagattctcaaacttgcatgtaattccctccagcatattaatgctgaactgaaagtcataagaacattgttaggcctgacatatgtccatgacgcaagtttacattgagccactaaccaaagaaatatgcaaatattaggacaccatgatcttgtagttacgaaggttcttcttggaccttcattttcagaacctaagaagccatattgtcataaatgttggcatttgcatcagagtacatgtgtttaaatcacatctgccaaaacacgacataccatctctacaagctaactagtttcacattcatcaattcagtcaaattgtaattaagttgctcgcaatgaccaatctattatctatctatctattatatactaaaagtccattaaactccctataaacgctctcaagctgccacgtggctccctcaaaacgctctcatattgccacgtggcactctaatataatagagaaatctgaccatcgattttcatttaaatcggtggacccattattttacatcgttagatctattttaaaaaccaaaaacctcccaccggccccaccacctctgtgcagtacgcacgtactgctccatctgtttagtactttttttttcgtttgttcctttcttttctttttccaatcctaattaaaattgaacctatctttatagaaaagaatacccccacaaatagacatcaaatgcgttaaaatccattaaatatcatataaatgtttctaaccgttgtgtgccactcttaaattagagaaacgtccaaccattggttttcactagaatcgatggacacattattttacgtcgttattagatctgtatattaactaaaagtccataaaactttctatgaacactcctaagtcgccacgtggcatcctagaaacgctcttaagccgccacatgccactccaatatataaccgttgatttcattatatttgatggacccattatttacaaccattaaatttatcttatagaaaaagttaaccacccaaacctaaccccacccagcgtacgtacttatatctcatatacaactacctactatatatgaaaataataataatatacctcatgtattattattattattacaccaccctcttcctagattaactcttccttctcatattttttacgctttattagttagaaagaaaaatcttctattatatactaaaagttcattaaacttcctacgaacgctcctaaattaccatgtggcatcctacaaaacgtttctaaaccgctacgtggcgttctaataaatcggtggatccgctatttgtttaataaattgctagactcactattttcaactattatatttatctttataaaaaaaatatcccacaacccaccccttctctcctcagtacgtatgtatgtacgtaatacaatgccatgctttctcccctcttccaatccttctcttcctatttctagatgaaaattttaacatgaaaaaatattataataaaacatctaacctttgcttttcacttaaatcgatcggtgaaccaactattttaaccattgtccctaaaaaaatattttaacgattatttaaaccggtgaacccattaatctatatataaaagaaacacttccctaaattttaccatagaacattgtgctttgcatgaaaaccaaatataaacaaacattaaaaccattagatttaggtatatagatggtttaaaccggtgaacctatcaaatctatatataagaaaaacgctttcctaactttgaatatatactatttttctttgcaatgcaaccaaataaaaacaaaatattaaaaatggaaatatatattatggagtaaatttcacaaacccacgtagatatatctatctattatataaaagtccattaaacatcctaaaaagctcctaaactgccacgtgagattccaagaaacagtgcaaagatgacacctaacgctctaattaattcctagaaaatctatggaaaaaggagaacatctaaccattggttttatttaatctgatggacctaatattttttttaccatcagataccattagatttatctttagtaaaaaacttaagatcaatctggcggtacgagtccgcccaacacatatacatgcttccatccatacgcatgataagagtctgtgtgattttttccttgctcgcctcccttttttcgatggtaattaagttaaggcttaagggtatataatatcttctatattagtaagttaattttatcatactttcaaagattgcatacacttgcaaatataggtatagataatatatctcatacatattgatcttggtatgttttataaataaataaagaatcttcaatagctgtaaatcttaaattatatattcaatttatgatctgtttgaaccattgtgtttttttaattaaatcaatagtttaatatctataccaaccatatttaattccattgtgtttttttaattaaatcaatagtttaatatctataccaaccatatttaattgctaataaaattattatattttggacccacatccatacgcaaaaaatcctaaaagttctcattacaaatcaaaatatccaacttagttttttaataaaatcaaaataacttataaaccgctaaccttaaccttaattatagcatcaatggacctattgactcacaaccaacttaattatatctctcgacatatatgtggatgctatttacttaattccaatgccctgataaaatatatgatcttcttttaaggataaatgtacgatcttatgctgtgttcggtgctgagggttgggaaaccttaatcctttggaagttggacattaacttatatcccaaaatacctatatcacgttgcttaaatccaactaatacaccaagaaaagaagaagaacagagggtgtctacagatcagtccttatggatattttactaataaaaattgatttcaaatacttatttgtacttattaaattatctaatcactagaacaaaggaacataccgtccatggagtgaacaaattggagggctaaccggtgcatcccggtgtgcatgcatgggtatagaactttttttctttaatgaaaagaggggcatgaggtagttacatgtatatacatgaagggcacttttttttcttctaagtatgatgatgtgagcatgctgccggagacacgaattaacatgtctaccatccatggtgagggaagacgaataatttgcttagttggactctacacaatatgttagatcttctacatatccaatggttacaaataatggtctaaactcgagggtcatatattatgtttaataaattaattaccaatttttctatataaatcagtagagccattaattatatatggtttgtgtatgtaatgtcttttataacttaagttttttctctttcactatggaatcacaatttcctatgaggaattatccatagctatgaccaatcaatgtttgccgtcaaataataaattaattatcatttttttctaaaaaatgggtagagccattaattatatatggttgtatatgtaatgtcttttataacttaagttttctctctttccctgtggaacctcaagagtcatatatatcttaggtaccattttttataccgtaagataccaatcctaatctccaatagataattttataaataacaattaaattcgtcatgcaattctaacgaagaaaattcatgggaaaaaaacataattttaaaacattgcagatattaattcgctggtataccgcctttataagtttctcaaatttatcctacgtacggtgcatgcccgcgcgtatgcgcgggctaccttcctagttacttttaaaactattaacaagagataggtatattttccccaatgatttctagttccaactcagagactacttaactgactgaaacatcttagtagccacaggaaaagaaagttcggaacaaaaaatacagactaccaaaggggttgagccatgttcttctgtagcgatgcatgcaaaatgaacaggcctaaagatgagtttgtgtaaagcatgaggatgtgtgccaactacacctaaaccactcaatcaccttacaggtcgttttatcacaaacaagtaagcgcatctctactatttatttgtaaatattttaattcttgtaatattttgtgcacacagtttctctaccgtctctcaatgagctctgtctcaactctcaaacaaaattaaaaggtggggcccaaaagttccgagggaatgagctttcgaataaaggagctgtcttgaaataccaggaaataatcaaggccattgtgccccactgctccatcactaagtggaatatcatgaggtagggagggagataaagagctagtggctatactgtgtgaaggaggttgggttggggaatggtaaacaagggaaaatattcctacaaattggagaatgctaacaacagaaaatatccctacacacacaatataggagatcttgggtttgtgttgcatggtggtattcggttgaacacatatgatgctgtatttattggttagttgttattacttcctggttttgttgaacttgatgaagctttgagatttcaaacttttatattattgagaaatttccttgtgcacccaaaaaattttgatcaaactctttcatatatatcctttggtctcaatctctttcatatccttcggtttttgtctcattccctagtagtccttatatttttatcctctacacaataattctattatgtgattgtgtattgaccatttgtttcagaaataaccatattcccttcacttgtttttttttctttttggactggattacccttgatttgtaaatgtcagtgctagcttatacagttaaatcataatcctcatgatgaaatagaatcacttatgaaataatttacaggaaataataatttgaataaatttcactcaaatttgaataaattttaatatttttacctcaaatttgaataaattttaattttttagtcaaattcataaaaaaaatggatatatattgaaggagggtggtgaaattactaaaaaaattagggtaattattaaatttaagctgaaatacaaataatttactcccttcaaatatgactaaaattttgtgattctaatttacaaatttggtgaaaatttaaaaatttaatgatttagtttattttccctccttgaaaatgatatagctaaaacattttcttgtgagggatttatttttagtgcggaggcatattgattattgttatgagtgatggcaatatagtcatttcataaaaatattacgatcaactcaataacaacataaccgaacaattatatgaggaataaaattgaaaaatatgggtcatgaggcacgtaggtatcggggcaaaactcattggtatagaaggaatcgagcgaaatcttgagagcatatagtgaaatttagcatgtagtaagaactcttatgtggactatttgggacccaacttatggcaattaatttcaactgacgggcaaaataggaatttatttgtccgtattatgtgtgttacggaaggtctcggaccaaccatagcatgcgtcagtgtgatttgttcatacaaatagcaccgtggttttgtctacaatagaaggttccttgcgaagtggctaacatgatgacaacctattgcaccatcatctatggacatgggtccacagttcggcccgaaatggaaggtttcgggcttgggtggcaaacaaggcaccatagcatatggtgtcttaccacatagcccctagcatttcttaccacatagcccctagcatttctagacatggtgtcgtggatctgctaggaaaacaaggttccttgcatgggtagaaaccaagtgttgttgtttctgctgagtatgataggctccgcaccatatataggatatggtgttgcacgtagcaccgttgaatccaacactgttagcaatggagtcatgctttcgtaattccttgaaagcatcatggaattacaaaggggcaatccttctttgccatttggaatttcatgcgatcatttatttgccccgatgtctcactaacacgtggcccttggaccaacatgacattattgattaagtacatgcatagagacatatagtgcgagcaaatacatcagccatgtaccatatgacaccacaagtattattactaataccgagcatataaaacacatcacaagtgtcaatacaaatttcgatgtgtacaacacaaagttgacacatgatttcttcatcattagcctctttcccctccgcaaggaatttgtaccaaggatacatcacttggttgatcatgattgttgtgcaaggaggaagatgtatatattcacatcacttggttgatcatgattcgctaaagcatagtatatattcacatttcaagttcatgcaacaacatgtaccttctacggatccattcaatatgaaattacaattgttaatcctactaatactttgaatacggcatactgctaattaattaagtcactgccacctcaaattcaagccgatactaaaccagggactcgagatctctcattacgggatgaggaaggaaaggggagatatggactctgcaggatgcagtacctttttaagtcccctctaatatatatgttgctagggatcacgtgatcacactatatatagaacaaaacggtaaaggttgtcgtggtaacttgattcacgttgtctgtgaccacctccacattaagggctcattcggatcacgggatagaaaaaacgtaggataggaaaagtataataaaggaatccaaatgtaaaatagagggttggaaatcaaaggaatatagaagatgggatcattgggagtagaggatgggattcataggaaaggaacagtaattaatccaactccgtttttcccacactcttttgtttcccgttgattcttcacgagccgaggagcagcagccctccatcccgtcgccatcgcctccgtgtgcaggcagccctccatcccccaactccatgccattggccgtgcggcccgtcttaattcttccccagcctggcctcctccaggaccacttcgtgctctaccccttctcttcgactccgacaccgagctcgctggctgccgcgccatcactgaccttctcatgcggtattcgctccacgccggacgccaccctcgatacccatcgcgtcggcctccgttcgccattgacctccgctcgcaacctccacgccaacgacctggcctctcctccatgctcatcgttctcctatgagatgtgcttctttgtttctttgttcttcactgatggcatcagttattagtgtttgattgtctcctttggatgcgaaggaaacgggaaaatgaggttggagtggatgatttctttcatgtgttttcccatggaatgaggaaacgcgaagcaacaatttttttgcatcgaattcaagcaacacttaaagtagtaactgatggaaaatttctataaactatggtgaagagatcagtttaatgtatcttgttttgtcttgccagcgagtttacagtccagttaaagaaaaatgtttcctagagatccgtttgcaaatattcgaattgaaataatttcactctcctgcgcaaggcctcatttatttatttatttattgccggaacagggcctcgtttgttgatcaatattgcatttaatcaattaataaactctcttattcattagtacctatgtttttgtatcatatgttgctttgacttttattctaatcaaactctttaggtttgatcaagtttatataaacatttagcaacatctataacaccaaattagtttcattaactataacattgaatatattttgataatatgtttgttttgtgttggaaatatttctttcctttttttataaatttggtcaaacttaaaaaagtttgacaaaaataagttaaaatggcttatattatgaaacagaggaagttataagtttatctgattgaggagtagttttttttagagcgagtggttttctctttattatctcccaatacacaataaatgatttctggtttattcataggtttgaaaacatgtacctaaaaatattcaaaaattgaactattaaccaactaaaattagctaattagtacttgattaacattagataaactggtctatggattaattcaagtaatgttaaaattggtgtaaattatggtggagaggaccagtttaatgcgtcatatttgtttttgcaagaatccaaattgaaataggcctcatttatttacttatttattttggcctgaacaaggcctcatttattgttcaattttttgtatttaataaattagattaataaactcttctccattaacaaatctctacaaagatcctcctcatcatctccaatatacatagtccaaaaactactactaaatcatactccttccggttctataataattaacgttttagaacaaggttgaggtcaaacttttataactttgatcatcaataacattaaaaatatttagtttaaagaaactagaacagcatatgtagatttgtctttcaaagcactataataaaagttaaaatgtatttatttattgtatatattataatagaaaataaggtcaaaagtatattttgtagaccgtgtcattgtctgaaatgtcaattaaaatgaaatcggagggagtagaaacttattaatcggagtaaaatgattccaattgattcaccaatttaaaattaagtgttgcacctaaaaattctcccaaatcaaactatgtgtttttttatggttaacacactcctcaaaccggagatttaaaacctcgttaattgcacgattaaaatcgatcaaacagattcatggaataattcaagcaaagctaataaataacttatgaaacatttcgtgtaaattattggtgaagaggatgatcatgcgtacgtacctccctgtctctgacagagaacttgagcaccttcacacgcgaaaccagccagagagtgtcgagaaaatcttcagttccgaggaaggcgtcgacggagatgttcgccgcgttcagcagcgggagctcgccggcgacgcggcagccgttgtcgacggccggcgtccagagcgtcagcgagtggagcttgggcgcccggatcgcccacgcctccggctcctcctcctccaccttcttctcgcccccggcgacgacgccggtgatcacgtccaccaggagcaggtcggcgaggtcgggcgcgccggcgatcacgcgctcgagcagcgcgccggcgccggcgaacgggagcttgacgctgttgagcgccagcctggtgaggcgcgggaacccggcgaacaacgacccctggcccggctgcggcggcggcgggcgcgggagctcgcagtagcggaggtagaggttggagagctcggcgcgggcgtagatggcgcggccgacgccggggaagacgccgggctcgtcggcgcgggaggagccgaaggcgagctggagcgagcggacgcgcttctccgccagcgcgcggagccagtaggcggcgcgcgggcggagccgcgggcggacctcgatgtcgaagctcgccacgggcgcggcgcaccgggcgagcacgccggcaacggcgccggcggagtagaacccgcggaaccggacgtcgaggcccgacgccgactcccaccgccgcgcccacccgcgcgacaggcagcacgtgcggaccacctccttcagcggcagccgcgtcaggatgtcgtccaggatctccggcagcagggacagcagaatgtccgtcccggcgacgtccgacgccgccgccggcggtggcagcggcggcgacggcggcgaggaggatgacatcgacatggccatctctagtgacgcgggtgcgagtgtgctgcgagtgacccccaccgcctacttgtattgtatctgcaccgaatgaactgcaccttttgcgtttacgtcctttgataaaagaagtattcagtttcacgccgtttagggggctat

SEQ ID NO: 43148 - DNA, 10782 bp, Oryza sativa
  unsure (1)..(10782): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcttgattttacccctggtcgattggttggaaggcaactcccatagccattctatcagccgaatgtatgagtcaatatggaaatacttatgttacatgtacttaatgaaccgcggttcaactggccggttcacattcggaccgtcagatcggtgaaccaggaggggtgaccgggtcatctaccggtccgggtttttccactatgagcgtgggtacgggaggttgggacaggcgacgtgatggtcggtgtccactggtcgcacgaatcccgtgcgagaacgactcggagatgagggcgggtgcggtgtgttgaacgagattgaccactgcgtcggctctttgtcgtctagcgcgcaacacatgggaggcggtgcgtgatgcgttggcaaccgagcctcgtacgtccatcgcgtcacggcactgttgtgcgcaggcctatgtcatatggcacgacatgcggggagaacaagggaggggcacggcgcgcggagctaggggtagtgacggctcggcgatacggctacgtttagggcgcggctcggcattttctgacggtgtcgaggtgcagtggatggggcggactctagcggcgagctcgctggcgatatgatggcaatgggctccatctggtacggcgacagtagcgagcgatagcgtcagggcttcggagggagagaggaatgagccgcggtgtcggctcggcttggtcgctagctaggtaagaggggcagtgctggtaggctgcgccggcctgggctgggcaaggtagggaagaaataaagagacgaggaaaaggaagtgttaagggaccaaacttttaagaaaaggcacattttgctataggacattgcaacttcgtggttttagctgtagaacaccgtgtgaagtgacttttggggaagacactctcaaatgttggatatttgctggtggacaccgcgctcattaaaaataataatttctggttgaataggagagagaaatcgcgtgaaatgtgaaaaatatccttgggcccaatgtcagctctcctatctctcttcttttctctctatattcctccttccagcgtcgcgcacgcctccacgactcgcacgcctccacgacatccaccgcttctccctcgcgggcttccacaggctttgcgtcgcccgcgccggaggtgcgacgagagtcgtagccgaacacactccgcacagcgtcgncgcgagccatcgtgccccgcctcgcctcgcagtgcgacactggacggaggaagatagagagagaaaagaagagagatatgagagtaggcccatgggtatttttgatatttcacgcgatttctctctccttttcaaccaaaaattataattttaatgagtgcggtgtccaccagcaaatatcaaacatttgagagtgtcttcccccaaaagtcacctcacgtggtatgctacagctaaaaccacgaagtcgtgatgtcctgtaactaaatttgccttaagaaaactgctaggctaggcccactagggagcaaagttagactttagctttaaaaacgtgaaattgattttctcaaataattttagtttacaaaggtttaaattaatatgttcatttatttgtaaaataattccttaaatgatattaattcatagaaatggctcttagtaaagtaattaatatttgcttttatttgcaaaatactttcttaaatggtattaatttataatctggctctttaaaaaaatattatttgaattccataaatagatttagaatttgaaatttaatttcttatttgattcaatttggcattggcataacatgaaaaaaaaatccaaagaataccagcactatggactttcaaatttttttattattccaaatttttgtttccatattttaaatcaaaaatgttcaaggtgttagagatattcatcttgtattcacaatatatttagattgcatcttctactcgtttgcttgtgtacttaatttgtttgcaacagatagctttattggggaggtcaatcgcgttttggcttggttgataacggataagtggtgtagtgattgggagaggtttgatcaatctggttggagcctttggattatcaacatcagtctccaaaatcgaccaatccaatacctattgtaagattaggacctaattcctcgtcataaagtatacttgcgtcgttacgcatgttagccgcggcctgtggtgcggcgcaccaacgcaataatgcaaaaatagctcaagagtctgctctctctttacaaaatgcgtacacagtcagtcctattaacatacaccctacatcaataagcaaatattcaactttcaacgagacatatttttttttaatatttgatatgttgatttttttcaggtgtttgaccattcaccttatttaaaaattacacaattaccttttattttatagtgacttgtttaatcattaaatatattatgagcatgacttatatttttgctttaaattttgaataagaaaaatcaatggcgtcaaacgttagaatcaggagggagcatattttattgtggcttttgatatctacatagaagtatgaaccttgagcatatatatatctcaacccatagacgtttcctgttgccacacgatctcaaaaaagctcaccatatttgtaaactacggacggtgacaacatgaaaaatgctcctgttagtatatactactagaaaaagtatttttcccggcgtaggggtcttttttcgcaggtggacatgacccttagaaccaaataaccatctacaaaaatataaatcagggtgaagttcgctctccgcctgcgagacgaatcttatgtggtcagcctacaaaaatcgtacctagcaaaaaaaaaaaatctttactccttatctcctcctcccaccctctccccatcactcatttctctatctccctcaacacttctcctcccggcctcccctccacacctctcctctcaccggcctctcccctcccctcacctctcctgctctccccggccgccggccggaggcggcggcggctaccggcggtggcggcgtgtgctcccagtggcagcggctgcgggcggtggcggtggagggcggcagcggcaaggagggttgaggcggcgcggctcccggcccctccctcccagatctggccggaggagggcggggggagagcagtggccggcgggccggcccctccctcccaaatctggccggaggggggcgggagagggcggtagccggcggagctcccctccctctatcgtcagacatggcggcggcggcggcgaggagggttgaggtgcggcggcggcagcggcggatgacggcagggcgcggcagcgggcgaaggccccagcccctctctccctcctggcggcgatggggcggacgacggcggggcgcggccgtgaggcgacggtggcggacgatggctcccggcccctccctccctcccgttgatgtgagagtttttgctgatgaagatggatgagctatatgtataaagtgattttaggaatgattttacatgtgattttgttttctttctttgcttgaattgattcttgtgaaactgaaatatggctggtgcatgtgaaactgaattttggatgaactggtgacttctctgttgcttctctgttggatttggattcactggattagatggggaatgggtaggaactgtattaggaacggatagggaatgggtgggaactgtattaggaacgggaagctaccaccagaaacggcaatagctgcccatatttttttagcgttggaagctatttttgcaggcggatcagttacacgtctgcgaaaatcaaatatttttacagtcgttaagttgcaggccgcttgcccgcctgcgaaatggtgattggcccgcctggaaaaacactttttccagtagtgctcctgttagcatctagcatcgcagcatcttttatactctagaacattgacaacagatatatccattaataagactctatagctaggttaacatgacaaggtaaaaagagagaaatttgtagcctgcatatccacaactcccttgatcgagtatcgtaccaaatcagcctgccattcaaaaataccaccacatgctatatcagtgtaaacatctagaaaatcgtagtgtcccacaaacaaagtctgatactccatcgactagcttctttatgtacaactctctgccttctcgagaaggaaaacaagcagctggttgcacaagaacagcctcatctagaatctagacagtatagcaagttccgaagtatttcttccataatacgaaggcagcatcaacagcaggatgtgtctgacttatcagtagtctattatcagttttgatgtcaacacaacttgggagtgaagccttttggcactccattaattctccccatgcatttccataccattcgttgctttcatcgtcacagacgaaagtgacatcaaatgtttgaagagatcttgctttggatagtaaatgcttcataaagcacatttgatttgagttgtccttcaccttgacttcagtcagggaaacatatttgaggcttgcaaacaagtagctgcttatctcagaattcaggaagtattcataaatctcatcttcagaactcagggagtcttcatcaatctcatcttctgaattcagggggtcttcgtcaatctcatcttcggaattcagagggtcttcatcaatctcatcttcatcccattctgaataagcaatctacaaaacaagggtaaaattttaattaactcacttgaccaagagatgtctttaaattgtaacatatcagttgaaggtgtgaatctaatattaccgaaatgcaaaggtgttcaatgtgcggagcaaacttcagtaaagaagctaacgatagaacatttgagcgttggccaaaatctatggtcaggcgggcttcccttatgttctcaaacttgcaagtaattccctccagcatattaatgttgaactgaaaatcataagaacatagttaggcctgacatatgtccatggtgcaagtttgcatcgacctactaatctaagcaaacattcaaatattacaccatgatcctgtagttagaaaggttcttgaagcttcattttcagaacctaagagccatattgtcagcaatgttgggatttgtataggagtacatgtcttcaattcacatttgccaaaacacgacataccatctctacaatctccgagtttcacattgaccaattcagtcaaactgtaattaagttgtcaaaatactactttctatccaaaaacaagttagatcatcccaacagccttactctgagcaatcaaggtgaactagaagcagtaaaagaattgtcctccgacaactatcacaaccaaaatttaggagagagatcagtccttctcagaaaatgatgatgaatacaccttttgttctgagaaggagtattcatcatcatcaaggccatgacgcaaggtacttcacgccagtctgaaaatagtcagttcagggaaatgactcgtgagctactatagcagtcaggtgcggatccaagaacaaaaaattaggggggctcaattacacaatttcttcaacctacagcaatctagagatctttagtttatcattcatggtgaaaaaattgaaggggtgctccagggggtattcatgagtcttgtgggtgtagggggcacacgagtcccccctgcacccacgttggatccgcccctgatagcagttgcagtgttactgtgttagtgagtgaaactcagtggaaatgcagaacatactacatatatacaagacataaatgagatcagcagtgcccccaatcaagtctgcaaattacctgtgtaaatgaggtaactaaaattcataaatgtggatgaacatgtacatgggattcacaagcagacaatgaggcaagcaaagataggcgtgtaatgaaaattgggatccaacgaggtattcaaatggtttgacgtcgtaacttatcactgatgaaacagagcttattgacagtagaaatattctggaaagcatcgaggaagtcttgggttccgaagaggcgatcgaatgagatggtcgcctcctccagcatggggagcggcattggtattcggcagccgttgtcgtcacccatcgccatggtgatgaagagttcccggagtttgggcgctctgatggcccacgtgtccacgccgccgccggtggtggtgatcacgagtgacaacttgagcacggcgagtttctccgccgcgacgatgaggtgttcgagctgcgtgccggcaccggcgaacgggagggtgacatacacgaggtcgaggcgctcgaggttggggaagcccggaaagcccggcggcgccgccggcatgtcgcattgctcgaggtcgaggcggacgagtgcggcgcaggagaagagggcgggtccgggaaggcggcacggcttacggcctaacgagaactccaggctgagatcctggacgcccttccgcgccatggcgcggagccagcgggcggctcggaagacgtcgcggcgggcgacgcgggcgcggaagccgcggacgggccgcgcgcaccgccacagggcgcggccgccgccggagtaggcacggggcagctcgatctcgaggttcttgatcgactcccagcggcggcgctacgcgcgggagaggcaggaggtgcggaccagcttgtggaaggggagcagcacgaggatgcggtcgtcgaggatgtccgacgggagcgccatcagcatgtccgtcctgggcggcggcggcggcggtggcgcctgggccggcagtcgctggcgcttgggggaggacggggaggaggaggagcccgaggtcgccattgttttggaggtggaggtggaggtggaggtggcttgctgacgacgctatgatccaacggccttcttcttgaaccttccccaagatattttatagggtcagccaacgagttggaggataaaatcgagctagccatgtttagttaccaaaaacttttcacaaaaatatcacatcgaatctttaaacacatatataaagtattaaatatagataaaacgagaaactaattgcacagtctacaaatcttttgagtctaattagtccataattagctataagtgctacagtaacctacatgtgctaatgacagcttaattaggcttaaaagattcgtctcgcagtttccaagcgagttatgaaattagtttttttcattcgtgttcgaaaaccccttccgacatctggtcaaacgtccgatgtgacacaagaaattttcatttcaccaactaaataggccctatgttgtgttttactattgcgttttacttcccacgaaaggaagctacgaaatgtgaatgtaccccgctgaaatggttctcttcttttcctttgattatgtaagtgtagctatttgcgatgtgagtgtagctcaactgattagaatacttgtggtggaatcaacccacccaagttcaagtcctatactttacacgggtgctcacattatggctaatattcttttggtggtagacgatatgacacgggtgctagctcacatttatggctaatattctttatgaggtgtctgtgatgattacgggcagatcgagcgcacggcgtggtgcttgcttgccgacgtcgacgctgtggcggcggagcgagacggtgatgtgggcgctgtcgtagagcacaaagagaccgcgcacggctgcacacaaatcaccatttcggacttgcctccctactgcctcgggaggtcttggtatcctgaatcttgaaaagttcgcaagggctatttgattgcgatggctcttgcacgaatagaagtcgccggaaaaggctttggtggggtcagaaacaccttgtaatgaaactgacaagctactgtttgcagtggcaacaacaatacaaattggagatggagcgaaagtgaagttctaggagttggcttggcttcaagggagaagattgaaggatgtcgcaccactagtccacgcgacctctaggaaaaagagcaggaccctcaaacatgccgctttagcagatcaatggctgcacgaccttgctctaccaacaaacgaaggatggacaatggatctgattgaccagctcatcaccgtttggagtgccgttcggaatgtacacttcatggaacatgaagaccagatcacctggaagctcaacaaccatggcgaatacacggccacctcagcctataaggcgcagctcctaggtacaacaacatcgtcgaattttgacacattgatatggaggccttgggcaccgcgcaagtgcaagacctttgcctggctgaaactccaaaacatagtgtggacattagacagactagcaaccagaggctggcccaacggatccacatgccttttatgtcgccagactcaagagacagctctccacctgctagcggaatgtagatacacaagaagaatccagaatgaaatcgtgcaatggacaggcaatgaccatctaagaccttctagctggcaaatatctttgacggtacatgagtggtgggaggccaccgtaagcatacgggaaacacctaagaaggcactacgcacgttaaccttgcttgttaattgggagatatggaacgaaaggaactggaggactttccagcataaagagttgccggcgccaactctgctagccaagataaaggaggaagcaaaaacatggggttggtgggcacagaaaatctcaccacttagttgacaacgtaactacctataattggtttttgtttttttttcgtacattatcctttcttacagttttcgtctcctctatccaatgaaattgggggcctcattgattcgttaaaaaaatggaggacttgattagttggttaggattaagtacatcacgggaaggatcgagaataaaggaggcgatcgatggactgatctggagacgacggtgaggggcgaagaagcggaggtagacgaggtaggcgacgatgatatcgaggggaaggccgacgacgaagccgaggaggtttcacgcccagaaattcccgaatagaattccaagcagaatgtgcattaaaacccccgtccaggaccggccagggtacacaaacgacaaagttgacatacagatccacgtcttacaaacatcataaaagtcttacataaatgcagcggaaaattaaaagataactggagctaagccttgacttggactgcagtgggaacaccactccacaggaatcctcgatggcacggacgaagcctactcctcggagaacccaccatctgacacgtactcaaactctgggggttttggggaaaatagagtaagactgagtacaactaccgtactcagcaagtcataccggaatagagggtatgatgtagggtataatcaaagaatagctagagcggttcatttgcataaagcgagcatttaaagacggtagttgaaagcagtaaaacagttgtaataattactcaatattaaccatccactgtccagcgctacaccacgttgtaacaggcccaaccatccacctgaactaatcaattccattagactagactagggtgagactaatcacagtgaatctggttgaccgcccataaccgcgggtacggctattcgaatagttttactctgatcagaggtgtacaactgtacccacaagacacagccccacgacacgtttccgtgcgccgacatgccaccacgacataccggaaagaggccgtgacaggacccttcgcataaccacctctagccaagcacaccacacctcaggtttcacccccgtccccagcgggcaacgggcagtcccctctcgtgcctaggtgaatccggaagcgacagaggccgtcaaagggcccgccccacttcatcacgcccacccttgcctggatgcgtcaactagaggaaaactacactacaagcccagccgttgcccacgctggcttgtggtaagtacgaggaattcttccagggtttcccgcgaaccggtccttaagtgccatgggcgcgaccatcacaaccatgcacccatatcccaccatatggtatattttaattgactaacaccagaacggtggctttaatccaacaccaacactagaacctgaagtctatgcattaatgtgatttcccccatggtgcgctagttgaactaagcatggccaagcaatccctagtccaatctctagtcatgttatatcctaggctaacaaaggagcatggtacaaaagtagcatggctgtaacagtaggtaaacatcccatagtatcattataaagcaatgcagtatttaagggaaaacggtagagcatttgtaatataggatcaacatgttcaagtgacaagcatgacttgccttgctctgctgctggaggaacctcggcgactatttcaaagtacaccagagcgttgggagagccggaatctaagtgacatataaagaaaacaatacaaacaggctataagactactgaaacagataacaaaaccatttttaatggattctatgcatttttctt

SEQ ID NO: 43149 - DNA, 4638 bp, Oryza sativa
aggtgggccccacctgtcggcgacctcgggagagaggaggggggctcgggcggccggctgggccgttgtcccgcccagaaattctcgaaccagaatttctaagctgaatgtgcattaaatccctgtccaggaccagccagggtacacaaacgacaattgttgacataccgacccacgtcttacaaaaaaaaataaaagattacaaatgcagcgggaaagattaaagcgagctaaaccgggaagcttgacttcagcagcgggcgactacactccacaggcaaaccttgacggcagcaacgacaccaacctctctgagacggctccaactgagaagaacttcaactctggggtgggggaaaagagagcaagactgagtactacccactgtacttagcaagtcatatcggaagaggagatatgatgcaggatataaccaaaggaagctaggggttcttttgcataaagcaggcatttcaaagcagtagttgaaagcagtaaaacagctgtagtaattaatcaatattaaccaatcactgtccaacgctacaccacgttgcaacaggcccaaccaaccacctgaactacactagttcattaagctaaactagggatgagactaatcacggtgaatctggttgatcgcccataaccgcgggcacggctattcgaatagttttactctggccagaggtgtacaactgtacccacaagacatgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccgaacacctcggccgacccaactccatcacgcccaccctcgccaccggtgcctaggaaagggtcgagctatacttcagatcaagcagttacccactcccgcttgtggtgagcacggtaagtctcccagggtttcccgtgaaccggtccttaactgccatgggtgcgaccagcaaaaccatgcactcacagcccgccattcagaatattttaattaactgacacccttgcggtggcaccaatcttaagctatgccaatagtcagagtctacgtaataatgtgatccccatttgtgtactagttgaactaagcatggctaagcatttcctaagccaacatctagtcattttgatacccaagttatcaatggcataaggtaaccaatatgtggctgaggaataggacccatcccacattacattgtaaaagaatgcaacatttaatagaaatgcgggatatttgtaaattgggtacaatatgatcaaacgtattgcatgacttgccttcctctcgaactgatgagacctcagcaacgtcttcgagaaaccgcggatcgacgaaacggccgaaacctacgcgacaaacaaagcacacaagcaaaacatgctataagactactgaaacaggaaacaaaaccatttttaatggattctttgcatttttcttgatttactgagacttggatggacttaaacggagctcggatgaattacttatgaattttagaagataaactgtgtttttactaataaagaaaaagtccttaattaattattgcgcaataatacccaggactgacgtcagcgaaggggggggggcggcgccgacaggcggggcccacgggtcagcggctcaaaggggagaggaagggggtgccggcaagcggggcccgcatgtcagcggctcaaggcggccggtccacgggaccaagggtctggatcggcccaagccgatcggacggtgcagggagcagccaccgggctcggcctcggcttcaagccggccggcaagcatggcgaacggcggcggcatgcggtcgccggcgacggcaaccggcggcgtgggaggcggcggcgggcggcgcgaaaagcggcggcagcggccgaaggcgacggcgcacgcgcgaaggacggcggcgcacacgggagagagggaaaaaggggagcagaggggagcctcaccggcgagcacggcgaccagagcggaggatgaaaggcggcggtgacccggcgacgaggaggggcggacgggcggaggcgacacctataggaaaggaggagagggattaggggtggagaggacgaccgcaacgaccaaagtggccggccggagatggatgaaaaaggagagctcaccggcgagcgagggaaatggggcttcgggggtgattggcggcaaccaagcggcggccgaggagcggacggcacccgcgagcgcgacgacggcggcttcacggcgcggcagcggctctagcggcggtggcgcgcggccgaagacggcggtaggcggcggcgcaaggggcgagcggcgcggcgacgataggaagcacgggagggcgcggcgagtgcgaacaacgagagagggggacgtggggagtgatttataggtgcgggagggggcggacatggccggggtggtggccgatttggccggcgacgtgggggtggagagagagagagaatgggggggattcaaattcgaatcccgccccttgcgagcgcgcgcgagggccgggagatgcgggggagaggacggcgacgtggggaggacgcgggagcggcgcggcgtgggcgcgggaggagcgaagaagccggcggcgcggacggtttcggcggcggttgccgtcgtggggcgggcggctgaaggaaggggaagacctgacaggtgggccccacctgtcagcgtcccggagagaggggagggagggaggacttcggggaggggaaaggggaacgggccggcccagaggaaggaggccgagcgcgggaagagagatgggccgacggcccatctagagaaaaaggaaggaaaagaaaaagaaaaagaagaaaggatttttcctgggatttaaaattgcactttggtgatttttaattggttaaaattatttccaaggctctgataattccactaaaaatcttgttaatgcattagagcatggggaactcaagaaaaattccaccacgctatttccgattattaattgcatttattaactagggatttagctctaggttaattaagataatttcttcgggcaatttatttatccaatttttaaagcaagaaaaaggggaaacttctgggcgtgacagccgtggccttcggctggcccagtggggaggggaggaaaatgggctggcggccaattaggaaaaaggagggaaaaaggaaaaagaaaagggaaatgaattttcagggattaaatattgcttgtgctcaattttaattggttaaaattatttctagagctctgaaaattccactaaaaatcttgttagcatatttcgacatgtagaactcacgaaaaattccatatgccaattccgattattatttgtattaatttattaggatttctctcatgcttttacaccgatatttttttagttgatttataaatctaatttaggcttgggaaaagaactttcagggtgtgacaggaggccaccgacgagccccatcccgcccactcgcacgaatgcagaagcgtccgcggataaagaaatggccggccagcgagctcgagctcctcttcctcagagacatcgcgcgaggcgggagctagcaatgcgccaaagcttagtttattgggaggtagcggagaaccagacacggcagagacaacggcatgggcggcttagcttatatgggtcgtggttgcggccgcgcaccgccgtggcaaaaatccgcggaaatatttgcgtttccagcctcgccacggcgttgcccatctttggccgccgcggggctgccgccgtgcttccccgctacagccgctgctgcctgctttcgcggcgccaccctcctcctctcccgcctcgccccgttgatcggcctacggcagagaagactgaaagagagaggaaggaagagagatgacgtggcatcctgatatgttgggtctacgtggatcctatgctaactcagccgccacgtcggacaaaacccatgtcaaaaccaccaaaaaacctattatgatcggttttgattagttaagagatgcccagatacgattttgataaattgagggatgtttggtgtactttttcctcctactaatgtcccaaatcttcgcgttgtccccactccccacgcgagaacttcccggcgcgccaagttaccgtcattgcactccgactcccgatttttggtttcgatctggtcgcatcgcaccgcctcgccctacataaaaggccgcgcccctctcgatcccctctcccatttcccaccccgccgcgcctcgctcgatctaccgcctccgatccgcttcttcttcttcttctcccccgcgatctcgtgctctgatggcgatggcgatggcggcgtcctcctgcgcgtcctgctccgccgccgcggattctttctcctcatcggcgtcctcctgctgctgctgcggctcctcgcggattcaggtacgtggtgatgcccctttcttgttcttcttgcaggagctaggtgtcggtagcggcggcgaggggtgcttctgctgtgcttcgtctccggggtacacgccgtcga

SEQ ID NO: 43150 - DNA, 1462 bp, Oryza sativa
ctactatatttacatcatcttgtattatcatggctgtaactatatgtctatatcaaatgcaatagaaatctgagaacgttgtgaatcttggtatgaactttgctctgttctttgttcgatattgctctgatatgaacaggagtaacagagtttctgttggtcttggatgtaaattgcatcagacatagtggatttaccttgtatcatgatgttaatcacagcagcaggatttcacattgcataaaatttatcaacctttctgccttagttcaattgatacaaccttgattcctggaagactggaagctttgttgtatcttcagtctgtcagtgccaagcaggctcttcaaattttgcatcagcagaccaacataagcatccatattgttcagtctttgattctgaaccatcgacctccaaaacgcctgcatatttgtcattccccggttttcagagaagcccaaacctctgcacgaaccctgtaaaatcatttgcatcagcagtcaagcctcgataatttatacttgatgtggcttgattctgaaacagtataatccaaaatggcaaaactcctgcatactatcccatttcttagtttccagatgagctagaaaccggcagcaggagtaatgttaaacatttgcattagcagtcaactcagaatactgatactgaaaccaacagttaaacacagctagctgcaagctgcagagctttttttcgtggcttctgctgacaagcacacggccaacacttaggccctgtttagttcccaacacaaaaattttcacgttatcatatcaaatgtttggatatatgtatagagtattaaatataggaaaaaaaaattacatagattgcgtgtaaattgcgagacgaatattttaagcctaattgtgccatgatttaacaatgtggtgctacagtaaacatttgctaatgacggattaattaaacttaataaattcgtctcacagtttcccagcgaattctgtaatttattttgttatttatgtgtgtccgtatatccgatgtgataataaatttgtaagatttcatcccaaatttctgtcgaatgccatatcgcaatttcgattaaaaaaaccatataaaatttgggtgttgaaaaacagctgaaataaaaaataaaagtgtctttcccttccaaagtcgctatgtctatccatcctcagaaattaggaaccaagaaacataacaaaacacagcacaggcacagctttcaccccccaactcgttagctgacgccggtcgcggtggagaaatactgacggtgttgcaggcgccgctcacccgcaccccacgaggccgaggcggcgtggtatggctccttcgcttttcaaacaaccctataaatatcttgcagaaagttccagaagaaggccgttggatcataacgtcgtcagcaagccaccttcaaccttcaccttcaaaacaatggcga

SEQ ID NO: 43151 - DNA, 8629 bp, Oryza sativa
ttgctaatgacggattaattaaacttaataaattcgtctcacagtttcccagcgaattctgtaatttattttgttatttatgtgtgtccgtatatccgatgtgataataaatttgtaagatttcatcccaaatttctgtcgaatgccatatcgcaatttcgattaaaaaaaccatataaaatttgggtgttgaaaaacagctgaaataaaaaataaaagtgtctttcccttccaaagtcgctatgtctatccatcctcagaaattaggaaccaagaaacataacaaaacacagcacaggcacagctttcaccccccaactcgttagctgacgccggtcgcggtggagaaatactgacggcgtcgcagccgccgctcacccgcaccccacgaggccgaggcggcgtggtatggctccttcgctttccaaacaaccctataaatatcttgcagaaggttccagaagaaggccgttggatcatagcgtcgtcagcaagccacctccacctccacctccaaaacaatggcgacctcgggttcctcctcctccccctcctccccgtcctcccccaagcgccagcgagtggcgccgccgccgccgcggcgcacggacatgctgatggcgctcccgccggacatcctcgacgaccgcatcctcgcgctgctccccttcgacaagctggtccgcacctcctgtctctcccgcgcgtggcgccgccgctgggagtcggtcagaaacctcgagatcgagctgccccgtgcctactccggcggcggccgcgccctgtggcggtgcgcgcggcccgtccgcttcttcagcgcccgcgtcgcccgccgcgacgtcttccgcgccgcccgctggctccgcgccttggcgcggaagggcgtccaggatctaagtctggagttctcgttagccggtaagcagcgcccccttcccggacccgccctcttctcctgcgccgcactcgtccaactcgacctcgagcaatgcgacatgccggcggcgccgccgggctttctgggcttccccaaccttgagcgcctcgacctcgtgtatgtcaccctcccgttcgccggtgccggcacgcagctcgaacacctcatcgtcgcggcggagaaactcgccgtgctaaatttgtcacccgtgatcaccatcaacggcggcggcgtggacacgtgggccatcagagcgcccaaactccggaagctctacatcaccatggagatgggtgacgacaacggctgccgaataccaatgccgctccccatgctggaggaggtgaccatctcattcgatcgcctcttcggaacccaagacttcctcgatgctttccagaatatttctactgtcaataagctctttttcaagagtgataaggtacgacgtcaaaccatttgaatacctcgttggatcccaattttcattacatgcctatcttgcttgcctcattgtctgcttgtgaatcccatgtagcatgttcatccacatttatgaattttagttagctcatttggacaaataatttgcagatttgattgggagtactgctgatccatttatgtctgctatatatgtgtcatcttctgcatttttgctgagtttcaatcactaagactgcaactgctattgtaactcaagagtcattaacctgaactgattatttccagaacttgttaagagagatattcatcatgatctgactcagggtgatctctctcctaaaatttggttgtgatagttgttggaggataattcttttactgcttctagtttcccttgattcctcagattaaagctgttggaatgatcaaacttgtgtttcgatcgatagtagtttttttttactgaattggtccttgtgagaaacttaattacaatttgactgaattgttcaatgtgagactaggagcttgtaccgatggtatgtcatgtttagtcaattaaatagctatatagtagtttactcacggaatgggcctaaaccatgtaatggttgatcgaaggatgaagggtgtggattaaagcaatggcaaactctgcctttggcctcaaaggcagatgatgcgaacctgtcatgtttcggcctcaaagagatgtactctgatacaaacgctaactttcctaacaatatggctcttatcttttctcaaaaggaagcttcaagaacctttctaactacaagatcatggtgtcctaatatttgaatatttgcttaggttagtaggtctatgtaaacttgaatcatggacatatgtcaggcctaactatgttcttatgattttcagttcaacattaatatgctggagggaattacatgcaagtttgagaatctgagggagggcggcctgatcatagattttggccagcgctcaagtgttctatcgttagtttctttactgaagtttgccccgcacattgaacacctttatattagggtaatattagattcacaccttcaagtgatatgttacagtttaaaggcatctcttggtcaattgtattaattgaaatttcggccttgttttgtagactgatcattccatattggaccccgtgagttctgaagatgagatggatgaagactccctgaattctgaagatgagtttgatgaagactccctgaattctcaagatgagattgatgaagactccctgaattctgagataagcagcgacttgcttgcaagcctcaaatatgtgaccctgattaatatgaagtacaactcaaatcaaatgtgctttatgaagcttttactgtccaaagcgagatctcttcaaacatttgacgtcactttcgtctacagttatgaaagcaatggacgctatggaaatgcatgcagagaattaacggagtgccaaaaggcttcaccccaagttgtgttgacagcaaaagtgacaacacacggcatgtaagacagacatcctgtccttgttgatgttgccttcgtattatgggagaaatacttcggaacttgctactgttcagattctagatgaggctgttcttgggcaaccagctgcttgttttccttcttgagaaggcagagagttgtacatagagaagctagtcgatggagtatcaggcttgtttgtgaaacactacgattactcgagatgtatacactgatatagcatgtggcggtattattgaatgacagactgatttagtatgatactcaatcaagggagctgtggatatgcaggctagaaatttctccccttttaccttatcacatgttaacctagctcttagagtcttatcaatggatatatctgttgtcaatgtattctgatgctagatgctaacaggagcacttttcatgtcgctaaccggagtttacaaatatggtgagcttttttgaaatcgtgtggcaaccggcaacagaggacgtctatgggttgatatatagaaatcaaaaggctcaataaaattgagctccctcctgtttctaatgttaggccgttgatttttcaacatatcatttgtcttatttaaaatttagtgcaaaaatgtaagacatgcttaacacgtatttaatgattaaacaaatcactataaaataaatgatatttatgtaattttaaaaataaggtgaatggtcgaacatctaaaaaaggtcaacatatcaaatattagaaagcaaagagagtaagatttaagcatgtttggcactgttgtgtgcactattggactttgaattggagattgtagcatcactggactcagttatgtgctagaataagagttactggaattgaattttaaaatattagattttcggattatttttgaaaaatagaaaaacccttttgcaaaatttggtttgccgttaggattttttttatctttcaatgaatgataaatatttgaaaataattttattggattatttgggtcacttgactccctatatcatttaactttgcttggctagaaaaccaactattccttccgtcttaaaatataaacatttttagctatgaatatagacaaaagtttatatgttttggtacggaggtagtataatataaataaaacttttgtccagtttatgtaaatcaaatgtccttgggaaacattcttctcccaagcaaaagtgtaattttgagaaaatatctcgctgaaaattgaatgtttgcttaggagtgggtatgtatgtgttttataccgtgtttctaagaaaaggaaagtggaatcttgagcaacttttatattgttgtgttggtgcaccagaccacaagtcacggctaacacgtgcaacgacgcgggtatacttgagtactttactatattattataagtatgtatgtagttttatttgttcagttaatttaattagaattaaaggtggtggttaattcattactccgtctgtttcaggttagaagacgttttgactttggtcaaagtcaaactgttttaagttttactaagtttatatacaaatatagtaatatttataatactaaattagtttcatcaaatcaataattgaatatattttcataataaaattgtcttgggttgaaaatgttactactttttcctataaacttggtcaaacttaaagtagtttgattttgaccaaagtcaaaacatcttatagcctgaaaagaggagtagtaatctttttcaataaaattccaaaattatttgaaggtgttcccatttatagccgatttatcaataatataaataactagctaaggcctttagctgcttgggctttcaataactaagataagctatagcaggctatagctgcagctaagccatttagctgttttgcgaaaatttgacatgagtcacgacttcacaggataaataggtcatcatagcaaatagttcatcacatgataattgtactgaattttattgacatcacatttcatcacaggggacattataaatacatatacttcatagttcatagatgaacatgagtgcatgacacatgagtttttgacataaaaagttcatcaatcatcagttcatcataggaagttcttgacaagtccacataaacacttaatagttcatcgatcatcagttcatcataggaacatgactaacagtccattacttaacaaaactacaaaacatcaagttcagtagacttatcagaaattcagaatagtgcattctattgatcagttagaggcagtatgagacagaatcggaggatcgcattgtagcatcatcatcgccatcttctgtatctgatgatgaaggtccaggctgtgctgaaatatcacgcatgaaagactgcatgctcctgattttcttcttcctagggcgcatacgcctctttctttttccttaagattgtgcttgtggtattgattctactgtcgcagcctccgggcgcaaccgtcgcctttggtcgcagccgctgcctccgggcgaggccgtagccgcagccgccaccgccgggcgaagctgtagccgccgcctccgtctctgagcgcagccgcaaccatctccgtcgacgctacaggtcgcagcagccgccgtcacctgtagaggagaaggagagggagtgagggactgagatcgaggaagagagacgatgtagggttagggttacagcttaacatgagaagtagatgggccttggcccgtagctaatttcagcccaaaaccaaggcttagctgcagctaactgaaggctaaattactggctatctcccgctaagtccggttattagcgtcatatattatgtagcggcaaaagtggcatttgttagctgctgccttttctagcatctatctccagctatagaggcagctatagccggagatttaaatccttacaatctatagttttcagttcgatacttcatttgctccaaaagtataaatacgcttgccagatcttgtggcatcctcgagctcgagcttagtatccgtttgcttgtcctaaacaccctagaggaaagaggcattgatggtggcgccgagttcatgcctcgattcttgtggccgcgggaggggagaaggagaggtgagaggatgtcgtcaccgtcgccactctgcgttgccccgtccggccattgctctactccgagacaagctcgatgacaccgcgtcggggctgctccgcccaacaccgagctcggctttctctgccttgcggctctcagccaacggcggtggtggcactcgtcgcctcgccgtagcgaggaagttgtgagaagctagtggtggcggtgcttgccacttaggcggggaagaggggagaggccaggcacttgcggtagtgctcgatacagccatgatggggattcagtgtattttctaaggttgctggatacataattttctaccaaagcataaatagaactaattgaatgactaaaacacaaacaagcagaggctgaaataaaatagaaactacaaatccacgcccgatctcctccaaaataattgggtggttaaatgtttcagttgtccaccggtgaaatattacgctatatatagtaaagaaaagacaggtaaacacagtaaagacacacgttaaaacatcacgttaaaacatgtaactatcgaacatgaaacattgacggattataaatgcgaacccaattgttcaggattcaaaaataaactttctcctgtgctcaacaaccaaataaatatcttggaataggttctagaagaaggccgttgggtcatatcgtcgtcagcaagccaccgcccgcaccgccacctccacctccacctccacgccaaaacaatggcgacctcgggcttcgcctactcgtcgccccccaagcgccagcgagtagcggccgaggcgccgcctccgccgccgccgccggcgacgacggggacgcgcacggacatgctgatggcgctcccgtcggacatcctcaacgaccgcatcctcgtgctgctccccttcgacaagctggtccgcacctcctgcctctcccgcgcgtggcgccgccggtgggagtccgtcgccaacctccgcatcgagttccccgcctcggtctcctcctcccgcgccctgtggcggtgcgcggcgcccatccgcggcttccgcgcccgcgtcgccacgcgcaacgtctaccgcgccgcccgcccgccatggcgcggaagggcgtccaggatctcagcctgaagttctcgtttgacgatctgccgcaccttcccggacccgccctcttctcctgcgccgaactcgtcagcctccgcctcgagaaatgcgacatgccgccgggctttccgggcttccccaacctcgagcgcctctacctcgtgggtgtcaccctcccgtacgcccgtgccggcacgcagctcgaacacctcatcctcgcgtcagagaacctcgccgtgctcgagttgtcaaacctgggtaccatggatggcgcggtcgtggtggacccgtgggccatcagagcgcccaacctccgggagctcagtgtcaccatgccgatgggtgtcgacttcggctgccgaatcacagaggcgctccccaagctcgaggatgcgtacatctcattcgattgcgtcttcggaacccaagaattccttgacgctttccaaaatatttctactgtcaataagctctgtttcatggtcgctgaggtacgtcagaataagatcatttgaatacctcgttgaattccaatcaccattacattgtcttgaatcacatgtacatgctcatccacagttatgaatttttttagttacattatttactgctgatcaatttatgtcttattttctgcatttcctctgagtttcaatcactaacactgcaactgctatactaagttcatgagtcatttccctgaactgattattttcagaacttgtataaagatacatacgtcatcatgttctgaggagtgatcgatctctctcctaaaatttggttgtgatagttgtcagaggactattcttttactgctaagttcccttaattggaagaacaactggtatttctatgctcagattaaggctgttggaatgacctaacttgtgtttcgattcgaagtaatttttactgcccttgcaagcttcacactatttaactaaactaggaaggtagcccgcgcatacgcgcgggcatgcaccgtacgtaggataaatttgagaaacttataaaggcggtataccagcgaattaatatctgcaatgttttaaaattatgttttttcccatgaattttcttcgttagaattgcatgacgaatttaattgttatttataaaattatctattggagattaggattggtatcttacggtataaaaaatggtacctaagacatatgactcttgaggttccacagggaaagagagaaaacttaagttataaaagacattacatatacaaccatatataattaatggctctacccattttttagaaaaaaaatgataattaatttattatttgacggcaaacattgattggtcatagctatggataattcctcataggaaattgtgattccatagtgaaagagaaaaaacttaagttataaaagacattacatacacaaaccatatataattaatggctctactgatttatatagaaaaattggtaattaatttattaaacataatatatgaccctcgagtttagaccattatttgtaaccattggat

SEQ ID NO: 43152 - DNA, 916 bp, Oryza sativa
  unsure (1)..(916): unsure at all n locations
nnnnnnnnnnnnnnnnnnnnnnnnnnnnnnnnnnnnnnnnnnnnnnnnnnnnnnnnnnnnncttcagttcttcctcgatccacttgactgacctccataagttgaccacatcagcattttctagtttcaacaactagtttcagaactactcaagttgaaagagagaggggagtagacaatgaaacaatttgcaaagaattctagataaggaagaaaggagaaattttcacaaatcatgttttcggaaaatttgtccttaaggtttgaccatttggcttatcctacagtcgagatggctctgataccaacttgtcacgcccggaaattcactagtaatttccgaacttatttgtgcataaaatcctcgtccaggaatcagccgaggtacacaaactgacaatttaatatacagattcatcaaattaactaaaacgataaatacttacttatgaggcacttagtcctcatcatgaagaaaactgcagcggaaaataaaatctagcgaagctccggctccactcccacaggcagctcaactggggtataagccaaacgtcttctccttctggattctttttcttcaactgaggttgattgattattgcaaggtgagcatatgacatactcagcaagccacacagcaaatatgcaagtgcacaaggataccaaaggatggcataatattggctcatttgcaaaagcagcatttagcaaaacatttaagagaagtaaaacagtggagtaattaatcaggaattttaatcaacactgaacagcacacccatgctgcacaggcccaaccatcctgaacaaccatacccggctgtacagatctaactccaaaccaggagctaagcaaattattaccagttatacatctatagttatggtgagaggtgtgggactaatcacgaaa

SEQ ID NO: 43153 - DNA, 3769 bp, Oryza sativa
aacagaatcacttcaatcctttgctgttacttttctatatagtaaatcaaacaaagagtatgtgaaagcatgcagggtactaagagcctttagaagggcatccgcatcaccccaagctaggttcgaggtaaggctttgggacaaaccaaccccaagaccgtcattcttttcatgtctgcctccgtaatgtggaaggatgatgttcaaacttgcagctgttcagagtctagatctatgtggctgtcgttgtacaaacatcttagaaatccttcttgaggcagagtgaatgactacgaagttgttctgagatgaagtatcccacaaaagatggtaccaatattgtctccatggaacgctatgattagggtactgtctgatttatcattatttttaaaatgcatcatgattctcattgaggctactgcagtcaaagatgttgtcaacatgcctggctattattttctgctttttccgttgatcactaagtttctaattatttcttgagctcaaagaggaagttcaatatatatcttatcatgtttaaacttttgattttaaatgaattgatgaagtcaattttacccccttaaatatttaagttgtaaatgtttaaactattttctagagcacttaacccctttaaaatttatgtaccttagccccttaactgttaaatgcagtactttactcctgctgacatttttccattttgtttatgtttgtccaaataattttttattgaaacctttataggtgtaaatcaccgtgacagctaatacacgcgcctttttctctctttttttcacaagctaccgcgcgccgtttctttacgtccgcattttttccatttctttttttttcacaagctaccgcgcgccgtttctttacgtacgcattttttccatttctttttgccatatttttcgcgtttttttatttgagaagttgaatctttcatcttcaattttatttgaaagttttgaatttgagttgaaatttttaagatttgagttgaattgttgaattttgagatgaaagttttcaaatttgagttaaatgttttaaattttcagatgaaagtttttaaatctaagttgaaagttttcaaatatctggttaaaagtttttaaatccgagttgaatattttcaaatctcgagttgaaaattttcaaatttgagtaaaaagttttcaaacctgggttgaaagtttttaaatctggagtgaaagattttaaatctgggttgaaagtttcaaatctgaattgaaagtttttcaaatctgagttaaaaattctatttatgtattatttttctaaaaactaatactaaccattatcattaacgctaatgaatgtcatcaacgctaattagcgttattagcggagaggccgagagagggcgcgtgcgcagctgcgccagttagcctgatagcgcgcgcacccattaggaatccatgtaaatcacatcatacgttatgcccaaagtagggccatgtttggatcctaggcatttgaattgttggagttaggccctgtttagttcccaaacaaaaactttttaccttgtcacatcgaatgtttggccacatgtatgtagtattaaatatagacaaaaaaaaaaactaacaaaaactttttaccttgtcacatcgaatgtttggccacatgtatgcagtattaaatatagacaaaaaaaaaactaactacacagatagcgtgtaaaattgtgagacaaatcttttaagcctaattgcaccataatttgataatatggtgctacagtaaatatttgctaattatggattaattaggcttaataaattcgtctcacagtttacaggtgtaatttttgttattagactacgtttaatacttcaaatatgtgtccgtatatccgatgtgacacgtaaaaacttttcacccctgaattaaaccaggctttaatcgcataattttattcaagtccaatgttttcgttcgggacagaaattaatctagaatttgattcaagggtgtgtctgcctgtctgggtcaatgccatagtctcaaccatgccccccaaaaataatactccctccgtcccaaaataagtgcagttttgcactgttcatgttcaacgtttgaccgttcgtcttatttaaaattttttttatgattagtatttttattgctattagatgataaaacatgaataatattttgtgtgactaaatatttttaaattttttataaatttttcaaataagacggatggtcaaacgttagtcacggatatccaccgctgtacttattttgagatggaggtagtaataggttcatttgcttcgttgctaaaagaattggcatatgccaatcttttgcaagtagaactgtgtttgtttccaagagttggtaacacagctgctgcgcacggaaaatggagcggtccattagcgcagcattaattaagtattagctattttttcaaaaatgaatcaatatgaatttttttaaataacgttcgcatagaaactttttgcaaaaaatgtaccatttagcagtttgaaaagcgtgctcgtggaatacgagagggatgagttgggaacccatagaaacgaactcagactttgaaccaactttgccaaaattttggcatcaaaccaaacaatcaactttaccaaaatcttttgtatggttgagaacggctaaaatccaaacaataccaaatcattagcaaaacaaagggtagatttcaatttgattaatcctaagatgcagacttcaccttatgagcatccttgcacattgtgctctagcttttcgatggataaagtgtgttgacttgcttagaccatgcttcattatctgttttaatgtcttttgaaattcgagaaggattctaaggcctagtttagatccctccataaaatttttcaccctatcacatcgaacgtttgaacacctgtatgctaaaaaaataaataattgcaaaggttgtgactaatttacgagacgaatctttaagcctaattactccatgatttgataatatggtgctacagtaaacatttgctaatgatggatttgttaggcttaataaatttgtctcttagtttataggcggaatctgtattattttgttattagactacgtttaatactccaaatgtatgtccatatatctgctgtgatacaccaaaatttttcacccctacaaataaacagagcctaagatgaactttaaattatgtttagcattgcatcgctccctcgagaattgggtagtgatttgagatagtaggaattaaagagatccgttctaactgttggacgggattaaaccgttattctagttttatccagtatgatgaggctgcctctgcacaccggaacaaaatagggaaattgctttgcgttacgatgaaatttgtacgattttagtacgatcctaccatgaatgatttttgattgggtgggaacaggttggatcccatattttcagcacacaccagagactacgaaggtccagttcttttctccaaaagagttgaagaatattaagattttcgtggcatactttttaaactgctaaacggtgtgtttcgcacgaaaactttctatctaaaagttactctaaaatatcatattaatctatttttcaagtttataataattaaaactcaatcaatcatacgttaataccacctcgttttgtgtaaaaaaattaatattcattttcatcttcaggagaaaagaacaccatcaaagtattgtactctgatcgtatgaa

SEQ ID NO: 43154 - DNA, 6290 bp, Oryza sativa
attttaagtatgacttatattttttttatattcacattaatttttttaaataagacgaatgatcaaatgttgcatgcaaaaagtcaaagtgatcactaattttgaatggaggtagtactaaggattagcacacccaaaaaaatccatgcatgattgctcacaatagttcatcatctctatgtaaacctccatcgcagatcatatgtcagtctatgttatattttttccgtctcagaatatagccatctagtatgatatgggacgtatcctagtactacgaatctggataagaagtatccccaaattcataaaactaggatatgtcttatccgattctaggttactatgttatgggacggagggagtattgattttcagtttaacaaaagaaaaaaaatccactggagacgcgtgatttcatcgaaatttgtgaatcagagggagctgaagatgaagatgaaggtcacataattaattaatcgtgcgacagttcataagctataaagaatatgaaagatgttcatctcgccttcatcgattcgaatgtaattcatcatcaattcctctagcaaatatatccctccgatccatccatccatccctttcgcccatgttcatggattagtagttcacgggagcagttgagcgagtgctcgcatatgcctatatagtatgtgcacatatgcgattatgcgtgccctactaccatcctctccgcaaccaaacaacacaacacatgcatagattactccctacgtctgtccagacgtttttcttagtcaatttttttaagtttaatgtaagttatagaaaaaacatatactccattcgtttcaaaatatttgacaccgttgactttttagcacatgattgatcgttcgttttatttaaaaaaatttgtcaaatatgtaaaactatatgtgtatatgaaagtatatttatcaatgaatcaaatgacatgaaaagaataaataatcacttaaatttttttgaataagacgaatggtcaaacacgtactaaaaagtgaacggtgtcaaacattttaaaatggagggagtatatagaaacatttttagccctaaaacaaacatattattaaaatatatttaatgttagctaggtttaattaaaccagtttgatattataagatttactgtatttttctataaacttggttaaacttaatgaagtttaatttagaaaacaagttaaagcgaagagagaaatgctgctactactactgctctctcactctcgtgcatgcatgctcgtgattgcaaataattcgcaacgctacagtaatctcgtgtgccctatctcgttcgtatcaggcgtgcatccaaagcaggtgcagagactatctcagtcgtctgcttgttccctagctacccttgcaggtgccctcacccctcaggaataatctctctctctctttctctctctctctgcacaactaaaactatatatcccaatccatgatccagccattcatcatctgcatatatataatcgtcttcgtcgtcatgtagcaagcagcaggtagcttcacattctcttgtctcttgtactcaccgcatcctgcttggtcgctagctagctagcttagctaaccttagctacgaactaggagtacctttcagttcagatcagcttcttacctctcatcttgcattgctgcctaagagtaagagccagagatctgtactgactactgctacggcatcgagatcagatcattggcaatggatggccgccatcttctcctcctccatgtcctcgcgcttcttcttcttgcggtggtggtcgccgccggcggaggcgccgtcgtcggcagggacagcgcagtgcttcagctgcgcgagctgcaatggggctcgtccggccaggtccggtattcccaatcaaagcgctttgagaagaagatgacaggtaattacaagttactactccctccatttcatattataaatcgtttgtttttttcttggtcaaaattcttttgatttgagtaagtttatagtaaaattagtaacatttacaacaccaaattaattttattaaatttaatattgaatatattttgataatttgtttgttttatactggaaatgttagtatatttttttctacatattaacttagttaaatttaaacaagtttgattaagaaaaaaatcatacgacttgtaatatattacaaacggaataagtagttgctaaataatgtctgagcagcagttgaattatttgtggggtttggcttttaaggttagcttcagagagaagcccaaaattacagtgataatattctcattattttatgaacctgcaggcatctcatgtaatgctaggtactgagagttgagagagttagctgatccatctttctcattcactggagaattgtgtctcccctgttatcaacatcaatattacagtgttcaccgcagtcctaatttttttagagcgatagatatatcactgtagtgtgtattgtcaattcttttcaaaaattttcataaccatatttccgatgcatttgagagaaaattgtataagggaaagcagcatcctctcgggcgatataatccatcttgttttgagggctatattttactctgctttcttggtagccctgttacctaccaaaccttctccaattatgtattcgaattgtcccatacaagttaaagctacacacacttttttctgtaaattggcaagttgtaactttgccccctccctaatacaaggatatgcaagacttatgcgtattctcgaaaataatagtgtaagttaatttcgaattttatgtgttttcacaagaagttccattcggattcagtgtaccacatcttcgctccaaatttatttgggctgtacaaattccacctgaatttggcgttccctacaaaatatatttcatgttccgagtttttctaaagtagcttcaatttcatctttttataaatccatatgcagtacagtacgttcggttatggttaattttacaaccccaaaataaagaccatcaccaatccaccatgatcaatctagatcgtgtagagcccttcttttttatatatatattagacactaatattagttgcaaaaatataaaccaatattaaattacattactctgctttatactctatcctttttcaatgtatgatattgttgactttttaaaatacgtttaaccattcaacattaaaacattttatataattattatttattttattgtaacttgatttatcattgaatgttcttttagcatgatttaaatattttatatttgttcaaaaattttaaataagacaaatggtcaaacgttgtttaaaaaattaacggcatcaaattttttctacaatttcaaatattttcaataactctgcttcattttcttaaatcaggggaacacaagaaagcagcagcagcagcaagaacgaggactaggagcaccaccgtcctagagctgaagcaccactccctcaccgccatccccgaccaccccgccgcccaagaaacctacctccgccgcctcctcgccgccgacgaggcgcgtgccaactcgttgcagctccgcaacaaggcagcgttcacgcagtccggcaagaaggcgacggcggccgccgccgccgccgctggcgccgaggtccccctgacctccggcatccgcttccagacgctcaactacgtcaccaccatcgctctcggcggcggcggatcctcccgcgccggcgccggcaacctcaccgtcatcgtcgacaccggcagcgacctcacctgggtgcagtgcaagccgtgctccgtctgctacgcgcagcgcgacccgctgttcgacccgtccggctccgcctcctacgccgccgtcccctgcaatgcctccgcctgcgaagcctccctcaaggcggccaccggcgtgccgggatcctgcgccaccgtcggcggcggcggcggcggcgggaagagcgagaggtgctactactcgctggcctacggcgacgggtcgttcagccgcggcgtgctcgccacggacacggtcgcgctcggcggcgccagcgtcgacggcttcgtgttcggctgcgggctcagcaaccgcggcctgttcggcggcacggcggggctcatgggcctcggccggacggagctctcgctggtctcccagacggcgccccggttcggcggcgtcttctcctactgcctccccgccgccacctccggcgacgccgcgggctccctctccctcggcggcgacacctcctcctaccgcaacgccacgccggtgtcctacacccgcatgatcgccgacccggcgcagccgccgttctacttcatgaacgtgaccggcgcgtccgtcggcggcgccgcggtggccgcggcggggctcggtgccgccaacgtcctcctcgactccggcacggtgatcacgcgcctcgcgccgtcggtgtaccgcgccgtgcgcgccgagttcgcgcggcagttcggggcggagcgctacccggcggcgccgcccttctcgctgctcgacgcgtgctacaacctgaccgggcacgacgaggtgaaggtgccattgctgacgctgcgcctcgagggcggcgccgacatgaccgtcgacgctgccgggatgctgttcatggcgaggaaggatgggtcgcaggtgtgcttggccatggcgagcctctcattcgaagaccagacgcccattattggcaactaccagcagaagaacaagagggtagtgtatgacactgtgggctcaaggctaggctttgctgatgaggattgtagctatgcataattagtactattccctaactagaatttgaactgcaaatcaactgttgagtaaaaaacaagaaaaaactttgaaatggagatgatgagaaaatggtttgtttctctagtctgttaggctttgtaacgtaaactcttttatttttgggatgttagaaaaaagttgcacaggtgcggaacaagcggtcaccacaactctgctatgtaccataatgtaactccatgtctacctataaccaattaggacttacatattcgacacatatttttaatatgaaatgtggtaattttcttgatatgtgtgggaatttaattgattccttcaaaaatccttatgaaatttctgctttacaaagatctaaatctgttccagaaattcagcagctcctgaatttcatattggaacatgattttttttttgttggcataaggtataaaccacatctgccttatctaccgcagtctaagtatactaaatcacacacattcaggcatgtctactaacaaatttcagaaatctaaaacaccataatttggttcaggtgttacatctaaagcaatctgacagtaagtcacaaacatgagtatcagagacacctctcaaggaaaaacaaaaggcaaacaatggtttgtgcaacaacatccatctctacagccaacacagtttgcaagtccagagaaggtgttcttccgtttattccggaaaatatttggactcccaaattaagagccgatgtcgaatgtgtccatgccatgctccactataaacttcacctgggtagatgactcctttttgtatgtcgtgaaaagaagacacgcatccgaaacgggcattatatgatgccagaacatcatgactttaagtgattcaagggatgctgccttggatagaagaagcttgataaagctcatctcccctgggaagcacttgataaaagacagggtcacacgcttgagacttctaaccaaatcttcactcatatatgcttctagaatcccttcatgaatctcatcatctccctgtgcttctttcagatcaacctacaaaacatatataggtcaagtaaatgaaatgccaattataattttacaataggccaatctacaagaaaaaaaagcagtgttctatgctgtgaaggtattttaaaagtgacttgaagagatgcatccagtgttacctcaatattcagttgttcaatctgtggagcacaacgcagtaaagaaaagattgacatgatacttgagattttgccaaaatcaacgctcaagtttgaagtccttaagttccggaacttccatgtaattctctccaatggattttcatcgacctgaaaatcatgacaaatttaagttagactgatatatgatcatcaatgcaacttgatctacttgcttgcaaacagtgtatgagtaattggagtatcatactcctatagctgagctgaaattgaatctgcctacaggtaggatagaggacacacactca

SEQ ID NO: 43155 - DNA, 1408 bp, Oryza sativa
attataattttacaataggccaatctacaagaaaaaaaagcagtgttctatgctgtgaaggtattttaaaagtgacttgaagagatgcatccagtgttacctcaatattcagttgtccactctgtggagcacaacgcagtaaagaaaagattgacatgatacttgagattttgccaaaatcaacgctcaagtttgaagtccttaagttccggaacttccatgtaattctctccaatggattttcatcgacctgaaaatcatgacaaatttaagttagactgatatatgatcatcaatgcaacttgatctacttgcttgcaaacagtgtatgagtaattggagtatcatactcctatagctgagctgaaattgaatctgcctacaggtaggatagaggacacacactcacacacacactcacacacacacacacacactctcttcatgccaaatgaataatgaggattaaaaaaggaccacaaataacaaaggaaattataccagtgtgattgggctgtccaaattcagaatgacagattataattttaaagcaattacaaaaataaaatgacgatgaaagcatctgacgttgatgcttttttgttttgtttttggaatggatagaaaagtatatttggagatcataacgagaatcttatgcaaaaaaataaatccgctagctctaaaaaccggttgcaaattcagcaaatttattattggagacaaacttattaatgggttaaatgctagagattgatcaataaaggaggatcttgtgtgcagatgagcaagtttcttttttgaatttagtgatttctaaaaatagtttccgcaaatgaacctctagcagaactttttctagaaagagactctcatttctttgtggggaacataaataatagactccaagtctcaacataaattgcagttggttcacaaaaagcacaacactttcataccgtgtaggccatgtgggatgcatcctagaattcacatgttgtccatgactctatgaactttaacgatgtgctctatagctggggctttgagtggtactgctaattagggggtacttatacgcacacataagaacagggcttgccgcctttctctccctcctctcctcctgaatctatatataaaccacccttcgtaggcagtttgtttatagtacatctatctatctatctatctatctatctatctattatatactaaaagtccattaaactccctataaacgctctcaagctgccacgtggctccctcaaaatgctctcatattgccacgtggcactctaatataatagagaaatctgaccatcgattttcatttaaatcggtgcacccattattttacatcgttagatctattttaaaaaccaaaaacctcccaccggccccacca

SEQ ID NO: 43156 - DNA, 939 bp, Oryza sativa
  unsure (1)..(939): unsure at all n locations
atccttaattgatttattgcgcaataattaaaatcccggggagagatagggcggcgccgacatgcgggccccacatgccagtgactcgggggggggggggtctgcggtggaacgggtccacggactggggaaggagcggcgcaccacgtggtgcatacgtggcggccacgtggcagccacgcgggcggcggggttggacggcctcgatctaccctcgggtagatcaggcgggtagatcggacggcggcaggagcgcgtggccggcgcgcacgggcggctcaagccggcccggcagccatggcgcacggcggcgcggctcaacgcagcggcggcgcaaggcagcgaccggcggcgaccggccggcggcggagggcagcggtggcgcggacggcgacagtggctgctaagcggcgcgggagagagggaggaaggggaggaggtggctcaccgacggcgattgacgacggcgagcgacggagcgcgacgacggtagcgggacgagctccggaatcacctagcgaacacgaagaaaggggttagagagagaggaagatggaagagggcgaggacgccggccaaaggtggtggccagggcggagctcaccggcgcgcggtgtgaacggggttcccgcggctgaaagcggcggcggaaaggcggacggcgtggccctcgggcttgcgaacccgatggcggtgtcggcgcggctcggcgcggtggctagcggctaccggagcggcggcggtggcagcggcggagaggagggcgaaggcgctagggcgatagaaggcacgagagagctcggcgaaatggagaaaaagagagaggggagagcggggatgcttaaataggggagagggggctcggacgtggccgggagcggcccgatttcgtcggagtantggggagggggtgagaaggcatggccggcgggattcaaa

SEQ ID NO: 43157 - DNA, 769 bp, Oryza sativa
aacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatagtctacttatatatacaaggacctaattaattaaaggagacgtatagtaagaaatctaactgaacgatatacttacaaaatccagcaactcataatagagacgtcgagggcgtccagctggtatagttcatagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttc

SEQ ID NO: 43158 - DNA, 1202 bp, Oryza sativa
  unsure (1)..(1202): unsure at all n locations
nnnnnnnnnnnnnnnnnnnnnnnnnnnnnnnnntctaggatccccagcggtctgaaaagtgtttgggcttgtcaacatggttgagatgttttttgggctctgtatggacttcttttgggttttggttgtttgttgggcttgtttttaactagtctttcatgattgattgtctatatttgtgggctgtttaatgtgctgcagtacaattatatttgggcctgagattatatttgggtttttcaactagtcttttcttattgctcacatgatctctctctttcaggctagctcccatactatcgtgtgttgcatcacagttccttctgaacatctcccttcaagatgacgtctcagaagaaactcgcgaggagaaagtgataaagcacaagccaacgattgaatctaaagtgatactcagatttatcggcatgccaaattacaggtactccctccgtcgcaaaatataacaacttctagcactcagaatttgtcctaaaatataacaacttctccactaacattctcttcccaaccaatcacaactctccaccaatccattcacttttcccacctacctccatttctcgaccaatcacaacatcttcccatttaattctacctactttcttaataattgtgtccaaccctaaaacttcttatattttgggatagaggtagtaactgattaatatcatttagtgtccattaaaaggaatatatatttttcaaataaatgtatttatattgaattcacttgcaggattaccactctgaaagaattcctggtgaaaaatcaggatgcacttgttgaaaaagtgaggctcttttcaaaggataatgtgctggtaccagcaaaacttggaagctcattattccaatgttgcatcttgcacctcattgcaaaccataagatgggagttagctggaacggagaatttgagctaactgattgggaaatatctgatgatatggtatctctaaaaaaggttcaccatgggcctttacctgatgactcaaaagttgcagatcttgagaagctggtggatttattggctccgttctttttgaagaagggctctcccttattcttcaaacaattgaaggacgatgtgacccttacatctagaacattggtcagtgctagtgattgggaatggttctgggattatcttggctcacatgtgttctatatgcctccagtc

SEQ ID NO: 43159 - DNA, 790 bp, Oryza sativa
  unsure (1)..(790): unsure at all n locations
nnnnnnnnnnnnnnnnnnnnnnnnnnnnnnnnctaaggcgaggcggaggaggacgaggtcagcctcggtggcgatgatggtgggctcggctggggatccaaaagattatagcactgcatatgattttcgcttacatatgtatagttagcatatatatgaatgatattattatattggtaaaaactctaattaagatatgtatgtacatactgcatgatttaaaattaataaaaattgtaatcatcatatatacttagcgtaggaattatattaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatcca

SEQ ID NO: 43160 - DNA, 5752 bp, Oryza sativa
actctagaggatccccaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcgcgtcgattgcgtggcgtacgtccaagaattcctaatatggtaactcccaaaatatagagttctttttccacatcgccgcatgaccatcttcgctctctatatgctggcttccaggcccctttccgaacactactttaagatctttaaccatagcaaacactgttttcccgctgcgatgtttaggcttcgtacggtggtcggccttatgttcaaagtgcttgcctttcttccgtaccgggtggtttgctgcaaggaatcgacgatgacccatgtatacaaccttcctacagtgcttaagatacgtactttctgtttcatccatacagtgagtgcaaaccttgtaccccttgttggactgtccggataggttgctaagtgcaggccaatcgttgatggttacgaacatcagcgctcgtaggttaaactcctcctgtttgtcctcgtcccacatggggacaccttccttcttccacaactgtttaagatcttctaccagtggtcttaggtacacgtcaatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattataccaaataattcttaaaaactatttgtaaagttttaaactaattttaatgtgttttacttcttttaattttcattttagtttgttttctattatttaagattaactttcactagagtttttcttctcaactattttataaaaccttgtttagcaaatgaactaaatttctatatattctttcttccccacacacattttctctctcatcaacttacaactaaattttggagaaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttaaagaaattttgaagcttgctcgggcagctggaggaggaagaagacatatatataggggtgggactttagtcccggttggtagcaccaaccggggctaaagatcacctaccaacccgggactaaagatcccgggggggcctgacaggccctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgtatatatatatttggcaatacaaatttgcattcaaagaatatatcatgcatcggtactcaaaacgatatatttttcttgaatggaggagggaggagggagcaatacagcctctactgggcttgaatcttgtacattacggcgctcatgacaaggaaggatgcatgcatgtgtgaccagaggaagtataaactacgtattccctctaataaaaaaaatttactggatatacctatatactccctccgtttcaaaatatttgacaccgttgactttttagcacatgtttgaccattcgtctcttattcaaaaacttttgtgaaatatgtaaaattatatgcctacataaaaatatatttaacaatgaattaaatgataggaaaagaattaataactacttaaatttttttgaataagacgaacggttaaacatgtgctaaaaagtcaacggcgtcaaacatttcaaaacggaggtagtagtagtatactgtaccaccaggacgaagtcagtactcgcgcagagattaatgtatcaattaattagaccttattatctcgtgcagattaagctgtgtgtacgcacgtattatgtgtagaaataaacatagacatgcaaattaatatatatgagttttatgagaatccaatcagtaaatatcttaaacggtatcaaaatttaaaattttcagttttaaaatttgacttaaaacttgtcaaaaacaatgtgttttgtaacagatagtgaaagcacgcacgcttctcgatcatcctatgaaagcaaattgaaatgttaatgcacgcattattggcatcgatctctttgactactgcaaattgaagaccaaataatgcgaactcaaaatatatatcaattcaatgcaactacacagatgagagcgattgtaacaatagtagatctaacatcattatcatatcgtccatcgattttaaaacctagctatctacgtacccagaaggtaaataaatgtacgtacgtttgagcatataattagataaatccatgccccggcacaaggatgaaaatgatcatgttggagttatctcactagcttgcttaatttaatgtcgttaattgttgcttaattgaatacatattgcgcgcacataaatcggttgatcaaaatgtggtcagatatgtttccagatatgggttatatattaataaatacaatcccatgcattagagcaagttcaatagtatagctaactactagctccaattcatctatagccaatctaatagctcattcatacaatagttacatactacactattaatatctggtcccacctgtcattcacacactgtgtgtgtcttggagtccgtgctacagctggctacaaatatgtagcccgtagcccttctctctcctcatttatcttcttaatatatgtttgcagctggcttatagcatgctattgtacctgctcttatagtggaatatctagttaaaaatggttactaaacacgtggcaaactaaacgtgctaagaatattggacaaattaagatttgctgggtgcgatatcgattaaggagaaagcaaggtggtagtccattttggcatagtgagctgtttccgtaggcttcataatctagctatggatgtttcagggacacattaattctatgggggtgtcaggtgtgtgtcgtgggtggtctggcttaatatgaaggcttctttaccgcaattaattatcatcttagcaagtgagtttttttgggatcttagtgagttttaactatacagaaagtaataaacctcttacaacatgggaggcctcttaaaaatatttacttgggatcaggtacctcagtacgagggttttttaggtaccttaaaaaattggaataattaactatttggatccaatagatctaattctattaattatactaaacctggtagtatgggtagtacaaattttatagggaaaattttgaactgaaatatataacagcatgataaatttatgtatatgcatgccatgttaatacatgaattgataagactaccagggtaaagtttcgaatgaaatattttaaacacttggattaaaattgtactatcctaccaccgcttgtagcagaaggtacctaaaaatgagtacggccaaaataaactgatccctacattttgaaaaattcaccttttgcatttgctcatggaattttctctgctttttaactaggataaaattggttattgggctattgtagttatgtttattctaatcgatcagtatatgttcagtcggacggtttaatttaaatctttcatctctcaaatagtacggcggtgtttgaatctcttaaagatgaaaattaaacatttcacgtaaaatggtggtaataacatgtgattaattgagttttaattattacaaacttaaaaaatgaactaatatgttattttagaacaactttcatataaaaagtattcgcacgaaacacaccgtttagtagtttgaaaaacgtaccacaaatatccaaaactttatcttctatttacagatgattagtagggagacgtatacagtatgtagctcctaacactttgttggagaactgagtttggagtggcttaatttataagctgcacacaaaatgatgaagattagcacatcatagtaattaagtattagctattgtaaattttaaaattgaattttatttatttatgaaaaaaatatataaagtttttgaaaatgacacatcgtctaacttttgggaattcgtgcttatcaaaacgagaaagtagatctccaaataaacccaaaaaaacgcagcctaagtcatc

SEQ ID NO: 43161 - DNA, 3962 bp, Oryza sativa
attagctgacgaccaaataatgcgaactgcaatatattaaatgcaagtacaaacaagtacatgtgacaatagtttagagatctacatgaccatatcgatcgtaatacgtccatcgattttgaaacctacagtatatatatatctgcaactaacacaaatcgatagatctgatccttaattacccagttaaattaacctgcagttacgtgtgcacgttttaggctgttcccggccaagagtttttatttcatgcatgatgctggtagtgaactgccaaaactgatcgtcaattccgtgcatgattccatcatccatgctagtagtagatgactatgtataaataggcatggattcacacgtacgaatgcggagaaacgcatctatatatccatctctggaatgcttgcttacgtggaaaattaattttaattattaattcccggaactcgatcggccattagatttcgggtgaaacatgaggaacatgatcatcatgcatgcatgtacttatctacagcgtatttatcagagatctgaggtgtgcaccggtgacaaggaatatctctctagtcaagcataaaattaagatggtaagaaaatttcaaaggggagggggccgggtagatcgttgccggtttttcttttccattatgcgcccgcacatgctgctacccgttaattatgatcaatgatttgtgctttgttcatttcccttaatgttactcctatttaatttagttttttgtcggctggcacgtcctatacatacgtctatgatgcatgatataacgaattaaagattggttagttaactagcacggtgatctctacagattgtgccgctagcattgttacaaaattttatcagataatagcatatatactttcacgcttggttctgaaaggaaaattatgattttgaattagggttaaacttgatcaaaagtatatcgtatgatattccaactaattaatataataatttctatgtctagcatagccaatatgataaatcctttagcatctatctatctattatctactaaaagtccattaaactccctagaaacgctcctaagctgtcacgtggcgttcctacaaacgctcctaaatcgccacattattttcagttaaactggtaggcccattattttagaccgttagattggatctattttaaaatccctggttcatcttaatgtccgggtaggcccattatctaatcacagctgcttcttaatgtccgatatatagaagagaaattttcacgagaaaagttaacgtacactataattggatattacccatatgtattgttcacttcaaaaaaccaaacaaacatacgtatctacagctataaagccagaaaaaaaacatactatgctgtatgctaatagaacagcggttttaaagtagaattttctatattataaaataaaatttattactccgcatatatccatgtatatgcacagtttaaacaagattaatataaagtatcaaatcaactgtctttaaatgttcatcttttaaattatttatgaaatatatatatatatatatatatatatatatatatatatatatatatatatatatatatatatatatgtaacttataatctattatattccttcaattaaataaaatattgatcacatataatagttatattgtagtgctaaatacatggtgccgtcatataatacttaatgtcataattatttttaaataatttagccaacatataataattaatgtcataatgccatgataattttttaaataatttcacatgataaaatggatcaacttggtgtcaaatatcgctcgataaatatatcgcagtggagaaataaagcctcggcgactacggtcggctttattacctgttaaagggggcattcatatttgattttaacagtgttatcttattaaccattaggaacaataattatagaatatttattcatagatttagaaacaagggttgacataaacatttatgtttgtagtagatataaatgttttatgtattaataatatattgggcttattttagtggtatagatgcagatccatttatttaaaatgcatcccgctttaaggataataaaaacaagtaagaatgataatagctgagttgacatgtaacgtggacaaaataaaaccctacctatggactaactattagtttctcaagacatatttatgaccattagatccatcgttttcttttaaaaaatagaacccatataccaacctccaccatggccccgtacatgggcgcttactcattcatccaccccactgcccacaccctcaaacacaccatacctctcttttcctcctattctcatgctacattacttagaaatcataatttattattaaaaaaatagagaacagtatcatccaaagcatatagtgaatttttgatcgacttatttttgttatattatttataactaaagttaaagacacatattcacaatattcaaacttttgaaataaatatgtttgattttggtttatattcttacacttttgcgtacattcaaacaattataaaaaaattatgaaaaacatttaaatgttcatattttaaattatttatgaaatatatatctaacttataatctattgtattcctttatttaaataaaatattaatcacatataaaagttatattgtagtgctaaatacatggtgccgacatatgacacttaatgccatcatataataattgatgacatgaaatttttttaaataatttcacatgataaaaaggatcaacttggtgtcaaatatcgcttgacaaatatattacactaattcaaatctagatgcagggagaatcatatgatcatcggttttacttaaattatttaggaaaaagcaggaaaataaagtctccaattcctcaccgtccccataacatgcacacaacaccaaacgcccccttcccctttagcttaggctcttcgcactccactcctccctattcctactttttagctatcaaatttaaagacaaactatgaataatattgaaaaacccatattttaagctatacatctaatttctaatctaattgtttctctattaaataattaaacaacaattcatgatccattatgcattttgaacataaaataagagttgtataaagtaaattagaaaaatagaaaaattccaatagggattgaattaaattaattgggcagaatataataaatttgtaaaaaatagttattacttttcacaaattggaacaaccattatatgttccatcgccataaccatgtttaagtacttagatgttaatgaccatccatctatcttatatcatgtcattatgagtttttcaacgaattattacatatataaaacatatagttggttaaaaagttatctatatgctactattaactttaagtttaggactcatgttgactaggtatgtttttagaaaaaacactaaagatcacatatattatagggaagcgtgctgtacaatatgtatatctcctatgtatttattgatgctttttttctagaaaatgaagaattactgataattgcagcttatagtagtgaattaaatattatatagtttaaaccttacagatatcttgtaaaaaaatatctgagcaatgtagatgaagaaaatttataagaaattgtactttttcaagagtggtgtgtcacccggtcgatattacaccttacaaaagcgtatcttatatgcccgcgcgaatgcgcgggctacctttctagttatattaataatgaaagagatgaaacatataaagacgttatagtatatttgtttctcttctttcctccatctttatcttttacattttctcgctatctctagtgacatttttctaccctactattaagcatttgagaaaaatgattgttggtcggaatatctctactattataaaaat

SEQ ID NO: 43162 - DNA, 1547 bp, Oryza sativa
aagtttttttaaaaagaactttcaaatataattacactatatttatactacaaatatatacatttgaaattaagctttaaaaaaaacttgtgacaattttttaaatgtttcacctctctaatagaacgtagggagacatatacagtagcaaaagcaagaatctcaaagagaaatcaagtaatactaggcatgccacaagcatccatgatgactgagaaacctaacaccgtcggttaacctacccaatttaggaactgctacgaagagtaaacatacgtgttacctattccaaggaggcaaaaaaataatcagaaaaaggagagaatccctacggtttcagctgttatcaactaatgatacgttacttcttcaaccatgaaggtgggatactgggattcatatttgcgatgatttacatacattttttaaaactctttttaaaagcttgctaaaattcaacaattaaaggagagatggagtggagcagtcaagttgagtcaggtcgtcataaattaaggtaaaaacgttgtctgtcatcactctcatgcatgctaataaacatgatggaaaaaagtacctcatttagttataaatatgagctactccctccattccaaattgatctacatatttcatagatacaccaaaactaagaaaagctaataactctctcatactatatttactctagcaacaaactcgatgcatgcaccatcacactatttccgagccaatagcaaatcaagatattgcatgtgggttataaatacttatatgcatgatgcatgcatcaatgtctatttactccaatgcacaaataacgaatagacttaataaatgaacacaaatatgtagatcatttaggaataacttaaaaaaactatatgtagattaatttgaaattgagggagtatgtacgttactaggagcgcgaaggtaaaaggatgactaatcagtgattgaattagatggataataagtatcttaattcttatctaatggttgctatctaattggtagtcctaattaatgtgatctaatgacaaaaattgttaatgatgtgtctttttctatatgtctttctttaaatgtcctttagtgaatactacttgtataaaaaatatatactccctacgtccctaaatatttgacgccgttgactttttttaaacatgtttgaccgttcgtgttattgaaaaacttttgtgaaatatataaaactatatgtatacataaaaatatatttaacaatgaattaaatgataggaacaaaattaataattactttttttaataagatgaacggtcaaacatgttaaaaaagtcaacgccatcaaatatttagggacggagggagtatatattagacctaatattttttagttttttaactatacagaggtacgcaggcgcgggattctaactagctagctagctagtattaacgtcatcgttgattcgcccccaaggttgaattaaactagtcgacgatggagctctataaatggcagtcccgcttccacgagctattcatgcactgctcgatc

SEQ ID NO: 43163 - DNA, 1037 bp, Oryza sativa
ttaaggtgggatctaaacaaggccttatacagtacatacgagggttgcaagatgacttgtgttttggactctactagtagctcttgttctctactactccctccgtcccataatataagggattttgactttttgcttgtactgtttgaccactcgtcttattcaaaaaattttgaaattattatttattttatttgtgacttactttattatccaaagtagtttaaacacaactttcggattattatttattcaaagtactttaataattctaaattttttttgaataagatgagtggtcaaacagtgcaagaaaaagtcaaaatcggagtacttgcaagagagtgggtaagaaaaccctcaaaagcactaatctagaattatgtgatacgcactggagtacacgtctgtacaaatgtgttggttttgcagcatgtgagcactctgcaactcatgtggtttcgatggctgggaatgggatcacgtgatgtgactcagtgttgcctcctcttcctctctctgattgatggtcgatccttgttgaaatgtcacactactgtatttaaaatgacaggcagatcaccaccggtatcactgtgctcagagagaacgattgttgggttcaaaaatttttaaatatcctcctacagatcaccatcagtatcactatgcccaaagagaacgattgctgggtttaaacatcctcctacatttggcatccatcagtatcactcactcaattgttcgttcggtctgccccaattacaagcctaacacaggcaatgtacctaggagaactgtacaacacgagttccctacgattcctttttaacaggaaatgggatcggcagatcaccaattgatgatacagagagatacatgatgctgtcgacatcagaaaaatgacagcataaagctcatcggtagatcttccggcatgcacgtccaagcacattactatagtctctctgccagctacgtactaccgtctaaccatatctaccatttgggcaaaatgcaggcacaaaagccacaga

SEQ ID NO: 43164 - DNA, 15331 bp, Oryza sativa
  unsure (1)..(15331): unsure at all n locations
nnnnnnnnnnnnnnnnnnnnnnnnnnnnnnnnagaactgtacaacacgagttccctacgattcctttttaacaggaaatgggatcggcagatcaccaattgatgatacagagagatacatgatgctgtcgacatcagaaaaatgacagcataaagctcatcggtagatcttccggcatgcacgtccaagcacattactatagtctctctgccagctacgtactaccgtctaaccatatctaccatttgggcaaaatgcaggcacaaaagccacagattacccaggctgcatgcgctttgatcagtacgtgttctgggggttgaatcgcctcctggcgtcgcgcttgtagtagggcgtgtcgtcgatggtcctcctcacgtactccatgaacggctgaggcgtacgaggtgacaactcaccagtagctggggacgctgggtcagccatcgcggctgctggtgctgacgcaggcgcaggagtcgcgtgtcttggtggtgcctctctgatcggtttcttctccagcaacttcatgaagagcgcaatcgtagcgattggaacaacaatgcatgtcacgattgcagccaatgttgtcaagcctgatgtcgatggctctcttctttctccagtgtcatagataacttctatttcttcagtctggcctgtaggtggaggaaaacaatgttgttagtgatgatcgaattgcaatcaccttgcataggagaggtgatacttaaattgcacattgtatatactgttaaggaggatcagtgcattcaaatgtaggtttacttggttttgacctcagttttaccaatcaccaaaaaggtggttcaggatgatggtcagaccaagacgactacttttattccttttgaaaactaccaagaaatgtcatgactctagtaatctactcattacaaggattttggcaaagatagaatagcataccggtggctggaagaattatagtgatcttgtcatagaatgattgccttttaagtgcttcaacctgcaaaagcatgtgagtcagtacatgtttaccaccgttaagcatcaatttctaaaaatacttccttgtcagttgcaatttacctgataactaatttgacttggaacacctcttccatttgtatcaacacgactggctgacagtaaatctttagcattccagaataactcaacatctggagcagggcaataataactctagcattagaaacaaacacagccaaagcccaaaggtctaaagttcatggacacaatagggttttatcctaccagtattcccaccaatagtgatgatgctatggttgcagcttggagtcagatttaactgcatcagataaccagctttttaataatcagttagaacaaaaagaaatgcacatgagatggggagtgggaaggtggctaccttcctaggttctttaatgtagaaccctttgacaaagagggcgtgagcagatcctgtcacctttggatcttcttttagatttgcatgaacaacaatgtgtaaaaatccttccttcaggtttaacttaacaggcaacagttgcgcaggtgaatatggatgaaataagcagtaagattttttagcagcatcatcactccacggctcaacaaacctaagggagaaaggagaatgagactttaatgcatccctataataatctagaggaaaagcaagttgtatgaccagccgatgatgggaaacatacccaacaaaagaaggttcaaccttgcagtcaaatgggacgttaatgtgattgatagaggagtctgcgctgtgtccagttgaatcacttctttcaacaaggggggaaaggttagtttttatcaaacataagtaaattcatgagtatccaaataccaagacaaaaaaaaaagctacagaagcgctatgttctgattggacttagtatcaaatactacgtacaattatagtaactttgtctattcaatactccctccgtcccaaaatgtagctatttctagcacagtgtcttgtcccaaaatgaagctatttcttcacctacctcctctcaaccaatcacaaccattcttcttcacctactttctcttttcaaccaatcacgcacttcctccaatcattctcacctactttcttaatacccgtgccaacctcaaaaatggcttcattttgggacggaggaagtacaggactatttgtccagttcctgctacaattatacgcctccctccaccatcctgttctctaatgttgctaagaactgatgtatgctgaagtatattctgttgcaagttatataataccatttctatatagacacatctaggaccaccagtttcaggtcacaatctccagctgtgaacctgaatctgaaagtaccaaaaatgaggcatagagaccatcttagcaatactactctgctggtgctccaagttctagtataataggcctaaatgtatggattgcaaaactgtaatagcctagtgtactagaagttcatatctaataaattatcatattagagtagctttggctttgactatattgatcaacaacaatatggaaggaatattgtgaaatgatatgagcattacaaaccttaattttacagagaacttgtatccaccaggtggtccagcagcatttgtcagcgtctccgcaggagcattaactactatctggttcaccttcagcacggtgacagttgtgtgcagttttgtatttggacctttgaatattactgtttagatggagaaatcacactgaaaaataagaatcgggagggaatgacactaggtaatgtattctactcattgaagataatcatagttgcataccttctgctataccttcaccacgtgcttgtgcttcaccggttattctattaatatgcacaactttttcattgctacttaaccactgactggatccacgcacatccatccctacaaaaggaaggccatggttagaaaacaaagcatagaatatatagtagcatgcatgtcctttgctcttacaaaacatgtatgagttaactacctattctggtagtgtggcctttctatgaactatccattttgttttctaatgtagggtgcgtcttcttttgcgcatacactaaggcatgcttgtaaggaagttagaatagtagtatataggggtagagggaacaccattcatttattggaatctgaaataggccctacatttctgaatatgaccagccagaaagggcgtcttacatttgtgaacgaagggagtactatactatcacccttgacccatgtttttccaaaagataagatcatgtactactaactaaaacgtgatgtgtggacagcaatgaatataaaaggataacaactaactaaaatataatcatgcacactgaaatggtgcatcagacgaaactcccaatacaacaaaaaaagatgcgaataaccggtagtatggaaatggtttcactggacgtacggtctccaataatggtgaagttcagttgctgcccagaacgaaggaccacatccctgggatacatctgtgcaccaacagatacctgatatagtggaatgtgttagtcaaaacacaaactgtattccattgtgagcattcaaccgaagaaatggcagttcggtatatggttttgctagatgatgtcaccgccagattctgaaagcatatgctattacagtttagtttgatacattgtgtacaagacatacacaaaaaaaactccacctgaggagcgctagccagaataagctacactgcattcaagtttaaatagctacgagcccattatgccattatggaccagacaaagaactctgggatagtagcattgaactttagcactttaccattatgaaatcggctttcttgggaatatggctgatttgcaaccttacaagagcagttccatgacttcttgcctgcaaaggacaacaaaacacaacacattttgcatggaagtctcactcaaattatccgtactcaagattgactcaaattcttgttacaacttccagaattagtttcaccaaaatattccttgattattcttgtcacagctttaaagcaatcattacaattgagaaagcgttaagatccactaaaaacccagtttacagcctgaacttcccaccagactcactctttttttttcagacttttgcaaaagttcagggttataaaaatggacctttttttccaaaacaatattgaagctcgattagaggggcaagcccatacctgtaacacaaaacgttcatgggtaccatgtgtaccattgccttcttttggcataagaattgacacgacatcaggatgattcgtctcaatctttacagggactattccaagtgcttcactgaaggtataacctggttggagggaaaggataaaaacaggaagaagtaaagttttctagatgaaaaataaaataaatgaagcattgatactaataaaattgttagtgaattacctaattcatcactgtattttatatccaactcaactttatcatgtacagaaagataggctatatggattgatgattctgcagctgctatctgtgcttgtgcaacctgaaaaataatgataacaacagaatcaaggattattttctaaaatacatagaaacatagagagcaatgcgattatagaacatctgtataaaatgatggcccaaaaattttgaaagagattcttgtctgcgacttatttttaggcatccttcagggccacggtggtcttttccaaaactaataaacagcctcaattagatattaaacagaaaaaattactagagtatgcattcccgcatgcattgaaatgataaactgacacatacactcaacatgcaactatatccctgttcctttttttttggtgaactatatgcctactttaactacccagtcacatacgtttgagtaccctttagtcataagtgacttcaatcataccaagggaaacattgtgtatgaaatgtagtccagaaaaacatggaaaaataaataatattacaatctcagagataatagggatgcctagtgctatgctatttgcaatagaaatatatgtaattagagtaccagcatccaacctcagcaactcgtaggcacgatgcaatttctgttctaccagttgagtgatcctttgcctgaatgcaatcaatcgcattgctttctccagtcctaattttacttccatcaataatgttagcattttgcaaaacaagatcacttttaccaatgttccttagcagagaatatccaatagtactctccaggtcatctgagtctgggtcaactgatctaggtaaaaggtccgtagtagtataaaagggtgggaataaccatgttataggaagtccaagtgcgagaggaggatctggcacaacaagaattgtcttggatgcactgtaagctatggacccagaactgccagtcatcaagaaatcacaagtaattgacacagaaattttggttttcccagcagatctgtcaaaagaaaaatattaattaggactcttgcagctaacccaacttaccacataagagtgttttttaaagtgtctcaatcaatattcatttttatttaaaagccaagaatagaaatagtccttcgttaggtccaaaaaagtttcaccaatcactgtaactttgagcaatgcataatgagttctcccaaacagctacttcggagtattagtttagctccctttaatatgaatattgggctcaacagaaacactccactactttcaaaaagttaaggggctaggctactttcaaaatgtacaaacaggcaataaattggcaattcagtatatcattcaatacttctatgtagtaccttccaatcacatgattaataaaagcattgctacttccattcgaaaaccatggatagttctttccttccgaatatagcccttgatcaagtccatactgccaagatctagctaattgaaacatagccacctagtgtagaacagtttgttagttcatagtgctctgaacttagcatttaaaagtatacaaggcaacaagaggaatattctaaccttgtcatcttctataacccaagtgtaactttggcaagtttcataaaaggaaaatagatctccctgaacagcatgtgtaatgttacgtagcagaacttcacaagatagtaataaaaggattattggattaaacataccttgggcagagaagggtagatgggcatgctgcaaccaacacaaagacggtcactttgagtactcaatatcatagccacagggatatccacttcaactcttccaaaagcttcacagatgaaggtgccttcatttgaaaaagcaactgcacgcatagtctaatggtgcaactggtcagtacactgatctgaactcggaagtttgaaaattgcacgaatcaaatgtagtacttcaaagcaagtgcaggtaagcagcatactttatattaaattgaaacaatgataacaaaaatcgcatgttcacttagagcatggtcaagaaaatgccttggatgggtatgacttacagagtttccaacagtctttgcagacagcttgccagtagaattttgaacttctacagtttccacattaagacttgtgtactcaatgacaactccaacttttggaccaccttttacagaaagctacaaggaagaaaaaactcaggacccaaaaaaacaaggacagtaataaaatcagagaaaagtacaaatagttgacataacacagaagatattaatggttaccacaaaagaggcacccggtgtgaggtagatatactctggatgtatttgcagtggtttgtacacttccaccttgacaacctgactcaaaactctttgaccagagtattgcttagcagtgacctgaagagtaaacgtagtaaatgatgcaggccaaataagccactaaaagtaaacaaatatccaccatgaaattgtcaacttacatatagagatgttgtgccaattttcgcagctttaactgaaaattttggtccgtccagcaactcatgtgaattaataagttccaaagtctcatcaccaagatgcacttcaattcccatgtatttgtactgcaaagaagacataaattggcggagtcatggatatatagtgtttagtgataacaaatctgtcaccgacaagatagcttgaaacagagttaagatagtgtatttggtatatattcaatacaggattttatgagcaaagaggaactatagcaacactaccaacagctaaggttccacagaaacttaccaggaaattatcataaaggatgaccaaatggaaagaaaataaaattttcacaataaggaatacaaagacaacactaatacatgcaattaatgtgtaaagatctgaaatacaagagcatggaggcatgggagggacctgagaatctctaaagacttgtccatcttgcgttccagcagaaatatgaaaatcttctgtgcttccttcctataaacagaacaagaagataatgaaaaaaataacccagagatttagcatctgagaaaactgatcacaagagagggaaagcatatctccataccataaggctgatgtgctcttctgagtttatcttaatccagtcaacatttgcaactcgaacctgccatatcgcataacaccaaaaatagctattatcagttaagtgcaatggactataaggaagatcagtacaactgtatttctaagaaactaggatacaatttgttgagttcatgtgtccatcgccaacaggtatataccaagagctttccttatcataagagaaatcataaaataaagatgagatggacgacaggacaggacatagctctggggaggtcaacggctgttatgaccaaaccaaacatggcaagcaataagatcagataaaaggcacttgtttcacataagtaaaaagtggaacattgagaaaattgagaagaaagtaccaaagaatcagttaatgctctaggagaaaggccaatgtcctggattgtaactgtagcagtgcccaagcctctagcaccaagaatcaactgagaacatagtgcctttcctggatgttgaagtatttgcaccacctgcgtgtcattgctagaggcatctaggaaacatgttccaccactaacagctaaggtttcctggtacaaataaattaggcagaaacaaataaggtaatttgcatataagtaggatcatgcaaaggaactataaaatgttgcagttacatacctgtgcttctggatgaaaaactatcaagacataatccggagtgactcgtaaggaagaaacaatctgtttgaagtccataacgattaagatgaaagctatacgcatagaagcataatagctcaaaataaatcaaatctgattacctgcaactgaatagcatcggtgagagtatcacgtgcgctttgaagaaacatgtgctcttcttcacgggtccggccatccactcttgaagaaaagccaatgactgtagcacggacagtgcactaaaagttcaaaaattgaaatagttaaaagagagatcgatttttagccaaaagagggcatacaattcttaatgaaatgtccaggctcctcaaaacactgtactattttgatttttgatatacaaccatggaatggctcgtataatcaacagtacggttcatacacctatctcaatatcagtgtgtgcacatgtgtgcgagcacattattgcaaatgaagataacaacaagcatttaataatagggccattaaaataatgcaaaaaaaagaatttcaaaacaattttggagtggacagtctgtgatgtaaacagtaccgagtactgaccattccagtagaattctgtaggacaagaaatctctcccagaatgagtcatctaacatgtctttgttttggtcaaagtagcaagtcctcacatcaagtgccttcccaactcaggcaaagagaagaagaattggcaaaaaatcttccatttccatgtacaccagcagcagctagacgcatgtttcttccatttgagattacaacaggtgatgcttgcagtctattgtgcttacgttcagctctgcttgcagcttccaaaataacaagtcggctttctgttcaagtgtaaaatatgatagctaataagttttacagaatggagacagcaaaataatatcatcatggacatgtgaatttatgaattatattaattatccaaatgacagtatagtaccattttcattcgcgatcaatgttatggctgacgggaagtcacaaacaactgccaactctgattggcttacagcaggcacaggatgatcttttccaatcatgtttccacgtgagaacagcagtttctacagaagtacaacaaattgaacaaatatatggaagcaacaaactagaattaagaacatactgtacagcataattgtaaacatatgtgaacataactattgacaggaatggactggattgatcaaagtgcaaagttgcattcaaagtacttacaaagttccctttgcttgggcaggatactcggtatagcctactggataatttttgtacagcagtagagctaacaacataattttttgattcaccaataacatcaacagtttcaacaaaatcgaccagttgatcccattgttccggccctccagagagaaatacatccatggttgatccaggaactaagtacagctctttgggagaattgttaaccatattctgaattccactatgtattctagataagtcaacccaatagccaccaaatcggttcccacttcctgcttgaagtaccacaagaggatagtatgcagatattttagaagtggacttaagaaaaataggtccactaaaaatctcagaataggactctgaatcaaaggaaaatgttgcaactagtgtggcttgaccagcagccgacgcatttagagatacccaagcacaaggattgccatattgtgcccaagaaccagcataatgctttaaggtttcggtgctcaaagcatcagctgtgccaacaactacaaaagattcattctcagatagtaggctccaccttataaaagcattaaggcaatcacatcgcgagaatgggtgtcctgcagaaatattaatgctcctaatggttattggaatgaacaaaatagttttcagaacaaagaaaatgagtttaattgttaaaacatagaaagaagttatagcaaatgattcttgtcacgaaatatatgtttcttttcagttgtcaaagcaacatatcagtctctttgaatttcgagtaccatgagaaaatagtatgagagggctcagttggagagaacatatgagaggatttagtaaggtaggttagagtgtggggggctgggggtggttattattatcaggagagtcaatggaaagtagtttagcattcatatatcatattttgtagaatgcatgctacttgctaaacttaaatctatgtcataagggagataatagccaatccaggacatgttagtcaccattagatgttttcaacgtcacagcagcttgaagttgtgtcccgacaggcacttcaacaggaaagtttggcaagatagcctgtgcagaaggagtggatacttcaacagtgacctgcgtgatcaagcaaacccaatgagctgacaaaagcgagaaagaaattcaaacagatggaaggttcaggtaatacagtaggtagtggacttgaaaaataaaataagaaaaaaggacccgcatgagcatgaactacagggtaggtaaccaaaccctaacaaacttttcacactacttagaccaataacagaccttcatgagcatctatcaagattagcggtgcaacaatcccaatttcccaagtcctttggtaacaaaccaaatgggtattgccaaagcccaaaagtttggcattactaaatcaaccaaaacgctacacattatgaaactacaggtaaaaaaaaaaagaagatttgaataagcagcgatttgatcacgtgagtgcgtggataagtgatatactgataccatatgcaagtgtagagtttttgcacatgacatagtgcaaatacatggtagcatcacatacagcaactcaacaaaggtgaattgacatgcgagatgcaaatttccattcaatgtgatcagactcatcttgcatgatagttaaacagaagaaaaggtgtcaagcgaatattttactagagaaaagtggtaaaatttaatatacacatcaggatataccatgatgaataaaaaatcatgcattccttcaaaatcttttttccatcatttataaacctaatactaaaattggttttccactttatttaggctaaaggtatagcagtatgtttgcatggaagaagcactttctttcctgtaagactcgtataacatataattgctagtaaaacagcatttcagataaaatccatcacccaggcaggtgaattatacaaaaactagcggaaagagaggcaaaaggattatttcttgagtttaaagtttttgttctaaaagtaatataagcctaacagatcacaagtagctcagtgctacatattgggaagtgaaataattaaataatcttgctagtggcatcactcttcaaatcttgcagaaaagaggtagttgtgtgcttgcatgttattcatcaaacttcagcttacattttcaaatcaaatagattacagataaggagttcaggaaagagaagaacaacaaaaggatatcaagaaattagattgtggcatacctcatcaaaatttaaggcatcaaaaacagaaactactttgatgacagctcgaccaggcctttttgtgcgcacaatcagtgagtcggacacagaagcaacactttcatcagaggaagatagcttgtagtcctccggcatcttgccacaaccttcagttgaacacaagataataccagtcaactcaatttacaatcaaaaggtgggttaagacttaagagtattaagacatcacaacaatcaacctccaactgccttcagttcaacttcctgataagctccaggaacccagggaagatagatagttctggaattatccatttcttcatcccatatggctttcactttactgcatacattaacttcttgttgaagcttgagaacctagcatgaaatgcttcaatcagcaaactatgatggtttataaatgccaataccatcctgacaaacattacatacaagtacagaccaccccaaaaaaaatgacctagcagacacaagcatggaatgtagtatgtacctttgctggtccagatgcctctgttcggtaagttaaaaaagcatctaagtatccttttcccttggaaattggagttagtaatctagatgtttgcacttcgtaggaacctgcagaactgtctggaacctgtgataagttccagaactccacagtactgctcgccaatttaagctcattttcctaccaagaaaattagattaaataaatagaataggattccatgtagataacaacgtctacatgaagaaacattagacccataatcaaagtgctttaacattcaatatagaagttagtttcattttatcaagataggggaatttacccacatccatagcttacttttttatgtcatagaacaaccaagtgaataaagctgtgtaagagtgtatatgcagcaggagcatgtaccatgcatgggcaccttaacatggattcacatgccagtgtagagatgaatggatctaaagacaaatagtatagatacaaaacttaatgtaaaaaggtgtggttgaaagatatgaaggtaatcactgcaacacagcactgtatgcatattcaaatgaatcgatgtgtaaattttgttcttttggtttttgtgatgcttgaaaatatgtgtaaatattttgttccaagttccaacattacatgttacatgatgcatcagaagatataagtaacaaagacaagaaaccaaatacatcggacgaatgatacctcagtaataaacatctccttgaaatcaaatccctcagcaaaagctttagcaaggaccacatattttcgtccaggaaagacataccaaacttctgaagatggaatacttgttatcccatgaaaatgagcagagtcgtccacaaccggaactagataaaggaagagtgcttgtggaataacaacatgtagagatgatacttgtgcatggccagaaacccttgtgtcttcaacaacaatattagtaaatcccaaactcaaagcatgtaagacacccaaggaactatccacttgggccacagaagagtttgtcacatgccaatgatgatgctgtgatggtaagttaacaactggtgaaaaggaataaagggagaggatttgttagctttcagctgcaggctgaaataaaggaattgcaggtagatagattctaatagtgagaataacaaataagaactccatatggtttttctaaaccgtttcactgtaaagcatagcataatttgctagttgtgcttctctttttttatattgcttcaatatatgacatgggtcacctgaagctgaagtttaactttctgttgcatgaactctggctaaagtttggtttctatacttagagaatgtcttatgaacaagactcaatttgtttgaagtaccttggggaactttttgtcgaaaaaccttgagtttgaactttaccatagcaccgacggtcacaaggactggtgaagggggctctagtgacatagcttcagcaacagttaaagtgattgtatcattcacatgttcaaactgaggttcaaataactgggcattaacaacctcttggccaatctcaatgcccttgaccacaaataaatctgaaccaagattctgcgagaggtatcataaaagagtatgcattttcatgtaactgcttatcggtaaagttaatgaaaaatgaggccatatttaataacagatatacataccctgtcttcaagctcaaatcgtatattcatatcaccacaaaagccactgcagtcacttaaatgtgtttctttcaatggaatatgaaccagatgatggctattagtatcaacccacctcggggtaagctgccacaggaattgtaaccccaccaatgatgagaacacattgtctgaaccaaaaggaaacaaactaagttacaacaagagaagaggattctacagctattagaatagctgacccaatgaagtactagagactagagaaactatgctattgattgtttcagtagaaagtttctagaccaagaatagaataggttacagttgagaaccaacgtaagaaaaaggtaacggacaggtgatggaatcaggaattccaatttgtgcacattgaaattcatgaatatgtggaagtttacggcaaacagtaagaacagtgatggtccataagcatagcacgagctagattgacatattcaagcagtatcaaagtaacaagtacgagttagtggaggtgggaggcctaatggaattttctataacaagagctcatccatattctgagaaccttaaagaaataaactatggaaaatagctctttgcaaacatggaaggctatacgaattaccttcatcatcaaaggcatgaacacgcaaggtggcaacttcatctaggtcaatttttacagcatgatggaaaatcctgatccgagagattctgtcaacaaaaactttgcaatgtattgtgattccactaataatatcagtggcatagacagaagtttccttcctgccactgtaaggagcaattgatgccaaacgagcactagttgagcatctgctgctgtcattgtactctggtttaactgaaataatatcatggtgatcccatgccctgtagatatagaaaataaataagcacgttaacctcatcacattgtgaaactgagaaaacaacaatgtcaaagcatagtagcatggtcccaaaacagttcccaattctgacatccttctgcagcaagatgcagacatacacgaagaattaaaacccaatggtgcatcagcattagcagaaatctttttcaagtttatttgtttcaccataaaacaaataacacaaattcatgcacaggtgacctgtaaattccaaacaagtggcaggcaaccgccccctgatcgaaatccatggaccaagggtgaagcaacaaagcatagataatgtgaaggtgggcatggcattttctttaccgcagtcacttctaactcatcaacagcgatttcaggttacagcaagcaaaaaaaaaaggggcacaaatgcacaattaacttctcattacttgccacgcagttaattatccgaaacga

SEQ ID NO: 43165 - DNA, 3927 bp, Oryza sativa
caatgccatggtactaccacagtcacattccgacggtaagaaatgacgccacaaaaacctgccactagctgcagagacgactacacttggatccatcccataagaacaccgaaatgtgcgcgcgcatcgcgaacatcaaacaaacaaacaagcaagcaccaggcgaccaataaaaataagaaagaagaggcgagagagctgcggaagtgcgtataccaggtgaagcagccgtcaaagccgatgaggcggtgctcgacgggcttggtcatccgcgggggcaggagcacgctcaggtcagccatgtggggcccgcccaccggggaagcggccgcggccgccgagaagcacagcgcagccgccgccgccgccatcatcacgaccgctgccgccaccgccgcgaaggccgacggcgaggccatcgcgggcgcaacgctcctggactctagaaccctagccttgggtagaatacggagagggggggaaggagggtttagagggggaggagaggaggagcgaactgctcaagcgaacaaagcaaaggtggctttacagacggcggagtgagagagaagaagggaaggagagggcgtagagaaaaaaaaaaggcgtagtacctttttattttgcttttgattaaaatttacttttatcacatttaattagcgagcgatgatttactttgtatcacttttttactaatctttttatactttggacaggatgagtttgtctttgttttactatggaccatatgactctcttctaaaacatatgaacgatctcgagtatgtcggctcctactcgtcaatgaaggctatatttggtagggcttcaaacttctatagatagctacacgaactctcatagctatatgtaatactattttttttagcatatgataagttggatgtagatggataaaaagttaatggtggtccaaagtgttacaaaggtaaaaatacccggtataaaagtaaaagctttggttaaagaacagtacaaaacaaaacatccataataaaggttggcacaaagtgaaatttaccatttcccttctatattttccatttagttttgaaatcatgtggggaagacttattaattaagttatatactagaattaatttctcgacgcaataaataaaacattagaattctgaataaaaatgtttacgacggagtgggagatgataaaaccccaaagaaaatggtttatgtggtgtgtactatttgtgttgggtttctcaaaagaatgtaatatgtgctataagacacaagactatatgtttattttaccatttctctagattttactattaattttccttcaatacataataccatataataaaaattcaaaggcatactcttaaatttgggggttttcttgggagttcatgggacttttgttattcctatgaataacacttggatggtaacaatttggcaacattgataaaaagtttctcatggcaaactttcccttaaaaaaaaatattatcatcaaacaaaacactaacgaccacttacactcgatcgatttggttgtgagacatgatttttagcatgtccaatgttgtaagagcgttcgatatcctttatatgggatggctactataggacagccctttaaagtcctcaatgggtggaaatggctaaatgaccagtgatatcatagccgatagaaattgaaactatccaagttgatggagatttcacgtaagatatagtttgccatgttacgttgttttgtgggtagggattcagatgctttgtgcaaccatgttctatatacaatatatgtattagacacatcaagtccgagtagtatcaaaccatcttatatcaagagtataattggatacactgttatttttgtcatggagtttgtgaagctagataagaaaaaaaatataacttatttaccgtacaattgaaaaaaaacaagtatcaacataatgaataaatatacaattagattagttgtttctctactcaaatatattctctttgtcaatagaaacatacaatattcatgtattcatgtgagtacacgacatatcgatggtgcataaattgaacccatttgaatcgtagatgcaaaaggataagttttagtgaattggccattaaaggctttgaacaacatttttaattggagatagagcagatagtgagttgttaacccacccgacccgcgttatacccaagtgaagtaacccaccgttgaagactcgagggtggcctttgttgagccatgtcgccgtcgcaatcatataagcccaaactctaacggcctatttggttggagggagtttttaggagagattgggacttgggagtttagaaggatgaggctattaactgttttgtttggttgggacacatgtgaattttggtaggatggggatggggaactgaggaaggaactcccttcttttcaatacctgggtaggaggaggtaattgagaggtaattcctcctttaatttgtgtaaacaaatctcagccatccgtttttattaatgacctaatctctgactaaactaaaaatcaaattctcatattaatttcaccgtcaattctctcgtgtaaactcccaatccccttctctcgagttaccaaacaagccataaccctattatcttttgtaatacagacacgtggtattgatgtgtcaatgcagttagactcggaagaggtcaatgttagcagttagattccgaagaactataagaaagaaacggagtacactatggagtactagtacagactactcctacgtacagtcctgctagtatttcttttagatactccattctccaagacaacactgattgtgaagtagtagatcgtttcgtggagtactgattatatatgacccgaatcccccatataggaatacttactcggatcctccctcccttacaggaattaattagaagatcgcgatgatgcacatattgcacaatgcacatgacttgtacagccgatcactaaaagtcaacactaaaaaacaaactacagttaaaaacatcaaaattaactcaaaagctaatgtgtaaatcttaatttttgactgaggctgacaagatggagaacaactgaccgggcggctttgactagctagttaattttctgaaaagcgaatataattcactctcctgcggtctattctatagaatcggcggcgtagagaggatagttcattgcaatagtgctccccttacccaaattcacactgtcagagtaaaaagtcattccgcaaaacaaaaacaaaaacccggccagcacggggttcgttttttcattctagaatcggcccatgaaactattaagaagcgtatagttagaatgcaagtataatgattgaaaataattaatactacctccatattttaattccgttgactttttaaccaacatttgaccatttgtcttattcaaaaaattatataattatcatttattttattatgacttgatctatcatcaaatattctttaagcatggcacaaatatttttatatttgcataaaatttttaaataaaatgaatggtcaaacgttgttcgaaaaaatcaacggtgtcatacattaaaatactggagggagtatatttttatgacaacaaattatttaccatgatttattaatggtaattttttttgcattcataatatgtttaacgaagtttaaaaaatatatattttgtttatcactatcttcaccactgcacaagtcattcattgtcttatgttccctaccggagaaacatccaattaaaggttgttagctcgtctcatgcacggggtgaaagcacgatgacgagccacgggagagggggccgggccgtgagtgtgactcatgctttctccagcccagcccagcccagcccagcccagcccatccttcttccgtcctatctt

SEQ ID NO: 43166 - DNA, 1404 bp, Oryza sativa
gcgaattcgataaatttcaacgaatcggcagacaaacaggagttgttatgttattatcccacccgagccacgttatactacccaacaagtgatgaagtaacccactcctcgaaggcttgtgttccgccgcgtcgccgtcgcaaccgaatcgcatcgcatcgcatcggtccaaactcccaaccggcgacggcgaggccgacgaaacccaaacccagctaagcttccctcttcgattccccccatggacgacgacggcgacgccgtcctctccgacgtcgacgaggaggaccctctcccgcccccgccccctccctccacctacttctaccaaaaatccccatctccttcacaaccccaaccccaaccccatgcgcaggcgcagcgcctgcacgacctggccgccgagctggaggaggagcgccgcctccgccgcaaggccgaggaatccctcgccgaggccgagaagcgctccgaacgcgtcaaggccttagcgcagaacgtcctccgcaagcacgacgacctcaagaccgaggcctccaccgcctcctccatgctcacttccggcttcgagaggatctccgccaaggcctccccctccgccgccgcttcgcccgcgccgctccccacttcccaaaagtactcctccggcctccccgccatcgcttacggcgtcctcaagcgcgccaacgacatcgtcgatgacctcctctcccagatcgacgccgccaaccgcgaccgcgacagggcgcgcgagcagatggagcaccgcaactaccagatcgccatcgaggtctccgagctcgaggcgtccctcgcgtccaggtccgcccactgcgactccctctccaagtccctctccgacaaggacgccgagatctcggacctccggaacaacctcgccttcctggagaccaagctggacgcgcagaggcccgtgctcgccgaccagatcgcctgcgcctccaaggtgtacgacgagatacgtgaggtggtcaagctagtggacgcggatgccgcgagcgcgctctctgactcggtgttcgtctggaaggagaccgacgtggaggagagcctcaaggtgtccctggaagggaccaagatggcgtacgatctcgctaccactgccctgcacaaggttggggcatgggttgataaaaaggaaagcaaagtgagggatttggaagcgagggtggatgagctattgcgggagaaagagcacattggggtgttgctccgcagcgcgctgcaatcaaacaccagcgaggtgctcaaggttgctgaggatggactaagggaggccggaattgaggttgggctcaaagagcgcagggagcacaggccagggagcatggagaaagatgaagtctataccctagtaagatctttgtaatgctataatgttgc

SEQ ID NO: 43167 - DNA, 2435 bp, Oryza sativa
  unsure (1)..(2435): unsure at all n locations
nnnnnnnnnnnnnnnnnnnnnnnnnnnnnnnnnnnnnnnnnncaagaagaacgccaggtacatccatgactttaacaggaagaaaggcatgtcctacaaactcggcctcaacaagttcgccgacttgacgttggaggagttcaccgccaagtacaccggcgccaatcccggacccatcaccggcctcaagaacggcaccggctcgccgccgctagcggctgttgccggcgacgcacccccggcgtgggactggagagaacatggcgctgtcactcgtgtcaaggaccaagggccatgcggtacgtacctacgtactatacatgattacaattaatcttaatactccctccgttcctaaatgtttgacgccgttgacttttttaaacatatttaaccgttcgtcttatttaaaaaatttaaataattattaattcttttcctaccatttgattcattgctaaatatactaatactaaagtttttgaataatattcataaaaaatcaaatgtgtcaaacatttagggacgggggagtacaattatacaaatacacacatgttatttatgcatatatacatatataggtagctgctgggcgttctccgtggtagaggctgtagaggggatcaacgcgatcatgacagggaacctcctgacgctgtcggagcagcaggttctcgattgctccggcgccggcgactgctccggcggatacacgtcctatgcattcgactacgccgtcagcaacgggataactttggaccagtgcttcagtcccccaacgacgggggagaactacttctactaccccgcctacgaggccgtgcaggagccctgcagatttgatcctgtatgtaattcattaatttaattgtctcaacatattatatatatgatgaatggactgataatacagtttgtgtatatatcgtacgcatgcgcagaacaaggctccaattgtgaagatcgacagctactccttcgtggatcccaacgacgaggaagctctcaagcaggcagtgtactcacaagggcccgtatccgtcctcatcgaagctagctacgaattcatgatctaccaaggggtaggctatactgctgtttgtttacagtacttctccctctatattttaatgtatgacgccgttgattttttaaccaacgtttgatcactcgtcttattcgaaatttttatgcaaatataaaaatacttatgtcatgcttaaagaacatctgatgataattacataaattttttgaataaaacgaaaggtgaaacgtttatcaaaaagtcaacggcgtcatacattaaaatacttgaagtactaattaattttctcccaaatatatatatatatatatatatatatatatatatatatatatatatatatatatatatatatatatatatatatatgaccagaatatatttacattatagaaaatgtggacacatgcatatagaaacatatgtagtcatgtattaataacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgtgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtttgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcagaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagc

SEQ ID NO: 43168 - DNA, 4274 bp, Oryza sativa
ggatatatatactaactactaaattattgcacattgatacatatcgtactacatatattaactataattatttatttaattagggtgtgtttagtgggccatccggaactgagttgaaccacgcggtgttggtggtgggttacgacgagacggaggacggcacaccctactggatagtcaagaactcgtggggcgcaggatggggcgagagcggctacatcgcatgatccgcaacatcccagctccggagggtatatgcggcatcgccatgtacccgatctaccctatcaagagctgcccctgccccatcaccgccgcttctgctgctgcttaaatcatccatgatctgtcgtcgtacgtcttccaacatatataccgtaaatgttatagcacgcgtgcataaaattatctgtggaaataaataaatatgcacgcgtcgcgtggatatataattactactactacgtacgtgtagacgaaataatatgagtgtgcatgtgtacttgtgtgtacctatgtgattgaataaaatagagctctgctcccgtatatacgcatgcatgtgtatgtagatatgcttgcttgacaagcggcaattaatataagagctctgctagttaaagaattacatatgttcttttatgttctatttaatttcggatcggactacgtacgagctgtatttatattagccagaactgtggcacagtgatgcaaaactacttaaattgtaagtattttaacacctacatccttcgtctaaaaaaatcaacttctaattataaatcatggtcagaaattagtcttgttatatgaaggttcactacgttaggttggatcacctctaactagctcaaaccctcccctctgatgggttcggccctgataaaaaatgagtggttagtgataatcctactcaccttactcacctctaccaactcgaggcccgttagaggagaatgtcgcctctaacggatcgcaacaaagtcgcccgttggaggtgactgtcacctcggacggctagatagggatacgaaagaacccataaaccttactcattgccagaattccagcccaccaatatggacaggccagtatctaggagttactagctaggcctaaatgggtaaggtaacccaaagtactgaagcaacaaatataggctaaattatgcgcacgcatatcagtaccgaaggtccttttgcattattagcttgtaggaaagcttgtacagtatgtacgttcattactactccctccgtcccaaaaagaagcaacctaggaggggatgtgacccttcccagaataatgtatgtggatataggaggggtcacatccctagacctaggaggggtcacatcccttcctaggtcgattctttttgggacggagggagtagtgcttcagcaaactatctaactggtacggtgtgccacgttttttgggaacggggatgaagtaagctccacgcgcgatatccaacgtaccatgcgggtagttctattattacacccatatacggcaattttactagtaaaaagttaagaaatatatgtcgatcgaaggaataattaacaacaagagctttatttatttatcaagcacaccaacgtacacacgcatacactgctatatcgttttattcaaactccatacacactcgggtaatgtatacatgtctttatccacatgtgcgcgtgctgaatatgtacctttatttatttacttatgcacatgtgtgtaatgtatatatagttgacgatctattaataagtttcgtagtacgtactatgcatgtgtatagtgtatgtgcgtgtagttgtacgtacatgtatagctcagttatatatgtatattgcatggtaggttggctagtaggatgcgatagcagttggggtttttggggggcagggacacttctttataggatatgtggcgtgcgtggcgatgccacataggccatctggggttcccacgtcacgtttcatgcggatgtagccgctctcggcccagtttgcgccccatgaattcttgacgatccagaattttgtctcgtagtcacaccataccccactaccagcacagcatggttcaacggtggtggcgtttggcaaggcccagtgaacacgccctgcatccatgcatgcacagtgataagttcattttcagcattttaattaaatttcactcgcgaattgaattaggtgaatattattggtgagagagataatcgctgaccccttggtagaactgccacccgctggcgtcgagtgccacagagatgggctgctggtagactttgagcagcagggcggcctcgcttttgttcacccactttacatcgtccaccgtgatgatgggttgtttgcctgccaccgttctgcacggatgcttcgtggcatcgtaggccgggtagtacggttccttcccgcaccgatccagggtgatcccgttcttgacgatgtactgctgcgcctggtcgggccaaccgccggagcagtcgccggcgccgaagcagtcgagcacctgctgttccgacagcgtcagcaggttccctgtcatgatcgcgtttatcccctccaccgcgcccaccgccgagaacgcccagcagctccctttgtaattaattagttaatcccattcattaattttatcaaacaatttattagcatgttttcgtaattaagtgaattattaaacatgttatacgtaccgcaaccgtcttggtccttgacatcagtcacagcaccatgctgcctccaatcccacgtcgccggaggggacacgtcgccgaccagcagctgctcctcctcgatcggcctcgcttgcagcgccggcgccggagacgccggtgtcgtctaccttggcgccggtgtatttggccatgaactcctcggaagtcatgtcggcgaacttgttgaggccgagccagtaggacatgcccttcctcttgttgaattcgtggatgtacctggcgttcttcttgaacacctcgaacctgctaaccttttcggcgaggtccccccactacgccggaccaggtcatctctgacgggcccaaaccctcacctttgacgggtttggtcttggtcagtgattagtggtcactgatgacaaaatcacctgtgacggatgaaacacccgtcacagataacccatctctgaccggtatataagtcatctctgacaggttaaaacttgtcacccgtcacagatgagtcattagtgacgtgtcgtaactacctgaccgtcactgatgacaaagcaagaaatacaatttttgaattttaaacgcaacaaaaaacctcaaaaaaatattttgaattttactagccatcctatacatggttacacatcactacctacaaattcacaatttttcacgcaatataacttgtatgctacaagtgagattcgaactcaagacctcaacctccatatagagctcccttaccaactcacctactcaacacatattgactactaacccaatgttattattttgtctatgcttgtctgaatcatttaacatatatttaacaccctaaatgacttcaaatgaaaatattatcaactaaatagttatagatctcatcgtgttttataacttttacatagaaaatatcttcatccgatgttgtttgaagaattcaaaattttcaaaatatatctcactttataacatgtaaattttgtgaaatgaaaatattttcaattataatgttgtagatctgattgagttctatgactttgatacggggcatgtatccatccatgtcatttgaaaaaaaactcaaaattttgtttttaaaagtagatctgatcacttgtaatgcatgttcggggatgtaaacgatctctaatagaaatgttgttagttataaagttgtggatatcattgagagctacaacttttatataggacatgtttcaatccgaggttttttgcaaaatttaaaaatttgaattttcactcatcactgacgggtcataactaccacccgtcagagataacgttatctgtgacgtgtgttagttaaagacccgtcagagatgagtggtctcttttgtgatggttcataatactacacccgtcacagatgacatgtcatgtgtgacgagccatggttgtgacccgtcacagacgatctgtgacgggttacaagtgcaagccgtcacagatgacttcacatctgtgacgggtcctccctggtagaggatattttttcggcccgtcagagatgactcatttttgacaagttgcgttggcccgt

SEQ ID NO: 43169 - DNA, 5440 bp, Oryza sativa
gaacgggacgtcgtgagccgacgccgccaccgccatggctgcagctgccaccaccacacccagcaccaccaccaatgatttcctcatctctccgtgcatacagtatatgactatgctggattgctgatgctgctagctagctatagtagtcgattgacttctcagatcagtcgatcgagcattgcatgaatatcttgtggaaggggtgcatgccatttatagagctccatcgtcgactaatttaatcaaaaccatgggcgaattgacgacaacgtacgactatttaatattatatactcaattttctctttcagattattctcactgggattcctatctttaggagttaggattaggatttagaagctagagctagagttaggattaggagacaggagtaccgtttgagaggtgaaagatttaagagtaaatttttcacataacttcatctattatggtcaaaattcgtcaaaaacataaggttttgccacgtgccatattcccttaggtattgtggccataaagtttcacaaaaccatatgctagtactatttattattttgactttactttattaaaattttaagttctacaatcacatcttaaatttatgggttctttatataaatgatgcatcaatataagtaatgttttttaaaaaatatataggagtgtgttaaattggttaatgatgttgttttgtgaaactctagtaccataatacatggattatgtatcatgtgttaaaatttcagtggtttcgtgtaacttggaacataatagataggattttattaaatttattcaagatttaaatcaaatcatccaactgaacacgcatgcaccgatcagaatgaacatgactgttatatttcaacataacactaaatacatatacctcacaccttatcataattttgacagcccaataaccaaatttcttactagttaggttaaaaaaattttcaaaaatatacatatatacatatttgatgtatatatatatatatgtatgtatatatgtatgtatatatgtattatgtatatatgtattatgtatacatgtatatttcaaaaatatacatatatacctttacatttcgtccgtcttatttgaaaattttttgaaaaaatttaaaaccataagacacgtataaagtactattcatgttttatcatctcataagaataaaaatactaattattaaaaaagttaaataagacagacaattaaagttgggcacgaaaattatggttgcacttaaaatggaacgaagggagcagcattaactatatttagtgaggatgaactttatagatatatagaatgcctcgtcgataggttaaatctacattcatctttgatttggattttctttttagtctagatagatactcacttcttctcatattgatcatcatataagaaaatgcaccaagactaagagcaagtataatagtgagctataagcctactataagcttatgtggaggagagagataacaaaaaatcatggacgttggctctcagagcaagtttaatagtatagccaactactagctctaatttatctatagccaatctaatagctcatttatacaatagttacatactacactattaatacctggtcccacctgtcatacacactgtgtcttgaagtccgtgctacagctggctataaatttgtagcccactacttttctctctccatgtttaacttcttaaaatatgtttgcaaccggcttatagcatgctattgtacctgctctcatgcaagagctagcttaacacaagctcctaagtaaatacattaaatgcataggtgagagatagagagaggagaagataattgtagccaactttatagctaatctattatatatattggctttaagatgggctaatagtaggaagtgagctctactattatccttgctctaaggacagcacagcctagttaattctggcattaaaaccacatcgaacaattaacagtcggtttgggtctcatgcaaagagtgtcacgcctaccgtcggatgaaagtgcattgtggcatgcaaactcctttgatccagcgattgcatgcaaacgcctacacacattaattccatgcaagcatgcatacgttacgaggaggcatcagcgagattatcaatggcactagctctatgcgacgatcaatatgacatttttagtttctgctagtaggatgggaaggagggagtattgtctttaacatttttttctgatccggtctgattttgtatcagttttgtcatatatgacgtggtgtataaattaatgatgcatgagaatttggttggatcagtttgtttgcgcgtgcgtcgcatagaacaggaaccgatcgacgaccgacgggccggcctagcgagaggtcggaatcgcaactacgccagcgcggagaatatgaggacgatgcggacacaggcaagcatgacacaacaagcgacagacgaaaatttaaaggtgatgattgaagaattattattcatttttaaagtaggtttgattagattagataggctcaaacgtactctctccgtctaaaaaaagacagatctctggtttccgtgcccaacgtttgaccgttcgtcttatttgaaaaaattataaaaaaaattaaaaagacaagtcacgcataaaatattaattatgttttatcatctaacaacaataaaaatacgaattatacaaaaaaatcatataagacggacagtcaaagttgaacacggaaactcagggtttgtctttttttgggacagagggagtactacgttaacgagaagtatacacacgtacgtaactacctggggttaaggatatagcaggccaaacgggcggcccggcccagcacgacacggcacgccgacggcacggcccactagggcacggcccattaggcacggctcctgtagcgggccgtgccgtgccggcccacgtgccaaggccacggcccaagcacggcccaagaaggtgctgggccgtgccgggccggcacggctactgtagtggcacgtgggctggtagccggcccactaatacatgtggcccataaaaattgaaatttgaggggaaaaaaagaaaaaaggcagaaaaaacataatataaaggaaaaaatgataaatataggataaatgtgaggaaaatttaggaaatatatcataaaatatatggtacaaatatgataaaatgtggaaaaaaataaaaaatatgagaaatatatggaaaaattagaaaatcgtaggaaaaataaatgggccggtgggccgtgccatgcctgggccgtgccgtgccggcacgctacagtaaacgtgccgtgccgtgccagcccacgggctgaggcatcggcccaaacacggcacgggataacgggccgtgccggcacggcccacaggctggcgtgccgtgccgggcctgggccggctacagtactgccgtgctcgggccggcccggcttggcacggcccatttggccaggtatagttaaggatcgatcgatcgatatgtgttgcgtgtaggttttaaaatcgatcgatgaaggcatgaagcatatgcatgcatgcagccagcatgtgccattttaaaacatgatgcgtttgcacgtcgacaggtaacagaggcgccgcaaaacagctggccaagtcaagttgaactattttactatccttaacaggtagtacgtcaggtatcatatgttcaatatctcgatcggtacctctctccagtataaatttaatatatagttataaatttttgcactaaaatttttatgttttttaagagctattaaatttctctaattaattagggtatacttcactgtactgtgttaatagagtcacatgattcatcaaagcataagcgaaatgaactaagtactcccaccgtcccaaaataagcatttttagaatagtgacaagtcaaactttttagatttttactattaatagaaaaaaataaaaaacattaatcatgtaaatttgatgttattatattagcattaaacgaactaccataatatataactctttttatttaaaacattttacttttatatatattatcggtcaaagtagcatctcggagaccttgttgaggtcaaaaatactccttccgattccataatttttaatattttaaacaaggttaagctcaaaattttattctttttttgactatcaacaatcttaaaaattattcgaaataaaggtactatataacaacatatataaatttatcttacaaaatactataataaaagtaaaaatatattataataaaaaatataatcaatgatgtaatttaaataccatgtcattatccaaaacgttaaaccttataaaaccggaggaaacagtacaagttctatcatgggtgatatggaatcggggaactagtatagtttggcagttcactactaccaggatatatatgccaagttcccgagaaaaaactcttgggaaacagcctaaatttccctgggtaaagctgtgtttagattcaaaatttggatccaaacttcagtcattttcgatcacatcaacatgtcatacacatacagcttttcagtcacatcatctccaattttaactaaaatctaaactttgcgctgaactaaacacagtctaaggataggtatctcttgcggatagatttcaaaacctatggacgatatggtaatatagatctctaaactgttgttacaaagttgctcttggttgtacctgtcttttaattgagtacggtacggtatatatgttgggttcgcattatttggtcgccatttaatttgcagtcaaaagagatcgatcgaggatcatgccaatcatgcgtgcatgcatctacttttcaatttgctttgctaggacgatggagacccagctttcgctatccgcctatccgttacaaaaacacattgttttggaaagtcaaaaactccagaaaaactttcagtattaataatactaccttttaagacatttagattggattcatgatcaattcatagatattaatttgtatacatcttattataataatatactgaatatgtatttcatagatactatatatataattcgttgagatcacttgtacatattttaatttgcaatatacaaatatagtggtcaaaatatgtattgaaagaacgtaacacatcggtaattttccctcgaaaaaagaacacatccgtgtacgtactcaaaacgacatattttcatgaaaagggagcgcaatacgcagtactcgtgatacagcctacaaggcgatcgagtattaatttatttctgcacgtaatacgaacgttcgcaggatggacgtatgtcagcttaatctgaacgagttaataatatataataattaattaattgatgatcacttcgatttgtatttctactgacttcgtcattacg

SEQ ID NO: 43170 - DNA, 2423 bp, Oryza sativa
cctgccaaacgacacaaatgtattatgggtctgtctagtttttcaagcatatgaaaatgggactatctattgagctttcgacagaattgtagtttagaatcttgtaaaattttcaaccaatgcatatagcccgttttaaatgaaataactaatagacaaacatgtcaaaaactgtaaatctagaggaaaaaattgttataaaatcaactttggtgcactgtaactgagtgtatgaaactataagttgaacatacaagaacatgaatcttgatgcaagatcatatggatgaaaaaagtgaaatataggagccttatcgcaagtaaaattacaaaaccgtatgaaaacaccataaatttatggttacatttttagacaactaggattgcgtcgaaattcatatgtaaacagtagagatatcatttccactccccaagcccctctccaccctgacccctacccaaaacctccaaactctaaccttcctaccgccacatagttgccgaagaagagctcgccatctagtcaccaccgcatgaaagtagttgtcatcggtgagtcaccccctcctatttctcccaaatccaaagctaggttaaaggtaactaaaattcaaagcaattttagtgacctaaacaagttaagaatttgcacgtttgttattagaaagatgggtactccctccgtttaatatagtaaattattttagctttatcttaagttaaacttatctaacgtttaccgggtttatggaaaatatacccaacacctataacaatatatatcattaacaaaatatctttgatgggtaatttaataataaaattattctgatcttgtagatgttggtgcatgctgtcataaactcgatcggtcaatgtttaacaaaattgacttagaaaaaatgatttcttttctaaaaataattaagaacacggccctctcctattcaaaccagatgtacacagccatttggacaaaaacaaaactaaggccctgtttagttcgtgaaaagaaaatttttgggtgtcacatcgcatggtttaccggatgtcggaagacattttcggacacgaatgaaaaaaaactaatttcatagctcgcctataaaccacgagacgaatttattaagcctaattaatttatcattagcacatgtggggttactgtagtacttatggctaatcatggactaattaggctcaaaagattcgttatgcgatttccatacaaactgtgcaattagtttttctttttatctatgtttagtacttcgcgcatgtgtccaaagattcgatgtgacgtttttgggaaaaaaaatttgggaactaaacaagtcctaaggggtgtttagatctaggggtgtaaagttgtggcgtgtcacatcggatattatatatggtgtcgcatgggatgttcggacactaataaaaaaaaactaattacagaatccgtcagtaaaaccgtgagatgaatttattaagcctaattaatctgtcattggcaaatgtttactgtaacatgacattgtaaacacgacattgttaaatcatggagcatttaggcttaaaagattcgtctggcaaattagtcgcaatctgcgtaattagtttttttttagcctatatttaatattttatacaggtgttcaaacgttcgatgtgacatgttaaaaaattttagggtgggattgcggaagggaggaaggaaatagttaggagtataagttacttgggttggagttggggctacgctggaatactggggcaggaaccacagtgttctcttgatcatgaaggtccattcgaatggcagctctgccattggcgtcgccgcatcgtcgtggaaggagtacttgtacacgtggcacacatccggcattgtccaaatgacaaagtaggcgcatccgccgctcacctcgccgccggcgccgaacctggcggcgtcgacggcgaagctggtcgggcaccccaggaacagcgcgtgctcacccagcagcctcccgccgtccgccgccctcacccacagatgcgccagctcgtcgccgtcgccggccgccgccgccgtccccagcgtgtacagggacaccgacagcgcggcggcgtcgatctggtaggcgctgctctgccatggaatctcgacgcaggcggacatcagcttgccccgaaactcgaaggtgtacgtcgatagcagccgcttgtacaggaagccataatcaggcggccatcttcttgtcctggattccactactcggccgccgccgccggcgtcgtcgacgagcaccctggcgacgaacgtctggtacaggtcggcgaacacgacgccgccttggtgatacgtggtgcagcagccgtaccccaaggcggagtaattcatccccttcgactctaccgtcgtccatgccgtgtcgccggggcggaggatg

SEQ ID NO: 43171 - DNA, 2456 bp, Oryza sativa
ggcagcagcgcggggcattggggctccgccgccggcaaccggaccatgtcacgccatgccgtgcacacggtgtggaagcgggacaagtcgacggcgtcatggagttggccggagatttcccggagcaagtccggcgggaggttgggccagccgcagctggacgagacggcatccatggacgtcgaccagattagatcagatcagatcagcggctagcgagcgatccaatcaactgttcatccattggactgccctgtatgatgtatgtatgcaaaaacgtaattaacgaggacgtactaccctacatgcaacggaaaccaacgtatgatatgatcgtttcctcagataatacagcatagcctgatgaaacctaatacgacacgattagaaaaaacaatgcaaaggtgcaaacaaaacccaaaaggaataattaaggcgggtgaacaagcctgatccaataagcagtttccgcaagagaaacagcacaaatgccacacacaccatgctcttcttttgcttaaatagataaatgttagacaaaacttttggatgcatcgacaaattggggtagaggggcatcataacagtagcctacgtgcatcaactcgtggccacaaccaacagttaacaagaaaggagcagtaaacagcaggcatgagaaaggacttgggaggatacagaaccaagaatcgcaagaaagctactatttgagggactaaaccagtatcagacgtgctatgatgcctccgatgctgttaaacccccacaaagcctgctatcccattaaaagcctcggcgcggtggtcgctcctctgcaacattcactctcagcgcacggccatccaaactctgttgaattcagattggaaaagtgtgttacttgggtaagcaaagttaaaagacacaaaagttattgatggtatgagtcaattagcatcagttcacagcctccatgtaacaatgattaccagtggttgcttaatcccagttgtaaagatgtcagtgaatcgaatatacacttacctgtccatcgagggctgcaatagcgtcgtccaattcttcctgtgtcgccattgttacaaaaccaaatcctcgtgaacgcccagtttctctgtcatacacaactctggcgtcgactactttgccatgctcgctgaacagctgtaccaacctagagtcatccacttgccaagggagattgcccacataaatcctgaaagaaggcccaaactgacggggaggtctttccacccgagcgcctctaggagctgccttgtttacagtcagaagcctcccatcaacatcctatccacattaaaaaggtttatcatcaaagcatgaaatctgtacattctttacatcatactaccatacttttaaaaatttagtagcaacagaagaacaagttttaagaggtctgtcaaagaaagttaaacatagaaatcacagctcttacaactttagaattgttattcctcatagtcatatcagtcaataaggatgacatatgcctaatatgaccctccctttctttttcacttaaacattatagtgtacccttgaatgagaaactaagagaaactatcatgtccatccatgatcattcagaatgaaacgccaataccacaatgccatagttgaaataaggaaaacaaatgcaaactgtttgaagccagttacatgcatactgcaagtacagaaattactgtgtacacaatgaacatgagctgtaactaacataggaaatcaggttatcttgagcttcaacaaaatgaagaaaatgttgaggggaaatagggcaatttagatagagagagactcacgtagcgatggaacatctccacagccttctcagcctcctcaacggtgctcatggtgacaaatccaaatccacgactccgatctgtttctctgttgtagatgacctgaacacgcgaaaatagaggttcatttctgatcaaaagaacaaaaccatgcatatcctaatattttgtctaactgcctctatacggttcacataataaataaatgaataccctaaagacgggaaggtaaatatcaaaggcatctttcataacacaagtaggatgcccacagagataaataagccacagctgcccatcttgcaggttttaaatgtgaaacacaaaaataactgtaatccgcagcctaacagtaaaacagggacagttcttgtaaacactagtatcctaccagcctaccacacagatgagccagctagattaaaaattataataagtttcaacagagcaagtgaccaagcaggtaaatgaaaaataaaagaagtgcatttgcacaggagtccactgaagtactgaactgaagttcagtgggtcattttagttttgcatatgaaagagcgcggagaatggagagggtcacacctcggagacctcgacgatgccggcctgttcgaagagctgggcgaggcgctc

SEQ ID NO: 43172 - DNA, 4586 bp, Oryza sativa
agggggagggcttggggaggaaggcgtcggtggcggcgagggagcggagggacatggcgatggaggaggccatggttgggaatggaatggaagagaatcgaaggaaggggataagaggcgacgattttggggggaggagaaggttggttgggttgggttcatgaatcatgatatttccttcttctcctttcgctttccttatcccaagtccatgggcccaaatcacggcccatataggagtacgtgcatagccatctgggccgtacatattttaaaataaatcgacaaaagtgaaattaagctttgtttatataataatgttgtgacttgcctgtaattagaatagggattaaattttatactcttaccactggatcactgattagcatgacagttcaaccatgccattgctccaaaaaaaaaaagaaaaagaaaataagagtctcacaagctattggcagtgaagtgatataatgaagtaaattatatttaaattaaaatagtattctgctaagtcatcagactaggcttgcattgcctacacaaccactttgtaaaataaaaaggtttacagtggcctgcccttcccctaagaggttaatagtatctcccggctctgaaactaatccaagggctagctttgcggtactgtacattcatctgtcatttcccctgcgggcaacacaattgtacaaagtttcctcagtcgagttcaattcccagaagttgagttgaatgaaaatcatcttggttcagaaagatacctgtcctgaaaattattaggtagaaataacaggccttggaggagggggaggaagaggcatccttgaaggcgcatctgcagccagatcactgaacaccacaacacaataggaaaatgaatcagaattcagaaccaaaagaacattcctagcaggtagcaacaggtgaaaccagctatttgtatcttcagttcctgtcagatatgctacaaacctgatcctcttgctgattatggctgcgtactggctcggtatcttcttcagcgcttctaaagcaaattgttcctccttctcggtttcaggcatttctcttgacattattattttggtgaaatcaacaaactgcgaagacaaaactagcttaattatgagcaaatcctcccatataaatcaatgttgtgatgcccaacaaacacctggaaattgtcaaacagctgtcgatcctcctgacagtgcatcagctgctcatcccatggaccatcgcccactccgacaagcacgatagaaagagggaaatgagtgcatagcataagtacacattttccttactcaaattcaagtatagctatatattttaaaagaatagtaagttgcaccttatgttttttttttcgccgggctggcggaagccagccgaagtttattaatatagggaaaaaagttgcaccttatgttcagtcagtacttttagatagaattcagaaacatctaatctaattagtgttgccactatgtacctcgcctgaacaagagcctgtagagtcctttcttccaggtagttctcatcccgattgttcgcagagttagcaccacaacatcttggaacctgaggtagcatgagcaaaatacatggattaaaaaaaaactagtggaacaggtaaggtgtcaataagattctggaagaacggcaacttcttttcagaagttcagagaaaaaggcacacctgcccatcagctattatcagtaggatgtgatactggtagccggagtcctgagttattctcattgcagtttctattattggagctaaagatgtcggacctaaaccacaactcaccagttatctttctgaagaagagagatgaattcatcgttcatccttcgcaagaatgaactcgtcggtcacaatatagatacctgacagccggacacgtggcgcaatttctctgtatccccttagaacttcagaaacaccattgcaatactgtcgcctgcccgagtagaagctgaagacattttggtcgtgcgtcgatgctgaaaatcacttcatttctgaacagagaaatgcagattgcagagagaaagaactagaagacgatggagaagcttttgcttactgtccccaaatccaaaacatgggatcctgttgtcttcgtcgaacgtcgataaggtcttgccgatgatactaatcgcttgctcgtacgggttgagggagtcctctgaaatgtgatgcaggcttctcccgttgaaacaatgtttccctgaaaatttccacccgctgattaaaccatgacgtgaggcaacactgcaacaatgagaaatctcgattcttggaagctaaaaatatatgcctgtccactcattgcttttggtgaaatccactccaatgataatattggacgactcgagaccgaccttttcaagagcttccttaacctgcatggatgaatcatgcaaagataactcaacaatacacttctgagtaactggatgataaattggcaaatcatgcaaaaagttcagttcaagaactactcatacaggctgcaactgacctgatccaaggtatcatatctctgcgaatcccaggagttgttgatcctcaggttgccgatctcatctctattcaggcgtacagtccaagaataaatggtccagaacagcagcaagaaagtagaaaagaacatgccgattctcgaagaaagaagaagactgtgaagaaagagctcagcacgaagatgaaggcgtttcacagtagcatggtgagcctatatacagtaacgaaggaagcgaatcagctgaagcgaaggcgagcgattggtcgtcaggaagcttcagagcaacaactctgttgatttaaaattttagataaaagaatatggcaagaacgcgcaagggttgtcgctgtgtacgctgaaacgagtagatggtggttgccgtgaaaatactaggctcaggctgttttacaatgcttgattgcttgatgcatttttcattctttcagtcttcagacaaagtgcagctgttttgctagcactgactaattgagtagtactactgtaatctcttgctctcgcaccacgtactaattaagtataaaaacggtagtggcaggcaagaagggcagcgaattcttggagttcttcttaattgactcgtgagttcatacctgaaagaaaagaaaagtggcatggctagtggaatatgctttggtgttgtggttggctggctagtgtagtggcatgggatttatctagcatagaattcagttaagagcaatactaaaatatggtatccatgtagtaacatatgattaaaatatcaccgagttgcatgatgccataagcgtagcatttgccttgacggggagaagaggaagaaaagaaaaaaagcaatccgcgttcagtgaaagtgagacggcctgcaggacgacgacttgacctgacgagccggatgctacagtcatgtggcgagcactagaccagcagctcagaatcttgttctattttcccgcaattacctgcccggaatgtaataactttcttaatttcgtaatcgaattcgctaaagagaaagcaatattctgatgagtgagtatgagaaaaccgtgtagtagtccccccaagatcaatgccactcaaatagttatgatttttttaaaaaaaattgataaaatatattaatacgtaatatatcactctacaaatttgcaacttaaaattcatagcaacttgtgagtatgacaaaaccgcgtaatattcttttcccctgaagatcgatgcagatatatttatatagaagaggatatttatatagatgtgtgtgtgtgaatgtaatcatatgaacttccaaatagaagagattgccaaatgaaggttggtattccagactctcctctcctccttcacatgaaaataaccatcagcatcgatcatccatttgcgttgcctcgatcagctcttaacaatttgcaagttcactgagcgcatgcagtgctagacacatacagatgatcccctttggtccttgtctgcaaattttactcgcaagggacgcccatccaaaatctgcaagaagttatcatcaattcatcattcacggaagattatacatcaatcccatgtggatttacgcagcgaattaactaattaagcacatacatcatactgacctgtccattgagcatggtgacaacgtcggccggttcagcatccgctgcgatcgccattgttgcgaatccaaaacctcgtgaaaaacgtcccctgctacttctctcgcacatcaccctcgcatccgtaaccactacgaatccgtcatgcccatgcccatgcttgctcttgatcttgctcatcaagaagcgtctcagcccatggctgtctaccttcctcggcagattgccaacgtggatcctcattagttgcacattaggctcaacaacctgcaggcctctctctttgatttcctgcatcgatcaagctaggctgggttaattaattaactcgcagattatatatatagtatcactgatcattatttctactagatggatcacttttgtgcgcgcggttgggttacctcgatggtggtgggagcaagagcaatgg

SEQ ID NO: 43173 - DNA, 1433 bp, Oryza sativa
ggtggccggtggcgtcgccgggggagaggagccacggcaggaaggtggggggatggggcgggagcgtgcggcgccatgacttgcagacggcgtggaagcgggcgaagtcggcggtggcgtggaggcggcgcgagatgtcggcgaggagatcgaacgggaggtccgcccatgggggcaccaccaccaccacgtgctcttcttcttcacttgccttcgtcaaaccggccgatgcgcggcggcgcgcgcgccgtgcgctggtccgtttctttggttcgtcgggcatcgtcgccgatcgtcgagtagctaggttcgatgtggagtaggacaagtactccgtatttgttagggcgaatggacttggcccgtgggccttctccgaatttatttggtaggcccattacatttggtttgttttaaacaagatatatactagataaatttacagtttaattttggcaaagacggtaagtcttgtaccagttttacaacccaaccagttgttagaaattactccacttttgtttaaagatgaacttattgacagcttaactataatcccaactgcatgattttacaattgcaccgccgcatctaacaccctcgtgagtttttgcacaagcattaacaattttcccgaacatctacacaaattaaaaaaaatgaaatctccttctcacgttttttttttcctttcaaaatgtcgtgtatttcttcaatctgtatagatatggcacaactatatcagaggttcagatagctccatctcgttggaggtttgatctgcctctgtcggtggcaatcgcacatagttcagccccaaccattgccatggccagcacatatacctatgcccgttgcgattgctcgagtcccttctgttgtctgattcttcgagctgcctattgatctcttccagtctctctcgcagcctggttgatctcatatccgctagtttcaatgatttctctgcggcatcacgtgccgccattgctgcagccgctgtctcttccttgaacttcagtttgttctctagctccagcattgcctgtttagcttcgtctaattccttgtttagggaagatagctgtgcaacaaagcatagttagaacaaggacaacttatcagctatcggttcttctacaagacagatctcaaaagcctgtagtatgaagagcaaaaaggattcaatgactctatcaagggctccttaagattctgtacccttcacagttcatacagccactgcatagctaatggggaacagctacatctaatgccaacgccaccacagatacctagcaaatttcatccttaggcatctttaatttgttttcttagactcaacaatggaaataaccaacctgaacaaactaaaacccatttggtttttagtataatcaagcaataagaccacaccttaaccaaaaattggg

SEQ ID NO: 43174 - DNA, 1238 bp, Oryza sativa
caaccttaagagtgtacataacacgtttagtcgttggcatacaagcatcagtgtaaaataactcggaaaagaaaggtgtgataactattaaacctaaaaaaatcagtagtagaaaattacactttcatttgccaccctttccttctcttcaagatgctttatttgcttccgtagctgggcaatctctttttcttgcccttccagtcttgtccgaagtagaccagactccgcccttgaaacaagcaaagcacacaattaggataagtttaaaaaataattatatagaatcagtgcacgggctggaacaaaatcaggatattttgaagaagaaaaatgcactaggtgataagtgatagcatttagcacattgcagctcagttgtccatatcgagatgtcaagagtgttgcatttcccaatgtttcattgtaaatcgtagatattattgtttcttacacagaacttcaaaagacaaatgcttcagaccacatgtctaattgacagcaagtgtgtcttggtcttttaaaattctttgttgccatgtagttcaacaggcagcgaaagtgacaacacaataaaggaaacacacagttctagtgagtttcctgctacccttcaaactaaacttatggtacactgggagtaaacagaacaaaaattcgtcagtggagatagctaccttagtgcttcaacaagatgttgcagctcaacaatcttaacttgggactccttcatgctattctccaattcccctgcctgcagcattgagtgcatgatagataatttagttgtaccgtattaagtggtccatgaacctgcaacattatagcattacaaagatcttactagggtatagacttcatctttctccatgctccctggcctgtgctccctgcgctctttgagcccaacctcaattccggcctcccttagtccatcctcagcaaccttgagcacctcgctggtgtttgattgcagcgcgctgcggagcaacaccccaatgtgctctttctcccgcaatagctcatccaccctcgcttccaaatccctcactttgctttcctttttatcaacccatgccccaaccttgtgcagggcagtggtagcgagatcgtacgccatcttggtcccttccagggacaccttgaggctctcctacacgtaaggctccttccagaccaacaccgagtcagaaagcgcgctcgcggaatccgcgtgcactaacttgaccacctcacgt

SEQ ID NO: 43175 - DNA, 6835 bp, Oryza sativa
ttggaatgaactttgtattaccataggatgttgctgtgaagatacttatggagcaggattttcatccagatcgcttcagggagtttatgagagaggtttgtttaactttttctttgatgcggtaaaggcctttgagcttgctatttccagtattatgtttcttcattcctgaaaaatagtattatgcttcttgaatgaatggctactagccacaatgtgttgtgccctggccgtgtttatgcatttatagagcatccccatccttagtactcaccttatgagtttcttctcattgttataggttgcaataatgaaaagcctgagacatccaaatattgttcttttcatgggtgctgttactgagcctcccaacctatcaatagttacagaatacttgtcaaggtatggttgtgatgtgccttcaagctattccgttaattatctcaatcatttgatagcaagtttaatgtgtccagcaagtgatgccatttttcattgcagaggtagtttgtacaaattattgcacaggagtggtgcgaaggaagttcttgatgaaagacgtcgcttgaacatggcatttgatgtggtattgtattatctcatattctcttttttgtgacttttgtctacctgctttcacatgaacttttaactcccaaaacaagaattcatactatttaagtaatctctggttgcttgacaggcaaagggaatgaactatctacataaacgtagccctcctattgttcatcgtgatttgaagtctccaaatcttctagttgacaagaagtataccgtgaaagtatgtttcataacttatacacctgattgcagctagacagggtatgatagtatgttttatgagtgcatgagtagatgattataaatcacgttgatcttgctgaaattgtggtgtcagtttttgtgatggatatttgtgtgaacttttgggtttttgctgtactactgtactgtacacaatttttaatgcgttttaaatcttgtctttttattattattattatgttttccttgttaccttctgagcagaaggattgagttcttctagtgagtatttgataggcagctaactgataacggacagcacttctattattgaggtggggggtatttggagcttgtagtcatttaatgcaggatgcttctgcaaactcaataatatggataaatatatatttataggtcatgattttctgtaaacatatttaaggaagtacttacaaggactgctaagtgtgctaaaaaatgctaacatagccgttgacttgacatagtatgtgatgttcaggcatgtttcttttttttctcctcctcagaggttgtatctgagatgattgtgttagtgcaactattttgtggatcgctaaggtgatcgttttaaagattattaatcattatatggatttgtttgtagcagatctaatccccatttcttattcttatccacactacatgttattgaataaatcccagtatttttcacttacctttcacccttttaacttttgtaggtatgtgactttggcctttcacgactaaaagccaacacctttttgtcctccaagtctttggcaggaactgtaagtaccatttccattcttcagaagttcacccttcaatccctttttcattgaaaatattattcatctttggcttatcttgttctttttccatttaaatattagcccgaatggatggcacctgaagtgctccgagatgaaccatccaatgagaaatctgatgtctacagttttggtgtaatcctatgggaacttatgacaatgcaacaaccatggtgtaatctgaatcctgcccaggtaattattcccttctatctaattttttgtgtccatgctgatgaagtgatgcaattagtccttggtatcattcaatgcatgcataacatatttttcttatctagaagcaagtatactcctgaagttatgcagatcattttttttaaaaaaaaacttttaccattttacatgatgctatgtttttctgcaggtagtcgctgctgtaggctttaaaggcaggagacttgatatcccaaaagatttaaatcctcaagtggctgcattaattgagtcgtgctgggcaaagtatgcattgacccatctatttttgtatatgaatcaattcgcaatgacatgcgagactaacggcaattttgtctgttacagtgagccatggcggagaccttcatttgctaatattatggatagtttgagatctttaattaaggttccactgccgcagttgattcgttcagactcatagccatttgtatattgaagagtcatatcatgatttgccttgataagatcaacatggagaagtttttcaatatctgacttgcttatacttggataattctgaccacattatttggtgctaagaaaatggagtcttgatttacatttttcaagcaaaacaaaacgtacctggcaactcctgtccatggtttcaaggtatgttgctacttgcagagtttaccttcaatgtaaatatataaccaagaccttggattggtaccacatcagcgaattgagcttaaataaggttttggtttcaattgaatgcagacttgctgattagtgataaattgtatcgttcgcaaccattgaactggacagtctttgttatctcgtcatatccttcagtctcaattttatcgtattccccaatctgtatagacacattgaaaacaaacggatgagttaatatgtatcaaacggtgtctgctgtctaattagctgatccatccaatattccaattataatgtgttctaactcttcagtgcacatataaaatttgttttgtccaagctgagtgctgttgctgttaatatatctgagtgagactacagtaccgttgactttgggtgtcattatttgaatttacacggcgttgctgttttctgattctaaactgatagcattagttatgttaaagcatggcagttactagcttgttatggtctggagccggggacaggttacggggtagtaactggccagaatgatatggatttaaataaaaaatatattaatttttacatatgtaaatttagaattattctgtccggttaccggttgctggccaaactaagttctgttcagaatggcttgtttgtggtgactgtcagctcataatagaacataaggatttctatgtatagttcaatggagtgtgtgcttgcctactgggtcacctttatttaagagttcgtaattttgaccttgttgctaattgcagatctgttgatattccttgtatgaacatctggttggccaagttatccatgagatgcagcacttcacttgtctgcatcctttactgatagagatctccgactggctgcaacctttgataagaacgtcatccttccctgtgttggtagctgaatcacatattggaaatgcatgctgggaggttcatcaaacttgaggatcctgactgtaaattctagtctctcctagatgtctatgtataatgttgactgcagttagctatgatgaaagtaaagaggtttttttttggcttatgtacatgtaagtctgttacactatcctagagcaggtagtactgtacatatgctgtactagtgctcctacatgtgtattgcttgttgtaatgcactgtgttgtttcatttttactaacatgtttagtttaatgctccgtttgtactacctgtggctgtgaggcggtgcaatatttggcggataatcacaggcggaacttgtgggttcgtcggaggccaaatatttggactgtctcgttgggcggataattgtgttccttgtcggccgccactgtccctcctcaatccggcgactccgctttccaaatcccccgcctctccaaatccgatcccgaatgattccccaaggtgaaggtgagtgctactcctagataataaccccggagtcgtcggcgattgatctaataacaattactactaagattgattgatcatgggaggagatgagagtgagagcgaggagtgggaggcgttggagctcttgggtcctcctcgactacgtcgccttcatctccaactccaaccaccacggcaacgccaccaccgccaggtccaagactaggaccggccagcccatcgaggtatccttctggacggcgcctccgccgcgcgtctcctacatgtgcgtccactgtcctagattggatccctacaagttcgccacagagcccaccatcatggccacggaggccgacctcgtcctcatccgcgtcaccattggccctcgcggcaactgctttaataccaaatgcagcgacttgttcatgtactaggccaccacccacacctcgtcgttgcgcttgatcccgcaccctgctgctgtctgcagcttcttcgaccgcgaggttggcctcctccgctgtggctcggtcaggcgtcgccatgatcccacaagattgggcctgcacgcccataccggccctgacgacggtacctacatcgtcgccgtgctctgtaacacctttcaatcagggaacctggagtatgccctctacctttaccgcgccggcgcagatgcttggacctgccatccactctcccttcatggtttggtcgatccaacatcatttatccatgtcaataccaacaccatcacggttggaggggaagctggcaccatggcctgggtcgacctcaaccgtggtattctcttctgcgaccttcttccctgcccatacacccctctgctcctccgctacttcccgctaccgccaccactcagactcagtgcacacaccaagctgacaggatgtccaaggtttagccacgacattgctcttgtccaaggtcgattcaacttcacccagatgcgaattcatgtcaagccaggctccatcaccaacggcacatacatctctcagggttggactcttgccacttggagtgcaccagccaccaatccttggaagcaagggtggcgccaggattgcaacctctctgcttccgatctctctgttgatgccaacaccatgaattttcagttactgcctaagctctcggatcaccaacagggcacacctcagcaaaccttggagagacttcacgtgggccatccaacgctcagcttgcaatccaatgacattgtttgcctcatggccaaggtcgaccaatgggacgaccatgcttgggtgcttgctgtcgacatgaagaacaggaggctaaaagatgtggctcagtttggcgctgaaagaactcttggcattagcttggtctacatcagcagtatgatatcagaatatcttcgtacggctccaggtaattgtttttcgtttttgttctacttgttccttcctatttccgtggtccgtccactgctaaccatcataatcttgcctgttttcacaaatagcaaacctgcaataagttataattgacaataataccaaacctattaaattgatgcacatgcatatatatatgtgggttaatcaattggaaacatctgtttttgtctttgctcacaagaacaagggacattgctgtagggcatgatgcccctgtttctatggcattgggtgtacatgatactccagttcaggatgctaatatttctctggtgttaacaatttacttgacacacctgacttgggaacaccttttctcagctgataaaacatattacatacatacaacctgagatacatgcaaataaatcattgaagggaatgggatttatgagcaatgcccagtaaaatggcagtacatatacgactgtaaaatggatgccttcttcaataatcacaaaatgttacatgacaaatagatggtggaaacggaaactgcatcatgaccatgtgctttcacagaaagggcatgtcacctaggttgattgttttgctttggaattttagagggaaagggtagatatgagagctactatttagttgtaattgagccggttttcactaaatattttgctggctgcaggtataaagggtaacctaaaacgacaaggggttgtgttcaccgtaccctctcacaagaagcagacccgtatggttcatctgtctactccctcttggaaaggtggagatcaacagaattctggaacaagtatggatgatggagaggataacatggacttggacttggacatgttttttggatgaggggcatggttaagttaagtgtggtgcatcttcagttaacttatgactagattatctactgttttatcaggtctatttatgaggggtactgctggtattttgtagagcagatgaatagtcttgtttatgcccctgttcgtttcttatcaatgtagcgaggttgtaaaccgtatagtccttggtggtgtcaaattgctcacaatttatgcatgtgtgccccctagtagcgttgggcgtcttaagtccgattatttttctgctgcaatttggttttctgtcaatgtgaaatgaagaatctaaaatcggcagactgcaatcatcatttgttatgtgttgggcaatcaatgattctgtttagattcatagaactccctccgtttctaaatatttgacaccgttgactttttagcacatgtttgaccgttcgtcttatttaattttttttgtgaaatatgtaaaactacatgtatacgtataagtatatttaacaataaatcaaatgataggaaaagaattactccctccgtattttaatgtatgacgccgttgactttttgaccaacgtttgactattcgttttattcaaaatttttgtgcaaatatgaaatatttatgtcatgcttaaagaacatttgatgacgaatcaactcataataaa

SEQ ID NO: 43176 - DNA, 6518 bp, Oryza sativa
aaatatggaggtagtaataattatttaaatttttttaataagacgaacggtcaaatatatttaaaaaaatcaacggtattaaatatttagaaatggtgggagtattagatggggtctaatcgagtattaggggtgagtatgttttatcagaactttttaactgaacaaacaggaaaatgtaaactgatgaggccacacctagcacagcaccatgactagactatgatcatcaattacaagctctaacacggaggaattacacctcatccaatcaagtgttcactgtgccttggtttgtccattttttaggacaattttttggtttgcgtttcttagaactggagtgtttttttttatttacaaaaccgaaccaataaactggaaaatctacttgttagttgttagatacacccttatatttgagtactgctacacatactaaaatttttttacaaaactcttactaacaaatttctcaaccgtttaatttaactagatggaagttgcaataaatctagatttactcacagcttgccacatcagagtttgtaaacattttgtaagaaaattttagtacgtatagacttttcccttatatttaatccctttgcatattttttattaaaatcctaaataaagattgtagtactaggctctcttttagcatagctctatagatccaagatctaatagagcgggggtatttttaactttacaaatcgacaaatctagatatatgattacatatataacatttgaagaaatcaatttattcatattttaggtgaaatttaactgtaatttaacatacaaatatcaatcttcttccagtttttttttaaaaaaaatcaatatgtttgcgctcatcttcttcctcactcgatcagttccccaaatcccccaccctatccaaactcttcctcccccgatccaattcgactccactccatctccctcctccggatccctaatgcacaaggtgtagaattaaattccggggaaatcgacggagtcggaggtaggcgtagcagcatggctggaggagatgactggtcgaagaggacgatcatggaggaatccctgcagccgccggcccacggcgctgcggcgactacaccttgggtcctcctcgacatccgtgctttcatggccaaccaccgcaacgccaccaccgccatgtccgagaccaggagcggccaccccatcgaggtatcctcgtggacggcgcctccgccgcgcgtctcctacatatgcgtccactgccctggattggactccaagaagttcgccaccgagcccaccatcatcgccgcggaggccgacctcctcctcatccgcgtcgccatggggcgccggaacatccgcttcaagagcagcttccatgactacttcgtctaccaggccaccaccccaaccccgaaactcaccttgctcccgccccctcccatcgacaggttcatcgaccacgagcttggcctcctgcgctgttgcgcctctcctgattacattgttgctgcactctgtaacaccttcgaatcaggatactttgagtatgacctccacatctactgctccggcgctgatgcttggacctgccatccaatctccctccatggcctggtcgacacatcatttacccatatcaataccaaggcaatcaccattggagggaaggcgggcaccatgggctgggtcgacctctaccgtggtattctcttctgtgaccttctccgcgacaccactaagctccgctacttccccctgccgccgccgctcagtcccaacaactcgttaacaggctctccaaggcctcatcgtgacattgcccttgtccaaggtcggatcaagttcatcgagacgcggcttcatgtcaagccaggttccatcatcaacggcaccttcatctctcaaggttggactgctgccacctggactgcaccggacaccaatccctggaaccaaggttggcgccaggactgcaaactcactgcttccgatatctctgttgatgacagcaagatgaattttgagttgctgcctaagcttttcgatgaccaaggcacacctcagccaaccttggagagacttcatgtgggtcatccaacgctcagcttgcactctgatgacattgtttgcttcatggccaaggccgaccaatgggacgacgatgcttgggtgcttgctgttgatatgaagaacaagaggctaaaagttgtggctgagtttggtgcagaaagaacccttggcattggctatgcctacatgagcagtaacatatcagggtatcttcgtacagctccaggtaactatttgttctgctgattcatccctaaccctgtgatccgttccaatgctaaccatcataaccttgcctgctttcacaaatagcaaacctgcatgttgtaatcgataagaatattaaacctattagatcgacgcatatgtatatatgtatgtgccctaatcaattggaaaacacatgtttttatctttcctaacaagaacaagggacatcgctgttgggagccctgtttctatggcattgggtgtacaagatactccagttcaggatgctaatatttgtctggtgttaacaagatacttgacacaatatttgtggggacacacttttggtgagctgataaaacatagtacatagatagatataggcaaataaatcattgaagggaatgagatttatgagcaatgcccagttaaaactgtaaaatggaagccttcttctataattacaatacattacctaacaaacagatggtggaaacaaaaactgcatcatggcttgtgctttcatggaaatagcacatcacctaggttgattgtttcgctatggaattctattagagggaaatgatagaaatgagagctactatttagttgtcattgagccaggattttttattttgctggctgcaggtatagagggtagcctaaagcgacaaggggtttgttgaccgcaccctcacacaagaagcagacccatatgatgcatatgtctcctccctcttggaaaggtggagatcaacagaattctgtgggaggtgaagttgattacatggattttggatgaggaggggcatggctaaggggagagcattttcatgtagtattgctgttgtgttagacttcttattgcttgattatctactgttttgtcagttctatttacgagggggtattgctggtactttgtaccgaggatgactatctaagcacaaaatcttaagagtgtagtttatgcctctgtttatttcttatcaatgtagcgaggttgtaaaccgtatggtcctctcgctggtgtcaaattgctcacaatgtgagcctcctggtagcattgggcgtcttaagtccgattaatctggaagctgattacatggattttggatgaggaggggcatggttaatggttagagcatgcatgatgcaaatgtctggaactctgggagcagtacaacccgatgaaaaagaatattaaacttgtctagctcttcaagtattgaggatttagtacttgttaatttcaggtacaagtagcagagtgtctctctctattgcactcattgatgaaaccttagttgacgcttacaggattgtttctgctgtaattctactagcactaatagtatatgcatgctttagtaaaatgaatgtcgattagaaaagaagatgtgccaaactgtgctacagtgatagcagtatatatttatcgaccggtccatggggagagagatatatacacatctctgcgttcatgtgcttgttcttttttgccgggcaccaaaccaatgcaagggagtgtagttgaaagcaagcaatttaattgcaatcagatgtcaaatatggagtactttctgcttatgcctcatccgccacccacggcgttctttcccgatggatgacgacgaggtgagaggttaaagaagaagaaaatgaagaggcaagagcagaggcaggcgtgagctcacctgatcgaagaaggagctgggctcgcccggagacgaagagggctgagagaagggtggcgggcggcaccactgcaatggaatggaggacggccagcgagcgcggcggcggcggcggagacagcatcacagcttgcctcgatctggtgcgtggaagtggctctaaccaacgggatagtgggctcccggctagtagcatatgtgggccttctttttagcaggccggccttttaacgggcaactgggctggctatccatcatcttcatcttctcttcttccccggccaattgaattccactccaccgtcgagagcacagcacggccaccgaggtcacactccgtttccctaaattcctcaatccgatccgatttcttcttctcacccaaaaccagaacggaaggtgtgtgtgtgtatatatatatatctactacttaataaaaaataaaaaataagaggtgcttccatcgtccgtcaaaaaaaccacgagaaaaaaaccgagcgaaaaaaaccggacgaaaaaagagtccgatcccaaaaaaaccgggagaaagaaaaaaacgtccgatccaacaaaaataaacggagcgaaaaaaaactggtgaaaaaaaaacgagggaaaaaaaccgggcggaaaaaagagtccgatccaaaaataataaaaaaaaagtccgactcgaccgattcctgtccgtcaaaaaaaaatagcgaaaaaaataaaaaaaaagtccgattgctataagaaaggaaaaaagaaagttcgactctagatctaaatcacccttaaaaacgaaaaataaaattgatgtgccggattaaagatctgtttgcaaaaacgaaacctaccggtcgagagcattccatttttatatgattttaatttttggatctatacttttgcatttgagtccctgtaatttttatatttacatttgagtccatataagtttgaaataaggtattaaggtcgtttttgattaaaaaataataaaaggggaagaataaagacagaaaggtgcataaaaagaaaaagaaaaaccgcacaataaaagaaaataaagaaaaagaaagaaaaacaacaacaacaacaaaagtccgtttctcctaagtggcaaaaaaaaaccgtagatccgattcctataaaaggcaaaaaaaaagtggtgaaaaaaatgctagatctaattcctttaaaaaggaaaaaaaaaggtctaattgctataaagatgaaaaaaatcccaaaaaacatctaaaaaagttcgtccgattctctaagaagaaaaaatggttcgtaaaaaataaaaagctggttcatataaaataaataatgcgcgcgagaaaaaaaatgaaaagggcgaaccaaattccgatttctaatcttcgttatgtctaatctaatctaactatttaaaaagagaaaatgcatgacaataaaaacagttcaaagaaacgtgtgagaaaagttagaaaaaagcgcaaaaaaaacacgctaaaaaggttttccatcttccgtaaaaaaaataaaaaaccgcgtgacaataattatttccatcgtcggtaaaaaaattacttaaaaaaaagggaggaaaaaactgtcagaaaaaacacgccatttctaaaaaatggtttaaaaaaaccgtgcaagaaaaaaacatcgtcgattaaaaaataaatcgctctgaaaaatctgtcagaaaaaaaagctaaattgatggacgcttgagccggataggatccatcgattttttgtcatctactacacggttttatttcatcagaaatttgttttaaaaaaaaacatgcgaggaaaaaacgcaccatttctaaaaaatggtttgaaaaaaccgtgcaagaaaaaaatcttctattaaaaacaaattgctctgaaaaatctgtcgaaaaaacgctaaattgatggacgcttgagccggataggatccatcggttttttttgtcatctattacacggtttttatttcgtcatatattctcctgtattggaaaaaaacaaaaaagaacattcgaaaaaaaagtaaaaaacgcacgagaaaataattgttagaaaaaacatgcaaaaaaacacacgagaaaagaaaagcaaaaaagggagaaaaatatggttttcgtcgtcagtaaaaaaacaaaaagaacatgctaggaaaaaactgttagaaagaaatgtgccatttttaaaaaatggtttgagaaaatcgcgcaagaaaaaaaatcgtttatagaaaaacaagtcgttcgttaaaatacaaacattgtcattgacatgattatgtatgaaaaaaatatattatcattagaatttttcacccgttgcaacgcacgggcatttttgctaatatatatatatatatatatatatatatatatatatatatatatatatacacacacacacacacacacacgtgtgttggtagatcagattagattagataggaaaagattgataaattcacattcacccacagggtaagtactccctccgtttggttttatttgacaccgatgactttttagcacatgtttg

SEQ ID NO: 43177 - DNA, 3445 bp, Oryza sativa
  unsure (1)..(3445): unsure at all n locations
nnnnnnnnnnnnnnnnnnnnnnnnnnnnnnnnttatttttcattaaaaaaatctaattaacaatattttgatatgtcttgttttagaacgaatgatttcttttaatacttgattttacgcttatcgcttgcagccaaaaattggccttttaatttgacttgttttcgatgttttcaagtgtatttatttttcagcattagctttcatgtcataagaacacatatataaaaaatttacctataaatatttttcggtgaaaatgttactgctcataattaattaatgagccttcaaaagaaaacggtgtgcttacatttcatagaaacattttcttgtcaaatattgtcacaagtatagttagctttttaacaccacagaaactatggaaccatacttatggcatcgaagtttgacaagttcacggagccaaccaaacatgctccgttccggctgtaaaaccaagatagcgagaaaccgcgaggagcagacgagcagtctacacgctttgtcctctctgttttttttttttggcctggatcttctacgccctttcaggatctcgtgctccacttcttcttcctactgaactaactgctcttcttgtactctctctctctcgcctccaattcaccgacgtctctttggcttttgctgttgaactttatgcagcacatacatacatgcatactggtcgcctactagctagtatggttgcggagccacagtctctgccatgcctgcaaatttgtggtgttcaaagatcacaaagggatcaaaagattcaatacaattgtacccaaagaaggatcccgagacccctaccaacggaaaagctgcattaatctgcataccagtatgaaagtttaggtccattctttttcccctagctttgccggtgtacaaacagggagatgaacgtactgtccaaccatctttcatgttccaagcttaaggtgatatttgattcaggaactaacttttcacattggatgtttggacactaattagaaatattaaacgtagactaataataaaactaattacataaatgagagctaattcgcgagataaatttttaagcctaattttagcacatgtttactgtatcatcacataggctaataatggattaattaggcttaatagatttgtctcgtgaattagtctagggttatggatatgttttatcattagtatacatttaatatttccaattagtgtcaaactaaattacgagatgtatacatactttgagagaaaatataaaatatggagcgcccaactatgtgtgctttttgtacaaattttttttctttggtccataatatttgtttgttttagagttggacacaagaactaataaggtagataaaatggctgttttgttcagttaatcattccaaaaatgcgcatgtatacatggataaacaacttagttatgagttaattaaggaaggggtacggtacgtcagaccaaaaaaaagaccaaattaagctgtctatcgaaattgtaggtcaacaaatattttgaggactgtaaaataggttaaaagtaagtattttgaaccgaagagatcaaagtagaaaaaaaaaactctgacatgcatgtttcatgcaaatttcagtaggttccaaaatatacactccctctatcctctatcccctaatataagagattttgacattttatttgcactgcttgaccattcgtcttattcaaaaaaatttagaaattattatttatttttttgacttactttattatccaaagtattttaagcacaacttttcgtttttttatatatgcacaaattttttgaataaaatgagtggtcaaatagtgcaagcaaaatgtcaaaataccttatattatgggacagagggggtacttcacttatcgctcttttcaacatttcaaaattttaatgcaaagcaataaattaaacaaatcattaccaacacaaccataccaaatgttgtcacaccgaaaataactttgaaagatcactcaaatgtactatactctattgtttaattaataatatgtaaataaaattctctgagtcttaaaaagaaaactatgatagatcctttctagccaaacatagtttgccacatagttttggctccctggaacttaattgtcttagaacatgtatgcatgtttgaaaagttgttttgactttctttccaaacaacaagcaagctaggatacatgccgtaaactagctagctgcaagcctgcaaattactgaagaacaaaagcttttgctcagtgtgttgaggatcgatcgcctctccatttgtaagggacggttctttaatttgcccaacgggcagaacggatcatattgatcgatctactcctgcgcagcacgctgttcaatcaatctttgacctgaccgaacgtgttgattgtacatgtacataggagtatgtactccggtcagttacaacgggaaaacagctttgcttcatcagcacaactttggacctcgctcgctcacatgcatgtatcttctttttttttttttggttatatatagtactccaggtcgtagctgggggtaaccagctaagccagaaagggagacgcctggcctcgcacctctatccctcaatttatttttcttcattctccgatgtattgtaatctcctcatcaagctcgttgggttcgaatcatttgtgtgccacagtgttacattcgggtatacaagcagatatagcgaccgtctctaacaaaaggcttgtaaaaatcaggtgaatgccggtgaaaaatcattttttacatgtgagcttacaactccaaaattattacaagtggatattttatggcatgcctgtaaaaataaaacgctagcgaaaatgatttttttaagtagtgattttgaggttcaaaagtaaaaaaaaaaatcacatttgttagataagaaatggcaatttttatgtgcaattgaactacataacaattgtttcgtatgtctctagtgtgactattgcatgtacttgaattctcacaaataggattaactttgaagttgaattttttttgtgggctttgaaaatgtacatgacctcttttaactgatcatgacatttcttttattaacttttggacctgtaagtatgcattttctaatttgcacccgtataaaaaactagggtatatatatttgctctcgagatgtacgcactggtgaagaacacctggcttctgtagcagtggttgatcgttaaaaagaagaatattgtgctgcttgcaactctagctaggacggacggggggcaaaaatgctgtggtgcaccgtggtacgcaacgtaccggaagactacctaggtaggttcaagtgagtcgcaccaatgcaatgcagtaccatagataggattcaaaacctctctctctctctgtagagcaaaaaagaaaaagctagcacagagctgct

SEQ ID NO: 43178 - DNA, 5919 bp, Oryza sativa
  unsure (1)..(5919): unsure at all n locations
gtgctagcttcttttcttaaagaaaataatttggataaagagatgtcgctttttctacatctcgctcatgctgcatgcttatatatgtttttccattgagatcgattggacagccatggttccaaaataactagtttttaaaatgtttcaataaaaagagcatcttttttcttgtcttgtgggcttgtggttagtacaaattttcggtccgatgccaaccggggttttggtgcacatacgaatgccagctcctctatatagtttttggatggtgtgagaggccaccatattcatcatcaaaaggagctgatagatcgatgttgcctgtgtccatggctagggaaatggcgcgcgcggcgagattccatcggctaggtagctgcatctcatcgatccagaccaacagtatgcgagccagcgagttggctttgacgtgtgcatgcgttggggttcattgggccttcaatatatttctcttgtgaaaaaaaaggtgtcttttaattaatttaatttcgtcgtcgaccctgtcgaatgggacagtatattgggagagcaatgcaaacgatctggagtatctatcactcgatctgagcgcatatttttatctcacattctcactcctaggcgccctagctaggatctcgatcggtaattaattagtgtatcatcctaagatgaacatatactgtataaactaatcggccggtcctcctttccttgcaaatatgcaaattttgattctttatatatacgtccttataaatactggtcctcatcatttcaatcttagtatagattcggaaagagctagctagatacagcaatcaagaaatttgcgcatttatttaaatatataatgtgtgtttttctcttgaaattatcgtaccgtatttgattgtttctttgcttgccgtttcgtttgcacaggtatgggtccaaggagcacaagaggccgtgttctcatgttccttttgctggtcctgatgatggccgtcggagccaatcgcgattcaacagtacgtcttctcattcccttccctatcaatcggagagatctagctagtccttaattataaattgttcgtcccacgcttgctaattaactcacacattgctaattaattaactcgtagtgttgtgtatatatattcaggcggctggatttgcaaggacggtgtccaaggctgaagtgttggcatcacctcctccaatttcaccagctgtcaatgctgtcatcattataagaaatcgggtggttctgtcaattggtaaaatcaatgttttgaatgattagatgcacttttttatataaaaaatagatgataatgtggctttatatataatttctattattacaatacaattcatgtttttttatacgtcgttgtgtattgttatgatatatgaaagttttttcatgtacaatctagatattgtcacaattagatagtgtagcatttctctgcttcatctcaagcatgtttcaaaaataagtttgaattaatgacacctaattattatacgttatctaattgtttataacaaaacaaaactcacatcttatgtaataattggagttgtatttagaaaaataaagattagtattatctttgaggatttagatgtgtagaatggataacaatatcacacgtgattatgaactaaagggaggtgaatggatgagcaatgattaaattagatagatgaatagctagcttcttgatccaacggctgataactctatacaaatgcgatccaatggcttaaaattgttgataatgtggctttttgcatatcttgatttttatgagtaaatgcttcttagtgggtatcaactatataggaagatatgatatgcattcatttctcttctgctctatttgattgttttcaaattaagtcatgtctagtctcgtgtactagttattgcttttatggcgattaatatgcatgcttacaatattattaaccggtctcccttttattttttttctctgcatctatttaatttattttattttatcttattgtagctaatatttttagcgtagcagtctcattatggccgttttttgttcgatggagatacggttcttggtttattacacgccagattttttcagcaaaagtcgtggcgtgtaatcttgtggcatctgtcacttggactatctatatgatggttcaaatgtatgccggcggtaattacgctggagacgacgttttactgatcaattcagtaagcagcacgagtagtatgtttattttgctggtgtatttcttgcatgggagagaggatattaaggtaaatggaacaaagtcgatatgtttttaattagttgttttcttttaagttgatctaatagtaattttatttattttacatttatatagtactggatcctcatgatcctctttgctttggtggtatgctgcggaatgggatggttagtttggcaccctaacataatcatgtccgagagaacacaagacattttaaagaagtccaccaaatcagctgggattactggaatagtactattcggattggtgaattttctcccattttttgatctggtatggttgcttgtctgaaacacatacgcattctactgttgtgtccattaattgttagtttagtctaaaaccttttggttagttagagaacaaatcatgttcagtatcagtttcacactgaaattaactttggaaatgtatcattgcttaataagaggaacatgtatttattttggtaacatagtttttttcagtagtaaatagtaggtatatacctatgcaggcacaaaataagttcaggacaaccaagctaggtttcataggatatttgtgtccttgaggctaagtagcgatccaattttgaattgctgcacccaccccttgtagtatcatatttcatcatgtgcatcattatccacttcactgttcgttcctaccaagggaaatcactcagtaatgtaattagtgtggctactgtagtgatttttttttgtgtccattgtacataaaaaatgatttaagtatatgcaattttttttttactttactaacgccccatttgttttttaatttcagtggaccataaccaagagcaacagtacagacttcagtttaacaacgccaattgttataaatacgatgttggcaggtgtattgagtgcattctgggctttgtatgcctggatatttgacccaaaatcacccaattactttatggtaagtaatacattgcttgtttttgtttttactaattattaatagtttatattttctttttaatgtacgtcattacagatagcaaattcattggcggctggcatgagctcaatacaatttgtatggctgttggttctgcgcaattctcacagagaagtaaacggacagattgtagaagttgagagtctgcggtgtgtgttacttagtgtcgcaaagtcgttggagaggttgggagcagcagctcctaccgaggagttcttgcaacaaaccaagtatctgctgaggttacaagaaggtctgtccattgggctgcagtcgttggatttgatggagagtgcattccttcggctggaacaggagctagtgaagaacgttgctcgcactgctaatcatgttttagaaatgcaggataaacaagatgcagcggctaatttcgtggcaaggtctgatgacaacaatgcaaatgatgtgctaagagcctgtagaattttacgtgaaggatgcacaacgaacaagaatgcttttgatagcatgcaagaggctatacaacacaagattgcaaatgccgaaggaggagaaaacaacttgaaagacagaatcaatgccgcagcagcagccataagaggcttggccatttccatgggatacaatatgcaaaccatcaacggtcgagggattccacccacggtgaagatcgccttcaatttttgctgtgagcagattttgtcagttaaaacttgcgccgacgccccgtttgtgtggttggggtttggtggattttctctacgaaggcgtctgaacttacggtttgataacgtgaactggcctgatgtacccttgtagtacgaattgggctacgtactgtacgtgaaacttgctctaatagcttcagcgagcaagcactgtgcaacttctggattgctagctaggatacttcgtgtccctaagtagtcatatgcttgttagctctgttagtttcttctgctgcttttgtgcccgattgttgtggagtgtgatgcttctactggtgccagacagctctatatatctttccagcaaattaatttctaaaactagctagatgggatcgatgatgtgtcttgtgttgtagagattaaaactctgctctttaggcagtgattgtgtctttaagtttgctgtgttgacgattatgcactgtgattaattatttagctggtcgtggatgggcagcagacggccgggttttcgctctggctctttcaccgtcaggctactgtggtgcgagggctctgcaccgttgcccgtatttgccgctcattttcgcgcgtgacgtacgcacacggcacatcgcattgacatgagagagacaattgtgtcgatcagtttgggatttgccccaaaaaaaaaatcatcaaatcaaatatgccttctgatttgccattggaattaaactcaccaggatcctagccaatatattattttcagttcttttggagattattagtagttctttacaatgttttgtcttcttataatgctagaaaatacaagcacctgttaggacttgttgcctaccaccaattataatgctacaaaatacaagcaccgaggtgatgaggtcttcctatatatactgcaatctactactcatgttctggcctatgaaggttgtgcaggatgtacaggggagccgaatccgatgacaagaaacgctcctagttggtggatggtcttcagcagcattggccaacctcactatttcccaatgaacagaacaatcattcctccccatggtgacatcggctagcctaaaaggcgaggttttgacaccatcgtcatcttggcagcctggtcaatctgaaaggattggaacaatcggatgttcaacggcaagagcaagaccatgcgggaagtgacggagcttgcggacatggaagccgcgctctgacgcgaggcaggaggagtgcccatttaagtggcggtcatctatgaagttgcgagagattggccttaggaaaccaagctcttttttccttttctttgcatgtacatagttgttgaacctatgtggaacatctaaatcctgatattaatacaaaagacacgcattttgtgtattcatgaaaataaatgagagaaacacgtaccgatgaacatagattttgagttttgtgtcacttaaactagggattggcccgtccagctttgtgcggagctagataattcacgttgttaatataaaaatatgtttttttttgagaaatcacaggaggggagagcttccccacctgaatcttccattgagaagagtgaacatgggagtacatcattacaagggccgatcacagccagcgttgtgccactaagaatggtgagaagaaagggggcgggagagagtagctttccaagcttggattacaattcaatcgccgcgcttaagtcttttagcccacaaatatgaaatttaatttttattagtattattacatgtagaagtatatttggatttcatatataactcttagcttctatttctataaggtatggatttcatatacaactcttggattctatgtctacatgcttagatttcatataaaaatattaacttttatttctactagcaaaatacccgtgcattgcaacgggttaagaaagaaaaaaaaaannnnnnnnnnnnnnnnnnnnnnnnnnnnnnnnnnnnnn

SEQ ID NO: 43179 - DNA, 2552 bp, Oryza sativa
tgcgagatgcgacaacgacagtctaggctgagaaggtggtgcggcttcttcgcagctgttgtccgtgtgtcatgctaggagacgacgacgagctcatcaccgccttcatgcaagctccagctccgccaccattgccccctccttcgtgcgagctccggctccgtcaccactgtcgtcaccttcacgtgagatctagctctctcgcctccacgctccctgaggcaagagacaatgtggtgttacactaaatatttgctaataacggattaataaggcttaataaattcgtctcgcagtttacagacatattttgtaattagttttttaatagactatatttaatactttaaatgtgtttctgtatatccgatgtgacatgacaagaaaatttcacccctagatttaaatgcagccaaaatacatcctttttaagctgaactagatattttgcgtgtgccatcacccatggtcctccgtactatcttttttgtccttttcttttggtacggcggttataaatgaatattgcacctttcttatccacactcatactatatcggcatgttttatatacgattccttatatcaggatggcttagctattggtatttgtaaaatagtgaaatatgatttaaataagccggcatgatgtgaaattgttgtattattttttacccgctgcaacacactggcacctaactattatttttaaacacaaaaaactatttatatttgtagagcgatgaactataagataatgccagcgagcaattaacaagaacaagacagaaatcaactaacaagtagcaacttctcattggttgtaataactagcgtggcatacaaagagtttcagatgcctcttcagagtgaaggcaacgcttcccacgcatcccagtcatagaaagtttcagacgcctccgaagattgaagttgaaggcaccgcatcgcagccatagaaagtttgagccgcctccgaagactgaaggcaccgcatcccagcaagagaaacggagtgtcagcacaagttttaattgaccacatatgctcacggcaaaaactaaaagcgattctcattgtgggtggaatgccttctgcaccgttgatcctttggatccagggtcccaaaaaaatagctaatatcctcgtcatcccagatgcaagtctgatgttggcctgcagcttttccccggctcctgcgacatctaatagcctgtcatttacagatatctgaatgtcattaaaaacaatcatgtttgccctgcatatttcaagaaaactcctgtaagctgacagggcaccatatgcagctctctcattagagacggctaagaagacaaccacgctatgtacacaagccttatcagcagccttgtccacttgtttagattcaagacgatctctatttgcggcgtcaattgcggcagcagcaattgcagcaagcgatgcaaccttgtccgcttgtttggtttcaagacgatggaaggtacgctccattagagagagcgattgccatgcaatgtcaaggttattttgtaacttgaggagatagttcctggtccagaatgatttggtaggaggggcagcacccaatctctccaaggattttgagacgctgcgaaacacggatgccaggcgctggacaaagggaatttgcccctggatagccattgtaggtaatttccaagatgtaattaaattgcaatccggcggctctgacacgaagaagaggacgggcagatcgacctgaaaacaactatcctatctctgcagatcgatttgttgcgatgagctgagattgacggttgggacttgggagttatatggagccaggcggccggcggaagtagaattgaatccgactacgagtccgagtcaggtacgctaatagtggagtaatacggagactaaaccggggtcggccagagtaatggactgtttgtaaaccaaatttgaaaaatcaagtttccttcttatgtctggctggaagatcaaagaacagcaaatcatcaattgattcatttgccagctagtactccagttgaaccatcagttatcctaattcattcccttttttctaatgttcagagtacaaaaattcatttctggtaatgagatgggatcgctgtctcccctctccgctatggcatctcatctactccgatcctcaccgagcataactttgactaattaatcagagtatcatccgcaaccgaaagtaaacatgaggaagagagtcttcctcccctttctctaatttgacagaaaaaaaaagaagagaaagaagcaattagtcactaacagaatttgagcatcagtcttgtcgatcgatcagcattatctgctggtgtcgccgccgggcgccggtgatggtgacgatgaggaggaatactcccatggcgtcatgtccatggggtagctgccgagcacccggaggaaggaggtgaactcctgtatctccgacagcgcgttctgcgccctgacctccgccatggacgcctggaagtcgatgtagaacatgtactcgaagtgcttggtcgtgcccacgttgg

SEQ ID NO: 43180 - DNA, 2286 bp, Oryza sativa
cgacgcgcagctggctgccgtgcatgggcgcgggggagaggtcggtgatggtgagcgggcgagggaggttggagacggggagcagatccaggtcgaacggcggcgcggcgtggtcggcgagggcgggcttgatgctactgttgctgtcgccgttcacccgcgggactcggcggatggcggcgcaggtggcgtgccagtgggcgcgggagaaaggggtggcgcacggcgggcggacggccgtggatctggggatgtgggcggggcgcagcgcgggcgaggtttccatcctccggcggtctccggaggcgaggcgggcgcggcgaggggttggtggcgggaaagggccgcgtcgcgcggcgaggcgcggcgaggggtagtgtaagtgaaagctaagcaaaagaagaaaggttgcggtgggaggagacgagacgccgcggcgccggcgtgagaagagaatgaggtgttcccggtggttgggtaggtgggcactaaactatgaactatcccattcccaacgatgaagatgatgacgttgcatcttttactagtcttgctacacgccacggagattttttatgtttttccagtttactttcagtggtacaccgaccaaagtcaaatttgtttttgcaagtgcaatcctacgtttcttttctttcctctttcacagtttcaacacacacaaaatatagtacagatgtacacaaatcacctcttgtaactacaaccttctcttttcgtcttaaaaaaaataaattaacctatattgaaatgagacgtaccataaaacaataaatttggatagttctccctttagatttgtctttagatttggtgtcctacattttattctatctaaatctaggttgtgttttctttttacggatgaagtactactcacttagaacctaatcctttaaaatatctcaatttacatcagaaagatgttttggcatcgttggctcgtccattccacattaaatggaaccgaacaatcgcaacggccaaacgagcttgccattagatcacacacccttagatcatgtataataaatttccattagatcacacacctttagagagaacagccggtgtgatctccattggcctccggcgtcatggtatcaagggccagctaccgacgcgataggaggaggtacagctagcggtggtgagtggcatgaaactataataataataataaaaagaaaatcctacaacctacatgaaactaatttttttcctcttcctctccttaatcctagaaattaatcattttaaattgctaactaagatgctacatggcaccacatcatctcagaaaacatcttagtttgacatcaaggatcaaaattaacgactttaagagttggggaaaaaataaatggtttcataatcaacggaccaaagttggactagagctatagtcaattaagggttcttatatatgatacgcagtactcccttcgtctctaaatataagtgaagagaggataaaacaaacggcagagctgctgcctctgtcttttcccagcaataaaaaaactctctaagaacacaaaagctctgaattctatgatgctattaacttttcataaacgtttgatcatttattttattaaaaaaatatataaatataaaaaatatatttaaataaaactttaatgataaattaaatctcagtaaaattaataataactatataagtatattttgaataacagaatgatcaaccggagatttctgaatccgtcgtacggttccggagatgtaaaaaacaagcacttttttccaaaccaacgtgaatattacagtcgccgccattgcctcagctctttgcaggttcactcaccgccctcaatgcggtcagtattcaccagctagactggtagggaaaaagaaagatcaaactagctagcaagacatagttcctttctttttcaacaaaatctatgttaattgatattcaacacggatgtcagctacaaataaacaacaggaatcttggtgaattttacatgttcaaatagcacaacaacgctcttggttctacaacgatgcaactgctaggcaaaatatttggatttaatacacgtaaggaaagatcctccaaggcacaagcttgcaatattctacccagatctccttgtacttctctgagcaccttgcttcgtcccttcgttccctccatatcagcaaaatgaacaggtatgttgggtagaagtatgggatcaccgaactgcaccaaaagggtttatgatttagggctttatgagaatcaaattg

SEQ ID NO: 43181 - DNA, 3436 bp, Oryza sativa
ctacaaaattgttgattaatatcgatataggtacgccgtacactacccaaacttggtgcagctgtgataaacatcatttagatacactgaattctaacttgtgtgttagctgcctacctactcacccacactttctttactagtatttttccttttctgtcccaactcaccagcaccagctaaatctttaggcaatgggtatgcagactagagcagaaggttagtatgttaggctattggaacattcaacaacacacacttcagaactcagtattatggaccaagcagttaataaaggagaaaacatgcacgcgctccataagatgcatatccatcttaccagtagccagatacaagtagcttccccccgacaagtttgggaggtttaccccaaataagagctttagggttcttcttgaagatatgtttttgtttgttggctcctctgaacacaagatagctgtgggcccaatggaataaaccattgttaaagagattagaatgcaataaacaggccatatattatataatcgaaagcaggttctggtaacataggaagagtacccaataacgaaaatgaagcagttaactacagcagccaaaagggacagctccactttgtttctcaaaagccaccatccctggtcatcaccgttaaaaaaataatatcttgaatgtcaaccacctgacttactaacaaaagaggcatccatacttttagttgacttgaaaacgtgataaagcttggaattaattgaatatatagccatatgatgcatgaatggtaattctgactgaaacagtgacatgggtcaaacttagcaattgcagaactaaaaatatatggatacacacctgaatggtgaaggtaaatggaatgaacactagatcaccaaagaccagcatgaaacccagcctttccgcaataatgtcccatctggaaataataaaaaaaaataagctgtacagaaaaacaatgaggtatgaactccgtccttgctgatcgtcacatgcatttcagatgatcattcaggcacactggattgatattaacatatctttatattataggacaaaatgatatacttacgttgaagtcatgaattcttcatgaacgaagtaatctacaatataccactgcatgaagaaacataactagtatcatgaactatggagtatatgatgatcaaaagaagaaatgtccatgtccaataccgcacaaaagaattggtagagaatgactgaaagattggctgaaccagctaggtagctctttgcaaacaaagataggttgataaataaccatgccatcatcccagctctcacaaaaaagaacctgcaaacatggtgaatatttttttgaaaaaaaatcatcataacacgatcccactggagaaattaactcttttcccgaaaagagtgagtcctccaattattttatcatttgaaagacaaataataggaacaacttgagaaaagggaaaatagctggttatggatatctactttatacatcacactgacaaggattcatagtaactcaccacaaattcgccctaacaaaactcaccacagattagttacgtgactttagtagatgatgaattaaaaaagaaaagaaaatgttatgcagcgcatctaaattcatgtacaattataatttgcttttgtccacccagaaataaaaagcctacatgtcttactattctaaatcaggtgggacgaaacaaatagctgtgacagggtaaactcaagtttcagcagaccctaacattcctgaagagcttatgcgctcaacaacactacttcctcttttagaactagtcaactgcacaataaacaagtgttccatttgaaccacattggcattgtgcatagactgtatgcatcaaataattcgatgagaacattacaaaactaatcaatctgttggggcataaaaatcaataggaaatggaataaatacttgcaccagaagcaacaagccaatagcacaattctcacaataatcatgctgctatttaaatatttgaacgacatatccaaaatggagcaagaaaacaaagacgttgctgacatacttgaggtcaactcccatgaaatgaggattgagctgcactcccaaccacctagtagacaaagtgatcaatgtaaaaattatcagtattaacttatatgattaatacagaggatagtttcctgaacttttgaagatgactaattgaaatgagatacataagcttctaattggtaaattttagaagttgaaatggcaagaactgatgaaatatctcgagtgcaaaagggatgctagacgttaattttcactcattatggtttttatacaaatatagagtttcttagaagtaccaatcttgtatgaagttcccagtgatatgcggtttcaaggaagaacttttatgatgggaccttaatcctgaataatacagtaagaaggtaacctgaaatacaaaagcacgaaatgagtcgatgaaaagaacttaaatgttttttgaccatatgttagtgaacactaaacgccaacagtttaatggtgctgacaaaatttggttgacagcaaaactagtaggaagatttcactatgtgtatcatctttttttgttatttcttacaaattctagacatatccagtgtgactaattcctttgctaaattttagctgtaccaaatgatagaggtagtaactggggctaaaacatcaaacatgtcgatggccgtttatttcttctgaattagttatgttcagttggtacttaaacttagattattcagatttgcacctaattttaagtctgtaacttcattaacaaacagtacatatgaaaggagggaggtcagatgagtgatgccacctacaataacactaaaaatgaaggttgtagacaacagctcgattccacggtcagcaatgacctgcaatcataagcaaacgagatgttgatcaattcaaggaagggagcaactgaaagcttggtacatgaggcagagggagggagggagtaagcaagctcaccctaagggacatccataccatgtagacaccgagcgcggagagcaccatcaagaggaggatcgagagcaaacctgctcgggtcacgcacgcacgcatgaggtggctaaaaagcactgcatcaaaaaagcgtagagtatcagggctagtgctgcggcggcggatccgttagcagatgtatgtggaggcgggacgagtccggtaggacagttccagagacgagcttgccggggaggacagcgccggcggcggcgaggtagcctaggtaggagaagagcaccaacacctgcagagaatggagccaaaaaaaattccaatccaggagcttccgatggatgtatggatgcaggacgaggaaggaggacgcaccgcgctccacgagggcaccagcgaggcggcgactgc

SEQ ID NO: 43182 - DNA, 5001 bp, Oryza sativa
  unsure (1)..(5001): unsure at all n locations
tgactcaacaaagttaggttgcatgactaacagactaagaagccaattgcatggtttaataggatttgtaactgaaatatgttcagacgtatttaaataaatacatcactaatcccattttccaactctggcatgaagttgagatttttcatgtaatcgatctctaagtgagtcatataagaatagtcttgcactcttcactcttgttgcatattttaatgtccccttcttggccatcagattttctagaaaaaaaaaatcaaaacatttccacgcacaagagaaatcgtaatgggacggaggcagttgatgttttgttaacctggagctttgtgtttcaaatcattttacttaggttacctggtgaccgctaagttcagattacccctgtgattacctcttgggtgagacagagaaatcactgttgtgtttaccactatcaactacaatggattaaccacctaggcccatagaaaataaatatcatttcaattgtgcgatgattgaagatactgtgtgtagaattatgtttcacaaaaaaatatctaaagaaagaagtttttgtctaaaaaacagattaattgaacaaaggataggtttgaaagttcagaattcagattgtacttcttaagccaatagcccaacttcatttgttctgaacctttaatttttacttctaaaagttcaaaagcacactgaaaacatttgatacatgcaacaagagtacgttagtgaaccaagatcaggcccggctctggggcatggcaacgagggcgacggcctagggcccgtcctagctaggggcccatgcctaaaattgtatgatagccaaagtattattttaagattagtgaataattacatactatctaccactcctggttatctactagtatctacataatactgattagtaaattaataaagattctatattcaacaatcaaaatcaaaattgtatgtatagatagattcttgttgataatatatatttcctttataattttaggtgctgataagttgtaattttactcaagaagcatttttatggtgctaagtaaatgggaaaaataaacaagatcagtttaagtgttgatatttttctatttctaaaaacatatatatgaaatattatcaatgttcatttctctctatgattagatttgaaaacacactttgaaaatgaaggggctgttcatatcgtagccaaaataaatcttaccaaattttggcaataccaaaatttttacaatttagtgatattgcctagttttagcaggatttcttatgtatttactaaagtttggtaaaaaaactaaatggatgcacatctttaacaactttatcaaaaattgatatggtttaaaatgacattaatctgaacaacccaaaaaatatgaatatacatataacacgtctctctataggggagagagcgttaaggatcatgttgtcaagtttgccctagggccctcaaaattgtagagccggccctgaccaagatattgtgtttacctccactgtccactgctctggatgccctgtatccgatcgttctctacctagcgcaacaggagcattcaactcgttttggcagacaaacagcagcaactgcacaggcgtgcgctggtgcgcaagggctgtcaagacgtgaatagatttgcaaagcctgaataacaaattaaaatcccaaattgaaacaacaattacttaccaccagccattgtcactaccatctctcccgtgttggtcgctgtccatggcaactccatcctctgtactgtatccttgtaatccgctgccattcatggaggaagggatgagcggtggggtggagcacccgttgtttctatgtcgtgaggtaggacaggggcacagggtgcttcaccgcacgttggagcctaggagagacgggggatggagtgacgggaaacaccgaacgaggagaccatcttcatgagcaaccacaggggcttgtctagcgttgcggaggtaatgtccctgaattttgctgcacatgggtcaaaacttttacaaagcacatttgaaaatataaagtgaaacaatgtcagtttctatgggacttatggatgaacagaaacaaaaataatcagttgatccaacattttagtgcatccatagttagaaaacttgtactatatagccctgatgttctatagacaacacatatctcagttttgataacgaaaggtttcaatctccgcttcaaaacaagagagtaaaccgagacagctcacggatattctaataaaccaaactctagggatagcccacctcagcattgaaaactggaatgtacactcgtataaagactagggaaactcaaaacaacaaaaaaaagaaccatcaacccagcgaacttactcctcttgagagcaacaatcacaccttctctgtgataaaccagtgccgcaacttttaaagcaccaatgagaaatcaccagttttgtaattctatggaaaactgaaatgcgagataaagataactaataaccaaattgtcaccagttctgcgctgcagaaattatgaatatctgccctaatggtgagatgtagcaatattgattgtcaacaagcttgtatagcaatttatctttgtgcgaaaaaaagttaggatagaactgacatttgaattacccaggtaccacccaattgctcatcatggatgctgtatggcctaccaaagaaacatccatttttcaatctgaaccacatattctgcacaacattcaagtagacatttctggtatgttgcgatttttaatagactcattcggtacaatgcaaattttgtctaaatcttaatgtgtattttatgggacttcaaatttaagttaagtgagatttatattgtcaataaccatgattccaggtatcattattacagtttcctacatcaacagagtgcaacaaatcattcatgagtatattctatataatgactgttgttacatatggagaaggaattagatggaaaatcataggcatgtagaggattaaaagaaaatactggtgttgatagttaacaatggatttaagtgaaaaatgacattaaatggtatatatgatacatatattcatatatttatcaactgacaaatataacaagctatatgttatacaattgggcacatacatggactgatccatataagttaaccacatagggcatagccgtgccctgtttttgacagtctcaggtataaattcagaactatactaagacatatactatttattaatcctgacagtttacaaaagacaaaggcatgcatattagtgttgctaatctctctgtattttatagcttcacagagatgtacccataatggagatgaggagaaaaaaaaacctcaaaatatcattagataggaggaatagaaaggaggatggggaaaatggattttaccgtgaaccgaggaggtggcgctcgatgttgttgtccaagtggcctgagatgtggtggtggcaattgggaactgcgtgggctcggtgcacggctgcatgcagacacgggccggctgttgagtggtcgacggccggtcttcgggctagacgcggcgatgcttcctgtcgtcgggccggggaggattcagcgatcgatggcgaagcgcgcgagtgggatctgaatgggcgacggggagagcgcgaaggggacgggggtcaccgattgacgaggtgatggggaaggcgcgacgtagagcgatggttggcggtatggatcccaaagggttgacctcatgcctcatatcttccccttccaatcgatcccttctcgacgcctcccggtaacggggccagcgagcctacggcggagcaagagaagaaagacgacgaatatcaatcccgtccgcgctcttggccgccaacagtggcgcggtggagactcatccgacgccgcagatgaaggcgcggcgcgcggtcgagcgcctccgccggcgaaatgggcgaagaggtgcagccaagctcgtcgtcgatggcgtccgtgcagagcccgcagacccacctcgatcctctcgtacggcgcccgcatgccagcgatatatggggccttgcaatcctccgtgaatccgcagcagtcacaactcccctcccaggtcacccaagtcggcaccgccgctggcgctcgcctcgccccccacgtcggtggcggcatacgagcaggagcagacgtacgtagacgacggcttctccaaaaccaacggctagagtaatttattcacaggtattttgaagtcttaggagaaatcactcatctttacatgccaaaggtgaccaaatttggaattattttattgacaggtacatgatgtttgattagctgaaaacagtatttatgtattctctgtgatatcaaaattaagtaccaatacaagtatagacactcttcttgtgtagttaattacatttggttctgataaggacagttgtctaaactaatcctaacgctagctaggattctctggactcctttggccttttctaacttaggcatatgcatcttataagagacttgatatggaaggtgcatattgaatctaagttagcacagaagaagtatttaaaatataggattctgcttatttgtcgcaatcagcagtaaatggaactacaatgtgtagaacatgattcaaaggggtcatcgtgatattggggtctggatcccctagagttgggtacaaatgtatcgagtggagttggctaaatctatgccatccgttatttctatacggttgagatcatgcctcgtcaatttcacttaataaattatccttaaattaatggttaagtgttcggagaattttatttttaaggttttcctttgtaatagtgatttgattaagttctaaacaaattaacacaacaactttttgtttttaagcaacacatacagtcgatcaatcctatgcggcattgtatgccaatatagtgctttcccatacatnnnnnnnnnnnnnnnnnnnnnnnnnnnnnnnnnnn

SEQ ID NO: 43183 - DNA, 6308 bp, Oryza sativa
tgcctgcaggtcgactctagaggatccccttaagttctaaacaaattaacacaacaactttttgtttttaagcaacacatacagtcgatcaatcctatgcggcattgtatgccaatatagtgctttcccatacatgcaaaagtgaacgataccaatgtatgatttttatacaatagatgaagcatgaaatttatgtattaattctataattctacagaaattatctggtgacaatgttgatgcaagtctatttattgaatgtttagttactgatttttatgtagtaaaaattaaggcggcttaatcccaacccttgaagtatacggaatgtcatggatcatgacaactccacctggtagagttgtagtctaactctaggggatctggacccgtgatattgtgttcatcgcttttcagagtggatgtacatttgcagaaatcctgcatcattctttaggctttaattttactttgttgtcggcgaagaacaatcttaacataaatgaatctttatttatataaaaatggcattgtgtcctcaatctttttacttcatgtctgtatttttaatgcatgattgcttttccccagtttgatcaataagcttgatatgcattttgtaattaccttattctaatgcactgtgatgttattacagaatctgtagacaataacatgaaagattcacatgaacttgatggcacaataatagttgttaaccgcgcaactccaaaggtaactttgctccaaaatacaattgcttccgtgataaatatgtgcaaggcttttgttgatgctcaaaatggatagatgataacacgaagacgtctgatgctggtggcgatgcacttcctaaaaattctgtatttttctgtcttgcttttcatgttttgttgtgacatctcttggaggtgcccagaatctgtatcaaactctttttcctcctcttaatgaataggcagagctcctgccgttttcccctaaaaaaacaattgccactgacggctgcatccaatagtatattatctttgaatggtctctgtattaggcatatattctattgtttggagtatttgttaccacctgaaatccatcggaaccaggatgaacatgtcagatatcctctgagcaggacacctcaggatggttatggtgctacatttcagctgctatcagatatgtacctttgggtgcactaactctgtcttaccatccacggtcagcttatagaagtaagtcttctactatgaaactcacaatttgcctttatccactgagtaaatgttttctatatctatggatcctccaaagaggcaaacagggaggacccaaggcattacttatgagggtgcagtagatcatcgggtagttcgcatgagacataaaattctatgacgtgaggtaaggttgtgtctgtctttctctgtttgcttccctctcctccaaagccaaagtccactaaagcatgttgtatagtgattttgacctttgatatttatactcttaaaccaatttgctcttgtttagtctttaaaattcatggatcatttgcacaaagaactatatatactgatataccatgcttcttaagctcgttagttagatcgacgacactagaagaattttatgtgttgtttattgcattttgagcaagttatattaatataccatgggtctttgcattattatatttgttttttttaacagaaaacagcacaggtgtgccttttcattgaatagagcaggagaaaatacaacccctaagggtaaagaaagagaactatgagctatacactatacaaaatgtgggactagatcgcacaatcttttagctcccgctagagcccaaagactagcctcatccttgattcttgataggaggaagccttttgccatctctttgtggtcgaagatctatctgttcctctccttccagatttcccaaacgactagcagaatgagggatcgaaggcccttttttgggacgccgggtgtatttgctaaactcccccaccaatgttggactgaccgtgcttcctcccactcagtgggctccaattgctgataacccgtccaagaagcaactaggctccagattctcttcgtgtatctgcacctgccgacaaggtgtattcctgtctcaagttcagaacgacagagagggcaatgtccattattttgccagcctcttgtcgcaaggcggtcagatgtccaaactctattttggatgataaggcaagaatggaatttgcatttccccggtgcccagactttccaaatcagggagtttagatttgagtttggcgcccctaagcactgcgcatgataggccgaggaggctgtgtagtgcccattagctgtgaatttccaagcaatctggtccggctcttcactgtttaggtgcacattccgaaccgcttcccacaagcgaaccagttgctcgacaaggctgattgtgataggcgaggccgcattgaaggtcagatcattcacctaggcgtcaccctcttttccttggcgcagggactttcttctatttttggagatagcatagaaaagtggcatgaggtcttttggtctctgcccatctatccatgcagcgtcccagaagcgtgccgtattcccatctccgactgttacctttgtcgcggcggcaaaaaggtccttgtctaaaccgtcacaaggcgtgtccagtcccacccacggcttggtaggatccttccattcatgccaaagccatcgcaatctcaaggcccttgtgaacttgtccagatttaggactcccaagcccccctggctggtcggcaaacacgtctttatccaattgactttacattttcccctggtgatatcacccgtgcctgcccagaggaatcgtcgtcgctgcttgtctagttgctccaaagactcctttgtcaccttcaaggcagtcaggaggtaaattggctgcgctgagagcacagatttgacgagtgtggtactcccggcagctcccatgttcttgcccctccagcttgcaaccctccttgatatcttgtcgaagaccggttgtaagtccgttttccgcatccttcccagaactagggggaggcgcaagtattttaggggaaaatttgccctcattactgggatgccctggaggacctcggtcaggtctatgctgtcacatctgatggccacgacctgtgatttttgaaggttggtgacaagtccagtggctgtgccgaaacgatgtaggatgtccgcgaaagccgtgacatcgcctcaggtgggattaatgaagatgacagcatcatctgcatacatcgagatccgcactcgagtcgttcttccccgaagttttgagattgagcctagctctattgccttggagagaatacgctgtagagccaaaatgaagagaagcggcgagagggggtccccttgccgaagtcctcttccatgcttgattcgttgccccggcgagccattgaggaggacttgggaggtggaagtggatagcagagcccctagccaatccacccacctcgtcgggaagcccctttgctgcagcaaggccaggaggtaatcccaacacaccgagtcgaaagccttcgttatgtcaagcttgaaaagcaacattgcccgtctcaagcgatgatatcttctggccatgttccgcacgaaaaggaagttgtcatggatacttctcccttttatgaaagcactttggttgaccgagatcaaggcatgcatgtggggcctaagacgcaacgcaagcaactttgagaagatcttggcaatgctatggatcaggctaatcggtctgtagttcgaaacactctcggccccatccttttttgggattaggacaatgttcgctgagttgattaggttgaggtgcgcacacctaagattgaagatggagttgaacaccagtgggatgtcctccttgatgatttcccaacaaactttaaagaatgccccagtgaagccatctggttctggtgctttatcagctctgtcgacgtttgatgtcgcaattccggtatttgcaataggttctatccgatatgccaatattatttgtatatggatgctagatttcctactcaatatattttagcctgcacgttaccatggtttctcccatctatagttatcatctacggaattattttctcaaatttatcggtctaattatggtacatctgcctattctgatgcaatctaaccatttcttgcatgccattgttatcgttattgatgcaatggtttctcaaggcacgccactctagctagcttgaattttagcgttgtttaatagataatctttgcttctggctacacaacatactaatttccccttaagtaatttttttattatgcagattttgctatcctaatcattttcagcacatgttaggcaaggatacagagtgatcatcctatgaccagcagctggtccatgtcttcaaatcaattatagttttttcatatgaacacaaatagtcagtgctgttgcttatatgatttatgtgaaattgggttatttagatcttcttgaatggatcaagctaactctacattatgtgcatgtgctatttggaattaagagaaatcattgtagaacaaatcttatgtgatatgtccttaattgctttgtcaattattcaggtaactcggttcatgcactatctaaatgttttcaatccataactatctgacagcacttcaggtgtattatcttgtagtaacaacctcgttattcaacctcactaagcattgattttgtattgagggtataactaggaccgttatgatttatatggtcgttaactgacatcttttccacagaaagtggaactctgagtatacgaatgttcgaggccaggttttgtaggttcaagctttggagaacttcaacatgcttactaatgtaagcttcttcaagcaaaactaatactttgtaatagttgggtttctaaataatcaatattatatgaaagatgcatttacatttcattttagaaggaaatataaaagatctagaaagtcaacaatagaatctaatgttacataaatgcattgactaacctacgaacgcatgagtgcatgaccacatatttctttgtcatgcacagcgtacacaagggctaatgaattaaaaaaaaatgcaattgtttcatgtggattgttctgatggtgctgctttttttcgtattcaggatggtgtctttttggaacgagctatcaacacatagatttttgctgatttaaccatgatactgtagtttagtttagcgcaaaataagatataaccgtgctttcatttgtatgtaagaatgtaaagatggaaaatatttttatgttatgtgaacaaaccttagatcatatgaaatactggaaatagcaaggtgtgctgtaacatgctaaatctgtgtagctcaacatacatattgcatcaccggctctgtttcgtcggctttgagaaaactcctggatacgacgacgctcgtcggctggacctctactgcctactctgactctggccaccacctcgtccttgtcaagaccatcccggtgacaggccgcctccatctcgactaacctggtatgtttggttcttgcttcatgtatgaattactcgttgtttgtgggttggtttccaataagaaatactgattatagtattatcatgacttcgtactttaatcatgttagattagatgttactagaatgccagtggtagccggtttgttaccaagcaaagatttatttttcagctttctgcatgagggggacatcagtaacttcgaacagacacccggcccctgcctgtttagtatgattttgatgtccattttgtgtaaagttgttctcctttagggtgtgtttagttcctgaaaaaagttaaaagtttggagaaagttataagtttagaaaaaaacttggaagtttatatgtgtaagaaagtttttgatgtgatgtgatgtgatggaaagttgaaagtttggggtagttgggggtgaactaaacacggccttacctgaatttgcttggagatttgcttgatgtagataatgatgcccaagctgtgtgactgcagatgccctgatcctagctgcaatctctttagttaattatacctaaatgacctatgctttcaggttagtgtctgcagtcaactgaaatatttggctagcatataactcttgttttgctaattatcagtaagagctttgataacttttcttttctttactaatctggttcattttacctttcatatttgattactatgcggtagtaattattattttttttt

SEQ ID NO: 43184 - DNA, 1502 bp, Oryza sativa
  unsure (1)..(1502): unsure at all n locations
acttttcagaaggatcataacaaggtctttgcatgctgggattttcagctttcgatccagtacccgacttatcaacagccaaaagagcatactacacagggaagcttgggcctacagcaatcatccaactctcttgttataccaagtgagacctccatcgtcaactgcctaatggctgcatcatttgtcaacatgaacatgttaactcttctatataaaccatgacatatctggccagatcaattgccagtctgaacatgtaagccatagtcgtcactgtcaagtgtgaaaatcaattatcattctaaacatgttgagtctgacataagccacaagagatctatcaatcctacatccaaaaaatgtaacaaggttcattgctaaaagcacttcatctcactatggccaaaaaaagtatcatgagcaatttagtttctttttccatcaatcacttcctcagttcttagtagtcgatttgtcatcacaacctatgcagccaggttgacgttgcctgaaatatcacatcgacctgagattactcaattgtagcaagaacataaactaacatgttagtgttatttataataatctagaagcaatataatgcagcttgttcaaaagagaacaaaaatatttaaattagtctcaccggaacccttgaaggcatcccaagatgatttaaacctacaaaaattacatataacttgttgataaacaagttcagatgaatactggtacacacacaaaaacagaacttacttgccctgcattagacaggctgaagaaacacgctgcagaaattgtgggagaaaatcttggtaactgttggatgcaaagagctcagcgtcaacaatatcagtaatattctcctcctacagatgtcgaaacacaacagtgtcaactgtcaaatagagagagagagagagagagggagggagagagagagagcatacgtgtttgtgttcatccaaatgttcaatcagattacggataaaacttagcaggtcaccgtaattgggccagtactttgggttttttggatcaatatcctccggcttaaccttgtgccaaaaaaccttgtaatagatggactcctgcccatctgtcttactcatggggccaattgtccaatcaccaaattcagtaaaatctagaagtacagtggagaaaggtttcacccaagtcaatttgaatgttttgatagccacaaagaggtctttgataagatgcagtcgagcgactggaggcatatagaacacatgtgagccaagataatcccagaaccattcccaatcactagcactgaccaatgttctagatgtaagggtcacatcgtccttcaattgtttgaagaatatgttgtgtagccagaagcaaagattatctattaaacaacgctaaaattcaagctagctagagtggcgtgccttgagaaaccattgcatcaataacgataacaatggcatnnnnnnnnnnnnnnnnnnnnnnnnnnnnnnnnnnnn

SEQ ID NO: 43185 - DNA, 3178 bp, Oryza sativa
catgtccttcacgaaaaagacttgcgttacatcattggcaagaacaaaaggttcgtccgagtatccaaccttgttaaggtcaacagttgtcatcccactgtcatcaatcattacgcctccaccagtcaacctaacccattggcaccggaacagaggaatcttgagaggaccatagtcaagttcccatatgtcctcgatggcaccgtaatacgtggcagttgttccatcgtgtcccatggcatcgacacgaacagcgctgttttggttcgtgctcttcgtcttgggctctcgtgtagaatgtgtacccattgatctcatatccctggaatgtcgtgatcgacccagacggtcccctcgccaggaaggcaagttgttggttgatcaactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccatagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatcgcgctgacccttgatgatgtggctagcttatgatacctcggatggaggttagcaccaaaaatagtggcgctgagatgttggatctcaacgccacttccgatggcactgagttcgtggttcattttttaaataagtttttgacacggtttattcttgtaataagtttttgtaaagggtcaaattgttaaaaattgtgccttggattactcattgtacttatgtgattggatgtttatattaaaaaggtgtctctcaacctggtacttcaaaattaaacaaacacctcatttatcgaaaatgttactacctagtttatatgattggacactccttgctctttgtttaaatttattgtactagaaaatattcaatcaaatcgtgtattaggtagcaaaatagtttaggatcactatagaatacttcaattctatccaactttgctatagagaaatgctaggaagtaacttcactagaaaacaatatatgtgtcaaattcatataaggacctgtttagttcaggggtgaaaagtttttacgtgtcacatcggatatatgggcacacatttaaagtattaaacgtagactaataacaaaacaaattacaaattccacctgtaaattacgagatgaatttattaagcctaattaatccgttattagcgaatgattactctagtaccacattatcaaatcatggcgtaattagacttaaaatattcgtctcgtaatttacacgtaatttatgtaattattttttatctatatttaatactctatatatgtgtcaaacattcgatgtgacagagtgaattttttttttaaaaaagaactataaacagggcctaagatggattgcaacctggaagagagtcagcgagtgatcgcacccgttcaaaaaagaccccctgcaaggcgaccgcaccgcagccgtacgtctttgtgggagggatccgaccgagcgagacacgatccgattcgattcgattcgagacaaacagcgaccgcgcgcgccggctttcacctctcctcactttacggggctccgcaccaccgatgcgatcacgatcagccacaccacaccatcggccagcctctctccctccctacccgacccgacgcatttcccaccaaaattacctatcaccaccacggctagggtttcgccgccgccatggacctccccgccgtcaccggccgccgcaccacctcctactccctcctctcccagttccccgacgacgccgccgtgctccagcgccagtccagcggcagcagatacggcgccggcagctccctctccgcctccagcgacttccccttccacctcccttccgccgccgcccccgccgccggggcccccgggggctccccctgcaagagctgggcgcagcaggccgaggagacgtaccagctccagctcgccctcgcgctccgcctatgcgccgacgccgcctccgccgccgaccccgccttcctcgaccccggccactctgccaccgccaccgccgggcccttcccgctcccacccccgacgccttctgccgactccctctcgcatcgcttctgggtgatcacctcatctcttcaccactcccatctatttctagtatttgtttacacaccatcacacatagcttgatttggattagagatcagaatgcatgattgctctatccgacccatcctagtagcctgcagcaattctatctcttctgctgagctcctaaacccgctatatcaatctcatttctcaagctcttcgatgccctctttttaacatttcaggtcaatggctcgttatcgtacagcaataccataccagatggtttttacttgattcatggcatggacccctttgtctggtcactctgcactgatctactcgaggagaaccgcataccttctattgattcactcaagtctgtccgcccagatgattcttccatgcaagccattctcatcgatagaagaaccgatttcgatttaggtatgctggagaattacgcttccagcttcttgtccagttctgccgacatgaaggatgtgataaaccagctagccaagcttgtgtcttccagaatggggtgactattgtacaactaatctactcatcaaaagtgtctttgtatcgtcttgtttctgtggtttctaatactattttttttgtttcaatcatgaaggggtacaacctccaatgaagagagttttcttccacgctggaaagagtgcagtgatgct

SEQ ID NO: 43186 - DNA, 1629 bp, Oryza sativa
tttttcggagagcatggccgagttttggtagctcaagtcgtgtgtgacagacaaaccgggcggtccagaggattcggcttcgtgagcatggccacattgagggaaccagacgatgtcatcgcttccctcaacggacaggtgaggcgccacaactagatcagtgcatattattaccctgcttatttacaatttgttatggtcttttgtacaaatatttcccttactatattatttgaagagataattattatttttctaattgtaatccaccttcatgttaaatcatgcagatcatggatggccgtcccatgagagtgagctttgcaaagtggcaaccacggcttggttactaagacactatttaggagagcttttagttccaattctctctagattaacaatgctagattctcgctggctatcattgctaattacttcttacgatctctagctccctgaatatggctcatcaggagccagaatacgaaatgtaaatggaatgggggcattattcactagtgttgcaattcacgcagaacaaactaaatggatttcttatcaaagaataacaaatttcttattactggtaacaaaagatttcgttcactcctgctttgctagcctctcagagatcaaattcgttttaactcaaaaggaaaaagaatcaattcgtttatgcttgtctatcttattcttgttttgggaggagctcgtctatctgttgatcaacacgtaagcaaacacacagccacggggagggcccaattataaaacagcccactcgccttcatgtaatctttcgcgaaggaaaggcccagacgtccgatgaaattccatgtgggccgagaaaacgggcttttctctttttgttcatttttcttttttggagggatggctacgatctcggacttgatgtgtctaatacatatattgtatatagaacatggttgcacaaagcatctgaatccctacccacaaaacaacgtaacatggcaaactatatcttacgtgaaatctccatcaacttggatagtttcaatttctatcggctatgatatgatgcagccgtcgccgccttcgctccaccactgggctaccgcgcgaggaagcagctccaccacctccgacgtggcgtcgccgaagctgtacctcaacacgcggcaccgctcacgccccgccgccgtcgcccacgccacctgtggacgaagtaggcgcacccgctgccgcggcccacgcccagctgcgcggcgtccatggcgaggctgaccgggcgccccaggaacagcgcgcggtcgtccatgctccggccgtccttcctcacccacacccagctgccgccgccctccgcctccagcgcgtacaccgacaccgacaacgcgctcgccagcggcctgccggcgacacggcagccccggacgtcgctgcagtagccgctgtcggcgaggacgaacgcccagagcagctcgccgcgatattcgaggaggtggctggattggatctccttgcctggctcttttggccaccaccgactccacttgccttcgccggcggtggtggctgctccggtcgtcacgacgcaccaataattcttaccattggcagtagcatcttgccgtcgtcggtatatag

SEQ ID NO: 43187 - DNA, 1164 bp, Oryza sativa
gagtatatacatattttgatcattgggctgggtatgcgtagattttgaaacatagctagctatcggctatcccaaacacatatcgatccatccttacccaggtaaaattaacatgttacatgtgcgctttagcctgtttcccaggagtttttggttctcgggaacttagcacagatcctgctagtgaactgccaaactaatcgttccatgcatatgattccatcatccatgagagaacttctactagctagttcaccgtttatgtttgagtcgtgtgcctccagtaatacagtatatgtacagtcagatccagtaaccaaattaacctgctgccgacactagttaattaagagttgtgttcagctgttttgcgactctgttacctgtcgatgtgctgacgcatgctgtttcttctgttaaaaaagctacatcgatggacgtaatacgcacgtacgtcagcttaatctgcacgagctatagttaaggtgaaatttattgtgggaatttgcttggatatatacttttttttacaaaatcatgagttacagttaggagtctgatcgtctcaagttagcatgcgatgttttttaaaaagatctcttatagaactccttttgtatttccaaaagtgaacgaatttaaaaactgactcaaatacatatacgtattttcaaaagcgaacgaacttaaaaatcgactcatacacagatgacgtaccaaattaccggcaaaaacatcttcaatttttataatagtagagatattccgaccaacaatcatttttctcaaatgcttaatagtagggtagaaaaatgtcactagagatagcgagaaaatgtaaaagataaagatggaggaaagaagagaaacaaatatactataacgtctttatatgtttcatctctttcattattaatataactagaaaggtagcccgcgcattcgcgcgggcatataagatacgcttttgtaaggtgtaatatcgaccgggtgacacaccactcttgaaaaagtacaatttcttataaattttcttcatctacattgctcagatatttttttacaagatatctgtaaggtttaaactatataatatttaattcactactataagctgcaattatcagtaattcttcattttctagaaaaaaagcatcaataaat

SEQ ID NO: 43188 - DNA, 756 bp, Oryza sativa
atcgtatcgtgcgcgcgttaattacgctcgccgaccgaagcgacattaccgtatctccaggcgaagcaaatcggctcgcccagattcattcgccgctcaggtgatgtggcagtcttgaagagaccgcccattattgacagccaaattaccataaccggtgtgcatggtttgagaccgttgggtttctgcccaaccatggagaccggtcccacctgtcaccaggctttaggagtggcgtcacgcccggccgcttcccataagaagggcgatcgccctggcataacgccgggggctactgtcggtaacatgggaccgggagtatcatgactagaggcttgaggcagacgccatcgcccacgtggcctggcaccctcgggggacgtcgggcccgagggtgatgtgtgcgcccacctcttggtctccccgagggggggggtcggaccactcctgcctcgcccccgagggccgaggcgccccgacccctcgcgtttctactccacgtgtatgggttaggtgagcacagcggggctcacctaaccgcatttattgcgcctcggttaagcgtgtcacgccgcacgaagtgcagtgcagtgcactcgattatccggtctgtgaccagtcacagaccggtcaaatcgcgggttaggtggcgacaggcggtctgacgcacgcttcgccccatcccgtcaagacgagagcttctaggcactcgtccccggctggagctagcgtgttacatcccagagatgacacgtt

SEQ ID NO: 43189 - DNA, 1433 bp, Oryza sativa
aagagggcacgcgggcaacgaggtgcagcgaagaagcttgagggccggcacatcataacggaagtgcaagaagatggacgtcctagtgccccggccgaagccgccaagaactatgtacgtcacagcggttgggttgtgcgggataacgtgcctgtcagtacagtgtactggcgaagaacaagggcacgcggagatcatgagagctttgtcccagattcacccttcctcgaggaccacaatgctcgagacattcacccttcctgcgggtacagaggacaaagtgaaaaggtggactctgaagaaaatggcagaatagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggcgatcagatacgagaggctgcgcgacgactaacagatgcagtgcaagcctcctctcagggcacgttccgaccagacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatacaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtccccaaggcgcgtacgaggacctcgagctggattaccctggaggagacggtgagacgcatctacgagac

SEQ ID NO: 43190 - DNA, 765 bp, Oryza sativa
  unsure (1)..(765): unsure at all n locations
nnnnnnnnnnnnnnnnnnnnnnnnnnnnnnnncttgaagtataaaaggaggacctggcccatagagaaaggggatgatcttttccagattcagaacctagaacgagggagaggttggctcacactttgtagctccttcatacacagatccaccaaaacacaggagtagggtattacgcttctcagcggcctgaacctgtatacatcgcttgtgtttcatgctcttttgggaggtcgcgatcttcccgcatacacggagagcttgagatctcaccctgagcccccggccgaaccggcaaaggggggcctgtgcggtctcccggtgaggagcgccgcgctccgtcaagctcgcttctcctctcttctctcttacacctcagcatttagccagcttatagcctactattatacttgctctaaagctagctagtactcccttcgttttcttaaatattcgacgtcgttgacttttttaaatatgtttgattgttcgtcttattaaaaaaattaagtaattattaattttttttatcatttaattcattgttaaatatacttatatatatacatatagttttacatatgtcataaaatattttgaatagataaacggttaaatatgtgcttaaaaaatcaacggtattaaatatttagaaacggagctaatattagcacaagatgtgaaacgtgggcgtagaccgtagagatgggaaacgtattgttgtatcgatcactggtcagtgattgttttcgccgtgtcactggt

SEQ ID NO: 43191 - DNA, 5494 bp, Oryza sativa
cccccccccctccccctcccccccgccatgcgccgtcgccttctgccggcttgcccagtcgcccagggaaggtaagagaagagtgagaaagagaggagaaagggaaagggaaaggagggcagagggtgatgatgtatagttaagggatccacatatctggttttgtggtttgagagcgttttttatcccgatgacaagttgagggaccttcggtgtactttttccatcttcctccccttcatagaccggcccacttattctccttcttcccggcggcccaatccccctcacaggccggtcaccatgtccattttaccttcctataccccaccagcccaataacagcctcggcctagctcgccgcatgccgtccctgagcttgacttggcctttgcaagcgcgatccttagacattgctcgcactgtctccaagctctctctcttaaagcatgcgccgagccgcttcaccagtgtggttcagctgccgcgagcgcatgctagggtcaaaatcaataccaatatctcttgcgtgtctatttaaagcttaacgccattcttttttgcgctgagcatagggatttgtttctagaattagttttctaaaaagtttaattcgtaaaataagttctgcagaaagggccatgtgtaaaaagtccagcatctagacagctgctcctagttaacataacgactcaatgcctcgcatttctttctttctttctgtgttcgaaggaagcatcctgagcggcgtggattgcaaaacaaaaattgactttgatgtgtacatctaccgctgaatacatagaatacataaatataaattcatgcagcgccgagcatgagttcgtttccttaggtccaaactcacttttctcaatattttacgtgcacgcttttcgaaatgctaaaacaatgtgttattttttaaaaaaaaatatacgaaaattactttaaaaatatacgatggttgatgaaagtgaggcggcatcgatgatgagaaagtaggtcagcgcatcaccttcctctcactccattgctacgcatctcctcctccatcactgccaccgatgggtctcgtgtgacgagaagggctctttagtgtgatagaaccaaccgcaacaaggaatggtggagctcgacagtgggatctcgctagatctaggcttgtcaacggtgggagcaacgagcatgactaccaatgacgaaaaaaagtagggaaaactaacgagacaaggaggtcgagagagaatgtgagacctcggtgatctataggctcatcacgcaagggctcaagagctagcgcaataaggaggaagagaggaagggggcgtggatagctagatgttggtagaaggggaaacatcaagggaaggtcaggaggcttggaggagtaaaaaatgaggcatgcgtcaatgagaggagagtgatttgagagatggagataggaaggaggatgaacatgtagggttcgtaatatggtaaaataggcattcacactcatgctgacaaatggagttggtgcgcttaccaaaatggaatagcaatgtattaaaaaaatataaataatatttaagaatcgtgattattaagaaaaacaaatagttggtcccgcggcgtctcgttgaggtggaggcagtccctcactccatcttctcgacaaacgcaacaccaccgagagacacaaagctttagcttcccttcccttgcagctacagggagggagggaggccgccctttcccgccacccacccctcgccgtcgccgtccgccggatgatggaaactctgcccgcgccgcgccccacccagatccccagatccacggccatccgcccgccgtgcgccacccccttctcccgcgcccactggcagaccacctgcgccgccatcctcgccaccaccactaccaccaacgccaaagcctatggcgccccgcgggtgaacggcgacagcatcaagcccgccctctccgaccacgccgcgccgccgctcgacctggatctgctccccgtctccaacctccctcgcccgctcaccatcaccgacctctcccccgcgcccatgcacggcagccagctgcgcgtcgcttaccagggtgtcccgggggcatacagcgaggccgccgccgccaaggcctacccctcctgcgacgccatcccctgcgaccagttcgaggtggccttccaggccgtcgagctctggatcgccgaccgcgccgtcctccccgtcgagaactccctcggcggcagcatccaccgcaactacgacctcctcctccgccaccgcctccacatcgtcggcgaggtccagctccccgtccaccactgcctcctcgcgctcccgggcgtccgcagggacctcctcacccgcgtcatctcccacccgcaggcgctcgcccagtgcgagctcaccctcaacgccatgggcctcaacgtcgcccgcgaggccttcgacgacaccgcggccgccgccgagcacgtcgccgccgcggggctccgcgacaccgccgccatcgcgtcctcccgcgccgccgagctgtacgggctccaggtgctcgcggacggcatccaggacgacgccgggaacgtgacgcggttcgtgatgctggcgcgggagcccatcatcccgcgaacggaccggccattcaagacgagcatcgtgttcgcgcacgacagggagggcacgtcggtgctcttcaaggtgctgtcggccttcgcgttccgggacatcagcctcaccaagatcgagagccgcccacaccgccaccgccccatccggctcgtcgacgacgccaacgtgggcacggccaagcacttcgagtacatgttctacatcgacttccaggcgtccatggcggaggtcagggcgcagaacgcgctgtcggagatacaggagttcacctccttcctccgggtgctcggcagctaccccatggacatgacgccctgggagtattcctcctccggccaaaccgccggcgacaccagcagcagctgattgatcaacaagactgatgctgctgctgttattggtagttgaatacagttatctcaagaaatgctcaaatttttgttggttaatttgcttctttcttcttcttgttttcctttgaaatttttgtgaccaaaattggagagaggggaggaagacctcctaatgtttgattgcggtcgcgggtgcggatttacatcatgatgatgttctcagtaagtcgaattttacatcttggaatggaagagctgcctaaaacaatcaaaacaaccaccacatttctgctgtcctgtgatcttgtctgctcacaaatgtttggctctcttgttgctgagaaaaaaaaaatgaatgaattcactgatcgatatggcatgccattactttgagtacacacatagtactgtagatggtacagatagaacatagaagacagtttggtgagtactgggagaaacaaacatgcatccatggcagcacgtactccgtaaggttgatgttgataggatgggaatatggctgtggttggtttggtggttggggctgaccgacagaggtagcaaggggaaccatctgcaaccacaaactccataagcggtaggtggcgttcgactgttgaaatgagccattttcttttcaggttatttatcggcttgttgaaacagcttatttacttcactctttaaaaaaaagttctattaagaagtgttcttttccattgaccattgcattacttgttttaagccatttattgtgtttattttttgaaaaagaaattgaatttatttatataatcaagttagtattccgctaatactctagaccagggtggggcggtcggctgctgtcttctcccactgggcattagcttagttaagcccaaccattgctgttacgcaaaacggaagcatcagacatgctaaaatgtactagtattacaatggagtaacgtgcatcaagctaccacattaacaagcaactcgacttgaccgcattgtttcatcaagtgattagtaacataagtcatgactgaagggacatttattaatccaaatggcctctttcgtaacattgacttgtaccaggaatccatgagaggcaaatcattgagctattcaccaggatctatcaggtgggaatggaatcgcttattactgatgcctacagtttcacaattaattacagaattatataatactcagatctatcatctgccgaattaacaacttccgacgacaaaacaattttacgcatcacaatggcaaggaggaaggaacatcgaactacaatgaagaactcccacatcaagcaagcaagccataagtaactagtttaattctgcctccatgatgttctattatcagttctttttaggtacaaaatctctagtcctcggaagatgaaacaagtttgccaaaaaacaacagtaactcaatggcagcgtcacctattgctttccctcgtaatgaaacaatacactcctttttaacatacaagctggccttctatgaacagaaagatcatttcccttcgattgaaccaaaaatacaaatatcagacccccgaagatctcgattgcgaggatgatcggttgacaaggccagagctggacttggaatttattctgtgtaagcaccttatccacgattaatggtgactgagggatgaacacaaacatttgaccaaaatttacttgtgcagcgcgtcaggttgtcaacttcacactaatccacctacatgtcatggccgcgacagcatcattgcagttgctgctgcggatcacccctcacgctgacccacttttgtggcatcatttcatttgagcttctgttaagcaccagatttccagctaatccacctcaatctcatcattcgagctgtttctgttgctactgcttctgcccctgtgtttggcacaaatgctaatcaacctccatgccatcatttgagcttatcgacatacatcttgcatgcactatgggtacacgctctttactctcagcactgtcgccactgctgccttctgtcttcgaagaatcaaaatagaccgcatccttgtacatccagttatccttctcaatggaataaatgtcatcaaatgactctccacagagtgcacagataatctgactctcatctgcaggaaccatgaattcacaaacttcctcttcagagctcaaatctgcaacagaagaagcagactccagggcgctgttctgcacttcatgtgatctatcgacccaattatttttgctagggtaccatttttcaggtgcgataccagtctttctagtctcactttgcttcgatccatggcacgcagtgtgcacagagagctcttcttcaagactgaatcttagaccacatgtattacattgatgactttggtcatcaaagagggtgctgatcacatgtgcatggtacttgcggagcatctcaggcttgaagtcaaagccaataaggtctaccatcttgatttctgcaggttccttcttgatttcaacagg

SEQ ID NO: 43192 - DNA, 1314 bp, Oryza sativa
  unsure (1)..(1314): unsure at all n locations
nnnnnnnnnnnnnnnnnnnnnnnnnnnnnnnnnnnaagtttgcctgcggttgatcaagtgtcctgagatgtggctttgactgcagcaaggaagggtgcttttcaatctgctgggaggcatgtgaaggagcacccagcagattaggtctgccctgagaaagtgcaaggttttgagccaaggcatgagttctttggttatagtcttccagagaattttgacccaactgtgagaatggtttggaagagtaatcaagctctacaggactaggggaactctggcgtgcaaatgatgcagaaggtgactgtacaggtggtgaggaagttgaccaatatctattcttttgctgtcctatagtctcagttgatcttgttgctgcactttctaggcttgatcgtccagcataggctgctgacaacccaacaggtacagatgaagtgatacttgttgacaaggtaccagcataaatggtaggcctgtccgctggctgattggaaaacgctgatatcctaggatctgacacaatgtctgggagaggtttttcatgggataaccagagagaggaaccacgagatgacgagaacggctgtccttccgggagcatttccctatcaattcttggttccacttcgtgcttaccatgaaggtactcttcatgatcctgaacaattgaaaaaacaatcagattataatcttgtccaaaagtagtgcaaagatggaatatgtgtatatatgtcatcaaaatttagcatggtatacaggtaaaacctaagattttgaggcaatattataaattgcaaatttgagagcgaaccagcagttcaaactatctaacaacattaggtacaagaaattaacttgctgtatctatcaagtattgaatatgattttatagtactgtcttcttttcacataccatatatggtgtaattcttctatcttgacccgtcgcatttccaaatctttggaagctatctaatttgtgttggtcagggtccaaaggtcctcccgcctctgcccatttaaccctttgaaagcttccaacatttccatcatcaggtatccattctctttttcttgttgaactggtacctccataatctgctccttgagaacgtacatcatcccacatgtactcttcttcctcagaattcttccagcttttgttggatgacggcctaccaatcctatcagaattactaacaggagttggcaaaagtgcaccatctaaacgtacagatcctgatggtctaacatccttgtttgcataaaaattgctgcgcctgtcaaactgttcttcagaagaaccaactccag

SEQ ID NO: 43193 - DNA, 14411 bp, Oryza sativa
tctgctccttgagaacgtacatcatcccacatgtactcttcttcctcagaattcttccagcttttgttggatgacggcctaccaatcctatcagaattactaacaggagttggcaaaagtgcaccatctaaacgtacagatcctgatggtctaacatccttgtttgcataaaaattgctgcgcctgtcaaactgttcttcagaagaaccaactccagcagtataatatggtccgccacttccatcttggcctttaggttttgcacgaacaagaccagttcccacaacagcctgctgcgaaatgttggagaatccaaggaccctcatatctctatcttgcttttcatgaataggattgctaaaagggtccctttgtgcccgctgtacattctgcatatcaaagtcaaataataacatatgcattatatatataacaaagtaaatacatctaagcacttatgttactcaatgatcaaatgatgaacttacagtcctagggttcaaagcatccagccgccgccctgcacctctatcaacagctgtcctgctagtcctctcaatatcatcaccagaatcggaaattgtagtagtcttggccccagctcccagtatcccctgtccctgtacagaacgaggggagaatagaatgaggtgaaaaaatctcacgagtgatgtgatagtataaagcagcagttacaatgctatgaacatatctatattttttcaatgggagcaatatctatcagtcttgatacgatactcaggatgacaagagcattgaatagctacatctacaaaaaaaaaaaaaaagaagttggcttgccttatttggttgctggagctgctgccttgcttccaaatattttgggttcacatgaatgctgtgggatggacgattggattgagaatcaggctttgatggtgcagcgcctgatgatccattagtagatgattgaaagccaagttccttctcaatcacttggagtgaagttggggaaaacactcctttccatgttccaaataagtgtctcatgctattgtgtatggaagaatcaacctgtttatatgctttgcagaacacctacaataacaaggaaccgcccaagaaaactaaggttgatctcatacagaaagaaaccaggattcattatttttccatgaagctggtcatctcaactatcaggtcaacaaaaaaaaaagttagaagagcaagaacgattatttactaacctcgggtaatcttgcagaaaaatgtttaacataatcttttccaatatttttgacaatactgtcaagtagatacagagatggtagcttctgttcacttggaacctacaagcacaagcagccaataatatgaaatagcatacccttctacctataagaatacaattacataagcaggtactacaggtttacaatgaaaaaagagaatcacagaaatgttaatgtgatacaagtacaacaatggaaaacctggtgtcactgctataatagctgtgtctccactctccaagactagaaaaatctgctacacaacagaccaatacaaattttctttatgaccctcacatagagaaggcccaatgtttttccatcttttgtttagttgagttacatctacttgttgagaagtccaacaacattttgttcaaacacacgaaacgtgtgaagataatgagcctagctgaaatgcaagagttatcagtaggcatcatcacctaggaagagcagaggctacaaaagaagtgaacagtgcgaaaaccatctaagttaagtagccagcagctacatgacaacaccaaccagcgtaggccagttatgaggtgcagtatttccacatcctctcatcacaatttatacagttttttcacctttacaggaacacgctaaggggatcaatcataaacatggatttctgaaatctggatccatcttgtgtgcaacggtggagatgaggtacacaatttgagaacattatcagcatgagaacagttcaacatgcagtgcagcacaaatctggggatcagatagtggaagagtaggaatgaaactgaagcctgcctggtacagtttgcaaccataagtcgatacttatgatattttctagcatcatagaacacttgcatagggtgatagaaccctaccattgatatccttttgccatgacgagtaagtctgatattcatacagtgaatgatatcgtgggcataaaatcgtcacacggtaacttgaaatggattccgcaacggtaaagcgtatataaccatgtgccttaacgtcatacaagagtagtgcatgagcacgcacacatagaaagggatttgatcgtagacaaagagaaattcagtccatagcgaaacactcattaccctgatatttgcatacatcaacataggcgaaatgcgggtggtttaaaccttttgttagaaattaggtcagtgcgcagttcattagtaaagaaggtgatgtttgggcaacaagcacagcacagggatctcatctcgattagctatgttattatgtatgtagagtagaatacaaaaaagatggctgctcatgggagcacgtttgctgtatctagcacaagacgtacatgataaagtagtaagtaggacaggaggcgcctcaatagttttacatggagagaaagggaatggaatagcggaagaggagaagggtcacctcgaggatgttggcgcagatgagagaggcgatgggcttggcggcgtggaggttctcgccggcgatgatggtgaggttggtgatgatgggcttggagttgaaggtgagctccccgagggcggtccggtactgcgcgacgagctcgtccacctgcgcctggtcgacggcgggggcgttgccattggcggcagcggggtaagatctgggatccctgggggcggggtgctgggcgaggcgaggcttcttggggtcgggggcggcggatctgcgggcggaggcggaggtctccatgggggcggcggaggcgcgcatggtctagggtttggggggcatgagcgtgtgggtgtgggtggagctagggtttgcgacgcccgctctcctgcgggtcgggtcgagtcgagtggagtcgaacggggtaagaaattggatgggcggaagccgaaggagggagggagagagtccgaagctgtgtttgtttggttgatttggagccgaagaagaggaggaggaggtttccttccttctttgcttgtcaagactcaagactccacatgaagaggagaggaacacatgacatgaggaggaaggaggcaggcatatgcctcaattcctcaacttccatctattcactgacttaagaataagattgttaaatttttatcatttttataccaccttaaaacttttttccttcacctgatccgataaaactagcatgccaattagcttaagtcatgtgaccaaaatcgatcggtcaccagagctccaaacatagtaattaacaattccacttagtgtgcgtgaagttgtcgctatctttttatgaagtcattattttcgctctagttccgtgaagccgtcaccatcgtcgcatgaaggcccatcgctcgtccatgaagacctatcattattgtcatactcgcgtgaagatcccgtccctaccactattacatgaagccgcgactccgtagctaaataaagaagccctctgtcctttttgatcttccatcatgtgaagacgttggcatgtctacctccatccatttcttctcttgatgaagcgatttccatgtacctaggacaaaattaacatttaatattttgaaaaaaaatattcttgatttggatctctttctttgccttatctttccatttcccctttttgtatgtgcggttaatttggttatggaaagcatcattcagcaacaccaaataatttgatatgcacagacgccggcgcctaaatatacacaatctgataaaaaaatacaggcaagctaatcctctcgggactcagaatgccagttaatgacaccttcaaggcttcactactgctattacctagaggaaagttaaatgggcgctatatcgtacatttggcattatgtttacttaagacaacccaaaaggacaacaagttcagttttccatgcacaaagcatatgcatttgtttttcttgtcatattatatatttcggtccacatcacagctcataaacagtggcggagccacctcctgggtagatcgggcaaccgcttgggcttcgctgatattgtctccactataaacaacggtcgacacatattacaatttttcgatcaccgaaaaatatcattagtcgcccggcttgataattcaacctttaatccaaataggcagttgcatgttggatcgagcatttatcaaattcttctatagcatattcgtcctaatggcaagtagtaagaaaaaacagaacgccaataatgagatggcctctgtacatgaagaagaaatataggtgcagttgaagcctttaacaaacatagtgctgaaattgagatgcaagcataagcatcaggtaaacagacacattaacaatgcagccatttgggtttgcacttcatcaggcatttgctgtgtcagtcaggaccactaaatatatgtaattgcttccttaagatgccacccaacaaatatcccatggataagtaggagagtatttttgactggatagttcatttctctgtgaatgaatcacaattcaatgtaaatttattctgaattgcagaacatctttgcctttgaagagtaatatggtgtctttacctgttcttgcagatggttctggtgaggagcttctagcattgtccattgcagtagacaaaaatgaagatcagtgaccacctacattcatacgtcagcacagaattaaaccatcagttaaaataaccgatcattgtagaatgtatatctaattttgcactcacaacttatcttgttgcatgcaccagcactacagtaccgccagcatgtcctagttaacctcaggcaccaccatctctgccggaagcaaaagccatcagattcaatactctttgccacccaaaggacgtcacagatccaagattatacaggaagattagaaggaagatagctgcaatcctgggggttgctcacattaacaaggataaaaagatctaaaaagttcaccaaggcacaaatcgtcatccttgattcagaaaaaaaagtcttgtttgtaaatgaactcttatttcaaagaactattcacaaatcctcatccttgattctgaacaacagatattgatagataatttttgcctcgatcagtagtagaattcagttcagttaccgaatcagcagtggaagggaagacaaaactcttcagaaggtcatcagtgtcagctttacttgagaatgtatgatcgataaaacacgttgctccatttctttttcttaatctctactcactccgtccaaaaaaaaacaaatcctaggttccgtgtccaacgtttgaccgtccgtcttatttaaaaaaattatgaaaaaaattgaaaaaacaagtcacgcataaagtattaatcatgttttatcatctaacaacaattaaaatactaattataaaaaaaattcatataagacggatagtcaaatgttggaaaaaaaacacaggatttatcttttttttttgagacggagggagtatacgacaagtatttaattgatgggcaagaccatggccagaaggcaactcaggcactcctcccagtcctaggtggtataattccatccgtcgatccaaacaggtctgaatttggtggtttcagagatgcaggtccaggcataggtagttagtgacagaagtgtctgaagtttttattgggctagcaacttgatacggctccagaattgactgacaaactgatcggttcatggatatgtctcatacaagcaggtactctactagtagagtagtagtatcaagtaagcgtgcaattcgttagagaatctaataattctttttctcgaagacgtaaaaggattgcacgtcaatatattaaaagataagaatattcgttacacaatgcattaagccagaccgacttattctaagagaggagaaaaacaaaaaaccaaaggaaaaagactcggaaagtacgactccaacttgcgggaagagaatctaataattccaattaaaccaaagccatggtattatctgatgaggtcgaacatacaatttactagcaaggccatgaatgctgcaagatactaatcagataattatcgctgtaaacaatacaatatatgatcgagtgaagctgctaagataattcctgggtgttagcttttgtggttgatgatcctactctagtcaaggtgttgtgctaggtgtcctcatcagtttgcatcttcaagtttgttccattcaaaagttctgataaaacataccccacctgtcccaaaatataatactctagtactcaattaaacaccatctagaattatggacagacctgttgattgccaggccatccagggcataacaaatgttgattgcagtcagccgatttcagattcacaattcacattctcagaaaacgaaaagctgcgaggaaaccaaattgcagaagaaaaataataggacttgagacgcccaactctaccaggaggcacgcatccataaagtgtgagcaatttgacaccagctagaggaccatacggtttacaacctcgctacattgataagaaataaacaggggcataaacaagagcacactcttaagattgtgctacagatacaactattcatccttgctacaaaatactagcaatagccccctcatataagttactcataggacagataaaacagtagataatctagccataagttaacacaacagcaaggcatgaagatgcatcacacttatccatgcccctcatccaaaaaacatgtccaagtccaaatccatgttatcctctttatcatccatacttgttccagaattttgttgatctccacctttccaagagggattagacagcaccacacgggtctgcttcttgtgagaaggcacggtcaacacaaccccttgtcgtttcaggttaccctttaaacctgcagccagcaaaatattaagtgaaaaccggctcaatgacaactaaacagtatcatatatatatatatatatatatatatatatatatatatatatatatatatatatatcctttccctctaaaattccatagcaaaacaatcaacctaggtgacatgcactttctgtgaaagcacatggtcatgatgcagtttttgtttccaccatctgtttgttaggtaacattttgcgattatagagaaaggcatccattttacagtcatatatgcacagccatttaactgggcattggtcataaaccccattctgtttcatgattccctgcctgtacataggttatatctatgtaatatgtttattagctcactgaagtgttccaagacagctgtgtcaagtattttgttaacaccagacaagtagcgttctgaacttgattatcatcagcggcatagaaacaatgagtatcatgtcctacagtaatgtccccttgttcttgttagtaaagacaaaggcacatgtttccaattgattagcacatacatatgcatcaatctaattgatttaatataactatcaattataactcacaggtttaatatttctgaaagcaagcaggagtatcaattaaaacttgtaggtcatgatggctagcaatgcaacggatgacagaattagttagtggatgcgccggtagaacacataaattacctggagccgtaggaagatagtctgatatcctactgcttatgtaggcagagctaatgccaagagttcttcctgcgccaaactcggccacatcttttagcctcttgttcttcatgtcaacagcaagcacccatgcattctggtcatcccagaggtcgaccttagccatgaagcaaacaatgtcatcagagtgcaagctgagctttggaaggcccacgtgaagtctctccaaggtttgctgaggtgtgccaagctcaggcagcaactcaaaattcatggtgttgtgatcaacagcaagatgagaggcagagatttggcagtcctggcgccaaccttgcttccaaggattggtgggtggtgcactccaagtggcagcaatccagccttgagaggcgtaggtgccgttgatagcggagcctggcctgacatgaacctgcatctcgatgtacttgatccgaccttggacaagagcaaagtcccgaagtggccctggacagcctactatcatgtcgtctttgtgctcgagtggtggcggcagcgggaggtagcggagctcagcggtgtcgcggagaaggtcgcagaagagaatgccatcgttgatgtcgacccagcccatggttccggcttcaccaccaaccgtgatgaccttgctagtgacatggctaaatgatggatcgaagaccaaaccatggatggagagcggatggcaggtccaagcatctgcaccagagcggtagagatgatcacctcgtttgaaggcgctacagagcgcggcgacgatgtaggtgccatcatcaaggcagcgcaggatgccaacctgtttgtcgatgaacctgttgtcgagtttcggggcggtggaagaagcgtggtagatgaagtaatcttggcggctggttttgaagctgtcgtcccggggccctaaggcgaggcggaggaggacgaggtcagcctcggtggcgatgatggtgggctcggctggggatccaatccagggcagtggacgcacatgtaggagacgcgcggcgggggcgccgcccagaaggatacctcgatggggtggccggtcctggtcctggacgtggcggtggtggcgttgccgtggttggtggcgatgtaggcatcgcattcgaggaggacccaaggtggtgtcgtcatcgccgcagtagcgacgtgggtcggcggccggagggactcatccatgatggtcttctcctcccaatcagaccacccatcactctcatctcctcccatgctctatatgcagctactatctactccctccgtttcgttttatttgacactgtcggtaacatgggaccggaagtatcatgactagaggcttgaggcagacgccatcgcccacgtggcctggcaccctcgggggacgtcgggcccgagggtgatgtgtgcgcccacctcttggtctccccgagggggggggggggtcggaccactcctgcctcgcccccgagggccgaggcgccccgacccctcgcgtttctactccacgtgtatgggttaggtgagcacagcggggctcacctaaccgcatttattgcgcctcggttaagcgtgtcacgccgcacgaagtgcagtgcagtgcactcgattatccggtctgtgaccagtcacagaccggtcaaatcgcgggttaggtggcgacaggcggtctgacgcacgcttcgccccatcccgtcaagacgagagcttctaggcactcgtccccggctggagctagcgtgttacatcccagagatgacacgttagccccgatcgatatatgccaggcttcatcctaaccattacaagcaagatgttgtttgaagaagggcaaacatgcacgttgctaagccgacgcgtggtggacaagaatgaccgatttgtgaccggtctgacactgctcatgtcgtcagcacacagccgccttcccacgacgtgcccgcctcaggcagaagtggaggtaggtgtgtgtcgtcccgtcaggaggatgttcggaggacgaccgtgcaaatctccgtccatttatgaagagaagaaaagtccagtttggaaagagaggggtgcatgtggtatccccttgaagtataaaaggaggacctggcccatagagaaaggggatgatcttttccagattcagaacctagaacgagggagaggttggctcacactttgtagctccttcatacacagatccaccaaaacacaggagtagggtattacgcttctcagcggcctgaacctgtatacatcgcttgtgtttcatgctcttttgggaggtcgcgatcttcccgcatacacggagagcttgagatctcaccctgagcccccggccgaaccggcaaagggggggcctgtgcggtctcccggtgaggagcgccgcgctccgtcatctggcgcgccaggtagggggctcagcgtgtgttttctgagctctcgcacttttccgtgtgcgtcaagtttttcttgatcagcctcatggctgagcaagcaaaggcgtccgacctctctcccagtgtgagtggcgacgacggggagccgaacccacgccgtcgagctcgtactccaccgccccctccacgccaaagtcctaagcagggggaggcgctcgaaagggtcgaaagatccgcggcttcaccgatcgcgggcgatggaggagaacggcgagatggggaccgtcgcctcctcgtctacggcgacggcagcacgccccagggcgcgctccaagctgcgggcgcgctcttacgccacccgcctgtcgtccctgacccggagtctccagcccaacgatggctggacgatgtggccaaattggtcatgacggcacggcagcgcctagatgctggtgggcggtcctccgccaccaaggcctctggtgctgctaccaccggctccgcgttgtcaagacggagggcacgacgagcggcagccgctgttcgccgttcggctgccactccttcgtcgactccttcgacccgggaagatctgcatggggagcaggacgcccgcgccagcatcgagcgccggcgtaatgaccgaagtgctgcccacgcaacggagggcgcttcctcgtccagagtgtcacctcgacatggacgtgggaatcagccctccgtgcccccggttggtggtgtcggctgtagagcctttgtggcgagtcttcggaatgtccgttggcccccaaggttccggcccaccatcgccgaaaaatatgatggcagcgtcaaccccgccgagtttctccaggtctacacgaccgggattgaggccgccgggggtgacgacagggtcatggcgaatttctttcccatggccctgaaggggcaagcgcggggttggctaatgaacttgccacccgcgtctgtccactcctgggaggatttgtgccagcagttcaccatgaacttccaaggcacgtatccgcgccccggtgaggaagcggacttgcacgccgtacagcgaagggacgatgagtcgcttcgatcgtacattcagcggttctgtcaagtccgcaataccataccatgcatccctgcacacgcggtaatctacgcgttcagggggggcgtgcggcacaaccgcatgctcgaaaagatcgcctccaaagagccccagactaccgcagagctttttcagctcgcggaccgagtggctcgcaaggaggaggcctggacttggaacccctccggttccggtgtggcagcttcggccgcccccggatccgccgctcaggcagggcggcgtgacaggaggaggaagaagaggtcagtccgttccgacgacgagggtcatgtcctcgccgtcgagggcgcttcgcgggccacccgaaaggggaggcctgcgagcgacaaaaagaaggaggccagcgttcccagcagggagcgccctaccggcaagtggtgcaccgtccacaacacctccctccatgaccttgtggactgtcgcgcagtcaaaagcttggcagagcggacaaggaagtgggaggaggagaggaggcaggagcgccgggaaggcaagtccccggcggttccttccggccgtcggcgaagtgaggccaggcagaaggcccccgccgaggacatcgatgatggcgatgatgacctgggtttccaagagcctggggccaccattgccaccgtcgatggaggagcgtgtgctcacgtttctcgccggagcctcaaggctatgaagcgagagcttctggccgcggcccctactcatgaggcgacgcgccgggcgcggtggtcggaagttgccctcacttttgaccagaccgaccacccgccgtgcgttgccaggggagggcagattgcgatggtggtttctcccaccgtttgcaacgtgaagttggggcgtgtcctcattgatggaggagcagccctcaacatcctttcccccgcagcctttgatgccatcaaggccccggggatgatgctccggccgtcccagccaatcatcggcgtgacgccggggcacacttggccgctaggtcatatcgacctcccggtcaccttcggtggacccgccaatttccgcacagagcgggtgaacttcgatgtggcggacctcagtctgccctacaacgcggtcctggggaggcccgcgttggtgaagttcatggcggcggtccactacgcctacctccagatgaagatgccgggccccgacggccccatctctgtccatggcgacctcaaagtcgcgctcgcttgtatggagcagcgtgcggaccgcctcgccgtcgtgtccaagcccgagggtggcgacgagaggcttggcacatccgcccccgccgccccgaggcagcggatagtcacgtccgatgaggtcccggtcaaggaggttgcactgggcgacggcccgtccaagaccacacggatcggtggtcttctggacggcaaataggaagacgcgctcgtctccttcctgcgggcaaacgctgacgtcttcgcatggagaccggcggatatgctcggggtccccagggaggtgattgagcaccgtctcgccgtgcggtcgggcgcaaggccggtccggcagaaagtgcggcgccaggccccggaacgtcaagccttcatccgcgaggaggtcgcgagacttctggaggccggatttatccgtgaggtcatctatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccaccgcggggtgcgaccttttgtgttttctagatgcatactctggttaccatcagattcgcatggctagggaggatgaggaaaaaactgcgttcattactcccataggaacttattgttatacgacaatgcccttcgggttaaagaatgcaggtcctacttttcaacgtactactcgaatttctttgggtagccaattaggacgtaatgttgaggcttatgtcgatgacttggttgtaaagacgcgcaaccaggaaacgttactttcagatttagcggaaacttttgagagcctccgctccgcccgcataaaactgaaccccgataagtgtgtgtttggtgtacctgcgggcaagcttctcgggttcttggtctctgcccgaggcatcgaggccaaccccgagaagatacgagctatagagcggatgcgcccccccagtaaacttagggatgtgcaatgtgtcaccggttgcatggccgccctaagtcggttcatatcgaggctgggagagaaggcgctacccttatttaagctcctcaagcgctttgggccgtttacttggacggaggaagctgaacgcgccctcactcagttgaaagcatatctcagctctcctccggttctagtcgccccggagccaaatgagcccctgctactctacttagcggcgaccccccaagtagttagtgcagcgttggttgtggagcgcgatgaggacgatcctcattccgtgcacccccaccctgtgctgacttggcccgggagcgagcagggaggagaggcccccgagccgaacggtggcctaaggcccctgacgaccggagtcggccctctgcccgctcgtcagatggtgctgggcgcccccgaccctcaggaaggccccgaggccactgcgggaaggctgcatctatcgccctctgaccccgaggctaaccctgtaccgattcgacccgggagggagcagggagaagaggcccccgagccgaacggtggcctaaggcccctgacgaccagagttggccctttgcccgcttgtccgacgacgccaggagcccacgacccccagaacggccccgaggccactgtgggaaggccgcccctgtcgtcctccgaccccgaggtcatcggcacagaagacgagtgcgccccgaggggccacttggacgaggagcgccccggggatatggcccttagcgaaggggatcggccccaccgaagggtgcagcggcctgtctactttgttagcgaggccctccgggacgccaagacccgataccctcaggcccagaagatgctttacgctattctgatggcctcgaggaaactgcgccattatccatgaactgcttgc

SEQ ID NO: 43194 - DNA, 3653 bp, Oryza sativa
catgctatcaagagccaggccctcgccgattttgtggcacagtggaccccggctccagagaccgggtcagtctctgaagccagctcggacccctcgcagctgcctcacgccgcccactgggtgatgcagttcgacggctccttgtctcttcagggcgccggcgcgggggtcacgttgacctctccgaatggagacgtccttaaatacttggtccgcctcgactttcgagcgaccaataatatggcagagtacgagggactccttgccggactcagagtggcagccggactggggatccgccgtctcttggtgttaggcgactcccagctagtcgttaaccaagtctgtaaggagtaccggtgctctgacccgcagatggacgcttacgtacgccaagtgcggcgtatggagcgccattatgacgggatagagcttcggcatgtgcccagatgggataacatgattgccgacgaactctcacggctcgcgtcctcgcgagcccagaccccaccgggcgtctttgaagaaaggcttgcccagccgtcggcgcgacccgaccccttaggggagacggacgcgcctgatcggtccccgaggcctgtcggagcccaggcctcgggacccgaggggagcgctccaagctcccttagattgattgcttggatctctgagatccaagcatacctcacagataagactctacctgaggaccgcgaagggagtgaacgcgtccaacgcatttccaaacgctacgtgctggtagaagggatcctctatcggcgcgcggctaacggaatcctcctgaagtgcattcctcgggaacaaggcgttgagcttcttgccgatatccatgaaggcgagtgcggagcccattctgcctcgcgcaccctggttggcaaggcctttcgtcaaggattctattggccgactacccccaatgacgcggtcgacctggttcggcgatgcagagcgtgtcagttccacgccaagcaaatccatcagccggcccaggccctgcagatcataccactttcatggccatttgctgtctgggggctcgatatcctgggaccgtttaggcgggccccgggcgggtttgagtacctgtatgtcgcgatcgacaagttcaccaagtggcccgaggctttccggtcatcaagatcgataagcactccgcacttaaattcattaagggcatcacggcccggtttggagtgcctaaccgtattattacggataacggcacccaattcacttgtgaactcttcggcgactactgcgaagacatgggcatcaagctctgcttcgcctcacctgcccaccccagaagcaatggtcaagtggagcgcgccaatgcagaaatcctcaaaggccttaaaaccaagaccttcaatattctcaaaaagcacggcgattcatggatcgaggagttgccagcggtgctctgggcgaaccgaaccacaccaagccgagcaaccggggaaacgcctttcttcctcgtctacggcgcagaagcggttctcccatccgagctcaccctgaggtctcctcgggtcaccatgtactgcgagttgatcaagatcagcttcgtagagatgacctcgactacttggaagaacgaaggcggcgtgcggccctccgagccgcacgctaccagcagagcctgcggcgctaccatcagcgccacgtccgggcccgatcactctgcgtcgacgacctcgtcttacgccgcgttcaaacgcatgctggattgagcaagctctcaccaatgtgggagggtccgtatcgagtgatcggcgtcccccggccgggctccatacggctggccacgggcgacggcacagagttgcctaacccatggaacatcgagcaccttcgtcgcttctacccctgaggggggggtcgggtgtcaggtttcgggctcgggccaaccccgcaccccccctcgggtgtgcagggttggccgggggctgccacacatgcacattctcatttctctcatttcagtatttcaataaaagcagtttcaatttcctaagggctgtatctgtgccgttttttcctttttgaagaattttgacttgaaatgaggtcactcgtgctcaaccttgccctcgggggctcggttcggtcagctaaaatcgccaaacggggcccagaaccgagccgtgccccggggcgtggtgaactccggggggggaatcggcaaaaacccacaatcgggtcacccataaccctcggtcaccacgttcccggcctggccagtctcgacatgcggatctccccaggcactagccccgacccgcgcttttttaggactgggacttggacacgggcccttaaatcaagctaagacacaaaaagaggaccacggcacagatcatcctcatctcatccgcatagcaaaataaaattaacacaaagaattttttcatcatttttgattgcagattataagttgatctatacaaaaaacaggcctgaaggccttagaagaaagaaaaagaaagaaattgtagattggcgggggcctgggggctcaatccgatgcgcccgggtcgccggcctcgtcttccacgtcgtctgcaccgctggcatcgtccttctcgtcggagttgggggcgaacgcaagccgaggggccgagccctcgaaactgtggacgatgttgtcggaggcattccggacctgcgcgcgcgcgctgtcttcaatcccaggtgggaactcgttcagcgccattcacagaaagaagatggggtccctggcctggtagctcgccaggacgagctccaccgctccttgggcgaagtccctcgaggatgacttgatggtcttctcgagctcctcagggagctgctggagagccccggccatcttcgagaggcgctgggcaaggcctcccaggttggcggcaggctttattgtctgccctttccagaggcccgcctgccgaccggcgcgatccagacgggagactgcatcccagagcatgccgggccctatctcgcccgccaaacggagggcctcggcttccccggcggatgagtctagcgcgcgctgcatgtcggcgacggtgtgttcggcatctgcgaggcgggcggctaagtcgctttcgcccgcagccgccccgccgatgcgcgccctcgcgtccagctccttttcccgcgcctcgaggtcggcagcccgctgctccagtgcggctctctcggcgcggacggattccaaattgcggcgggcctactccgtcagcgctgcctcacggagggacaggctgtccgccaaccgttgcgcctcggcctcggcctttccgagagctcgctcccgctcggtaagcgcgtcctcgcggaggcggagtgcggactcctcttcggcgcaggcagactcgtgcgccgccagcgttgtctcccgggaggcgacggcggcctcgtggtccgccaggtccttctccgcgacgcaggcgcgctcctccagcgccatggcgcgcgcctcgagggcctcttcacgccgccggagcgccgcttcggtctccgacgctcgctgctctcgggcagcggcggcatcaaggaccccctgggcggcgtcgagctttttcttcagctccgcctcccagttcccgtgctgaaggcggagggagtcctgcgcctcgttcatcaca

SEQ ID NO: 43195 - DNA, 2160 bp, Oryza sativa
ccccggacctgtttggtcctgggcgtcgcccgaaggagtgggcccaagcgacgcacccgcggcctcgtcgcgagccgcccccggacctgtttggtcctgggcgtcgcccgaaggggtggacccaagcgaggcgcccgcggcctcgtcgcgaactgcctcggaagccgccatcgcctcagcctggcgaacccgggcggcctcctcccgagcggcttcttcggcttggcgagcccgggcggcctcctcccgagcggtatcctcagcctggcgagcccgggcggcctcccgggcggcctcttcagcttcccgtaggcggtctgcggcctctcgccggtcagattcccgcctccgtgcctctgcggccgccggatcttcggcctcggactggccggacttgggatggtgggaggaacgcgatgagatatcactgaagcagaaagaaaaaccagaaggcaaacaagatgggtaagagaaaacttgcttttgggatagaagaaaagacggtcgcaatgagcgtgggacgaacctgcgagggggtcggttaaatgaccaccttggaggggaaattaggtttccccgggatggttctgtctcccccatcttgcgcagccgcttcttcttgcgctccccctcgggctgcgatgctggcgcggccccctccgggcgcctgctgctggcgcgcaccgccccgccccctcggggaggagatgggggaggtgttcctcccagcttcctcttcccccgggagtcggtagggcggctgctccccgagcccccgacgcggggcccagaagcacgaccccctccgggggtagattgatcccctcggcggctcccgcctgcgtcgtcatggcccttaggagcctgctcctctgaggccccgaccgccgtcataatggtcaagatggaggcgcgatctggatcgctgcagagggggaggataccgtgggggatgagggacgcctccacggagttgagatttagcacccgttggaccagtatcttgaagtcctcgggagcccaatcccatctgactccctggtgggtccgcatgtagtcttcggacccggtgtactcccaggcgccccgagcgcgccgctggagcggcgcaatccgacgacggaggtagtcgccgtacaccatggccctggtgagcccctgggatcgcaggcccgcgaggcggtcgaggacggcgtcatagccatcccccagatctaccggcgcccgccagctggaggcctgcgccgggggctggctcggaagtcggaggcgcgcttcgtcggcgaggggggtatagaaccagtcgctcttctagtcatcccactttttgcggaggacgcaggggatgtagcggttcaacaccggcccccgcggcaggaaatagcagccgccgaccaccgacggtggcgataccgactgcacggtgaagaaccaccggaacagccgaagagatgggcgcaccccaatgaacatctcgcacaggtgtgcgaagatgcccaatgtcatcactgcgttgggggtaaggtgcgccatctggagatcgtagaactccaggacatccatgaagaaagaagaaaatggcggaaccagccctgccattgcaaaggggagaaagaagacggacctccccgggtagtctggcgccgggcgtccctcgcccagcatgactatctcacggccggtggcagattccggcataaagcggcgcggcaacccagcctgcttctcgctcacgatgcgggaaggcggcagcacgctaccatcaagcagtgcggagccccgtgccatggcgccggacgaagagaagatggagagcgagcgcgtgtggcgaaagaagggcgcagggaagaaggagttagggcgcaagcggcgaaggcaaggggaatgatggcgaaaggaaggaaacaaatcctatcctcagtgcctttatacccttgccaacgctgtgcccggctcctcgtttctcgcgcccattatttcgccccctcgtttctcgcgcccacgcttccactgatcccattcgcccgcttgcggcgcgtgaggtggatatgcggttgcggcagtcgagatagatcgtatcgtgcgcgcgttaattacgctcgccgaccgaagcgacattaccgtatctccaggcgaagcaaatcggctcgcccagattca

SEQ ID NO: 43196 - DNA, 32102 bp, Oryza sativa
aactattcttcatcatgtaaagttgtaaacagtaaggtgtatgctgaatttatatgtccatacctaatctattttgttgttctatacttgtatgctctattttgttgttaataaattttattttttaaaaaaatcagtgcctagaaagcaaaaacgacttaaacatcaaaataacagctcaacgacgaccattctacctgatcctgctcctcaaggctgcacagcaaataaaataaaggtcagttccttattaattacttcatttgattgtgcaaatgcagagtagaaccatcatctgctagctgtatatgtccccaccatgattgctaggtttttatctggtcttgttgttttcattgatctgtcctagataaatcactttccaaaaggacttttagttgagctcgatcaggggtaaggtaaagtctaccttggaatgcctatcttcatactgttgtatacaacccatgcttcttagaattgcaatgtgctggagaaaaatctgacacgttgaaccttcagtaacacaagcaatggtgtgaaaaatctgaggaaatataatggtcttttttcaacaataacctttcctactaactataagattgagagttttccttgaccagttcattctcgtagcaaagtacaactgcaagtactcttcatcagggcaactttaaagaagtcagaaactgcagagtactcagctgtcacacaatttgaatgtaaattttagactaagaccaataatctatcagattttcatgcacgattcactggagaacctgaaataaagcagtactagtctatattcatctgaaagaagagggaatgagttgcatcagcaacaataagtctcaagaaaggaagcaatggcgtctgattttccaatccaattaagatgagagaaccacaattaatcctaaaggaagaaaaagagcggatacaacatgcttactagtgccaggaaaaaaaaaacaggaatgctgaactgaagttgatcggcgattttaatgagatcggtgcagaataaaacaaacttttgttcatcaaaatttttgctgtattacataactgtattatagatgcacttggcatcttcctgctttctccactgtttgcaatagatgaggaatgaatgcaagaaatgcaacaatctctgtatccagtgattctggattgttgtatacaaatgtgtgtatgcaagaaagctgtgttctagatcaatgtgtctgtggattaagtaagtaattgattgtatttgtttttgcacaaaaaatgagtatcagtggcggttctctgccctaacagggactgatgatccccacacggaattgtctgatggtgcttgagggccattagtgccagttccaaaaccgtcaaaaccgagagttatagcccttctgaaccggcactgatgagaggtctggggtgtttatcaagttgtctatgagaacctgcagtttcttacaatcttccaactaacaaagtttggtacccagtcatattatcttatatacaaagggtggaacagatgaggagtgaacctcgtattaagtttcacatacttatttcggaaccctcaggattaggtaaaggcatgagcttcatcttcagcagaaatgagcatttgcactatgtacttcatgcttggcctcctgtttctatcttcttccaggcatgaaatggccaattttataactagctgagcctgcaaatgattaaattcaccaccaaattgatcatcaattaagtccataatccatgattcattcttgctgtccagtttgtcaacaaccatcttaaccacgcttctcacatcagtttctactccatctttcccatccactacccattctgtaatcctcctccctttcaccagctcaagaagaacaactccataactatacacatcaaccttctcggtgatgggaaggctagaaacccactcgggagccatatatcctctcgtcccccgaatccgtgacatttcagaaccagacccatctctgttcaacaacttggacaagccaaagtcagtgattttaggctccatatcttcatccaacaatatgttctcgggcttcatgtcacaatggatgatccactctaggcattcattgtgaagatatgccaaccccttggccacacctagagcaatgttgaacctttgcttccatccaagaaacttgctggaatctctcctatcaaatagtactttggccaatgatccattctcaatgtactcatagactaaaatcctatgtgttccttccgagcaaaatccccacattctcacaagattcatatgataaatcctaccaatcacactcaactcggcttggaaaacatcctcactctggctcacatcttgtagcaccttgacggccactaccctctcatcgtctaaactccccttgtatactatacctgatccaccatgaccgatcttgttgttgaactttttagttcccctctccaactccgagtacctatatgcgcgaaaatggctagtaacaatcctgtacccttcttctagtaccgaaacctggcttggcctgaaaactcccttgttggaaaagatccagcaacccatcgcgatcagaaacacctcaatgacaaaaattgcagacaggaatccatagaagtagaaccatattgacttgccctgattattgctcgagctcgacgacatatcggaaacatcgagcaagaactctgatgagcttgagccactacatccagcaatgtcttcctcaatggcaaggccattcgtctgccattggtggacgtgcaactctggcatgtcgagatcagctgggaccttgagataggccgtcccaagatgggcagggtgtgttctgccattgaacatgaggcccttggtgtagcactctcctgtgccctgcttgtactcgaacaccacgcacgacggctcgctcatgcaccgcgccgtgcactcgtgcagcgacaggtgcgcgctgctgttgatgtcgaagccccagaagtcggtgtgcggcagcgccaccagcttcatcgcccgcggccggccgccgccgccgtcggtgtggttgaacgtcggctggcagcctcttgtccagtcgctcgcgtcggcgcgcgcgtaccccggcacgcagacgcacactggcgccggcgagtagaggcacacggcgttggcgccgcacacgccgtggatgacgcacgggttgacgaacgccatccacgacaccgaccatgtcccggccatctcatccaggctgtacagcctgaggttgccgtccgtgtccagcgtcagcctcctcctgacgccggcgccctcgccgaggtcggcggcgtcgaaggtcgcattgtcgctggacaagaaatggccggaggcgtcgaagaaagcttcccgggtgaagttgtagtagatgttgcggttgttctgccagtagctgtagtaggggttaggccagtagatgctgctgggcatcttgtggttgtcgtacaccagcgagagcatggcgtagtcgctgaagcggaggctgtagaagccggcggcgaggagcttgcctgccgagaccatcgcctcgccggcggcgacgatgcgctgggtgggaagcagggtgtcggtggggtgatcgaagctctgccataggatgttcccgctcgcgtcctcgatggcgaggttgccggagtcgtgcagccgcgcgcgagcggcggtggcgttggcgacggttgagttccataccacctcgccgtcgtagtcggtgaggacgagcgcgccgcggcggccgtcgagcgcaacgcgggagcgcgcgccgtggacgggggcgcggccgcggttggctgaccagacgacggtgcggcccgcggcgcgcgcgaaccagacggagaaggtgaagacggtgggcgagacgccgtagaggccggcggcgaaggtgccgtccggggagagcaggacgtcggtggcgtggtcctcgacggcgatggaggcgccccgggggaggctgtcgcggcgcgcctcgcacgggaatggacgcgacgacgagaggaagacgacgacgacgagaagcagcagcacggtggcggtggcgcggctacaacttttgcccatggccgtggcggtgaatgggttgatcagaagcgatgatttgcttctgctcactgttgaggtgttgagttaattaaattaaacaaattaagtagtgtaatacagtatgttattacagttatctgagagtgatgttgcatcgttaactctttatcaacagcgactgcatctttgtatttgtttgagagcattccagcaagccgagtgaagagataaagtcatgctgaagaatcgtcatgagtcatgacgatgttttattcatggataaggacataccgattggccaatcgtttcgagcaaagccgaatgttttctttgctagatgctccctacgtttcatattataattattacatattataagttatttaattttttttcttagttaaagttttttaggttttatcatgttttatagaaaaaattagcaatatctacaacactaaattagcttcattaaatttaattgaatatattttaataatatgtttgttttgtattgaaaatattagtatatttttctataaacttaatcaaacttaaagaaatttgactaagaaaaaaagttaaacaacttataataatacatatggagtaatttatagaggttacagagcaaaagccggccgaaatttaataagtaggagggtgaaaacagagatttatagaggttacagagcaaaatgacacctaccaccgcaaaggacatgtactccaatgtaaaaaaaaaaagacatgttactcccaccgtctacgtcctgcttagcccatctatgtctacgctggctttgctagataattcattcaacgtgcttctcatggggaatggattataatttttagaggggatgtcttttcatgtatactttttaaaaaaaatcaatgcaaatggttgtaagaaaaaactgaaaagttttgataatgtagagtatactatttgtgtattatttaagcaacgagaagatatcatctcgagagtttaaaagtgtttcccctttttgtggatgcttgttttgcaacaggaattgcctacaattactgctacatgttagctgttgttacggttgtgcactgacttataggggatctgttgtttcttgttttgatcatatattcaaggtaaatatgtgtttcttattttgaccatatattcaaggtaaatgtcattttttatagctaagtctaactagaagttcttctctgcaagataacttagaaaaatgtccaaatctgctaagaagtactaccaaaggttacatcaactacactgtgagtatctgactaataccaattctaacattagctgtcatacaagatactctacattgcaacacatgcaacaaactagttcttcctccgttgtaaatttttagtatataacaacttctctatccactatctcatcttgacccatcaatgattgtctcttgttaattttttccaccactttcatatatcaaacaatcaaaatcatccctcatttagttccacctcgctccttaatttctgtgaaaaatctctagaagtattcatattttatgatagatgaagtagtcactggtcaagccatgctagctcatcctagcatcatatttaactcatggcggtttgtactaaaattttgtaacaacttctattaattaccagcggctatcatgcccataggttattacaacatcaaactagcaaacaattgtaaagtatgtcttcatcatatgaacaatagaaaaggtgtatttgtgtatgctcccacaagtatctccatacctgaggctctattgttgttaatagtttgatttttttataaaaaaaaatcagtgcctagacagcgaaaacaacttaaatatcaacatcacagctcgaggatgaccattcttgcctgatcctcgctcctcaaggctgcaccgcaaactaagtcagatcatctgatttcaactacagaggagccacagtgaagtatcattatctgctagttgtacgggtgttgttggtatcattatctgctagctgtgcgggttgttggtatcattggtctgtcctaggtagattttccacaagtcttaggctgcgttcgggaggagggttccccgacacgcaaaacgaaggatgcattactagatgattaattaagtattaattatttttttgaaaaatggattaatatgattttttttaaaacaagtttcgtatagaaattttttgtaaaaacacactgtttagcagtttgaaaaatgtacgtgcggaaaacgagagaggtgagttgggaaaactagggaagaacacaaccttaagtctaactaggaatgcctattgtcagactgctacagcccatgcttcttagaattgcaatgtgctgaagaaaaatttgataggctgaactttcagtggcaataagccccaacaaaggagacaaaatatgtccaatttctcaaaccaattaaggaccagcaatcaatccaaaacgaagagaaagaacgcatacaacacgctcaataaataataaagacatgcaaacaaaaggaatactgacctgaaaagtatatcaacaattgtgatggattaggtgcaaatgaacttaaggaaaacacagtgaactaggatatattcataagatatttcttctatgggacaatatctcatagaacgaagggtctggatctaactgtacatgatagcctaggttcgatcatatctaatgaagatgaatcaggcttttattagggaaaagagagtcaatcaggtttgatcaaaataagcagatgggatctgcaaccactgttcattaaggcgctaggtactattctggcatcggacagcacccagcacctagattctgttcctatatgctgagtttctgcaccaagatgagcttcttcatgcgctgacttcatccctaccaaggatgaacacaatcacctattaaaattaatttaagacttacattcctagtaaaactatgacaaataaaagatcacactaaatggaaattgcgttgatgttttgaagacatacttaggaccacctgtcgtccatagattgcatgttactttatgatttatacatgtctacgatgttatggagggacatttgcaaatttaaaaacaaaagggtaatatttattctgttgcaattatttttagtttagttgtacgtgcaatattctctcaaatgtttcatcataaaaaaaaatgttaagagataatgtgaacagaaagaaataaaagctaccatctctcctttattacttgcaccaacaaaatttacaagatacgttatgcagctaccaaatttctaattgtttatttctccattgaccaggataacggcttaactatgtgtacggactctacggaacatggtaacctgcaaaaataacaaaagaaacataagtcttttattcattgcagaacagggagaactttatcaaaaggttaaattaaaacagatataactgtatgtaatcaactaagttagtatgaattaataactaacctgcgcagttagttcctgcgtgtaacggattgtcacatacttttgcaacattaacccactttgacaaagcaattttagccttatccgctgctgtaaatgtgcgacagatgcaattgacatctgcgctctgcactgtttggcagcaatgtgagtgtctttttgggaattggtcacccaaatgtttttcaatattgtgatagcatccatccttattcatcacaatatttttctcgttctcacagccttcagcttgtaaatggctcggagaagaagagatggctacaaagccaagaatgcaaaacactcctacaactttagcactaatcatcttcttgtagtggatgctaaaatttgtgtgtttgttgatcaatatgtgtgcagcatatgcagcacaaatatctagattcggatcaagtgcagtcacagtagtgactgcaactttggcagtacccaatcatccaaccatccagcacatgagggatggtctagatttaactgtgtcatgcatcattttagctatttgaacaagcacagaacagtagttcagattttgcctgcaatttctctccttttgatctgaattttcttgaactttcagaaaacccaaataatgttaaagaaaagtagacacagacttcatttcattatattgaacttcataatatcttgcacgcataattgacaaaatgagctagagtttaactattttcgctgaaattgggtgtcatgcatccactgagacaaaagctttcaaaatcaactagctatgctactgctagattaacacagtaacaaaagctttcataatccaaaagtagatcatcatctgcttcccaaatcagcacgatgccttctaagttctattgacacctcttcaaatgaacttttgagataagatgacatcttcaacgtcaatagaaccctagggaaaaaaagataatatccaaattaaaataatttgttagcacatatatttatctttgaagaaactggtcagcataccagtagaagttgggcatagctgctaattgcttcacattcttgatgttcttccacatcagtttgcaagttttcctcctctgccttttcttcaggctgcataacagatttgagaagtggctcaatatatagttctcaatatatatagctgcataacagatttgagaagtggctgaaatatatttacctttctcttttttgttttctgcagtttatcaatccaatttgttttccgttttgttacacgtttccggctctcctttttcttcagaccagagacatgtgccaagttctgagctaactgggatgttgactgatcattcgactttgcaatgccatcactgtaagtttgttttattttgtcctcaacttttttactaacggcatgaagtgcttcttccacaagcaagtaacattcttcaaagtctacagctctggaagccaaaggaagaaattgttggtacagatatctgtacctaagagtagtactcagcttggggtcttccactatttgtctgccatgcatatcttgaatagctccacattttgcttctcgagtccaacgcttcaatacatatttttcaggcaacaatttaatgttcactaaatcaagagctttcaaggcatgtctacacagtagacctattctctcaaacattcgacaactacacgacacggtctgatcaaaagggttggcagtcaccttgtgctcatcttcaagtatgaactgatcatcaagtgagccaattgcaattatgaaatcattacttccatttgatcctttcgtataggtagccatggatttctcatattcagcttggaagacttcaaataaagcaggtgtgtaaagcttacttgcctgtaccaacataggtgtcatcatcataattcttggcaacttttttcttgactcatattcagattgcaattccttctctctcttttcttcaacaacacgctctacacgattaaggaacctgccgatgtcaagatctgatttcaaatgacctttcaagttactattcaaactttcacttaattgtgggcttcgcatccctattgtgaaaacatctgacatgtagcactcagcccacttttcttttaaattgtatatgctatccaaccaagtcactttacgcaccttttgtctcatggcatcaaatacatcttcaaattcttctttttcctcatactcatacatacatgcactgaaatctgctaggatacttgaaccttctgtttgttgaggactcaaatgctttacttcattttgtgatatgtgccaagtacataaaccatgccatgcaccagtgaatacttcagacacagcctttcccattgcaatgtcttggtctgtaaaaatggtttgaggttgcttttgattatgggctgataaaaatgtattgaacaaccacttgaatgattcaaatgtctcatcatacatcaaagctgcaccaaaaaccactgtctctctaaaatggttgaagccaacaaacataccaaaaggtctactttctttgtttgtcccgaatgtagtgtcgaaggtgatgacatcaccaaagtgagcataatcagcaatcatcctagcatctgcccaaaatatattagctatttgttcttcgcaatccaattgcactgcatagtgaaatgagggattttccacaattttatcttggaagtactttagtaaacttcctgcctcaccataaagtaagtccctttggcgcctagaacgcagataattcttatgatcacgctgtgtgtaaccaagattagctgacccaccaacatgccgaccaagaaactcatgtgctgctttaggtgtaataccagaatcatacgccacctcaatttcgactgcttggtgtttagaaatgttcctttgtgatggcatcaaatggcttgtttgtggagtttgaagaagatggttgtgttctacagctaagtcatgaaccttgtatgtcattgtttccctgagtaaagtgatgcccatgcgaacttggcaaccagttcgagtatgagctcgattacgttttgctacaacatatttcttttcttctgctctagaaccctgatttgaacaaacaaacctactggatgttactaactgatcaagatcacttttgttagtgtaattatttcgaacatcaaagccaatacgaccaccatatttgacccaaaaatcccaagcttcttcataggaattaaatgtcatgccaatttgaggcatccaacagggaggtttagtagatctgttacattacagtatagaggaataaaaagtttgacgcatgaacaacacaggaagaaagaagacaaaaatcagaagacaaaggatcctatcgcgatctgtacctctccaggttttgctccatggccttctcaacggtcatggctgaacagagaagagaaagaagcgtgtgatgtgctgcagcagtaatgggtaaagtatgcttcccatggtagaattggcgccaattctcacctccctctcagacttttccctccaaaacacttctgctggagtcagagagtaggtgaaaagttgggggaaattgagcaaccaatctagaccatcccttgtgtgctggatggttagatgatgggtactgccaaagttgcagtcactactgtgactgcacctgatccgaatcccaaatatatagtggtcatgcgaagtcctgtggggtctctacatactattcacttgtttttgaatatctactataaaagatatctaatggctaatgtttgaacttataatatctccaacatatcttaagatatatttattttcctcggatatgtgcatttatttattcttttttaagaactggaagatatcttcatttattaaaactattgatggattgcttggatatgttctcatttaataaaaatatgatatgctagatggattattctcatttattgatctgctactacacagtaatttattctcatttattatagagtaaatttcacaaaactatatatactttcatcaaattatcacaaaactacagatttaaggtgatatatcataaaactatatatttaatactaaatttatcacaaaactaaaggtttaagactaagtatcgcaaaactatagatttaataataaaattatcacaaaactacacatatggggttcaaatccttatgtttgagttatcaacgtccaagttttataattaaattgacgtaaacatgtggttttgtgataattttattattaaatatgtagttttgcaatacttaaccttaaacatatagttttgtgatatattatcttaaatatatagttttctgataaattaatcaaagtatatgtagttccttaaaatttactctttattataagtttataactaccaatagaccattagaacgcatgatgctggtaagtagcatgtagggctaacgatgtcccacctgacacactgaaccaagctacagattatttgtgattaattaagtattagctaattaaaactaaaaatggatgtatgattttttttaaaacaatactttctatagatttttttaataaaacacatcatctagcattttgggaagtgcgcgcacgaaaaacgagagtgtagaagttgggaaagtagggaggatagcatagccctagagtgagttctttcttgatgttgggaactcatccctcgcgcatgaaaaatgaagcgacttattagcgcatgattaattaagtattaactattttttaaaaaaagttaatatgatttttaaagaaactttcatatgtaattgttttaaaaagaatacaccatttagaagtttaaaaagcatgtacgtggaaaacgagaaagttgagtttagaacttaaccgaactcaaccctattgatgttgtgaagtctctgttaaaaaaatagaatgatctaaagtaagttgtcttgactactgtctggacaacaggttgaatggtgattttaatatgcccaagaaatttacaatattgaaagtggttattatcttgtggttgtggctagagggagatccaaaagaaatgctataaaagtatagattgttgcatgatatgaaaataaggatatcaatccgtaagcccttctctatttatgatgggaaaataatttgtgaaaagttggcttagatattcatctaacttagaaatactcagttgcattttttttagttttaatcatttgctagcataatttcagtactatagtgatgtttatcaagttgtccttaagaacctgcactctcttacaatcttccaactaacaaagtacagtgctcttgaatttgcatagtttttacagaaagggtgaaatagataaagagtgaacttcatattaaatctcaaatacttgtgttagaaccatcggaattaggtgaaggcatgagcatcatcttcagcagaaataagcatttgtactatgtacttcatggttggccttttgtttttatcttcttccaagcatgaaacggccaattgcattagtagcctagcctgcaaatgattaaattcaccatgcaaccgatcatccatcaaatccgcaaccaaggattctatgttgctctcaagtttgctgacaaccatcttaaccacacttctcaattcggcttctagttcctctttcccatccaacacccaatctgaaatcctcacccctttcaccagttcaagaagcaccactccataactgtacacatcaactttctctgtgattggaaggctagaaacccactcaggagccatatatcctcttgtcccccgaatccatgacatgtcagaaccagacccgtctctattcaacaacttggacaagccaaagtcagtgatcttaggctccatatcttcatccaatagtatgttctctggcttcatgtcgcaatggatgatccactcaaggcactcattgtgaagatatgccagccccttggcaacacctagagcaatgttgaacctttgcttccatccaagaaacataccagaatccctcccttgaaatagtactttggccaatgatccattctcaatgtactcatagactaaaatcctatgtattccttctgagcaaaaaccccacattctaacaagattcatatgataaattctaccaataacactcaactcagcctggaacacatcctcaccctgcttcacatcttgtagcaccttgacggccaccgtcctctcatcatctagaattcctttgtacacaacacctgacccaccacggccgatctcactctgaaaatttctagttccattccgtagctctacgtaactatatgcgcgaaaatggttggtaaccatcctgtacccttcatctagtgctgaaacctgacatcgcctaaaaactcccttgttggaaaagagccagcaaccgaatgctatcacaaacacctcaatgacaaaaaatgcagtcagaaatccgtagaagtagaaccatatcgacttgccctgattacttttgctcgatgacgcattcgagacattgagcaagaactccggtgagctcatgccaccgcatccgacaatgtcttcctgaatggcaatggcgtggcgatcgccgtccttttgccattggtggatgtgaatttctggcatgtcgagatcagccgggaccttgagataggccgtcccaggcaggccggggaacgttctgccattgaacatgaggctttttgggtagcactcacctttgccctgcttgtactggaaaaccacgcacgacggctcgctcatgcaccgtgtcgagcactcgtccagcgacaggttctcgctgctgttgatgtcgaagccccagaagtcggtgtgcggcagcgccaccagcttcatcgcccgcggccggccgccgccgtcaccggagttgaacgttggccggcagcctctgctccagtcgctcgggtcggcgcgcgcgtaccccggcgcgcagacgcacaccggcgccggcgagtagaggcagacggcgttggcgccgcacacgccgtggatgatgcacgggttgctgaacgccatccacgacaccaaccatgtcccggcgacctcgtcaaggctgtacagcctgaggttgccgtccgtgtccagcgtcagcctcctcctaacggcgacattcttgcccagatcggcggcgccgaaggtggcgttgtcgctggacgagaaatggccggaggcgtcgaagaaagcttcccgggtgaagttgtagatcttgcgactgttctgccagtagctgtagtaggggttgggccagtagatgctggacatctcatggttgtcgtacaccagcgacagcatggcgtagtcgctgaagcggaagctgtagaagccggcggcgaggatcttgtctgccgagaccatcgcctcgccggcggcgatgcgctgcgtgggcagtagtgtgtcggtggggtggtcgaagctctgccataggacgttcccgctcccgtcctcgatggcgaggttgccggaatcgtgcagccgcgcgcgcgcagcggtggcgctggcgctgacggtggagttccagaccacctcgccgtcgtagtcggtgaggacgagcgcgccgcggcggccgctgagtttgagacgggagcgcttgctgtggacggggcgggcgcggttggcggaccagacgacggcgcggtcggcggcgcgcgcgaaccagacggagaaggtgaagacggtgggcgagacgccgtagaagccgcaggcgaaggtgccgtccggggagagcaggacgtcggtggcgtggtcctcgacggcgatggaggcgccccggaggagactgtcgcgcgccgtgcacggaaatggacgcgacagcgagacgaagacgacgagtagcagcgctttggtggcggcggcgcgaagggcaccgctactgctacaactagtgctcatggctgtcaagtcgtgccggtaatggtaattggtaggtggcgaggaagtgattagctttgatctaatctactcactgttgatgtgttgagttaattagacaagtatactagtaattaacaaatgttttatccgacaggcaaattgcaggaaccgtgaccaaggcgcctaataagtttgactcgccctgacagacgacgacaacatgtttttcctgagacaatggggaccagatcctgcaaatggtattaggaggcaatcgcgactggtattggaattttgtaattcttccgtttcacaatgtaaaaatttctagcattacctgttggtaatttttctaacaagtcgacaagcacgatcgcaacacctaaacgccttgcggtgatatggagtcgccaaccacctcgatctaaccaaagggccaaatcaatatgggttttgcaaaaagaaaagctaaaccggctagcggagctatgggttttgcaaaaagaaaagctaaaccggctagcggagccgatttagagatcaaaatcagcctttatgccgatttagatcgatatgaggataactacccgtctcgtgggcaaaacggaaggttttcaggacaaacctacaaagaggtgtcgcactctcgcagcggcgacggacggtttacggcgcaaaccgacaaagatggactaaaattagggtaaaataaaaaacatagtaaaagaacgattcaagtagattgtattcgggtgttttacgatgaaccggtcttgtcccttctccacgtccaactcgggatagaaaataaaggaaacacgaaacatgccttcccgagcaaggaaacccgagacctgacgaaaacagactcggacttggaccctaccggtctgaccgcccacatacctgcggtcagactggccctactagccggtcagactgcccatatacctgcggtctaaccggccctatgaaggaaacccggcactttccaaactttaaattttcctctatttcgtctataggtgccaaatttgggtgtaaacacatgcccccctgcattttttatgaacatcgtgaatctaaaagcatagaacatattgtcttagggcgataatccaattaccggccatagtacttcctaagcatcttgccaaatgctcgggaagtatttcttcaagtatttcccattaattgctctatgaaaacaccgtcttgaagtgtcttcatctccttcaaagtcttcaaacgcttgtcgatgacgtcttcaaaattgcttcccatcaaggtcttgtaatcttcaaccgacaagtcatcttgcttgaaataccgaagagagtcaagatttacctcaacttcgtataagtaatattctcaagcggcacggcttcggcccacttagtgaaatccattgcaactagcacgaaccaatgcccttttgataacgaaggataaatctgaccaatgaaatccaaagccctacctcggaacggccatggtttgataataggattcaatatagcgacatgcgccaaatgaacattgccgatccgttgacaagcttcactccctctgtagcacttgaaataatcatcaattactttcggccaatagaattccactcttctaagcaaccaattcatcttatgggccaattgatgaattccacaaatcccttcatgcacatctcccctagcaactttagattgatcattgtctaaacacatcaatagcactccatctatatttcggcgatataatatttgaacatttgccgccgaatcttccgatcaaccccaagactaggatctttcaaatattctatcaaaggaattctccaagctatttctaactcatgggcacaaatgtccgaattcacaattaattcggccttttaatcaactgtaacgtgcccccaagcctcctgtctgggatcggtcagaccggccacgcaatgccggtcagaccgccctgtctgcctgaacagaccggccatgcagagccggtcagaccgccggtaccaccggtcagaccgccggtaccaccggtcagactggccgtgcaatgccagtcagaccgcccctagtctgtgattttgccaatttcatccaaagacttaaaaatcaagcaccggcttttctaatatcaaaaatactcctttcttcatattataaccagatgcttggtgtatcgaactattggaccaaaatccctcctctctagacatatgaaaaattataatatccaactaatatgtctagatgaatactaattcaaatggcttttgaaacaataatcatcatggcatcaaaacacttagccaattgaagtatgatcaataatgaatcaccaaagtcatatgtgtcacatgcatagattctaataaactacaaatgtaagtaatcggcttgagcatgtatgtaaaatattaacaatgccaatgttcctaaagaaaaccactctagagcaaatcatcacattgaccattgacattagtcgaattactagtaagcaaaactttcatggtgcaataaatatgaaatctatatattatctggtgatccataaaaacacatataatttggctttaaataaatatcagagtcatgagccaaatcatatttcaaacaaattatatgccaacctaccaattctactacctagaactggcatttgcaacatgtatgtataatatgaatttgataagtaaaaacacacatgtgctagatagcaagcaatgttctaacatggcataggcatataatatgatgatgaacacaataaacccataccttgccttagcatccaacaaacggcggctaaaagatgtgatgccgtatccatcgctattcatcttctcttggttccctcataagcatattgatgtcttgccccccgagcaaaatcggctttcttgattgcacaatttcaaaggcaagacgaacaccgcaccagcatcgatagcatcatgtgaaggagacttatctctaatgaccgatgattcttctcttatcaaattggattcatctctactacgggaaatcaccagtctcttaacttttacctcattggatctccacatttgcctaggtgcttttcgaggctccaaattattgcatgtcttgttctccacatcttcggcctctttttctttttgacctatggctcgaagacgctgtagcctcctcttttgagagtgagataagccagaaggtatccacttcggctgtggttgttttccaggagctaagcaatgattcttcatatttttggtcgaagtggaagctcctatgttgctctcaattttcacactcttctccaatacccccccccccggtcagaccggcctctgggcccggtccgaccggtcacaagccgtcggtcagaccggccagtaaggtcggtcagaccggccgtagactggcggttagaccggccagctggctcggtcagaccgctgatgtcgacaacaacggtattggctttagtcttttccgtttgtatagttttcgctgcatctccagtaggtacatgaacatcttgagattcctcattgatagcaacgacctccggagctttggcttctttcctcacccacaccttcttcacctttttcacctttgatccaccggaccgattcttttggggaaacggtcttgtcttgagttggatgaatgatttggcactaacctaggtgattccttccactcttggtaatacggcataggtggttgatgcatccaaggcatgtaatacataaaaggataaccatatagtgacattggatatggataccatggcatcacaaccggaggtttatatggagttggtatggttgatggctccgattgctttgatgtttgaccaaatctcttcctacgagatgatcttggtcttttcgaatcactagtttggttatcaaatcgttgaccggctaatcctttcttgtatttagccataagcatctcaaaagtgagcttcggctttttggtcctttggatactagataactcatcctttgcaactttatgatctccggcctttgcattattgatcctattcttgggccaaggatccccaataataacacttttccctttctttttgtcaacatcaataggactaataaggagagaattactaacaattccggtcttaggcataggtgtaaccgaaatagtttcacacgtgaccgatgaagtatcaatcggtctttgctccatcaagcttgcatctttaaaataatcatgaaactcatgctccatttgtgaccatgtagaaattgaattgggagcaagtaaactatatcatgtacatgcaaagtttgacaaagaaagaggaaacaactttaacttaagcaaatcatcactaccggccttaccacattgttcaataaattgaccgatatgctccattgttgttctagcatcctcacctgtgaatttcgtgaagttgggcacttcaaatccttgcaggtacgggaccgaatctacatgttcaggatacggcctttgatatgtatgcatagctactttggattctatttcactactatcccgcaaaacattatcattatcttttccaacatccacatgaccgatttgtgattcggtcttaggtgataatgctatttcactttcacttgtgatataacctgaaccgtcacttagttcggctatattttcaatgatgctattctctaagctagcaacacaatccgaaccattacttgttcggctattccatcgttgtctaaactagtaacacaatccgaaccaacacttggttcggctataatcgctatggcatcattgcacaaattattaacacaatccgaaccatcgcttggttcggctatacatgatattgcattttcatctaaactagtttgtaagctattgtcatccactcggctttcctgagccagagcttcatgcaacacatgatcaatatcaagaaatatatggccattcaatttctatttaatagaatcaagcaatccatcatatgcgatgtcagccaaatctttgtcagttattttcaaattgaaacatcggtttttaacatctctaaacctttcaatataatcagcaacagattcattgtatttgtgcctaaccgatgttaaatcagacaacctaagctcagtctcactagtgtggaaataatcatgaaatttttgttctaattgagcccaggaagaaatagaatttgccggtaaagaagtaaaccatgcaaaagcaataccggacaaagataaagaaaacaagcgcaatttacatgtatcccaattagcttcaccacattgcgctaaaaaattgatctacatgctcccatgtggtcctactttcctcaccactaaacttagtaaattcaggaattttataaccacgaggatatgggataatatcataaaaatcaagatacggcttttggtactccctagcatgattccttagctttgcgaaattctccctaatagtatttctaaaccaatcctccacagtttcaggctttggtggatctggtggtggacttggtggcctaaaaggtggttgttgcggcacaatattgttatattggccatacctagtatcgggaggatatcccctattaatatcattgtaggcattagagatatgtggaaaagcatgactaacagtattaacaggtgatgaataataattaaaatcagtactgctagtcgtggtatgaaaacctggagaaactcccagggaaccggtccgaccggcccatggcccggtctgaccggtggtcagtggtgcggtcagaccggccacaggaggcgcgatctggccaggatagggtatggtctgaccggctatagtaggcacggtctgaccggcgtagtacacggtctaaccggccatggtgggcacggtctgaccggcaaaggatgcggttagaccggtgtcacgactggtcataccgtcagctcggttttgcatatagccgattcctatgtaatcggctgtataatcacccattgaccccccctccccctagcattataagcatattgtataggagcaaaactaaaagtagcatatgcatctacacaatgattattaacgttttgaatagcaaaggacgggttgggcgaatcgaaggttacctttggtgaaattacaacttgaggtagcgggacgtcttctctcatgacgccttgatcggtcctaatgtattgtgtagcaatattgttgaacccgttctcactcgttatagttgatgaagaaattccttgattaatttcagccatatagctcgtagccgaaatattgatatttttcatgtgtgtgcagtgagcaaaaatctggaaatttcgatgtctcgcagaacaaccgatacagtatgaatcggttttgtattttttttttatgtacgtacacagtaatagatcggctttgatcaatagcctgatctcgttttgttttgcttttttttactcggttaatatgcacaataagaaagcgagactgatactgctcctattgtcttcctggttcccgcatttgcgtcggcagctgctgctcctcttctccggtctgaccgaattgataatgtcggttagaccggcaagataggcagccagatcgacagcacaagaacaatgccgccgatctgaatcaatcaacacaatgatcgatagatatgtgcagtgatagtacatagatagattgatttcggctgtttagccgaaactctagatttgacgaaacagaaattactagattaaacgaaattcggccatgatatggctgattagatcgttccccagtggagtcgccaaaaatcgtgttggcaacttttttaacaagtcgacaagcacgatcgcaacacctaaacgtcttgcggtgatatggagtcaccaaccacctcgatctagccaaagggccaaatcaagatgggttttgcaaaaagaaaagctaaaccggctagcggagccgatttagagatcaaaatcagcctttaggccgatttagatcgatatgaaaataactacccgtctcgtgggtaaaacggaaggttttcaggacaaacctacaaagaggtgtcgcactctcgcagcggcggcggacggtttacggcgcaaaccgacaaagatggactaaaactaaaacatagtaaaagaacgattcaagtagattgtattcgggtgttttacaataaaccggccttgtcccttaaataggggttggtcttgccctctacaggcccttctccacgtccaactcgggatagaaactaaaggaaacacgaaacatgccttcccgagcaaggaaacccgagacccgacgaaaacagactcggactcggaccctgccggtctgaccgcccacatacctgcggtctgaccggccctgtgaaggaaactcggcactttccaaactttggcaattttcctctatttcgtctataggtgccaaatttgggtgtaaacattacccatattcatttagatgttaaagaatctagacatatgtatgtgtttaggttcattaacatttatatgtatgtggacaatgttagaaagtcttacattgtgaaacggagggagtagtttactacccctccattctacgttataagctttttgggcgaagcaagaagccttcgtctgaatagaaggggccttcgaccaagggtttgggagaccttgcggcccatgggggcctttcgtcattaatgggccggcccaaggagatcgcttgagggcccatgaatacaaaagagactgtgtacccacactaatgtccatatcataaaggtatccatgtaaattctcatatactaactaaaccctagaaggtatgagcatgtactaagactataatattgctcttactattccatcaacttactgagtgaaccacgtctttcgatatgacgcaattgtcttttgacaacaatatctttatccaaaattacaaattattttatggaaactaaagttgccatagaatacaaatagctaatatcaacccctgatattccttgcaagagatctaaggttaaaactacatatcacataacaattaatcaacaaatacatgactgacatagctttaaccttcaaatgaaatgagtgcttgcacaactgagttcatgtttggccgcttgctcctatcttcctccaagcatgaaagagcaatctcaagcatcagcttcacttgtacatggttgaaatcaccgttcaatcgatagtccacaagatcctcgatagatttttcttcattggactccatcttctcacgtgtcaccctaacaactatcctaatatccatctcacataccttgatcccatggatcacccattccgaaatccaaatccccttcactagctcaaggagtattactccataactatacacatcaaccttctctataaccggtaggttagtaacccactctggagccatgtaccctcttgtccctctgatccgtgtcaaaattgcatctgaaccatctctgtttaacaacttagacaaaccaaaatccgtaatcttgggctccaaatccttatccaacaaaatgttctcaggcttcatgtcacaaggaacaatccattctgaacactcactgtgaaggtaagccagccctttagccacacacagagcaatcctgaaccgttgattccaatcaagcacatcatcatcaaatccatccctaccaaacaacttatgtgcaagtgatccattctctatgtattcagagacaagaatcctgtgcttgccttgagagcagcaaccccacattctgacaaggttcatgtgatagatccttccaatcacactcagctccgcttggaactcctcactctaccggctcacgttcttgagcaccttcacggccaccgccctctcatcgtcgagcacgcccttgtacaccacgccagagccgccgtggccgatcacgccggtgaagctcgccgtggctttcttgatgtcaccgaggggtcacatcaagaaaaggttagaatgttaccgagcagtggcggatctacgaatttttctaagcccgggcaagcctagcgatgggtagaaggtgtacttaaatctatataagtacataaaccatttaatatatattatatagtcttgtattatcttaaaattgaaaaaacagatgatcaactagtaaattaattaagaaagtaattagctactactactcaactgcatgtacgactgaaccctgtaactaagtactagtcactgcagtatggtgcactgaatgaggcgaagtgatggtaacaagtaacaagtgctctttcactgttgattcatgcggcggagctcgggcagctgcccatgctagccgggcggcggctccgccgctgttaccgagggtcttctctctggcatatagaagcttgctgcagaactttctcacatgtatgattgtgaaaatgaggacatggtggtgggttttggaacccacttgcaattccagccataccttcctctatggtatggtatgtgtgacgtgataaatattcatctagctcagctaaacccttagccatgtcctcttcctggacaacctcctcctcctcctcctcctccagtagtacatgaagggcaagaacaactggatgtattcctttatttaatttcttcatgataggatgattcttcaaaatagaatgaatacccctctccagatctgcttcttcctcttcatgagtcatattcccaatagaacaaatgtcctcatccaccacatcctcatccacctccaaatccaatttctcaaacctaaacaacacattacaatccaattagtaatcatattaaaaaaaattgtccctattaatttagagatgattgtaatgacaacaaaatcttgcggttatatgacattttattaacaacatgcactattttcttagactaaacatggcatgcattaaattaatgccaattatcttcatatgaagattaatgcatggtgcacgagtcaaaatatgaagaaatacatgaacgcaaaaacaaatactcacaattgtgacatccaatgcggtaattcgtcttgttcatgcaagccagcagcatccacgttgaccctaaataaatatagcattgcattaacgttagcatgttgctaattaatcttgctttgagaaactacaatgcatggatctaaataaatcaaaaggaacgcatagttttaatatggcatggttagaagataacccttataaggttttcagcaggtgatcatattttcacacacataaagaatagaaaccatttttcatctcatgtcaagcatgcaatttttgccaaaagcaaaaaacagtgccctgatataaatagaccaattgatagaagtgaaatgcgttaagcatatagtaacaaaacagcaatataatatcaaggataagcttatgaattggcaatacccaaagcataaagaatcatgatttgcagattaacaaacaggataagtaaaccataaacagcatgggaacatctacttagcagaagaaaactgaaggaagagataagatgaacatacatggtggaatcctgctggattactgcagttgattcggaggtcactgtttcagcatcagccgtaggcatttgctccgctagcctgaagaacacaagatgaacatatatatataagtcatcaagaatgcatcctattgcacgagagcaactgagcaagcaagcaaacaacggcaagcacagacgtaagtgcctggtttcttccccaattgcctcccgcagccgtgggtcgtctggcagagaagagctgctccggctcgtcggcgtctcctcgtcatcgtcggcgggatccatggcggagtggatctgtggatggatgggtggaggcgaagccgcaggccgcagctagagctaggtaggaggaggaaggagcgagccctagctaggtgaagtaggtcccttttcgttcgaggaagacgaaggggaagggaaggcacattgcgaaatttgatattttaccatcgttaggcagctggattcgccgaaaatatcattatcaattgagaggcttcactcatatgccattttcttctaattctctctttcgtcttattattattgactaaaatactcctagttgaatcaatttaagtatatcaaaaaatacgtagattataaagtaaatataccaaaatagttttacatgttattttttttctctacaccatattacatagtatgcggcgtattatctccacaacataaaaaaaaacactctcaactgaaactctcataaaaaatacgtaattattttttatttatgctgtgaagatagtgtcttatactctgtaatttggtgtaaagaaaaaaaaacatatatattgcatgtcaatatatttgtgcgatatgtactctgtaatctacatatttgctttacttgaattaattcaactaggggtattttggtcagcaaatataagagaaaaaagagaattggaagaaaatggtgtttcggcaaaacccctcaattgagaatggtatttcggcgaatcccaactataagtggtatttgggtgaaaccctattttaacgatggtattatgccaattttctcctagctatgtagtgttatcatggcgcatgggcctttgggattcggcccagtttccactgttttgggccaataagttcatctgaggtccttaagttgtcagcgaatctgattttcgtcctttatctagaaaacgatacaacgggttcctcaactgttaaaaccgatgcaatataggtctcatggcggtttgaacggcgattttagctaacgtggcattgacgtgacaatttaatttggaaaatattaaaaactgtgaccccacatattagttacaccaaaataatgaattaaaaaatggtgggctcatgtggaccccataggttctcaaccccccccctctctctctcttcctcccggttttgctactgggaaagagtagcatgtaggggttgggtgggggggtgatcgcccgagcggtcacccacccattagcaccccctcttcctcctccctctcggcctctccacattaatgccacatgtaaactcataattacaaaagccacaatagatcgacaaattttctaatggagcaagcatgcatacacacggctaggttaaatctataactaatataaatattcgtatttttccggtcgtcacatctaattttcatccgtttatcttccatacacaatccgattcggttagcaatagccatggaaaaaaattgcaaaaaaaagggcagccgccgacgcccgcctccacgctgtccgggccgccgcacctcccctcccccgatctagcggagggaagggcatcgccggccctcccgccgccgccacacagagagaaagggggagaagtggagagagtgggggtggggcgtcgcgctgtggggagggtggcgctgctcgctggggggagtgcgcgccgccgccgctgctcgctgtgggggaaggcggcgctgccgccacaccccgccgcaccccgccgtcgccgcaccgtgccggcgagaagggagggacggcgccggtggcgggggagtcagccggctggggggagggggagaggcgccggtggggagagggagagggggaggaggaggcggcgttgggggcggggaaggaggaggcggccggctcggctcgactggggcgggagggtgagggggagggttagggttagggttaggttttcatcaattttaaactgatctgaggcgtccatcaaaacgaacggctgagatcgatcgagggtttgggccacaccacttgggctgcacgtgggccggcggtccactaagtgagagaggaggagtatgggggtatcgggtatcaagtagattttgctctcttgtgggctgaaaaaggcccatacagaaaaaatgatttttatttcaataaatgctgaaatgatatttgtattatcaaaattagcaattaagctatgtaaattccaagaaaatttcaatgagtgtaattaatatagaaaatttaataaaagttaaatccaaccataacattttatttcttacccttactttacttataaattaatttaattatatacctacctacttaaaaaatacccaaatattagaatttaatatgttttaattcaattttatttgttttttttcttttcttgcaacgcaagaccacttttgctataatttaaaagagtgtaattaatattgcagaaaattttatatttcatcaaattataattcattttcttcatattaatagttcaaatcaaatttcagtcaccatatcattagccggtacaacgcacgggcattttgctactccctccgtttcacaatgtaagtcattctagcattttttatattcatattgatggtaatgaatctagatatacatatctatctagattcattaacaacaatatgaatgtgggaaatgctagaatgacttagatcgtgaaacggaagaagtagttaaattaaatgaatgaagaagtaaaattttgaaagatcatcatcgttaccttttatctcctgatgattgatgatgattcattgaacataaatagatcggccgatcgatcgatgtcctgcagctgacgaacttttatctcctgcaccctgcacgtatatatgcgcgcgcggggcaagttgtagttgagtatatattctgatcacgagcgcgcaccggccggcttggaaacggactaggcattaattatacgaatcggagtagctaggcactgctattcacgttcgcgctcgatcggatgcgtctccgcggccgatcgatccaacacgcgtacgtatgcttttcagattatttgcttcacattttaaaaaatatattttcttgtattgctcagatcaatttgtttttaagttctttctaaaaaaagcttatttatcaatatatttaatattttcctacaatcaagtagataatccgtagtacaatactctcgataatttgtttcaaactaagccttaatgttaggccactaaaaacataatactccctccataatataaggcgcacacatattccaagattcaacctttaaaatatacatttgaccaacatttaatataatatgaaacgaattttatttgttaaaaattatatcattggattggcatttaaatatactttcatatggttataattttgttgctagaaactttatagtatatgagaaattataaattaaagattagttttgaacaccgtgtcaattttgaccgcgccttatattatgggatagaggaaataaagaaaatatagtaataataaataattgctagtggatctatacactcaaatgtttggctacgtggattggatcacactcatgtctgaattaaataatagatgcatcccagacaaagagattgttggatttcatgaatcatttagaaaagaaaaggttatgtgattacataaatatatttcattagtccgaatcctcaaaactctacaccctcccgttcggaactatcattgaccattatcactctttatctctctacaccactcatcactgtttttcttatttagcagctattgtctaatcgatctcatctagtctccgcgccacatccgttctctccctttgtcaagctcttctccccccccccccctttctctctgatctttcatctcattctctaatcacactactgtcgaatttgacactgcccaaacatcgagtttatcgccctaccacttgccttgcccatatctttggtggcgtcatgccatcccttcctcactatgttgtgtagctaggtaatagacatctcttaagcccaaagaaaatcccaccacaacacacccccatctccacccttaccctaccctaccacatgctcctcgacaagctaggataaatagtaaggtgaaaatgatttttttgcaatttttttaatcaaatacttagcaaatcccttaaattaaataaatcaaagttaatgaaatatcttcatctaaaaatacgaattagtttacggaaactaaacttgtcatagaatacaaatagccaatatcaatctctaatacgtactcttgcaaggatctaaggttaaaactacttatcacataacaattaatcaacaaatacatattaacaaagcactagatgacacatactgacatagctttaaccttcaaccgagatgagtgattgcacaactgagttcatgtttggccgcttgctcctatcttcctccaagcatgaaatggcaatctcaagcatcagcttcacttgtacatggttgaaatcaccattcaatcgatagtccacaagatcctcaatagatctcttttcattggactccatcttctgacatgtcgccctaacaaccatcctaatatccatctcacataccttgatcccatggatcacccattccgaaatcctaatccccttcactagctcaaggagtatcactccgtaactatacacatcaaccttctctgtaaatggtaagttagtaacccactctggagccatgtaccctcttgtccctctaatccttgtcaaaattgcatctgaaccatctctgtttaacaacttagacaacccaaaatccgtaatcttgggctccaaatccttatccaacaaaatgttctcaggcttcatgtcacaatgaacaatccattctgagcactcactgtgaaggtaagccaaccctttagccacacccaaagcaatcctgaacctttgattccaatcaagcacatcatcatcaaatccatgatcaaacaatctttgtgcaagtgatccattctctatgtattcagagacaagaatcctgtgcttggcttgagagcagcaaccccacattctgacaaggttcatgtgatagatccttccaatcacactcagctctgcttggaactcctcctcactctgccggctcaagttcttgagcaccttcacggccaccaccctctcgtcgtcaagcacgcccttgtacaccacgccggagccgccgcggccgatcacgccggtgaagttcgccgtggctttcttgatgtcagcgtaggtgtacctctggaaatggctcgtgatcagcttgtagccttcttgatcaatggcgtacacccgtgaatgccggaacaatcctttgcttgagaagagccagcagccgaacccgatgacgatggcctcgacgacgagcaacgctgacaagaatccgtacaggtatggccacaccgtcttaccggcgtcgtgagatgacagtgaagaggagacgttgaggagaacctttctgttgctgtcgccggtggcggcggcggcgcagccggcgatgtcttcttggatggcgaggccaccgccgccgccgtcgccgccgcgctgccattggtggacatgaaactccggcacgtcgaagtcggcggggaccttgatgtacaccgttcccggcaagccggggaacgtcttgccgttgaagaggacgctcttgaggtagcactccatgtgctccttgtactggaacaccacgcacgcgcagttgtcgaggcacttgttggcgcagtcgccgagcggcatgacctcgccgtcgttgaggtcgtagccccagaagtcgctgtgcggcagcgccaccagcttcgccggccg

SEQ ID NO: 43197 - DNA, 61212 bp, Oryza sativa
  unsure (1)..(61212): unsure at all n locations
cgaggtcggcggcctcgaaggtggtgccgtcgctggagaggaactgcccgagcgcgtccatggcggcctcgcgggagaagttgtagatcttgcggttgttctgccagtagctgaagtaagggttgggccagtagatgctggagaagttgccgttgtcgtagaagagggagagcatggcgtagtcgctgaacccgaggctgtagtagccggcggagagcagccggtcgcgcgacaccagccgcgtcgccgccgtcagccgctgcgccgggagcagcgtgtcggtggggaagtcgaagctctgccacagcgtcttgccgcaggcgtcctcgaccaccaggttgccggtgtcgtggagccggacgcgggcgccgccgctgccaccggcggcgggggtggaggagttccagaccacctcgccgccgtagtcggtgaggacgagcgcgccgcggcgcgcgtcgagcgtgacgcgcgcgcccttgctgtgcacggggcgcgcccgagccgcggtccagacgacggcgcggtcggcggcgcgcgcgaaccagacggagaaggtgaagacggtgggagacgcgtcgtagaagccggcggcgaacgtgccgtccggcgagcgcaggacgtcggtggcgtggtcctcgacggcgatcgaggcgccccgggcgagccactcacgcgccgcgtcgacgcgccgtggacatggacgcggcgacgagcttagcgtgatgatcacaagcaacgcgaaggttgcaaggcgagagttcatcatggcacatcaatcaggatgttgattctgacaggactgagattaggatgttgatttggactgtatagtgattacggttaatttttttgtcacacaagtcaagaattttgtgcgttccatcgcctgggcaccagtgactaccactaattaagatagtaatatggtaatagactagtgttagtgaaagcgatttgacttagatctgagtattgtatatgcataacgaggtgtacatgcacgttgcgtccaatggagtttgtgtgcatctgaactctgaaattctaaacttctgcttaaagaaagctgggtgagaagatagtagttctgttcacagcagtaattgggactacgattgattaatagaattatggggcaatttcatttttcccccactttcatctctaatattgattttgcccctactttttagggtttttgtttttgcccccactttttgaaccgaaaaatacttttgcccctgctttggatggaggagttaacggtgttaaatatgacatttataccctctcccatatctattcattaattgtgtttttgcccctattatgcatggctttggaaaattatttttgtgaatatgtttaaaattaaatgattgatttggacagattttgacattacaattgggacataatttgaatttgatggaattttgacaaaatttcggcagcattttgacagaaattgagcaaaaattttgacaaaatttcaacaacattttacacaatcatatgaagtcatatcagccttgcatcgttgacaataccacacttggcatacagattaatcagggcattgctcacatgcgaattgtccaccaacacaaccttttccgcatacacatgaaccctcctcccaagagcaagcgccccaatctctgcacaagcggttagaacactgactatggtgactccatctggcgcaaagttgacgcccagcatctcccggaagacagtgagaacctcgttagggcgcccgttggccgcaaagctgttgagcatcgaattccacgagacgaggttctgcccatgcaccggcatttcatcgaacaccttgtgcacgctctcgaacaggccacacgcgccgtagagatgaacgggcgagttttggacgaacccgttcttggcggcctcggtatggaggcactccccttcgcggagcgcgaggaggcgcgagcaagcctggagcagcgacgggtaggtgtgcgtgtcgggcggcgcgaggcggcggcggtggagctcgagcgcgacgcacgggcggaacgagcccgcagcgatgcggtgcacggtgttgagggggaacgggtctagtggcccgtgcgggaggaggcgggagagtaccgccacggcgtagcggagcggcggcgcgcggaggacggcgaggtggaagaggaggtgcttggcgaggagcgggtgggaggtgggcacaccggcccggagcgcccgcgcatggatctgcttggcggcagcgagggatggcgcggcgaggtggacgggatcgcctcgctcctccaaccaccctatcagccaccgccgccgccgcccaacctagccctctccccccagcctagccctctcgccgccgccgacccctctcctgctcgccggtgggaggagctgtgctctagccgccgccgccgcctgtagactcgagagagaagcagcgagattgggggaaagaatcggttctctgttagactagtgccaggggtaaaaaagtagaacacaaattcgaaaaaaatttattttactgccatatagctggtcccactaacttccatccaaaccagggtaaacgtctcttccggttaaaaaaaagtgagggaaaaaataaaaaccctaaaaagtagaggcataatcaatattgaagatgaaagtgggggcaaaaacgaaattgtccctagaattatagaagtaatgtttgtatcataccagcagctgtgcagtatcaaatgcaggatgagctgagcagacaggaaaggttttgactgtcagttaatgttgggtgattttttagtcaacacttggtttgatgatctgtaccgttgactttgtaaacaaatgatctatattctactgtatgataaggttgaggtgctttgcggacaagcattaatcagccatcaatcaagccaatggagaagttccatgtagtttcaggattgggacacctcacagattttcagcgagtaaatgcatcatcacagcagctacaataacagactataagaatatattttaaggagataaaatagtgagcagagctgaactcagctgcgtctggagaaatttataatatgccactcaatagaggtactctaaccgaatgtcactatttaggatgttcttataaaaatgccactcaataaagataaagactcgttcttaataaaatgtcactttaggctattttgaggcttttaatcgcaaaagatgtgcggaatgacaaaaatacccatgtgtctttccctgcggcgataacgactccttctcggcgttggcgctgcggtggggcggcgggacggcggtggcggcgtcggcccctagcgcgactgagaggaaatcggccgtgcgtggacgggcgacgccgcgacggtagcacggccggccaggggcgcgcagacgggcggcgtcggcccctagctcctctcgactgcgcgcggtcaagtgacagcgacggcagcggcagctgggcgagcgcgcgccgacagggcggcggtggcggcgtcggcccctagcgtgccaagaagaagtcgtgagaaagagaagagacgcattctccagatctaaacgatcctaagggtatttcggtcatttcgcgagcttagtgtgagaaaaaaattaaaaatataaacaaataaaaaatgtctcaaaatagcccaaagtagcattttattaagaaacagtctctattgagtggcatttttataagaacatcctagagagcggtcttctgttaaagccacatctactaagtagcatattgttaagggcatgttcactttgaagccattttcaaccttaccaaattttggtaaagttaccaaaaaagtggctacatttagtttgctgtcaaattttagtaactatataagaaatcctaccaaaattttggtaagtcaactataccaaaattttggcattaccaaaatttggtaagttttttttttcgcataaagtgaaccggcactaaatttctccacctagatctgcacctgcaccagtacctgtacttgttctacttcttgttgtgcgaagtccagacccaattccaggctcaatcgtatcggcatcggtctcaggtaatgggcctaattccaggcccaacagtaagcaatgcagttcggtcatgggctcttcctcctcctatgcgtatagccgtataggaatagtcgtgtcgcgcctggattaggaccgcgctataaaatttaaaaatcaaggggttttttcgcaaaacgacgcgccctaacaacccaccccgcaagtcggcaaccctagccaccgccgccagtcccctcctcccccgcgctctccctctccccatcacgccgccgccgccgccgtcgcgtcgccgtccccgacgcctccgcctccctctcccgccgttcgccgcctcctttgccgaccgccaccgccccgcgccgccttccccgcctccgcctccgcgcatcgcaacgcaacctcaggcgcagaggcggcgacttgactccccccctccccgccctctcgctctagggtttcctcccttccccgtcatcagccgccaccccaccccctcccccgccgggcttcgccatgtacggtcaccgcgggtaagccaagcccctcctcttctttcttattcctgattaatctccgcaattccatcccgccgattcatccattgctttctttttttcctacaatacttgcttgcttacgcgatctcatcaatttctcgattcttttagggataatttctaagtaggtcactttgctttgctaccatgatatgatatgatatcatctgcctaggatttaggatacatgtacagcttcccccttacaagaccaaacctctctccccccaataaataaataaataaatcggaggcagtaatacatccaaattgatgtttcatcaactgcaccagcatcccaactgtggtttgtaagattcttttctactgatatgtgtcatccagtagtttgagtatttcttctattcatatgctgtcaacatttaattagtttttgtttatgtccactaatgcgttcgcatttcgactccattcacctttttaagccttaagtcatgtttagattactagtatttcttatctgtgcagttatctttatgtttgggttattttatatgaaatggggattgagagatggggggatcgtctcctttttttttcttttctctttttgggactctggattatctgaagggcaatgatgggaggcgggggggtttcggatgggtacgagggatcaaagaggccacgaatgatcgaatccaatccatacttcgcagtgaccgcaggcagtcccttggatgtctcaaagagggccaggatgatggaaccagcccctccctatttcggagccatgggcagcagcgctgctggtggcaccagtgccttctaccagccctacggcaccaacttacctggtgcaggggctaacagtgccatccagaactttccaggggtccgtctacgagggctcccctttgactgcgacgatcttgacatctgcaagttctttgttgggctggacatagtggactgcctcttggttcacaagaatggccgcttcaccggcgaggcttttgtcgtattcccatcagccatgcaagcagagtttgcactgcaccgcaaccggcagaacatgggcaggaggtatgttgaggtgttcagatgcaagaagcaagagtactacagtgcaatagctgctgaagtgaaccagggcggcttcttcgactcggagtaccgtcactccccacctcctccacggcccaagaaaccagctgaagacaagagcagcatggagtatactgaggtgctcaagctccgtggcctgccctactctgctaccactgaagacatcatcaagttctttgtggagtacgagctgacggacgaaaatgtgcacatcgtgtaccgtccagatggtaaggccactggagaagcctatgtggagttcccgacagcagaggttgtgaagacagccatgtgcaaggacaagatgaccattgggacaaggtacgtggagctgttcccatcaaccccagaggaggccagcagggcgaaatcgcgagtcaggcaatgaattatttgatccagtcatctactttgccctggccttgagcagctgtgttccagtttagctttcgccttgcatgcttaaactgtatccctcgcctttaggtttgtgtgtgtgtgttttagtatgcatcatgttgctaccgtgccacaacccgttggtgtggtgactttataagaacccgaattgcatttttaaaagaagtggtggattatgagatgcctgcactttaacagcagttgcgcctggttggatgcattttatatggcaatggcatgatcattgttttccttctgagtttgcgacagatgttctactgtatccccttctttttggtgaagcaggggatgaagctcgcactaactctgttccaaaagttggttgttaattaatatgaatatgcataaacataacgaggtgtacatcagtacatgcacgttgcggcccatggattgtgtgtgcatctgggatacggttttcccgattcctatgatctatccaatatgctaactctgaaactctaagcttcagcttaaagaaagctgggtgagaagatagtagtagctttttaattctgttcacatcactaattgggactacccccggacaacgattggttaagaccctgtttagatgggactaaaactttttaagtctctatcacatcggatttttggacactaattataaatattaaacgtagactattaataaaacccattcataatcttggactaattcgcgagacgaatctgttgagcctaattaatccatgattagcctatgtaatgctacaataaatattctctaattatggattaattaggtttaaaaaatttgtctcataaattagcttttatttatataattagttttataagtagtctatatttaatactctaaattagtgtctaaatacagagactaaagttaaatctctgtatccaaacaccacctaatagaagcaatgtttgtaacataccagcaccagcagctgtgcagtgtcaaatgcaggatgggctgagcagacaggaaagattttgattgtcagttgatgctggatgatttcttaatcaacacttggtttgatgatctgtaccgttgactttgtaaacaaaatatctatattctcatgtatgataaggctgaggtgctttgcagacaagcattaatcagccatcaatcagccagtggagaagttccatgtagtttcaggattgggacacctcacagattttcagcgagtcaatgcatcatcagtcaggacaaacacagacatgaaaaattgatggagttcatcaacaatattgtaatgctagccacctcaagaatctcagttatctaaaaataattacataactgcgaaatggctatgagtaataacattcaatcaatagctacacaacctattctctataggatggatttgatacaacgtctgatctctattggatctgatacaacttatgatagaaccccctactcattgggtagtcacactctttgccagattccttggttgatcaacatcaaatcctcgaagaactgtcagatggtatgcgagcagctgaaggaacaaataacaatacactcagtaaatgaaattgtttcacaaatgataaagcataagtagaagttctggaatttgatgaaattaaacaattcaaacaatgtgcaaacctgtaacggaattatgttaatcactggctggagacagtcagcgacctctggaacttcaataaccctgcaagatccactagggcaaactgcagatgcgtctccctttgagcacatcactatcagacgccccttgcgagaaaggagctgctgaatcactgactgttgcttgctgcaagaggtgaagatgtttagaggaactccttgaaaaatgaaaagaaaatgaacgtgctctgcagtctgtccaaagcgcttacctgaagcacgcatcacgtgtagcaatgacgatgatcggaaggttttcatccactagtgcaagtggtccatgcttcatttcaccagcaagcatgccttcgctgtgcatcagagcaacctccttaactttaagagcaccctctaaggcagtggcatagttataacctctgccaaacacaaggagagactctgaatcgatcaaggaagaggaaagttccttcatctcggtatcaagttttaaaacctcgctgacattgcctgtgtagtaaaatagacaaatttggaaaacgttgttcaaaagaaacaatttcctagactaaataatgcatttgttgatctaacacgacatacttggaagattggaaagaccactgatgatagcttgacgtctaacttgggtggatatttgatcagatccaacagccaaggccaccatcaccatgactactatttgacttgtatatgcctgcaagatatgagatattgttaggaatcaagacgaccaaaaaagggttgaagcatgagaatagacagaaattaaccttggtactagcaacacctatctcacaaccagcattgatatgaactccacaatgtgttcttcttgatagtgtgcttcctacggtatttgttatgccaacacaaagtgctccattttctagtgcataatcaagagcaaggagggtatctgctgtctcccctgactggctaacgaaaactgcagtgtcttccctgtagatgggaccttgtctgtccagcaagtcacttgcaacctccatagtcacaggaatacctattgtccaaataatgcaaggaagaagtatctgggtcaagaaacaggtagctaatacatattgtcactgatgttgacatctaaaatttctacataaggagtcaggacaataagttggcataccagttaattcctccacaaaaggtcttgcagccaaggcagcattgtaacttgtaccacagccaatgaaaactaaccttctactgcgcctaatagttttgaggtactccttttcctttaatcctcctaaaagaacaccactatccttcactctacccctcatggttgttgttaatgaatgtggctgttcatggatttccttttgcatgaagtggtcataacttcctttctttatctgctcaacttccatctcaaggacagacaatgctcgttgcacagaagctggcttctctttctcatggtcaaacttaaggatagacacactgccatcctgcaatggccaaattgttaaagcttggacaaggcatcaaatgtaaggctaatgatgtcaaagaaacaaaagaactgttgcactagcgtgttcacatattatttcagtcaataaaaaaccagtgacacaataaaagtacaattgtcaaattggcagaaaaaatggtataaaggaaatagataactttaggtctagaaaagatagattgccccccattaaaaatgatctttctttctaaaaaagaaagtaaaggcaaaatagaacagataaggcaggtgaatcaacagagaaagctgaagagtaccttaatatgaacaatttcatcatcttcgatagccaaataattcttggtatgctccacaatagcaaataaatcactagagaagaataattctttgggcttcccgtttgttgtcagagctttgacatcatgaaatggtttcccactattttggccacttaattcctgaaaatagagacaacagttacaaatataaaaaaaatgtttccaagtcaaagggaagcagaatatttatagtatctataaatatgtgtaaaaaaatgattacacaaaagataacttctaaccaaaccaacatcaccataaaagaaaattatttaatctgcaagcaatctactgcacagtttctcacgtttgcatttttatagaacaaaacatgtggcagttaaccagagcaagtagttcgtagttactctattgagtgtggattttatcgcaggttccactctatgggaagaaaaaaatggtagttcttagcaccttttgacaagccaacatttgtgagaaaatgcacttcatgttttctagtttgacacttttacctaatacatgtttgaagcagatggagataagaacggtgaagagacaacagagttaaagttaacttttgatgttaggtctagtactacataataaagtcaacttgaacagcaaaagatgtagctcaagagcataacacataattcttacacaaaataaaaatcactgttttactatgcttgattagaacctagctgatagtttaagacaaaccaggatgcacttacattgacaccgagtatcagtgtgctgccccgtttgcatgcaatcaattcattggggtagtgtgggcttttaaagataagtgcgtaggctccttcaagctgcctcatgacttccataacaacttggctaaatgtcacatcacctgagaaaataataaaaagttgccttaactagaactagtacagtaagaccaacatatagaatctagttaccgatttcttttccttttgaattttgtaagaattctcctgccttgttaagagtaatgtattgcctaaataaaaatttctgagcgcgaaaagcataataaggtatatttattgcctcatctagttcttaggtggcaaatctagtttccaacatagatcatagtagtataattcttgctccaaagaaatgataatataattataacttgagaatgaaaggtttagctaaagatcagggagtacatcttgtctgttgtcaagaatataaataccttcttcatcatgcgccttatcaaaaacaaactttgccaacttagggatgacttctgtgtcagtatcagactcaaaggtgaacccgtgccggattagtgtctctttcagaacctgagcagatacatcagaaataccaagttatgatggaaatttatctgtttacatcattatcatctcttgctacattaatttgagatggtatcatgaggttacacatgatcatgaaaccaagtttgagatggttggctgattcataaatgtctaataaacttattgtgaattcagtatattgtcatttgccacttctataagataatattctctgcattacaacgacaataatctagcaaaatgagatagaactcactgatattctagttgctagttaatctacagcagttattttattccagtaaaagcatatgagctttcaactaaacggcagattatttaacaacaatagtgaggcgtctatggagattggagacagcccatgtgcagggcttggaagataacatgttggccaatagcataaatccaccatagttgcaataatgcatgtggattccccagctgtaaagatgatgagagaaatactatacaagaattctagtacaatatcagaacttcagaagagcaaggtaaacaagaacctcgtagtttgtgatgatgccattgtggacgaccaagaactcatcgccggcaccagaagattgggggtggctgttccttggggcaggcacaccatgcgtggcccacctggtgtgggcaattccagcatgcacattgaaggcggcgtccaggttcacatccttctcatcaacctctgaaaaatacacaaacatccaacatgacaaaagatagagtacaagagagcaccaaaattgtagccgagactaattgtatacggtataaatcgtcaggaaatccagagagaaaggaaatcagctctccaagtggtaaattgaataaatcaccgaaaatgccataaacccaagaagatttagagttgatccgaatgggtcaaattctaccttttctgaggagatccagaattttgggagctatgctatgccaatcccaaaaatgcaaagtgcgaacagaagaatttccctcgcaaggataactaaacccaaaatcgctaaacgacataatgatattccccaaaatgtgatatggatcccaatcaaaatccaaagcttttaccaagtgatacagccaagtcagaccacatagcacatggaaatcgtgcaaaaatccatcccaagaacccaaaattcaacccatttttcagcataatcaggagggaaaaggcactgaccggagtagacggatcgtacgaggttctcgatcttgccctcctggcggaacaccagcggggacgccccggcataggccggcaccgccgtagaagaagaagaagaagcgcaggagggaacgtcggcgtcgacggcgatgccggaggagtcgtagccgcggtactcgaggcggcggaggccattgaagaggacctcgaggatgtagcggcgctcccgcgacacattgtagttgaggtacgcgaagatcccgcacatcgtgcgccgcgccgcgctgggctgggcttctagaagcttccagaagtttccgggttcgggagagagagagagagggaggacgcggttacgacggcggcgaggagtcgccggccgaggcggaggaagaagaggagaaaaaggccgcgtttttttttttttgataggagaaggccgcgtatttgggtacgcggagtcaaagcccaaattttatactgatcgagtacagcaggacaggctgacgtgtagcctgtgacccagtagccgcacgatttggatcggacggctactgtagcgcacagctcttcgaaaggaaaaatggaaatctaggtgctccttactccctcaagttccatttctgtgcctaacaaactttgatcatatatcttatttaattttatttataattagtacttttattgttataagatgataacacataaatagtactttatgcgaaacttatgtttttaactttttttaaaaatattttaaataagacaaacaattaaagttagacacggaaaatcatggccatcctccttaaaatggaagggagtgagtgagtactcattacgggcggctgtcacttgtcatcacgtcaatgttaatacatgtgtagtacgtgttaaaaaaaatgctaatacatgtgtagatttgtcatgcttgtgccacgcgtcgcgtttctgattaatttggacgtcgatttttactcgtagttgcagtagatgacaactgagtgcgtgttttaagccatagtatggatcagatattttttggagagaaatatgcacacgtgttaggattttcagtcgtgttaatttgacactgagagattgtgtttattgctaattggagtgattaaagttgtagattagatggaatggatgcatggagtaacccaagtcagagtagcaaaggtctgggactggtcagcaaagggcagcgtggacgtagctcctctttcttttcttgcttgactcattctccctaaaaatctcctaccatctgcctaccagtttccaagaaacaaacaagtaccccccatgtttctgaaatttgatacttgtctattttgcttatgtcaagtatatagtaatgactaaactacgttctcatgcgataccacgtgattaatcaagtgtataactggtctactatttctttctctaatgggcactacccgagttctaaaaacacacacccaaatgaataatacgataattatcactggattgatgttgcttcagtttccagcctcccgaaaagaagcttccattactccaaagaactgttcactagagtacagataaacagagggaaccatacaaccagtccagagggacccaacgcagtgccaaacgtcaccatttcatgggcaatattgttacaagctctaggacagaacgtacatctctttactacatcaaaacggaaacaaagtccctagcttcacggataacaacagcatttgaaccgtcatctcataaatttgtcatccttaagagcttggaacagttagttgcttagattcggtttctgatataatctgacttgtacaaagcaaatcgccaattaagagctccaataccatagcttctgcttgtaacatatctttgtaaataaattcattgatctttcagctccttgacagcactgcatcttttatcatacacttacatggagttctgccctgcaggggatcacagagcagggcatagtacagtcaagaataatacagggaagcatatactccccttcgtcccaatttaaatgcaaccatgattttctgtgtccaactttgatcatctgtcttatttaaaaacaataaaaaaaacaaaaaaaaaacataagtcacgcataaagtaatattcatgttttataatctcataacaataaaaatactaattataaaaaaacaaatcaaataagacgaacgattaaaattaagcatggaaacttatggttgctcttaaaatggaacggatggagtatttccagcggggatcacggatggacatacatacagtacagcagatatattgggggcgccggccagtcctcagctttgtccacacctgtttctcaacatttttctatgctagttgctcctaacttggcctactgtcctccatctccaacaacacaagagtacaagacaagtactacaacggcaacaactatgcatgacatcaaaacgaaagctgggacctcgtcgatcaaagctaagcacaggcacataacaccctcaatgcaaccagcagcagcgaggaggccatgctgccatgaatcatgatcatggcgtcatcacaggagttcgaggctaatgacccacagcagctgcacgccaagcccaagaggctctaccaagtctggaagggaaacaacgtacctgctctttctttctttctttctttcttgctccagcgatctggctacagcttcttcaacttcatagcagcgaggtagactgattttccttcattttgcagatattcctgtgtggtggacgccttattattggcccggatgcagcctccctgctgctttccatgtttctcatccttggcccggccatcgtcttcagctatcagatggagtccacaatccaccgctctcaacaacggatgcatcgagctgcacagctgatagtcatcatcacaacagcagcggttagtgaatccccaaatcatttataagttgcttcttcacatataattttgattgccaatccgttctctagtgacatataccaaacaattaatccgcatggtagtcacagtgatttcagcttcaatatctgaaactgaaatcagtcaatcaggggttcaagattccacaagtctaatttccactatacaacatgtctagcactgtacagtcatgtgaatttcaccttcaaattgcaggaccttttcttcctcttcatgacatcagccagggacccagggatagtgccaaggaacacaagagcaccacctgaagtcgatgaatttcttggctcaaccacaccatcgatggagtggagctcagggagaactccgcggatgaggttccgtaggtcaaaggatgttacagtcaatggcttcacggtgaaggtgaagttttgcgagacctgcctaaggtaccgcccaccacgatcctcacattgctccatctgcaacaactgcgtcgaaaagtttgatcaccactgtccatgggtcggccaatgcattggacttgtaagtaaacaatcaatgatgcagtaatcagtatagtcatcagcctaattcaatgtgcagttccagtactatttgtttccatagtgtttttagaaatatggtagagtataaccactatgcaatgaatttctcttaaaaaaaagctctatggaatgaatgaacttactttcaagtttccataagatgctggtaaatatgccaaaagagttcttccctctccaatggttaatgtccagccaaattccttccagtcatcttcagcatttgactatttataagttattcataaagctacagagcttaacaagacatttagacttgaatttgtgagttataactttactttttagctaaaaggactcctcaatcatctaagttgaattacaccaggctcaatgtaagctattttttaattacaaaatcatcaagaatgagttgttaactagttccactgtttgactagacgtgcagataaggttaggcacctatgggaacagaacaatgaaattttcagagcaagacctaaactgtacctaacatacattttttaggactaaagcacatatttcgaaaagaatttctcgcaattaatgcagtgaacctaaggtcaaggaataacttatgtgaaagagcaggttaaccaagcactaatgatcatctgaactctatatttcagcaactcacaaatctcttatacagaaatgatgttaaagtattcttaagtgcgtgatcaatcattgcactctcggatggtttccacttgcttatcaaaatcatgccattttctattttttcttgcagaggaactaccgctacttctttctgtttgtagcgacatcgactttcctgtgcatatttgttttcatcttttcatgggtgaatgtctactatgaaaggggatacaatggcggatccatctggaaggctttgcgaaaggaagtatactcatttgtgctaatcatatatacttttatcgttgtatggtttgttggtggtctcacagtatttcatctttatctgatcagtactaatcaggtaaacctactttcttctttagctattctagagactttgctatagttactggttctcttatactgtaattcagtaaatgcattttaatgagtagacagtattaagagtttgagatagttctgataacttcaactagcagctccatacacggtgtttagttgtgtactgaatgtctaactagatccaactgcaaattctgcagacaacatatgaaaacttcagataccactacaacaaggacaacccctaccgaaagagcattgcagcaaactttgtagatgtgttcttcaccaagatccctccaccccagaacaatttccgttcatgggtaggtgagggcgcactggaagctggattttatactccatatattgcgctggatttgactgatccaagggaaaagattgatttagagatgggaaacaaggatatacttgttgggggtattcagatcccaacagtgcttcagaacatagactatggttcctttgaagataatccagatgacaagaacaggaatgaagatgatagactagtgccttttgcttcaacttgggcacaacaagcaaatgaaggtgctcgaacatctgaaatagctactgtagaatataaggacgaaataagtgaagatggtggtaaggaaattattagttcaaacacaagttcagaacaaacatcaatagaagctaatgcagcagcatctgaggatgaaagcaatgaggacaatgctggaaaaagtaacagttcagatagaagttctacccaaaatttgggggatgtgaactatagctctgtattactcatctaaattgataatctgttcatatacatggccattatgagttgacattattcttagcattacacatgataaataaaaacagaaaatgaatgactgtatgcctcagccaaaatttttagaatgtattagtttacgtctagaagcccatgttgcactgttcacgctttcctgcactatatgtttctaatttctgtagcatgtgggccgtaatgtggacataaaaagaaaagagttctgttgattgattactaccttaatgatgcaacagttcagattgctctactgcctttatggtactacaaaggtgaagctaacgatgcagatgtggagcaagtcacagaaggggcttgacattcacaaaataatccataaagcaggaccaagataatgtaaattgttaagtaatgattccattgctcattatttggtaaaaaaaaatacagctgcttacagcttacaagctaaactttccagactaactgaaatctggaatttgaaagcaaattactggtcgctaaaaggcagtaccaaagattgcacatttctgcaaaaatgaaattcctcacgcctgatagacatctggaagctgaaggcctacactggcagcagatttgttcaatatcttcttcatctcctctgatcggtccacagctatattatacgagaatagcaggtcctgggcaatcaaacatgatttacagagttaacatggtatacagtgcatgaacaaccaatctaaactaggtgtgatgtactgggaagtgggaattagcaatgaagcaactgcgagtttgtatactaaaacacaccgaaggaagttcaattcatcacgttaatcagagtttgatttggggaaaaaaatagcaaggaacccaatagaaaggggagtttcagtcaaaaaaaaatagaaaggggaaagaagccttctagccatttcatcgaacacatttatctgctaaaacaatgcgcaaaacaggagaagattatacgcatctagaaatggctccaaccttgtggtggtggacgctggcgaggaggtaggcgtaatccccggcgagccgcagccgcgctctggcgtcggcgtccgtgccagtggggcggcggaactcggaggcgacgaactcgcggaagtgcttcttggagtccccccgccgacgtgcttctgcaccgccttgagcacccgccggtagacggccgccgacgtggccaccatcgatctgtccacggatccgccgcgagaggaggcaatcggacgcggagactgcgggtcgccggcctcgccttcttggccgtgtcgatcgaactggaactgtagaggaggaggaggaggaggaataggtaggcgtccccttgccggagattctcctctgcagttgccggagttcgccggagcttctccgccttcttcaggaaggagtaaaggacagagtaaagggactgaagtaaaaaaaattgcaaagaatgaaaagggctattctgcaaatatccatcttcatcctgagcctcaatctgaccgtccatcttcgatctaacgcccaaaacatttgcaaatcagaccatggtttggtttggattggactgctacgagtttgcatataaccaaaaatgcttctcgctcgaacatttcagcataaaataacttttttctttatttgaagatggcttatcaatactttattatatctattataaagctttaagtttttccagggcggatccaggaatgaaaaatagaaggggctcaacatacgggaaaaaccgacataaacatatcatgtctcatacaatattacagtatcaacaggtacccctatatcatggtctgcaatttcgattctaaaaaatttaggaattctgcaacaccatcccccaaggaaactatcacacccaaataaaatcatttttcttgtgaagtttaacaaaatctattcaattttggtaaaaaaaaaattcaaatatcgaaaaactttcttgcctaaaaatttcgaaatttgcagtactaatcttgaattcctagctaatctaagctccctgattcaaatattggccatctttgtttaggcttaaacttattggcttagacttttaagtcagcttattggcttatatgatttataagccagtgaatttaatgtcctaagtttagtggtagagtcatacatctatcttatataagccaaaaaaagcttctccaacttagcttttggcttaatagtgtaagagtggcttataactttaagaaagccaaacgaaaaaactgcttgtttgtttaggcttagactttttggcttataagttgacttataagcctaaacaaagaggaccttaatagtggaagggatcgccaatatatcgggttttacggttatgtgatacaaatcaaatcagatttgcccaataattgagcgagtaaaaacgaactttttcctactttttgcagcacgcctgatgatgcgtttgtgatatcgtgggcctcaaccaggtgccagcactcccgtcctgaggccatcgacgcttcccatataattttggcccggaactccaattccatcacatacaatatcggcccagtatgtttgtgggcttccggcccaaatcgccttgggctgtagcctacgggtactcaggtctctgggggagtcaagggtttaacccgtcctgcgacgcggagcaccggccgccgctcgccgacgcaagacaacgacgatgccgagcttccctccgcccggcaccgtcaccatctgcgagatcaaccgcgacctaggtgtgctatccactccctgctccccctctctctgctgtctccaatccgcttcgcttgctagctgggctgctcattccaagtctgtgcgttgcagttgcggcggatgcgctgtccgacgatggagccaaggatgcctacggggatgtcctcgtcagtacactcccatcttccccccttcctcctccgcctcgcatagtttcgtctttcttctttttcacaacactaattttattaggcctctaattgaaactttaatttgggatttcttctccagggaatggtcttcagcccgattcctttccagccggatgcgattgttgccacccacgagcctcctgctgtcactgaagctgctgagattgtccccagaacaagtttagcttccaccgtagctgagtccttcaaacaaatgctattcccttcttgcgatgtgagttggttctttatcatatcttagtgactcaattgcgaataattaatatatctccatattctgtttatgtcataatatcagttggcatagtatactgttagattgaatttatttatttatttttaatataagggaggaatatgcctctggtcagcgtcatatcatgacaatgttgcatttgtgaaatctggtacctttcctagaggttctagtggccaagggatgcttgtggacattctctattgttcttctgctgaaggtagtagcctagtaggaaaggatcctatggcttacaaaatattgtatactcgcttcaacaaattatagatatcatcgtcgaaaaaagtacagatatatttttcatccatatgatttcactaaaggaggtaaaattactgaaggcgtgcagggtattgaaatgaacactcaaagtcatataatggatgaaacataatttatgtcatactgagtgcatgcactgtatcgaaatgaacactcaaagtcatataagtgaccaaacattaacttatggcatagaagggattaagtgaaaacttagtgaaacataaagaacattctcttttaaatatcggtgtccctggaaacagataagtggtattttcaccagataaaatgtagaccccagaattttgcattccaaaattagttaccagtaatcggtcagaaattttaacatgagaaaagaaaaaagatctgacatataaaatacattaatacatcacaaatagatcataatgattgtagggatataatccatagggacatgcttcacaaaaaaagtatataacatacaatagttccaccacaaatgtggcaattgatttaattctagaactggatgtgagtatttctttttccttcagaaatgtaacaacaaataaacttgaaagagaagatgaagttggcatacttccaaagttgaatttaaattgttccaatcaatttattggtactggttcattggcttaggagcggcaactgatcacttaccgctggctgtatcatgactcctctttgtgcatattcaacactgcattatttaattttgtcttctaattaacatacttgctccatttttcagttcttccttaaggaccaatgctgtgtctaatttccataccctcgaggataagtcctttcttcgagttgagctggacgatctcttgcaggttgataacaaccattccatctccttggtggttgtagaagtgccccagttgtacctccatccagccgtcaccccgttctctcggatagctcactgtctcctctgctcgtcctacttcgcttctacccatgtcaagaggtgtctcttgcgtgcgtgggtgcagagagacggtgcgcttggcagacactacttgatcgtccatggtgatatatgcctcttgtgtccggcagtcaagcccgtatgatttatctgccaatttgaagatgagatagactatgtatcgtgtgttgggtgagagctctctgcagttgatgcggccacgcaaatggaaccagcagacaaatacaagcgcagctactctttcaaacctgaaacaaggagaaactttggtttttgtttaattatcgagaaaaaaaatcaaagcaaatcaaagaatagtatgtatattgaatttaaacactatctgattgagaatgtttattatagtttatttcttaatgattttgtatttctaaaagaagtgtcatgtatatgtgattatgtttgcaaaataagtgcttcagatttatcctccacgtttgggatgcaaacctggaatcgggtaagtagatccatctccagtaccgggcatcatccccccatgctatctctaatgatctggatgatagcaagtagcatttagctccgcttgttctttccaaccaaaaactctggatgcaaatgtgcaaattagtcgcgcgcattcatttacttagcatcaagataacaagaagttagcactaatattgaacaaaataatggattttccctggcaacattgcgtggagctagattgtaatattagactttgatttaatatacaactcgtagctcctcaatacaattgtattttgtatatagtagatttaagaatatagaattgaatttgatttacaactcttagtttctactttcgtaggtacaattatttgtatacaatacaacaaaagtgggattggaactaatatacaactgttgacatttatttatgtgaatacaattattttttctttaaaaacaactatattgatgtaacgacccgcctctcccaggccaggaccgcttacatatgacagctttcataggtcatatactatgaaacgttttatgacctattttaagtgactacatatggcagctttcatgtcctcccagagagacacaagtcttttatgcacactatatatgacagctttcatagtcttttatgcacactacatatggcagctttcataggtcaagtcttttatgcacactatatatggcagctttcatagtcttttatacacactacattatgcacactacatatggcagctttcataggtcacatgtcctcacttgtgcgcacccgggaggtcttttatgcacactacatatggcagttttcataggtcatatactgtcctcatagagacacacaagtcttttatgcacactacatatggcagctttcatgtcctcacatgtcctcacttgtgcgcacccgggaggtcacccatcccctcacttgtgcgcacccgggaggaccctggagttctttggagatcagcttctggaaaagaagttgcaacttgttaatatgagtactctattaagcaacttgttgatatgagtattctattaatcctattaagccctaggctagaatgttctggcagctttcataggtcatagactactctgtgtggtatgttctagcagctttcataggtcatagactgctctgtgtggaaaagaagttgcaacttattgatatgagtattctattaattctattaagccctaggctgggatgttctggcagctttcataggtcatagactgctctgtgtggaaaagaagttgcaacttattgatatgagtattctattaatcctattaagccctaggttgggatgttctggcagctttcataggtcatagactactctgtgttgtatgttctggcagctttcataggtcatagactgctctgtgtggaaaagaagttgcaacttattgatatgagtattctattaatcctattaagccttatgctgggatgttctggcagctttcataggtcatagactgctctgttctggcagctttcataggtcatagactgctctgttctggcaactttcataggtcatagactgctctgtgtgaaaaagaagttgcaacttattgatatgagtattctattaatcctattaagccctaggcaaaattgctccaggccaagcacgtttaaccctggagttctttggagatcggcttccagaaaagaagttacaacttattgatatgagtattctattaatcctattaagccctaggctgggatgtcacaattgataattctgcaccatcataatttgaatagatcaaaatctaatggtttaaataattttcttttttcaattaatatggtacggtttctatgccttccgagtgaaactaatgattttctttttcgagctatcttaataatataaccaatgaatgtttttttctcgcaaacttttgtgcggagctagataaaagtaggattagaatttgataaacaattcatatcttatgtttctataaatatatgatttatatatgatactaaaaatagtattagatttcatatacacctttatcttatgtttccgtgcatatagttgtaatttgtataaactattttaaaagtaaaaatagatttaatatataaatcttagcttttgtttcaggtactcatattttgtatacaaatttatcaatcaatctatgcttataaggctataacttatattttgtatacaattgtgttttgtttttctctccgactaatgcgaggtgtgatggttcttttttaaccatcttaactgtatactactccattaggttacaaacgttagacatttagggtgtgtttggttgggtggataagactggatgggagatagccgcttgattttttatggtacatgtggatggggcggtctagaaaagggaatatttcctcaatatgctagatgagtgtatacggcttatttggccggatgaagccatccatgctttcgtatgggtgacgtgtcatattctgattagttgtgcttggtttgatttttttctcctaaaccgtttatctaatttataatttgattacaccattatattagttacaattaaatatttaaaacaagatctcgaatgattatattttgattaaatatatatatatgacaaatgggtcccactaaatttggcttatcccatccatgctctatccctccaactaaacaagaaatttgatcatcctatacatacaaaccaaacaaaaaaaaattagatcgtcatatccaataaaatatggatgaccatatcttatccatgcatgatcatgaaccaaatgcacacttaaggccaagattcggtcatatttttggaacttgaccatcaagtgatttctgaaatggttagtttaaaaacaaataattacggtatgtacttatttgcctcaaagagtagctagaattataaggtttaaaagtttgactaaatcatgtccaaaacaatggggagtattaacagtggtacagctgtggggggtgccggagggggccaacacctcctatccaaacaccaccaccgccaccctcacctgtttttactctatattgaggttaactaagatatgtatttatctagtttatttgtgtagcttgaaattattatcagtttagttagcaagtctaaaaaaacattagcaagaaacatgatctacaaaattagtttgtgatttctcatctttttcaaagtaaaatagaatatacttatttgtgagattattcaatagtttacattaaaaggatttaacaataaaaactagttccaaactttcaatgatattattaaagagctaattaagattcaagtttttttaaaggattagtttacacgcattgattgttattgacagtaactacttgacctcctttgctatcgatattggtaattcagtcttatggcttatccccaccccccacaccccctaatcttaaatcctaggtattatacgtaccttgctgcgttggtcgagaaggacgtggtcctgggcgaggctgaggaagagctccttgttggaagtggtgaaatccacaggatcgtcggctcgagcgaggatggagtggtagtccggcggcaggaagcgctcccacacggcgttggagctcgccgctgcttggaagtcggcggagacggcggagcagcggcaggcgtccgtgggagtggtgaaggagattgcatgagccaggcatgcctctgggaggcgtgagatgctgctgctgctgcagtatcctgcttcttcctccttcttaccaacgctcacatcgtcgtccacttcctcccttcgtgattgcttcatggccagcggcttcaacaactgtcgttggagatatcacaatctagtatactgtatattggactataggtaggcatcaggcatgtctgtacacgatagaacttgtacaatctagtatgtgaacgcatgtcttatcagtaaggaaatttcgttgttatgagtaacaactgatcttttcccacctaatttattattaatcaaccgtacgttacatcatcaacatatacaattgtatatccactcctacccaaattccacggcgcgccatcaggccacggctgccacgcgcttgtgctcgacgcgttgacgaggaggaaaagagctgcaaccatctagccctctcgtggcaggtggatggactcgtgggtccggagccattcagccaacagtttcatcagacaataggtaagtagtagaatacagaatttaggccagtgatacaggtggttcttccccaaccagacaattcctccaacagatcgacacaagccccggccgccatcgtcaaggccactcgcctgtgctatatttcatatactagaaaaagactgcgttgcaacaggcaatggcggatacataaaatcgattcgttggtgtcataacgtttctattgatgtcatagtatgctaattatgtttagatcatattgttataacatagataagcagttatgctataggttttgccgaaagtcgttggtgtcgtctgacaccagtccgcccctggcaacaggtaagtgttttttaatatacaacaactattaggagctaagcaatatattgaaacattaagatcactatacataagtggagctgcagacccagctagcatagccgatgtctcctcttgctaccaagctagacccacacgtttcattagcgtcttcaacctccggacgacagtcatgtgctactatgatgctgtagcctatcctttgcatcaaatctggccgaatctttctcgatctcccaaatttagttgtggatttttaatccactcaatcttctgtttctatttccccgtaatcgaagcgaatccataaaactgggggataaaaatgacctggggaagcttgtcggccgcattattggtgaccgttaaacgaagattaaatctggtgaattaaagccagatttataaggaaaatcattggagaaataatgagggagttctttctgtttctcaataattgaagcgaatctgcaaaattggggataaaaatgacccggggaagcttgtcggctacatcattggtgaccgttaaacgcagattaaatttgatgaattaaagctgaattaatagggaaaatcatggggaaataatgaggggggagtggggaatcgatttttgcaatcaattggaggaggaaacgtatgaggcaaatcgacgtggcaacggtgctaggatttggccggcagctagaggcgcacgtagcttgcagtggatcggacttattaaagaaaatacaaaatcctcctaaaagaaaaaggtgaaataggtgggagagaaatggaggtccggaagactgaaagggagagaaaaaggaagcagggctgactcagagtcaatgacagacgaaaaaaagctatgaaaatctttcgtatattttaattaggtatagatttgtagagagagaaagatggcggtggcaatgatgcctcgagagcaactacaattttccagagcaatgccaaggagttgcttgctgaactaaaggccaagctcaccatggtgaaggccatatccgaggcggcagacagccggctcatcaccaacaccaaccttctccactggctgatgcgcctacatgcggcggctcaggaagccaaagatgtcctcgacgaattcgaggtcgacggctcaaacatcgcccgcaagcgcaaggccagtgacctcatactgtcatcccgatctctcaagaatctggtcattgctgatgaaagcctgaaaaggttggaacatgtcgtcaagaccctcacatagctctgcgcaacctcagccactttcattgagctcatccaggggcggatctccagtgtaacggccggtgttaggcgaaatcaacaactttcgataaaacatatagttaaactatttatccatttattataacaccatggtttaagtataattagcatactatgacaccagtagatacattataacatcaacgaatcaatcttctagatccgctgaaccagtagagacatgtttcaaggaagaactgaagaacataaagtgctaaggaagaaaaaagctcagaatatatttgcatgtgcaggagatgcatatgccttttttttttccgtgtatgacttctactcggacatctatatgtgcgggttcgatctaatcgatatggtcagactctatccttctatccttgtatgactctatatgcaggagcctatatctattgtttctcctgtttccataaatacaaagttattctgtatcaatctaagaccaataaaatatggatctactataatctaacggtcaatattttttctttttcttcgattaatgtggtaatttataggctccacagtgaacgtggtatcttctttcaaagctgttttaataatataattgatagatagatagatacaaaatcctcctaaaagaaaaaggtgaaacaggtgagagataaatggaggtccggaaggctggaagggagagaaaaaggaagcggggctgactgagagtcaatgacagacgaaaaaaagctatgaaaatctttcgtatcttttaattagggttgtgtttagattgacccaaagtttggaatttggttgaaattggagacgatgtgactggaaagttgtgtgtgtatgaaaggtttgatgtgatagaaagttggaagtttggaaaaaaactttggaactaaacacaatttgcctcgagagagaaagatggcagtggcaatgatgcctcgagagcaactacaatttgccggagcgtgccaaggagttgcttgccgaactagaggccaagctcaccatggtgaaggctatctgaggcggcagacagccggctcatgaaggggcgggcctacaatgattcatgagtattcaaatgaatacccaagaattttaaacaaaaaatacatatatgaagtatatattccatatgtatatatgaaaaagaaaaaaagacctaccattcaaaagaagcccaagctaaaaacgattcatatccctcccatcatctcttcctcccactatttcacgcccattggcccaatagcaaaaaaaaaaaaaaaaaaaaaaagagcccaaacactttctaaccctgtctcctcaccacccatcccaactctccccgtctcctgactcccgatccagccaccaggacagccgagaccgacgcggcgacgcgccggcgccggcgccggtcgccctgtgcgctgcgccccatcgccagctacccgcctggcgcatcccccacgtcgccaccgccgcgtctccaccctccaggctccagccacggagccgctgcgcacggtgcatccggcatcccccgcgtctcgccctctccaagctccagccgccactcgccggcccgccgggacgccgccgcgtgccgcctggcaggctccaccgcaggtggcaggccgctggccgcattgccacaggcgctgtggctgtgcacagtgcgctgagcagctgaccgccccctgcctccctccactcaagtactccactcactaaggtaactcactaactcttcccttcaatcctcgcctagatggctagatggttaggaagtaggaacaatttggattaggaaaacaaccatacaggagattaggatttaattcatagttgaatctagcctgttggatattgttcatggttgaacattttttatttaaaatttgaatccacgaatgatttatggttgaatagagtatactgttgttttgtaggtttgaaacatgaaaaaaaggattggttacattcattaaaagggatttcttcttgcaagttcaggataaagataccatcaatcattttcaaaatatcaagaaatggaaagttcttctctaaattgtaagatttcttatcattttgccattttgtatactctataaatttgatatgttttcgcaattaatagtttagtattatactctaatatgcttaacacattcaatttatgatcaattttatccatccatctatgactttataaaatcatgtttataccgttatatattatacaattattagactctgggttgaacaattttttctatctcttctaatttcgaatacccaagttgaaaatcctgggcccgccgctcatcaccaacaccaaccttctccactggctgatgcgcctgcatgaggcggctcaggaagcgcaaggttgacggctcaaacatcacccgcaagcgcaaggccagcgacctcatactgtcatgatgtcatcccttagatctctcaagaatttggtcattcctgatgaaagcctgacaaggttggaacatgtcgtcaagacccttacacagctctgcgcaacctcagccactttcattgagctcatcaagatggatgattccaaaacaaaccagctgcacaaggcagcagaggccagctctcatctcccggtagatgtccctgtgtttggccgggatgaggtcaaggagttcatcctgaatgtgattattggatcaccgtagcatgatcatccagaatccagcattggaactggtaaagtaagagcagccaggcacaacattcttgttctcccaatagtcggtatgagtggcgtggggaagacaacacttgcccaggtcatctacaatcatgccagagtgaagcaacactttgagcatagagcttgggtctatgtttctgaggatttcaccatcaaaagaactttgcaagaaatcctgcattcgttccaaggacacggtggcgctattttcaatggcgatgaaagcatggaagctaccatcaccaagctccgtatcaagatcagtggaggatgtaaattctttttggtgctagacaacatgtgggaagagatgtgccaggaatggagcgtgctgctcacagcattatccgatgaggcacgtcagcatgggagtgtcctccttgtcacaactcagagctaaagggttgcacaatttgccgccacgatttatcccataaatttaaaagcattgccgtgggagagcttctggcctctctttcagtaccacacatttggtggtgtggaggttccccaacaagatgacaaccgaaacatgctattgatcgcccaagggattgcaaagaagctagatggattaccattagcagcaaaagtaataggaaacctgctgagatgtaggttctcctgggataattggagaagggttgccgagagtgattggtggaacttggaagaagctctccagggtattctgccatacctcagggtcagttatcagcatctgtcaccaaaacaaagacagtgcttagcctattgttcaatatttcccaggaattacctgtttgacaaggacagggtggtccagatgtggcttgcgcacgattttatccagtggaatgagattgctgacgttatgaggccagatgatgttgggaggcagttatttgatgagctcgtggaaaggtccttcttccaacccacatttgttagtaacaagtatgtcatgcctgatttggtccgtggtttagcaattcagtttctctacaccagtgcttcttccatggtgaaagatcaacaggagtatcgtccttagcaccaggaaatattcgccacctggccctgcaggttaatagcctggaacaatgccaggagctgcacaagtacagaaatctgcgtactctcctaatatttggccgttgtgagagtgatgcattttttaaccttcttgatgggatgttggagaagtcaccaagtatccgtgtgctagacttattgatacggggaaagcccgaccttctcgacgtaggatccggatacacccgtgaaacctcacgaactggatgaacaacacgctgcccgtgcaacgcacctttcaccacgaattcgcaagcatcaaattctcatatatttcacgcatagacttagagagaaacgagttcaccttatgttctgatctgcaagtaaagaacaatgtacttttgataggtagatctgcatcacttatcatacgttaaagcaccagggaaggtatggcccaaagatgctaggcccctgagaaaactgcgattccttgatctttcatttacaaagatcacaaagttgaaggatctccccaccaacctccaagtcctgcatcttcgtggatatgatgctgatcgtgtgccacaaagtatcaccaagctgaccaacctacggcatctgtatgtagatggttcagcattgtccaagattcaaagtattggacagcaaactgaacttcaagagttggagagcttcattgcacgaaagggacaaggattcatgataagagagttaaagaacatgagggagttcacggggaggctgtgcatccgtggtatcgagaatatcagaagtaaggatgaagcgatggaagctagattgatggacaagaaacatgtgggtgccttggtgatcgaagggaaaagagtgcccaagtttgcacttgaaggactgcaaccacacacaaacatacaggaactcaccatcaaattcttccaggaacaagattttcctgattgggtgtgtccagataacttggttaatctcttacaggtaaatcttgaaagctaccacttcttgtctaccattccaccattgggccatctgcctttgctaaagctcctcaccctaagaaagcttccctcagtgaagcatgccaacggcacatcattcggtggtttcccatctcttgaggagttcgagcttcattcaatggagaaatgggaggagtggacagaaccagatgcagcagctcatgcttatgggttgtcgcttttccttggacacctcaggaagctccatcttgcatactgtccatcactgagacgtttcccgcatcttccatgctttatctgcattgaaagagctgaagatctccaagcctggaagctggatcctggcattaccagcatgttctcaagtcttgtcatccctaataaccttggcagtcgagtactgcaaccacaacgttgtaatgtccgcgcaacagttcaagtccctagaaaatattgagcttatcaaaagtgaagggctacgtttggctgatggattccaatactttagcaaactgagaagcgcatgggtggagggttgtcctcaactcctaagtgccatcaccacctctgtctcagtgggctttggtcaagattgttgtgcggcacatgatgagaagcagcagcaggaagctagccttttaacccacctcagagccaatgatagcttgatgtatggtgattacttcaggaccgtgggaaagctcccatcactgcgcaatctgacaatctgcaatgaatcgaatggcactaatttctcggtcaagcaagaactgtggtttcagcaacaaaactcgctagagcacctctgcattgaaggttttcatgcattgcaacgtctcccttcattcttggttaccatgctctccattaagatactagagcttcatggcttgcgtggcttgcagtccataccagacaatgctctgcccctgactctccaagagttcaatataaacaactgtacttcgtgtttgagtactcgggtatctaaagatggtgccgattggccatatgttgctcatgttccatacatccgagttaacggaaccacggtccaaaacttatagacttttgtactgtatatatgaactcctgaaaaatctccgatacaaaaatagaagagaatggcttttggtattcagtaatccagtcaatgaattcttttacctgagccatatgtttccttgagcaggttgagtatatcctcgtagaaatgatatgtatataagcatgcctatgtaactaaagaaggtatagacaaacaaacaaaagttggaacttgatttcgattttcatatatatgatccccttgccacatctgaaagggcatcaatgccatatatgtgtttctgttattgtgtgtgcgcctcccgtgtcagtgcattatttgatttttaattttcagtcaaagcagagatcggtaaacagttctcctcatcattaggcagattcttttggtaaaagccacctacaacttccaacactgaattcattgtgcgagcatggcatctgcgattcctaaattttcactcttccctcgttgtgctccacagcaagctagcacttgcatttcttcaatggcatcctgacaaaataagacctggcattttccttcttaggttgtagacagggggctcaagcagacatcatactgtgactccccctaagcaggactgtatgtctgcctcctgttgagatgtagaaaatgtagggtgcttaagaacaaattcttgcaggtttacttccaaagcagaaggtattccgaagtgtgacaacctttcaaatggtttcatattttccgttatcaagcacaaattttcatgaagaataccagcacatttctcaagctgctcaacattgcgcattggatgtaaatcatcctactcatagatctggtaaagggaagctctgccagctcttaaacttttctcctaaaaccattccaaaaccttaaagccagtaggtaagttcattggaaaattacattttgtttcagatgcagccagccacttaatgtgtatactccttcccttccattcttcgacatggtctgctgctatatttccatccctggtgaccaacggtttggtactaaagagcaactgtagttgtcgagcagcaattcccttgcgagccacaatgcatgcatactcagagtttcatctgttgacatcatgagaagcttcttcaactctgaacaaatagcaggttcactatccccggtgacagggtctttttctaccatcaaaccagccatcttttagaccttgaaacattcgttcctttcgaaagggtgcatgtaaactttggggtaaagtgccaacctcattgttcaacctgacttcatgccacttccttgagacaaaacggagagacgtgcagcctttcccctgctgaaattaaaaagaaagaaaagaaaccccaatgaggatcgaaaccatcatcgtgttcttcataattcttctcctgctacttgtcatacttcctctgatatttgttgattatcttagccgaattcacttgaaaaccctttgcacggaccctatcggctgattggccagctgtatgtaccatattaacaggaaaaggattactatcgaccttcattggcctcttcgaatcatcaaacttgatttttcctccctcaatagccgtttggatctgctgcctgaagaccttgcagtcattagttgtatgagacccagaattatgccacttacaatacctcttcttacccaactcttcagccgatggaattgtatgtccggcaggaagttgaatctgtttttctcgaagtagcaaatcaaatatcttatcagccttggttatgtcaaagtcatacctctcctcttttcctgagttcttcacccattggcacggtataacctgtttgctcctaacccactcggctgcagctatttcggaatcatcatcctcctcatccgacccatacatataaggatagacatgattaatctccctagagttcttcctagcttccgcaaacctttgttcatgcaaagctaccttctgtgtaaggtgcgacaagctttcgaaattttcatatgagaatttttccctgatcggagcaatcatcccttgaaaagccaaatcggataactgggcatcagtcaaactcaagctgtaacacttattcctcattttcctgaacctttgaatatactcacgcaccggctcatcatgcttttgcttgattgacgtgagatcagacagtttcatctcattaatcccactatagaaataactatgaaactacttttctaaatcggcccaactattaatcgacccatgcggcagagaagaaaaccaagtaaaagccgacccagccaatgacaaccggaataacctaaccctcaaagcatctacaaccgatgcctcaccacactgagctaaaaatcggctaatgtgctcataagtcgatgtagtgtcttgtcctgaaaactttgagaaatctggtgctttgaaccggttaggtaaaggaactctttcaaaccattcaggataaggttgtcggtacaaatttccagtctcttttggtttaagcccaaattgctccctcattacatcagctatcacatcagcccatggtcgctgctgaggtgttccttgaggttgttgtggtgtgggctcaaactggttgtaaaactgaggttgaactgatcctgcctgttggtactgaacttgtggtgatggaggttgatattgataactcaaattgccccctggtaattgtgaaggttcggctgaataccacgcgccaaatgctcaggaataacttgaggtactactgaaccatctggttgcacatgatgaaccaggtgttccgggacaacctgatttgtagtgtactgcacaggctgaccaccaggcattgcaaatccagccgacgcgttcattgaggcttgctgctgaatcggctgaacgacctgctgtctcaacggtgtctgctgaatcggctgtaaagccggtcgtcttggtggcgtctgctgaactggttgcacgacctgctggattggggatgtttgttgaataggctgcacaacctgttgcctgggcggcgtttgctgattcggctgctgctgagccgaattaatagcattctgaggaggtagaaacatagatgcaaccgggtcttgtgttatctgagtcacattcggtccaggatgctgtgattgctctcttaccaatatttgaggattgactaattgacctgaggccgacgacggcactgcaggtgctggagccgatgctggtaccgtcggctgagctgatgatgtaacaggaggaactccctgagtaagtggatgaacatcggtaatcaaagtccgataatttggaaaagtacccccttgcaaataaactgggcctgcagcctgatgttcagctattgaaccatcggctaccgatttcatcatatttgacaaggtattagttaatactccagattgattgatcaaagcattatacacggcatagtcaacccgatcttgaaagttattgaaaaaatcttggaatgcattgtcattctgattaagatttcccctttgcggtccctgagtgccgtcaccttgaactccatgtacttcacgaaagtagtcaccctggttctcctgggtcgacccatctgtaacacctttgtcactcggctgggctgatccatctggaacttgtttcttttctccctctttaaaagagccgatcccaggatcatcaggaaccaccttcaccttgtacttctaaacaaatgtgcccttgcgagtctgcatgaatgaacttaaaaattgatctcgtgcttgttgcatcattgcatcgaagtctttcttctgttcgggagtgagcttctctggatcaatgggcacaacgtttccttcatggacgtcagtcaaaccgagcttctggatcgtttctttaacattactcgggctggccgacgacggcgacaatggtggtttctcagccatgagggaagctgccttctgacttctaatcagtcccaccaggcatgccaaaagcgtgttgacagaaaacacgaggcctgggagatctgcttaactccagtgcaggtccaaaactcgccttcggatgtatgagcgtgccagttgatttgatcatgcaatcaacaagaaacaaagacaaagaaaccgtgattaaatccataaatgatagccgatcggctaaatgccgatgacatatcatttatctttgagccgatgtcatatgtaaatcgatcggcatgtgttaagtaaacaaatcagaattaaatctactcgatcggctgtagatatcaataatatataatccttatatcgatatatacttgaatcaagtgattgggatagatcggtcaccttgccgagacagtataaatcacttagatcgaaatatatattaataatgagattatacatatattcatagcatagccgatcagatagatctagcatgtatcggctaatactccgataccacatcgtgttaagatattaaagcaaatagaatataccaaacataagcctaatatacttaaatgcaacaagatcttaacataaagggtagatctaacatgtcaatcgatcatataggataaaagcaattagatcagataagatcggctgaaactccgatactaccctaatcggcaaccagtaggcaggctagagattgaaattcaactgatacaacattaagtatgaaaagaagaacaatatctagacaatcaagctgctggatgtttcgtagagtggtggatatctcatataatctaagccaacgtcgttatttaacctaatcggttgccttctggtaacagatgttagccgattgtaggttagatgacgatattgtcaaggattatgcaagatataggataacttgacggattacatgaacaagattagagtatcataaagatggaagcactaatctcgagaacacaaaccgtcataacaagttttacctcatgttgaagatcgaaaccgatgcagctcaacccgaaagtaagaactcgtcgaaataaaactaaagcaaaaagggtggtgatgcgccgaaattgttttgaacgtgtgtgttctcaattacatagggctcggggactatttatacccaagaattataaaatatgtccatattggacacgactcttatccctaacaaactgtaagataccataagtctttgcggcagacttttgcccacatttatctctaagtaatttacataaaatatcctaattaatagatacaattgccttcccaggactctatccatgcgtggcaatcatcttgaagcacatcaattcgaacccgatgtcgtacacaagttgtattatcggaatcggctgtatcacttaacctaatctgactcagacttagccgatcccaatcatagtcgatccggactccagccgattcttactctgtttccgcaacaacccttatattcgattccgcttcgatcccatcttcatctccgatgctgatattaccaaatttggtcgttaacagccgcagacgccgccgccgcatctcttgggtgagagccatcgctgcctctctctctctctcgatctcgatctctctctctctccaaaccgccaccacctagctcgttgcccacgccactgccacgccacggtcaaccgccaccattgatgaccgacttcgacgcggccgccaccgccgacgacgctgtcgccactgccactccgccgtccccgcctcgagctcgccacgccgccgcccccacctcgagctcgccacgccgccgcgccacgccgccgcgacgccacgccgtcgggcccccacgccgccgccgcggcacgccgccgccacgcccgcatgccgtcgggccggcccacggcgccccgacgccgctgccgcactgccacgcccctgccgcccgcgcccaacattgccgaacgtgaacgaacgtgattgaaacgtgaccgaacgcgaacgaacgtgaacgaacgcgaacgaacgtgaccgatacgtggacgaccttgaacgaacgtgaacgaaacgttaacgaacacgaacgaacgtgcacgaaacgcgagtggacgtgaacgaaacgttaacgaacgcttaacgaacgtgaacgaaacgttgacgaacgcgaacgaacgtgaacgaaacgttaacgaacgcgaacgaacgtgcatgaaacgcgagtggatgtgaacgaaacgttaacgaacgcttacgaacgtgaatgcacttgtaataaaagtgtgagaacgaacgcgtttagactaatacattttactggtaatacatatatgattatatatgtaacttggcccgtttagactaatacattttcctggtaatgttgcagagaagacgtcgtcgtcgtccctcaagccgaagtggtagctagccatcgaaggaattcgcgcaggcaagtgatgtaaagaagtgattgttagagatttaatataagattgttagacttagcatatatgattattacaattttaatataagatttgtagcgatttaatataagtttgttagacttagcatatttgattgttagagatttaatataagattggtagacttagcatatatatatatatatatgattattacaattttaatataagattagtagcgatttaatatgagattagtagagatttaatatatgattattacaattttaatatgagattagtagagatttaatgtaagattagtagcgatttaatataagattgttagacttagcatatatgattattacaattttaatataagattattagagatttaatataagattgttagagttttaatattacggttagcaaatacatcctatagacctaataaatattttttgtatgcacagatggctgatcgcgatgaggaacagatactatacgatacaatcgcagagggaagcagccagtactggaacgaagaagaggggaacgaggatccaaaccagtacttgaacgaggaggggaacgtggagagggatgcggaggggagcgaggaggggaacgatgaggaggctagtggaagtcatccctcctacggacagaagagggcacgcggacaacgaggtgccgcgaagaagatagagggtcggcacatcataactgaggtgaacgaagacggccgacctagtgccccggcagaagcagccaagaattttgtacgccacagcggttgggttgtgagggacaacgtgcctgtcagcacggtgtactggcgcagaacaagggcacgcggggataatgacagctttgtcccggactcagagaaagagatgctgtagaccacaatgctcgagacgttcacgctacccgcgggtacggagaacatagtgaaacagtggactctgaagaaaatggcagacagttccagagcttcaagggagatctctacaagaaatacatcctgaaggggcagacaccgaacttcgacacattcccaaagctaagggatcactgggacgagttcattgcatataagacaggtcaacaagggcaggcgatgatggagagaaacaaagaaaatgctgccaagaagaagtaccatcaccacttggggtcaggcggctatagcgtcgcaatgccaaagtgggaggagatggaggcaagtttgattgagaggggtatcaaaccagccaccgctaaatggccggatcgatcgaagttctggtactatgctcacggtggaacgcttaactcagttgatggctcccttgtcttcagcgatcagatacgcgaggctgccagtcgactaacggacgcagtggtagcctcttctcagggcacatttcgacccgacagagagaaggatgagctgtcactcgccctacagactccagagcatccaggacaaacacgagggaaaggcgtgattcccaggaagattggatttaaggaggacatccacacgtacaggagttggatgaggagcaagagagataccgaggcgaatattgcagatcttgagtacagggtatcgagctacgagctcagcatgcaagaggaggtggcaaggaaggtggatgaacgtatggccgcacatcggtcctaggatccccagccgtacattaatcctgcaatggtcagtccatcaggcaatcgtagcagctgcgcctcaacggggcaggtcggatcacagagcatggacgccatgcaaacccaggacgaaaccacctgcaccgttgatgagatcacatagtggacaccatgtgagctgcatattcccttcaagaacttatcaatcaaggtatgctcgtagtttgatgatttttgacttgtacattccgcaagttgctgcttaggttgattactaatagataacctcttatcacgtgaaggtggcgtcgggaatggccatcccaacggacccttccgggacttaccactgcaggccgattccagcaggatactctagggtcgaagttgagctggtggaagccgcgtacgaggacctcaagttggactacccaggaggagacggtgagacacatctacgagacacaagccacgccattatactatggcgcaagtggtacatcatcctccctgggcgacaagcggcgtctcgtgtaccatctcctccggctccgccgtctcctccgtctcctcctgcaccatctccttcggttcctccgccacgtcctcctgcaccatctcctccggctcctccgccacctcctcctgcaccatctcctccggctcctccgcctcctccacctccacctctaccgtgtccgcctgcacctcccaagacaaggtctcgccaagctccacctcctgcccgcacaagggcaacgaagaaggtgaaagttgacgccaccaaaaataaggagccgccgtacgattgcagtcaagaggagcttgacacttatgtggcaggagaagtgaaaaggcaactcaagcctcggagtcctaaaaagaagatacctattgacctgagcgtgaagaagttcttccagggaatgtccaccgcaaacaaggatgccttaaagctatcggactatgaccgaacacttaggaaagcctattacaagaagtccaaaccagttcctcagcttggagaacagccaaaccaagaggtcaagtcgttggtgaccggcgaagactttggcataacggattttatttcggacaccggtctaacggtggatcagttggttggagccgcaccaatcccgaaggcggaagtggcatacaagtttgaactcggtaaaccgcttgtcaggcctgagcagctgcagtccctaccgacacaaatgtacaaattccatgaacggtacatggaaatgagcgccaatggtagagaggtgttcggagcgaggattagaaactccaacttcttgcaaggagaaaatgttctatggatccatttcaaggatgtcttcgatctgtaccatctggacgccctcgacgtctctcttctgagcgcatggattttgtaagtatctttgagttcgatttgtttcgttcaataattagctcctggcatatatgaaaacaataataatttcctttcatcgttgtagaatggagattcaaagggcccgacggcggggggtttacgatactgggttcatcgaccctcggaaaatcaacaccgaaatgatcgacaattacgagaaagacacagaggacaatctcgtccatctcctaacgcagcagcatttcaagacgttcatactactgccgtacaacacagagtgagtttttattgtcgtttggacaaatttcattcccatccatataacatatacattctgatatttatcttatctcacgcatattccagattccactgggtcctgttatttttcgacttggacgcatgcagagtcactgtgtacgactcaatgaataaagaggagaaggtttttgaccaggtcttccaactgatagacaggtaatataatgccatctattccaaagtggcgggactctgttgctattatgttgatctcgagtaataattaattaatcatagcttgcaactgcacatgtagggcttgggatcggttccgtcaattggtccgcgagacttgaaaagaaaaacttggacggaggtttcattttccagtgagtacatgcatgatccaaaattatattgaattgaatctctaattacagttaatataaagagtatattaaatctctcattttttctcatgtagtgtgcaaagcaggaccagggaactaacttatgcggctactacgtatgcgagtatgcccactgcctatcaaaccaaatatacaccacacgagaactcgatgtacgtatacataaaccattcaaaatttcattgcgtatcgatttgttaagttgtttattaatttcatatattgatatgtcattatttttcgaatgatagcgtattcacatgagggaaaatctcccacacaaggattttatcacggctgttcaagaacaactgatggggttcatcaacgaagaagtccttaatcccgatggtgaattctactacgacggatcgacaattcataacgtcggtccttcctcttgtgacataacgccggcgtcgaagtcgtagctatagctagcgagcaaatgaattgtactatacatgcatgtatatatatttatatatgtacgtacatttactttagtgttaatatatattttggtaacatatatgcacataaaatgttaagtgctttaaattataaatatgtgtgtaatatatgtatttatacatatacacatatgcacatatatatatacacacacacacacacacacatatatatatatatatatatatatatatatatatacatatatataagcacatatatatatatatatgtatatatatatatatatatgtatgtatatatgtaatcaaccatgcagcaaacatggccatgcaaatcaccgatctttagtcccggtccgtgttaccaaccaggactaaagatcgatctttagtcccggttatttcacccgggactaaagatcgctatctttagttccggattcgtagtcccgattggacaaccgagactaaagggggttacgaaccgggactacaaacggtttcccaggtaacatacacatacaaaaataaatatatagaaatggtaactggcacgtacggcgattccgagagcaatttggttgtcgatgttaggtggatctttgcctgggattggcgtaaattccctgactgttggactggcgatggcgaggtagctcttggagaattcagagggtcccaccccaactttccatataggaagccacgccgatgctccgtgatatggcccattcactccatatgccgctgcaatctgcgcacacatcatactaatccatcaccttatatatgtttaatttgacgattaaattaatataatcactagtactatactctcttcgtctaaaaaaaatcaacctagaagaagatttgacatttcctaatacaataaatctgagctacctttatccaaattcatgatcctataaggggtcggattgagtttttttttttcctgacggagggagtatagtagtattattacttctagattataattattattgccagcttcatcatgaatactgtttggaggaggtcggccattggagtagaagaaatggagggttcggtttgcatctgcagtagcagtagcagtagcaggtgtccttcggattgggatgcttccttcagggcacctaccgcttcgatgccatgcctgctccgcgaatttgaacgagttgtttcttcccaacaccatcatcttctcaactatcttgggacgatccacgcttggtttcaactgaacaatatatattcatcacatacatcagtactagtagctcttagactgcaattagttcttcgatcttaattctctccttaatttactactccctccgtattttaatgaatgacgtcgttgacttttcgaccaacgtttgaccattcgttttattcaaaatttttgtgcaaatatgaaaatattcatgtcatatttaaagaacatttggtgatgaatcaagtcacactaaaataaatgataattacataaattttttaaataagatgaatgatcaaacgttggaaaaaagtcaacggcgtcatacattaaaatatggaaaatatggaggtagtattactttctttctaacaattgcatacatacatatataaatggtcgcattccttaaaaaactattataatattctatatgttttatatttaaaacattttgattttgatctttccatctctcgtctaaatttgctaacatccatatatatttgggtatatatatgaaacatatacatgaatctattcagaacctaaatattttgtagttataattataacgtgaagagaaagtagtaatcgacaatgaaaatgttcagacgtatgtacagcaccaggattttatgatctttgagcaatggattcttgaggcttggttgcttgtatatgtccacgcagtcaataatatcaccgcactcgctctgtcaattagaaaccaaagtgagacttaattagcacatgaaacttttttggggggtaaggtcaatgatcactggaaaaattactacctggaccaaaatgacctcagttgttcagctatatataaattcatgaattcaaccagatcgagtatatatcaagatgaggaatattagatttgagaattcatcttgtgtgattaaaattaaacagatttatactatgatatatagttaatagatatctgccaagtagtaacctaaccaatcctaaataaagaagattaacataatgtagaaattcttacctctatggtcttgataatgtcattgggatcgatttgtacaccatgaacagtagttgtcgttgaagccaacaatatgctttgctgcaaagaatgcaagaagagacatcattctctaggagtcgatcttcaggacagtcgaggatcataccgttggcaaacaagataatatggaggctttatatagaggtgtttgtggtgcatcgataagataattatgtattaatccattgctatcatttttacattactacacggaaataaggaaaggaggaataatgcttccttgtattctgtaaaattcatgattgattaattaaataccataagtaggtctgctggtaaaattcaaatttcgaatgcaagtgtactaaccatattttggtggagaaagtccatttttctccctcaactatagggcggttttgggtcgtgtccatcaatcctaaaatcaggtataaagaccccctcaatcgttaaaaccagatcaatttaactccctaggcgatgctaatggtgaggtttcctcctctgtggtgttgagtttacgagtcactttggcctagtttttatatgacgtggcacttacctaccattccaataataaaataaaataaaatgttaaaaataggcaggacccaatgtaagtctcctggaaaaaaaatgggatcctcccctcttatctccctcctactcctctctctcaccctgcgagtatagagagagattgccaccgccactccactacaagtgtactcctccgttgcaaaaaaaaaactaaacataggaggggatgtgacattttctaatacatcgaatctggacaaagggctatccagattcattgtattagaagatgtcacatgcttgcctaggttgtgttttttgggacggagggagtacacaagcgtataggggagggccgccatggatcatctccgagtggtacatggccccgtgttttatgctactgctaggagcatgcctcctagggtgtaacctccgccacctggaagccaaccctagctcgccaaccgtcaccagaggcatgccaccgaatcatgctggcagttggaacggagagggccaaggagggttggctcacttcggaggaagagtcactcgagttcgacgtggtgatggcaagcgtggggctcgagctcgagcgagatgttgccaaggacttaaggctcggggagctgaggcaccttgccatgatgtcgatggtgcaactcgacacaaggagtagcgcggggacagagcaactgcttggaggtggccatcgagtcaagggagtatagtatggtgtccagttcccactggcacctctatcaccttctcctcaatcacatccaaagatgtcgtcgttgtcctggttaaccaccgtttgagctcaactaccaaaccgaaccccatcacttccctatctttgagaagatgccaccaccacacaggctgccttcacagtttggcgagggaaccgagagaaaaaagagtgggaagggaggagagatgtagtcacttacatgtggaccctatatttattttgttaatttctttgatcaacaaaaagccaccatagttgagggagtcattttgcatcagctttaggccatctttgtttaggcttaggcttattggcttagacttttaagtcagcttattggcttatatgatttataagccagtgaatttaatgtcctaagtttagtggtgaagtcatacatctatcttatataagcaaaaaaaagcttctccaacctagcttttggcttaatagtgtaagagtggcttatagctttaaaaaagccaaacgaaaaagctgtttgtttgtttaggcttaaactttttggcttataagttggcttataagcctaaacaaagaggaccatactctcgagctactagccctacctaccttgcaaatgtatgagctagttcatcgacctcgcgtcgtcataggatctcgccacgaagaagaaggaccctctaaccggatgtaatcatacatgacgccgaagaaggggctcaacgccctcgtctgcgtgatgaacaccacattctcctcctctccctccaccagcatgtaccccttgatcgcgaactccaagctccactgcacgccgtgtgccccgtgccgcgctatcgcgttcccgtcgccgaacgccgccgccgtcgtcaacgcctcgtccgcccggccgttcaccaccacctgcaccctcgccatctgcgccgccgccagctcgacgcggagcgtgtaggtggcgtccgccacgacgcgctccagcctgaaccggatctgcctcgtcgtcgccgcatacccgtcgccttgctttctgcacaacaaggaaagaaaacacaattggttatcttgatgattcttcagaggttaatcgatcgagaggaaattgattgattgattgattgttttgttcgttgttgtttaattaccttgtgacgtgtgcgaagaaccagtccttggagatgtcgctctcgccgatcgtgaagacgagatcgccgtcagggtatagctcagcgtacctctcccacaacccgtactgcctgtacttgtctttggtgatgaagatcttgttcaggtatttggggttgggatcagggatgaagaactctgctgcactcctgtcaggaacacccatctcccacagtgtcgggcctgatcttggaggctcgaacacaagatcaccgaggttgatgccacgtcctgcttaaattcagacaaacaatggtagttaaacagagttgttctgatccagattatcatgttaaatactccctccgtttctaaatgtttgacaccgttgactttttagcacatatttgataattcgttttattaaaaaattttataaaatatgtaaaactatatgtatacatgaaagtatattcaacaataaatcaaatgataggaaaataattaataattactttttttaataagacgaatggtcaaacatgtttaaaaagttaacgacgtcaaatatttagaacggagggagtaataccaaatgccatctgaattagtgctaacttaacctggtgttactgttacttgcgaggtgtacatgtagtccccaagaaacccaggaacccatgcgtagaggttgtacactcctgctctcacattactgatgctgaagctgccgcagggcgttgccctcgtccagaattggtagtttttgctctctgtcacccaagaaccgggttgtccaggagtggccaagccaacaaaagccatcccagctgccatgtccttactgctcatgtacctgaaataaaataataattaacatcaaaacaaacacattatcaacgtttcagagatgatgatccatgaacaatcttgacccatgaaatgcaagtcatcatgtacctgtgtggagttgaaactatgaaagtaatgaatcttacctgtctctgacaaatagcctcccggtgactgatcctctctgacttgccttgtggaagtcaggggatacagggaagctgtatggccatttcctagcttcagcttctgcctgcaacttggcatccacccaaagcgaatgcagatctcctctcctcggattggagttgaggtagatgaacaccgggcccatcaccttcttccagtactccccctcctcaatcttcagaacaatgtcattcccgacgtaatgcgtgccaagaaacatctgacacgaaccaaaatttcagttttctctctgtaccaagattccaagtgcagagttcgttattaggaatagtaattgttttttttttttgcggggaggaatagtaattagttgtagggtgaactgattgatcttactgtcagagaggtcgggccgacatgggaggtgagctctcgcttgagagggccgccgctcttgaactcgttgctgggggtgatcacccagaatcccatggggttagggtgattgctgctaatccatccatgaactctgttgtccttgttgtccagcgagtactcgtacttgtcatccacctagtacatcacaaattcagaaaatcaccagatgcatacatcaaacagtcgattaaaagatgacagcctgattaatttggcgtgcaagatgtttcagaattcggttagttaattacctctcctctgaactgtggttccttgggatcaacgagcaggacagcctccttgtatgccaatggagcaccgcgaggtgcatctctgtctgtcgcactcggcataaacctctgtatatcgtctgagatcgccatgtagttgaacctgacaaaacgttcatgaacacatgttttcaagattagactgcagatcaagcaaatattgaatgtcttcagagaacaatttttgagaaggaatactcacttgtccgtgttcagtttgaaggcgaggcgagcctctgaaatgttgagagcaggccagtccctgacatgctcaaagatggcatagcagtagaatcctgagctacctttcagcatcacaagcctgcacaaattttagagcagcaatcgtaaaatggcagtgatatttgtatactaccactatatggcaggataaattatagccaaatttattaatataggtccgaaaattctaaaggagtacctcttgtcgatgtttagcctgacactatttggacgtgatggattgtaggtgctcctgaaggaaagctccacttgatcttcacttgaggatactaccttgaattcagtactatccagcctgtgaaaattcagtcatttagttcatcctttttgagagaaaagcataattcgttcagctgtagcccgtaataaggtgcagtgcatactattttacattactgtgaaattatgttttccagaaagaaaatcatttgagctcttgtacatatcctctgtttattaggcagtaatttctgacggtgtttaacaccgtttgcttatcagaaaagaactgaagtcacagttacaggttgctcttggtactattgctattaggaggcatctttcggtgcagagtgatgaactgcaaaggcttgctcatattttactcacaacaagagcttgtttgttatctggcctgaaggcaagttcttcaatccatatgaatatgggtggttcaaaagaaataatattgattacaattaacaggctggtagctatatgttcaagtggtgttaaatcgaactagtactgttatattgtggttattgggtaggttgatcttgttaattatgttatgagctgtaacagatcaaggcaataaaacaagaacactattaactacagcaagctaggcaagtacctgctcactggctggtagtgactttcagattatgtacctacttcagttgttcagttagaacgagagtattagtttatccaactttctaactgacatttattttgcacattccaagtagaaaagtggtataaattagaaataaattgagattgaacagtagtcagatcatatatacaaatgtggaataagaacacacgcaaagatgatgattttggatgactctaattaaagtagcatatggatgcatccttttcagtttagaacaaaaaatgaattgaggaccttaaacacaggaaagatcaaagcgcatgcatatataccaagcaaagtatagttagcaggcgatatataaatgacttaatttacaataaagttaagaagtaatgacgtacatatcgatcatgcctcttggattattggatccggggaaattccataccacatcccagtacctgcagacagaccaagatcaaattaattatatatggttagatgtaactggtatgtaacataaagatggcttttcatctatcaagggaatatcatctttttttttacatgtgtcatctaagataatcacaaaaaaaaattaaaaatatgataacatagattaatataaaatatatataatttcacaaatatgtaaggctaaattcaacttttacaagttgcaatagaaacaacaaatttaactgaaaatagttatcgtaccataataattatatttgttatttttttataacatgtagaagttgaatttgaactttttgagaaaaaaattaaaaaaagacaggcaggtatgtactaagtatgttttgagaaattgaaagaactgagtaattagttaaagagcaagaaaactatatatagtagttacaccgatggagagatggatggagtgtaatataccctgcggagttgggttgtccgtcgaagcggagcaggttgcgttcgccgttgtatcggacgccggtgatgtggcccccaggttttgacagcgacacctgcacgatgccattgtccaccatcacctgcatgcatgcagatgcagtatatatcagtcagcttaattaaacaacgtacgcgtaattcggtcgaaacgcatggatgatctgatcgatagctaatactaactgcagatcgctaatataattaagcacatacgcgtatagttaattacctggcggtggtcgaggtgcaaggtaacgccgccgccgccggggcgaggtcccttctccggcacggccgcgtgctgcggcgttagtgacgacgccgacgacgctgcgacggcgacggcgacgagcaggagcagcaacggcagcttcgtgcaggccgccgccgccgccatcatggacgatcgatatatggaagtagagctagctagttggacaagtgacgactaaagcgcatgatcaatcgatcgatggatatatgcgtgtgcaaaacgcgctctatctatatatatatctatcgatcgatcggctaacttatatagtagttcttgcttccatttatcgatcgatattgaagcatgggcggctgggatttagtatcaagtgttggttacggcgccggaaagacgaactttaaaagaatgggaaataatgatggatgatgagtttggttgttctagccgtgcaagtgcggtgcgtcgtcgtcacaattcttgcctttagctcgatctcttcgcagttttgtttgttacaccaagccgttatcttgcttttgctctgcctctgatcatcgacgatgcagacactactacgcagttggatgcaggtctggcctccttaattatacgtagcagcagctaacaaatatttaatacagaaggaaattgttggtctgtgcaatttgccttcgattatattagtcgtcgttgtcatcaagtatacatgtaagtacgtgcttgactcgatcgaatcaaattaaaccacattgtgtttcagcttaaaattgctacgtacggagtagttgcagtgggattaggtacatatttaggtaaggttcgtaccgtactccactccactaatcgtcctgaaaatttctcccaaaaaaaaggactggtaatcgtcagcataagcatgcaatgcatgcagccggccgctagctacacgggctgggccttagtgggctaatgggcctagcccaaatcaaacaacggaaggactaccgctgcaagcaggctttgcctttaccggctttaaactagttaggcagtttgggctgccccaaataaaaaatactggctaactatcttacccttatacggaattgctaaccttgtcgactcgatagaaaacacatctccaaatcttacagatttttctccaaatattacagattttggaccactggataagctttatgattcgtgctccaggcattctcctccaacttcggcgacctcctctttttctccggcgtcggcaataccctaggctccggcagaggaccctacgggttagggtcccgagttggggtggtggtaggaggggtgggagagggagggggaagagggtggagttcgccagctttagagggatggtcgtgggaggcaacagtccggcggtgggcggcgaaggcggcggcggcgccgctaaagctgcggggtcggaagctggcggtgggggcaaagcggaaaggtagataggaggcggtcagtggtggcgccccaccttcggagacgaggaagacgacagcgccgccatcggcttgaggaaagaaaaggaaagggaggggaaggagagggggaaggggaggggagggggctggccgggtggcctcaccggtgccattgacgcccttcggccagtcggcgagacgggcggcggcacagtggggcgctggcggcggtggatcgagcagtggcgagatggaacacgcgagggtagcggcggcggcggaatgcgcgaagaggaggggaatgggaggaaaaagttagagttaaagctgtgcatgaatcctaaagcatattcaacggtccagaatttgaaagatgagaggtgggattttctgttaacagatgtatagacagtctcatatttataacatcacaatttctgtcacatcttctttatagagagagagagagagagttgtttttacactataaattatacgtatacatttacattgtaattgcattgtaaagtttaaaagttgccatattattataatatttatagtactcactagcataacataagagaattaagagataaaaacgattatttacctacttggaagaagaaaagatatactccaatgataggaaaatatataattatatatttatataagacagatgtagtaatcatatatatactcactccttccaaaaatctgagtcctatttacagtcactatatgctaaattaaattgttaatcagaaaacaagaagccattctagtacttattggttgaatgttcattggttttgccacatggtgagtgagttaattgctttttggttttgatgaaaaaagaaataggtctcagttttttggaaggagtgagtaataaaaatattgattgaataactgtaaaattaaagtacggatcagtagcactttttttgtacattgatgcaaatgcagagacgatcgactacaccgaacgatcgactacaccgaacgatcgatgcactgtgttttgtttgcatccatgggaccatggctgatacatggcgccatggcccagctgcatgctgctagcagactagcagtaggatgcccttatattggagtactagctagtagctagttctatcatggagatgggggcaatgcaatgttcacgtctccaatcttgtcgattaatgattaatcgttgcctcctgcaggttacttacgaccttgcattgcatgctcacgtttattactatgcacatgcataatccattatttccatcggtctccctacctgttcattcacgtttgtggctagctaggcagtatgatttatatatgctcaaatctgtatctactatctctgtttatcctgcaagctagtttcagtcaaaatcaaacgtattacctccgttctaaattagatgtcgttttgattttttttccttaaaatgtttgaccaatttgaccattcgatcatccatgttatgtaaaaaattagtgtaaataaaaaaataaatcatacttaaaatatttttaataatgaagcaagtaaaaaaataaataataatatcataatttttttaaataattacaaacagcgactcaaaagagtaagtacgacttttgcggcatgatctctctctttccggccggccggacagatagattaattagaatagatcagcatgcgtatgcatgtacttgctgcaggtcaattttccggtgtagtactgtagaatggatatccgcatctctgtactgcccagaagggaattaagcaagacagagatcacctaataataagatatcctaatatatatattctgtttgtgcatgcaactcgtgtgattttgaaaattgatatacatgcatgtatgctaatttgtttagtaggacgaagacgtactcgattatgttaaatgaatttttttagcagaaggcatttccattaaagaaatgtagctcgattatgacatgatcaacgactaatggtgattggttagctggctgaaccccagccgatcggctttatccagagcagctaaactagctaggagcgtcgacggccatgcagacacaaagcatcattgtactgtataaaaaaaaatcttcatccattttatattacaagacatttcgttcatatttatttgaatttaatcaaatttgtaaaaaataaaacactaatacgaaaactatttttcatggccgccattttgggttttcgctgacggaattcctagccgccacgaagcaaaggccagtgaaaatcaagatcttcgctagcggttatcgaccgccagcaataatttatttttgctggcggtcgtcttaagctcgccacaagacggtcgccagcgaaaatgttttttcactggcgggtttcactgtgccagccgctagtgaaaatgctggccaatttttttttaaaaaaagcgacggacggagctctatccgcctccgtcaatgctccaccattcaaaattttcacagaaatttaaccacgcattcaaaaatcaacagaaaattacatcaacaatttacattaaaaaatttccattcacccaagcattcaagcatcagaaaaaaaatttgaagtcgtcgcggcgctgcccccgtcggcgtcagcggcagatctggcctcccaggtcgtcgcggcggcggatccggcctcccaggtcgtcggcggcggcggatccggcctccccgacatcgcggcgaccggattcggccgtcccctagctagcggcagcccacggcggtggtggcgacggcagctagcggcagcggaggagggagagggagaaggagagcccaccgccggacccgtcgcccaccaccgcagccggcccccgtcccttccccgccgctatcgttgccctttgccgcagccagccgccgccccttccccgccgctgctgttgccccagatctggcaagagggcgcagccggccgccgctggggagaggtgggagggagaaggggagcttgctgccggactcgtcgcccgccaccgcagccggttgccatcccttccccgccgctgccgccacccccatatctggcaagagggcgcagccggccgctgctagggagaggtgggagggagaaggagagctcttcgccggactcatcgcctgccaccgtagccggccgacccttccccgccgctaccgtcgccctttgccgcagccagccgccgccccttccccgccactgccgtcgcccccatatctggcgagagggcgcagccggccgcaacctttctccgtttgccacaaccggccgccgctggggagaggtgggagggagaaggctaggagggagaaaggagggagtggaggaaggaggaaggagacgtgggtggtggaggaaggaggaaggagacatgggtgggtgggggagccgaggagaccgaggagacgtgggtgggtgggtgatttttaatagtgatgcgttgggcaggcggtggatttttagtagcgctgaaacatatttttttgtagcggtgctcttcacggtccgccacctaaaatcggattttccgtggcggacacttaagaggtccgcaacgaaaaatagagtttcttttatggcgaaccttttagcgtggccgccaatgaaaattggttttcgctagcggtccgtaactcccctcccctcgttatatttttgctgctggtttttgcgtatggccgccagcgaaaattatatggtaacgccatgaaaaatcgtttttctagtagtgataataatatttttaacacaaaacaaatatactatatacttcctctgttttatattataaaattttctagcattattcacattcatatatatatgttaatgaatctagatatatatattaagattatattgatgtaggtaatgctagaaaattttataatatgtaactgatggagtatttattaaagtgttttataaatatgtgatatgaaacggaaagggtgtatatattaattcgctcaagtcacattcgtaccttagcgtaccgcctaccgcttacgtttccgcgctgctggaagatagggagtgtatagtcttggacaataattgagaaactaaccgagaacagattagtagctaagctaggattagaattgatttgcaaatccctttattaataaactggggcctccgaccacaataatgcaaatgacagatggccggccacataatcggatcacacctagctttgcatgattggatcgtacctacgtacgtacatcggtcaaagatctgatcgatccaccgatcgatggataccctatcccccaccctcaatcgaaattcgtacgtacaaactagctcgcgtctcgcgacgtcgtgcataccctatccagatacgcatcgactgatgttgcaaatactaagcgcaaggtcaataagaagaaactataatcttcgatatatgtccatatcagctaaaataaactagcttatcatataaatatcatgttttctgtcttttaatgcacgtacgataccgttgatttttgacacaagttaacaattcgtcttatttaaattgtttacgtagttatcgtttattgactctggtgttgggcacaattacaaaggtgtgacgaagacggagaggtcctaaaagttgcatgccgcaagcttgagtcgacggttatgcagttttttgccaattatgagtggagattcacaaatagacttcaataatatattcaccttattatttattggttcatttttatctttccgtgatgtttgctttcttttttgaactacactcgatgtggagtgctagattgtaataatagattgtagctctcttaagcaaagaccgggatgttatatttcattatctaaaaaaaagttttgttgtgagttattttatcactgaaagtattttgagtataatttatatcatgcattttgcacaaaatttttgaataaaatgaatagtcaaacgtgtataaaaattaacactatcatctattaaaaaacaaaatagaggaagcactaactagcgtcatctagcatctcatctcacttgcacttaggcttgtggccatttctttaggctatgcctaacactccaaggtagagcatggtttcaccaattcacattggtgccgagctactatgagggagagagagagagtagaaaaagagtgtggcttgcaaaggggctatgtagcctataaggacatggtgatttgagagagaaaagtagtggtccccaaccactgccattgttgctccatacaccacatcatccgctcgaattaatattggcattcaatgtgcggtcatcggcccacaatgtctggatttgcactcatcaacgacgaagtagaacaagggttgcttcgatctgtgctagctctatccatcacagaggtcgatactgtcgcccgatctgctaaggttgagcaagtcaccgccatcgagcttctctcgtcccaccgagctcccctcccaatccgaggatgagaggatgctagtggtgatcagtgggaggagaggacgatgctagcatgggggaggacggtgtacatggcaatggttgggtgccgacgcatagaggagagagagagtgagtgatgcagatagaataggagtgggagatagattttatatacttttaaattttaggaagccacaaaaaattggactttcacaaaggtaagaaaatgaggactaaataaaaaactatcagaggtaaaataaaaaaaaatagaagttacctataaggctactttgtattgtggaaaaaacccagactttagcctaggtgacctttgggatcactcattgaagctttaggttgtatcgctaatcgcagcttgtatgtttttcttttcgtttggagctcgtgtattgctgatgactaaataggtagctgtgctccaaccaattttttcctatctccatctctactgacgttaacttcggctttttcaaaatagtcattcatcatagatgattacaacctctaataacataatgcacatgtagaaaagataaacaactttgtaagttcattcttttatgataaactatcgataccggtcttctataacttccttaaatatgaaacatagattctaacaatgcaacgtagttgattctcatgaggatccaatattttattttcaggagaaagtctctctaatccccactgagaggatgtttggttgatgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 43198 - DNA, 17008 bp, Oryza sativa
  unsure (1)..(17008): unsure at all n locations
aaattgtatatgtgattaaaatagataatgttatgggatatgcatatcaaggaaaatagactaacatgatccaactaaatttactgagcagaaatttgatcaaaggtcaattcagaaaactgcaacctcaaaatgtgcattactttgccaatataaaaaaaactagaaaaatataccaccaccattccattagaccattactaaataacatgaaaaatttacaagatataagtaagacacacaattatatagaactttatatacattacggtgatcctaggaaatgaagacttctagaattagtatagtcctagcaataacataccactaagggactccatattataaatattctcccttggtacattattattttattaacttctagctaaatcaactgaaaggaggctctcgactattgattccattgttggccttttcttcctatcttcttccaagcaggacacagccaactttaccaaagtttttgcttgcaagtagttgaattcatcacccactctgaaatctacgaactctgctaaccacaatgatttctcattgtccaatctataacaaatcatcttaataaacttcttgagcatctcatgcaccttcgtcttatcctctcctatgatcagatcaaagactcgttttcctgacactagctcaagaagaacgactccataactatatacatcaacctttgctgttattggtaaaccagatatccattctggagcaatgtaacctatggtccctcgtgctcgtgaaacattctgcttagagccagatctactaagcagctgtgccaacccaaagtcagcgatcttaggttctaagttctcatccacaaaatgttctctggctttaggttgcagtgaatgacccactctaggcactcatggtgaaataagccagtccctttgcaacgcctaaagcaatattaaacctttgcttccaatctaacaagattttactgttgaacagtacattagccaatgatccattctcaacatactctaagaccagcaacctatggaatctttctgagcaaaaacaataaattcttactaggttcatatggttgattcttgaaataacatgcaactcatcctgaaactcctccctatttcgcgtgacattttccaacttttttatgaccactgctcgatcgtcatccaatattcccttatagacgactcctgaacctccccatccaagctcatgtttaaacctttcagttgccttaaccagctctctataactatacattcgaaaatgactagtcatcaccctgtagccttcctcagctgcccatacttcagatgaccacatctccttcctcaagacaaggaaccatgcaaatgcgaagaagaaaacctcaacaatgaaaaacacaccgataaacccatagaagtagaaccattttggttcctccccaccaatcttattcatgttacgaactgcctctgtggttattgtgtttacacgatcacagtcaagtctacttggtgtataatcatgtatactagactgtggaatgggttttttagaaacatccaaacttgaaggaagtttgatatacatcgttcgcacaaaaggtgtcgggaaagtccttccattaaagagaaaagattttggatagcatgtaccatttccttcttggtactgaaattccttacatgtgcaatcacttatgcaagtgttccaacacacctcccagggtaccttttcaatatgttgttgatcagaaccccaaaaatcagtgtttcgaagttgcaaaaatgttacattctgtttaccatcgcatgcaatttcgacaataggcttgcaaccttgtgtccagttacccggattcctcatcttataaccaggtgggcatgaacatcttggtgtaggtgaatagtggcagattccatatggaccacacaaaccatgagtcatgcatgtttgaggttgagcaatccatgaaattgtccatgttccatctgagttattcaagctatagagtctaagattaccatcataatccaaggtaagcctccttttaatccccaaacttctatcagaggcaacacgggcttgatgcttagcaagatcactcgaaaaaaattctccataatcatcaagactacctatccttgtactgttataaaggttcctattattctcatagtacaggtaatcaggatctggccagtatacaccggaaacattagcgtcatcatatataagtgacaatatctactgatcgctgaaacggaaggaatagtgaccaggaacctgtaacccagtggtagagactaactttgttgtagcgagaatgcgttgagtaggaagcaaagtgtctgtcggtgaatcgaaactttgccaaacaatgttttcactggagtttttcaagacaaggttaccagtgttcaataattgaacatatcgaacattagggaatttaccgtcagtttgccacacgactgtgccgtcatagtcagtgaggactatgtttccatccttgcgcagagtgatctctgatctccttgagtgcacgggacggccacggtttgcgctccatacgatggccttgtcagctgaattggagtaccaaattgagaaggtgaaggcgctagtgatgttgtaggctttagtgatgttgtagaagccacatgagaatgtgccatcagatgactgcaggatgttggtttcatactcttcaacaaatagagaggatttcagtggtagaatatcatgagttgcagcactccatggtagagcaagcaaaaagaggatggccagaacagcaagggaagtagtaagaaatggagcatccattgttgcagtcttggagagatggtctgagctttagagtttggatgagcatagcctgactactagtttgttgcatgataaagaactggtctttagtcataatttcacagtgcaactggtgtgacattttggaatacttatctgccgattttgaatttttaaaaattgttatgctgcagaggagcacttctaattggacttttctatgagaaatgacatttgccttgaatatattgccaaaacaagtgtccgtagtatttgcccaagaaacattcggcagtgcttgaaacaattgatcaatcggtaggtccctcatgcatatagttacagccgaatgacgtttcttcaggatgactcttatctcttcatttgacttgctggaatggtcaaggaaatagatggatcaaagtcagggaagtcgctgttgaacagggacatgaacttgagagttctgaacttctgatgccacatcactgtccagagaactatcccaatcatctctcatcttgggctatgcttctgtggatgcttcaggtccaggtccaggtccgtccatacggggacaaacaatactacgattatattatagcttggaacaaacactgtaacttagtgtgatgcaagttatggaaagtaagtccaaagtccaggtgactcttggtaaggatgcatgtagaaatatggatgctagaaaagtgattcacttctgaagaatcatagtatcatattccaaacaactgcattataactattactaaaatattattcattggtcaacaaatttatagacaacacagctaaatagagatttatgtatggaagaaattgttgcactccttatcaacagcacctttcattcagcaagttttcaattgatttgaggatgatgataattgggtgcaatagcttctgacctctgttggctgctgtcgtctcttctatattccagttagcttgacaggtcttgcactatgcacagctcctgttcttaaaaaaattccacttaagaaatgataagtgtttttattgttgggggaaggattgcgatcttgcgccattcactccctggtggctccggaggagatagggcctccgcccggaggcccgccgccagcaccctgcggagcccgtctccgtagggaggacccattccgatggcctaggaagccggccgagcccgaagagggcagttggctccgggaagtttgaagctaaccggaaggcccggaggatcccggagcccagccatgggccaccggaggccccggcgccggttcgggggccccagaggcccatgagccagctcaagggctccagagctcttgacatggctccgaggccagagcctagggaagacaccaggaacgagtatggggcgccataaaagcgcattactcatcctccaaccaccaccgacgtcatggcacgactggcgatgtgaaggccgatgctagtctttacccgaagcccgctattacccgggtaaaggctagcatcatgatggcgccataccgccccccttaatgggcgccgttgtctccctgtccggcgaatggactcccagaccgttggcaggcccacttgtcagccacctcagggtagctacagagataggggtagggttgtaatttcctttgcatgtaatctagtataaatatgtaaatgttaccctctgaagggggatcgagagcaatacactagttgaacactcgtgagttctgtttcaacatttatgatagaccagttcaaagcatcaatgactgcccttaaatcttcattggacctatctcttcagtgaaaataaatcagtggagtaccgtaaaaataatagtagatctgtcgaacaggaaccaaggttgacaactgattctgctcaagcgcatcttcctttgttagctgctaagcaccgtgatgcatccattcttccctgggtgcagagtaggccctcaggacagctgactttcttagcttgcacatcagtacattcctcaaccgatgatgctccaccaccgacgtctcaagttcataccattatcaacattgtactcccataagcccataaacaatgtcagagattaaaatagctaattctttgataaatgtcactttgagcttccgacaaggcatccggaatctgtctgccacatgtgattctatgacacattactgctttcttgattgtgctcctcaactaactgaattggaccatccgtttcatcaatcccatggcatcctgacaaaataagatctagcattttccttcttacattgtagacagggttaggatcaaccaagcatcccttactgtaactctctctaaggaggacagtttgtgtgcttcctttggttgagatgtagaaaatgccagggtgcttaagaataagttccctcaggtttacctccatatcaaaaggtcttctgaaatgggagaacctctcaagtggtatcatcttttccactgtcaagcttaaaagttcgtgaagaatgccaacaatatgtttctcgagctgctcaacattatggattggatgcaattcattattctcataagccttggtgtagggaagcctctgccagttaccaagcttttccctaaaacctttctcaatcttaaagccggttggaaagtttataggaaaagaatattttgtctcagattcagctaaccatttttctgtatattccttcactctccattcttcaacatcggctacagctaaattttcatccctagtgacaaatgtcagagtatcgggggaacctagagaaaactctgaccgatggtttggtagtatagagcacctttagtcattgggcaacccaagttctcttcttatgagccacagtgcatgcatattcagagttccatctgtcgacagcatgaggagtttcttcagccgtttaacaatagcaggctcattttcccagatggcagcatcttcttctgcaatcaaatcagccatctttggagtgaccttacagcattggttattctttattgggtgcacataaatgtcgaagatgtggggatatttcttaaggaaagccccaatctcaatgtttagcccgacttcatgtctccacctggagaggagttggagagatgcgtagccattcctctgctgagatatgaactcatgcaaatccaaagctagcctcaggttcttcagttgaatcatcagcttgtccagtttatgatcccttattctgccctccagacgagttcttgctgaatcaattggctttttccacctcctctgtgtgctacaattacaaggaccatgctgaaacacctcatccaatatgtgcctcctcaggggaaagacacacacattcctttgaccaaacactacagatgccattcagttttatattcagatccggaccttacttagagcacagaaaacaccatcagcatgcaaaaatggatatgtgaatcaatgtcgacttatcaatctgcaacaaacgaattcgaaggattcttatgtgtaatataccaaaaagatgaactaactttaacttgtcatctatagaactacaaccaaatatggaagactaattattttcttttattattgttccacaaggttgtgcaaaatagcaaaggaacgcaggatgctcatcagttttggaacaagaaagtgacagaaccaggagtcgaaatcttgggctttggcgggagccaaacgactagcagagatgttgccgtagttccgatcgtcttttctgtaaatcccattactccttacttgtaaatattgttcccttctatattcaatgaattcaaaaaaaaaaggtgacagaaccttaaccttggtaggcatttcatcgaacagcttgtgctcgaggtggaggaagcaaactataccgggtgttaggtcgtcgaatgctcatgcacaataatgtcaggtgatgccgacgagagcaacggcgacgagagggatcgacgactccccgctttcccctggctggcgcttctgattggcttctagctagagttggggaaactggaaaaggagagcgtattggggaggttctcctgtctgccgctgattcgcctcggctctgccgtcggccagtccgccatggcgggttcgccggagctcggtaaccccgtcgtggagaagagaatgggaggaagcgatggcggcagcaaccagcaaccgcgcgagttgggggagcggggagccgacgccacgggttcaacacttcttccttgtctctcgatggataagaaacgttgaaaactgtttcattcgaggaaatattcctcatttctcacataccactatagttatttaatttttttaaaaaaaatacttgtctatatgtatgcacaatacatagctattgctagctatggaccattacttggtgtacgtcagagaaaagaaattaaaattatacattgtttttggctttttcagttatatacatactcttgaaaaaaatagaaaaatatatacacgtaccgttacgtgtgaacgtacgaccaattatttggcgtggcgcgaaggtgccggaccgatggttgggacaatcccgcgccgtggcacgtggtagccgattgggaagattgacctagccgtttgtcccctactgcgccaaacaattagtcacacgtcctcgtaccacggtatgtgtatattttcataattctttcataaacatatatataactgcaaaaactctaaaaataatgtatattttttacttcttttgtcgctgtgtaatgaacatcttcccaaaacaacacttgatttttcattagtttttcaaacactaccccacattcatgaattattcattcatgttacataatgaaagagagatgaggtagttaattaattattactaattgtgatcacagtcgtatccaccagggccaccgaaggcgacattgatgccggggcggtagaggtcggggccatcgtccttgacgtcgtagcacttggggtgggtgacgatggtgttgacggggtcgtcgacctggtcggcgccggtgtaggcgatggcgaggtaggcatggatgcaggctgcgttctggaggccatcggaggggtacatgccgctgcccatcggggtgagcgtgtgccgccctcccggcctcctgtccagcacatgccctcccatctcgttgtggaagctctcgatgaagggccgccgcgaacgcgctctcgtggaagtagccgatcggctcatccatcagcgacacccaccacaccgccggcccatcatcctgcataatccactcatatataattaatcaatttaatttctgaatactaaaacaagttctgttgataaaacaaaattaatggtcctgcgatacggattgagaagcctcctagctatccctttcccaatatatagcatagattactcatgctagctctatgtcttcctacacaagtgttagtcatttgtgatttctatggttgattttattgaataaaatgtgtggagcatgtaatttattgttatgtttgctggttgaaaattgagatgtgatttctaaattgtgatttttgggattatatatatagacttacagtttaacaagataatatcacatgtgtttcatatggagataagcatcaaagtatataattatttaggacattataatatgacaaataattttcttataaagaaaattttattcaaaatgcattaaggtatattgtcaaatatcgtcgtagcgttagcatggatatattaattactagtatataattaatcaatctccttttattacatatatgtatcccataatcattgcaataaatatatacgtgccgcgtaccattctcttcttcatccttaatatataagtatatttctagatacttaaaaaaagtatttctaactagctagcagctgagtgatgtttatacacaatgcaacaagataatattatatactccctatgtattttaatgtatgacgctgttgaatttttaaacaacgtttaaccatttgtcttattccaaatttttgtacaaatataaaaatatttatgtcatgcttaaagagcatttaatgataaatcaggttataataaaataaatgataattacataatttttaaataaaataaataattaaacgataaaaaaagtcaatgatgtcatacattaaagaaagaaagtatgttttaggacagaggacgtacgcaccctgtatatattacggcgtgggtgaagtaggtggttccaccaaccgtggaaaacttgtcgtatttagcaccaatggcgtgctttttgctggtctggacgaaagaacactcaaggttgaagcactttaatttcacgccaccatcgttctgcatatatagtatatcccatgcatcaattacaccagtgagtagctatagagcactgtagactgtgctgtacataccagctgacatcaccaactttaactagcatgcacctaattaatttgtgtcatcttcttaaagaaaaaaaaatgagttttaagaaaattagctagctgttttaaatctagctagtgctctatctaactatcttaccactatatatgcaggtaagaggagtagaggactcctactgatcctgaaagttgattatccatcatgtgcaatattgaataaaagaattatgtgatccttctattaatacatcacaggaaagtagtagtagtagtagtagtagtagtaataataataataataataataataataataataataataataataataataataataataataataataataattatcgtactaagaattaggagattcataggggcctacatgtcaagaaacaactgaatatttatttttggtatttaattcaaacattcaattttctgtgaaatatattcaaattaaataaaagtgaccaaataatttttgtacttctaatgaaaacagtatgtatgcaattcgttacaaggtactccctctgtttcacaatgtaagttattctaacatttcccacattcatattgatgttaatgaatctagattcatcaacatcaatataatctagattcattaacatcaatatgaatgtggaaaatgctagaatgacttatattgtggaacggaggaagtaggagagacactttacagtggagtatatgtagagccgaggaagatcgtcaccaacaaattgagggtaaacctgcatacaaattaatgtaacatacgttggtatatacgtgacacatatggtatacatacatataaaagtgataactggccggtaacatacacatactccctccgtcccaaaaaaaacccaatcctgggtttgaatctggacatacggattgggttttttttcggacggagggagtacaaaaataaatatatagaaatggtaactggcatgtacggcgatttcgagagcaatttggttgtcaatgttgggtggatctttgcttgggattggcgtaaattccctgactgttggactggcgatggcgaggtagctcttggagaatttagagggtcccaccccaactttccatataggaagccacgccgatgcaccgtgatatggcccattcactccatatgccgctgcaatctgcgcacacatcatactaaatccatcaccatatgtttaatttgacgattaaactaatgtaatcactagtgctatactcctttcgtaaaaaagaaaaatcaacctagaagaagatttgatctttcctaatacaataaatctggactacctttatccaaattcatgatcctagaaggggtcggattgagttttttttttctaatggagggagtatagtagtattattacttacttctagattacttctagaaggggtccgccccttccccgtcgggattcgtcgccggaattcgcatcccctcgcgctccggtgagttctacctctaccgccgccttcggccatggatgccggccgccgtggttcatctccctctctctaatctctctctcctccttccttagggcaccccgaagcccgtccgccagttgccgtcgtcctcccgtggctcgccgtcgccgttcgccgtcgtcttcctccgcaccgaccaccctcggtgaggcgtcctctcccctttactcccctccctctccctcctagtgccgcgccgccgcttcaagtcatgcgccgtcgccttcggccgccgccgccgcctcccgtgccgccggtcgccgtcgccgtcggccgcgtgtcgtcgccgctagccttggccgtccggccggctttgatgccgagccgagcccggcggccacctctatcgccaccgcccgatcggctcggggccgatctgggccgtcagtcccgtggaccggcggtggatcacccgcgtggtcccggtccacggtggaccgacagccttgggccgctgacccgggggccccacttgccggcgcccctctcccccctttgagccgctgaccagtgggccccgcccgtcggcgccacccccccttgatgacgtcagccctagaaattattgcgcaataaattatttaaggactttttgttatagtaataaacacagtgaatcttctaaaattcataactaattcatccgagctccgtttaagcccattcaagtctcagtaaatcaagaaaaatgtgtagaatccattaaaaatggttttgttctctgtttcagtagtattatagcctgtttgcattgtttgctttgtatgtcgcttagattccggttcttccgacgctccggtgtacttcgaaatagtcgccgaggttcctccagcagcagagcaaggcaagtcatgcttgtcacttgaacatgttgatcctatattgcaaatgctctactttttttcttcaaatactgcatcgttttataatgttattatgggatgtttacctattgttacagctatgctattttggtaccttgctcctttgttagcttgggttataacatgaatagacgttggactaggagttgcttagccatgcttagttcaactagtacacaatggggaaaatcctattaatgtttagactgttggttctaatggtattgttggattagtgccaccgctttggtgttggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagctgacgcatccaggcaagggtgggcgtgatggagcggggcgggccctgcgacggcctctgtcgcttccggattcacctaggcacgagaggggactgcccgctgccttgcgaggagtgggggtgaaacctgaggtgtggtgtgcttggttagagggggttatgcgaagggtcctgtcacggcctcttttcggtatgtcgtggtggcatgtcggcgcacggaaacgtgtcgtggggctgtgtcttgtgggtacagttgtacacctctgatcagagtaaaactattcgaatagccatgcccacggttatgggtggtcaaccagattcaccgtgattagtctcaccctagtttagtctattgaaattggatagtataggtggatggttgggcctgtcgcaccatggtatagcgttggacagtggatgattaatattgattaattattacgactgttttcttctttaaacttctgtttataaatgctcgctttatgcaaatgaaccactctagctctcctttgataattccctgcatcatacccctattccggtatgacttgctgagtacagtgggtagtactcagtcttgctctatttttcccaaccccagagtacgagtatgtgtcagatggaggtttctccgaggagtaggctttgtccgtgccgtcgaggatgcctgtggagtggtgttcccgctgcagttctagtcaaggcttagctcctgttgtctttcgtttttccgctgcatttatgtaagacttttatgatgtttgtaagacgtggatctgaatgtcaacattgttgtttatgtaccccggccggtcctggacagggattttaatgcacattctgcttagaattctattcgggaatttctgggcgtgacacgttgccactaatccgcctggcctccacgctggccttctccaccgtcgccgccatcaccggatcgtgacgatggtgccgcgcctctccgccaccgttccggcccctcacaccaccacctccgctccagcgcgcacacccccgcccgtcgccgccatcgccacgcccgacccctctcttcctctcgcatgcaacgccggcccccaggaaggagagggagaggggggcgccaccgtcgccgccaccactccacccggccttcgcgctggtcttctccaccgccgccgctatcactggatcttgatgagaagagaaggagggacggccgcagtccactgctaccgacgcgcacgcgccccccagcgccgcccaagcagtcgccccatcggtcaatgaaaaaaagagcccacatgtcggtcctaatctgactcagctcacgatggcccactgtcagctatctatttctcaccatactcagttgagtcagtagtgttgacaacggtcaaggtgccacgtcatcggataccgcccacaatactgccttaggagtcaatttgtaccggttttactaattgggggagtcgtcttacccggttttctagttaagggtcacgaattagattcggtgaacaattaagggaatcgaggtggactttttcctatttttggcccagaactccaattccatcacatacaatatcggcccagtatgcttgtgggcttccggcccaagtcgccttgggctgtagcctgcgggcactcaggtctctgggggagtcaagggtttaacccgccgtcctgcgacgcggagcaccggccgccgctcgccgacgcaagacaacgacgatgcccagcttccctccgcccggcgccgtcaccatctgcgagatcaaccgcgacctaggtgtgctatctccactccctgctccccctctctctgctgtctccaagctcattccaagtctgtttgttgcagttgcggcggatgcggtgtccgacgatggagccaaggatgcctacggggatgtcctcgtcagtacactcccatcttcccccttcctcctccgcctcgcataatttcgtctttcttttttcattcacaagactaattttattattaggcctctaattgaaacttcaatttggggtttccagggaaatggtcttcagcccgattcctttccagtcggatgctcttgttgccacccacgagcctcctgctatcactgaagctgctgagccttctgagattgtccccagaacaagtttagcttccaccatagctgagtccttcaaacaaatgctcttcccttcgtgcgatgtgagttggttctttatcatatcttagtgactcaattatttgccactcttacgaataatatgtcttcatttgcaaacagaaaaattattaaagaatattaaagaatccttcaaacaaatattaaagaatcctacattctaacaagtgaccgacaaaacgatgttaaagctgttgaatggaggccaaatagtgaaaagatgattgcagttggctgcaagtactactgccaacttaagatgtctgcatgttcttttcatgtaataataatacctggtggcataatctgctgttacattgggttgatttttttactttgaggggtggtcagcgtcatcctggcaatgttgcatctgtgaaatctagtgtcaccttttggtcaatggatgcttgtggttgtggacattcatcatggttcttctgatggaactggtaggaaaggattttataccttgtagatatacaaaatgcatacttgctttaaccaattatagacatgttttcactgatatgataatttcagtaaatgaagtgcaattaccgagacatacccataaacatagggtaatgaaatgaacacttaaaggcacacaagggacgaaacataagtcagggatatagaagggattaagtgaaaacttagtgaaaaaaaactctcttttaaatattggtacccctgaaaacagataactggtttttatcagacaaaatgtcggtccgaaattttgaatttcgaaatcacagtaacctgccagaaatttggcataagaaaagggaaaaaaattcaagatccaacatatatagcattattgaattcatcacaaatagaacataatgattatgatgcaatagtccataaagacatgcatcacagaagtatacatacaacatatcaatagttccaccacaagtgtggcaattgatataattatagaactgaatgcgaatatttcattttcctttagaaatataacaacaaataaccatgaaagataagaagttggcatacttccaaagttgaatttaaattgttctgttcagtatgccaatgttggttcatcggctttggagcggtaaccaattgcttacagccaggatttttgaacactggttgaatcatgactgctctttgtgcatattcaatgctgcattatttaattttgtcttctaacatacttgctccatttttctgtatcttcctcaaagacttatatgttgtgtctaatttccataccctccaagataagtcctttcttccagttgagctggatatgctccttgaggcggataacaaccactccagtgtcttctaggtcgttgtagaagtgccctagttgtacctccagccagccatcacctcgttctcttgggtagcttggctcctctgcttgtcctgcttcttcgattctacccatgttagaaagtgtctctcgtgtggatgggcgtgggcgtgggcgtgggcgtgggtagaaagagatggtccgcttggcagacactacttgatcgtccatggtgatgtctgcctcttgtgtctggcaatcaaggccgtacgaatcatctgtcaatttgaagacgaggtaggctgcatattctgtgttgggtgagagctctctgcagttgactctgccacataaatcgagccagcagacctttagaagctcagttacttcttcaaacctgaaacagggagaaaactttggtttctgcttaaattgataaaaagaaaatcaaatcaaaccgaatactagttattattatattgaatttaaagattatctgatggataatttctttgtagtttatttcttaatgcttttgtatattcgtccagactacgtacttctttgacaaacatttctaaaagatgtgcattgcatatgagggaatatatcccatgcacatgcacacaagtttcatgtgcacactccgtgcataccaactaacaaacgtcactaaaaatctagaaaaaaatgtccatatactttagcctagaaaacaaaaactctgacagttttaaaactacgagtttatatcattattgtctttttttctctatatgtaaaatgaatttgaagatgatgctttacatgtatgtataatactattgaaagtatttcaatatgtacaatttttttatagaatttttagtaatatttgttagttggtgtgcatgatatgtacacgtgaaggtttgtgtgcatgagatatgttacctatatatatatatatatacctatctttgcaaaagggaaacaaacaaatgagctaacgttaaatttatcttgtacattgctacagtaggttggaacgcgtacctggaatcgggtaaggagatccatctccatttcaggggatggtcttcccatgctatcggtaatgatctcgatgatagcaagtagcacttggctaggcttgttctttccaaccaaagactctgcgtgcaatgtataatgaatcgccttcattcagttaacattacgataacaaaagttggtaatactatattgaagaaattcatactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 43199 - DNA, 2092 bp, Oryza sativa
ctgtgtccaatgcacgtcttgcggaacttgctcctatcttgagacctattcagcacatggatggtttcaaccgatgacctgaaaatacaataatataaccaaagcaacaaagaattagatccaatatatattaggtaaagatgattagcaaagaaacccagatgaatttattaacctgctagtaaatttaggcagcttcgatagttggcaacggaaaggtcatgaggcaaaggcgagcgatgatgcccatcaagctgtgcgagatggcggatcgatgatgtcagcagcctcatttgcagaactggccggattcggaatggcggagccgtggaggcgatctaatcttctctgcctgaggtggagcggcacggtgccagcatcgaccgtcggggaaagagcaagtgcgcggaggcggcgatgtgatcgagcaccatgggaagaccttcctgctaagtagccgtgacgaaggcgggaggtgaaagcatagtcgctgtcaacgtaatgtagcagctccaagtcctctgtgttcagatgggagtcaggaatcaacaaggaagtactgctcaccattcaatggtaaaaaatggaccaaaaaatgaatcccatcttacccacatccaatgggaatatagtatctacaaatgggaatataatcatgagcataaagtttgattgttttattctgactttgtgtgttccaattcatactgcaagctgccgttatgtcatgcaataactcgcagcaaaactcttgctagaaggctggcaaataagcaatgacagaacctttctccagatgttcaatttcagacacatggtcccctttaaaaaaatttagaaacattggtgtccaaggatatagaattcatatagaagacgatgccaaattcagaaaaacaaatacagtggagaataaacccgcacccaacaattatccatctacctatccactaaaacaagtatatgatatttgctaccggctttcagtcaattacctcatctctcaaatgacatgctttgaactatccctcaactccagtgtattttgttaaaatcatgtgattcttcaattatatatcgagtgcaaaatttcagtatgcagcattctatttactaattggcattttttttatcgatctgtatattttattggcattaaaatttcatccattgagatatgaggtacataactgttcgtgaccatactgttcatcatcgtgagatgaacaaaagttcatcgtttgagagatgagatacataacggtatgaaattgatacaagaaaagattttcatgactcaccttggagagagcggagagcacaaacgattctgatggaccatgttggggatcgtgagtagaagaagaacgatggatgacgacctggcactgagttgcgaacgggtggcgtgattggacgatcggtgggggctctgtcaacgtgaccccgaattggcggtcaagaatcgatggtggtcgcgatggcaacggccgtgagaagatcggctattgcgtctaaagggaagagcaaaagaaccgcgggcgtggagagggagattgcggaaggggagatcggaggaaccgtgggtgtggagagggagatcacggaaggggagaggggaggaaccgcaggcgtggacggcgatgtggcaacacccgatctaggggaataacggcaaatcgcggggggcggcggcaatgtcgcaggggtgtcagcactggcaaggtgtgggtgtggatgggcgcgtcggtgatgcgggccagcaggagcggcgcagcgatagaggagcaagagcggctcagggggcggcgaaaggaggagaaggcgcagcggcggttctgggtgacttttttttttttttggcgaggagagggattgagaagcgctaattgcagggttaatccggcgctaattgtaatcgcggtattaattgcacctaacaactcgtgctttttatattagtctataaatcaacggcaattttctaatttttcattaactagtaagggaacccgcgtattgcgcgggcatgtatttcaggatgcgtttgaaaaatttagatgggcgaaatatcaacaggatgataactgcc

SEQ ID NO: 43200 - DNA, 1325 bp, Oryza sativa
  unsure (1)..(1325): unsure at all n locations
gatcggatcaagggttggtaacgccgaccatattgtccctctccggcatgcaagaattaaaggtggcaaccatagcacgcttctacgttgaaaaaactgcagtaatgaagcttctacctccaatgtttggaggccccagctatggctcagctcctaggctgatccaggtgtgttgctttctctttttatctctgagactctgacagtgtatttctgtggtaaggctgagttccatcaggtttgccaaagccaaaacctcgttgagggattgagccaaggcaaaatctggtgcagctttgctatgggcaatcaagtcatctttgacgacagatccagcaaggcatgcatggaggacttgattgcttttcttgtactagcctagagcccgtacgttgcaatggaaaataaattgagtttctagcttattaaatcaattaataaaacacttatttagtctaagtaataatatgatttttcttattgaacaagtaggtgattttgaaatttggagtgagtcaatagggaaatagggaagtactcgctaaaatgtggtgtaacactatagattgtgggacccacatgttagtggtaggagcggtgatgttaagtgtacagattttctatagtcgtttgctaaattcaggacttttatgtatgttctctgtacccaaaagggaaagagattctgtgacttaactgctgtgcagttgagtcactgacgtgtgggccatagcaaagtaggacccacatatcagtgactcaactgcatgtcagaggatctgcttccacccaaaaggggttgtcctgtaagattggctatacgagcccagtccttttaataaactagtaatcgtgcacgtgcaaggcaccttgggagagaacaacacttgcaaaagtctgttcacacacttaagttagaaatatttctagagcatgtttccacactgaatttaaatatatttcaagtgcatgttcagacaataacttggattttgtaagtacatatctactaagtccattatagaatcaaatagtttgtgtacattgtataataccagttcagtatgaacttgtatagatcagataatacatattgaggtaacactcacatgtatgaatttgtaaatactaatagctaagccccaaacattaagaagggaccgtataaatatatgcagactgtgagtttaggtgaaaaggaagaaaaaataaaatgtaatttccatgactgatataccaacaaaatctttgcgtatggatgaccatggnnnnnnnnnnnnnnnnnnnnnnnnnnnnnnnnnnnnnnnnnnnnnnnnnnnnnnnnn

SEQ ID NO: 43201 - DNA, 820 bp, Oryza sativa
  unsure (1)..(820): unsure at all n locations
nnnnnnnnnnnnnnnnnnnnnnnnnnnnnnnnnnnnnnnnnnnnnnnnnnnnnnnnnnnnnnnatgtttatttgtaatacgatcaaatcatttgaatagacagcttgttataatttcatataacatttaaattaggtagagtttcgttgttctctttgtttgtgagtcattaacgcgtgaaacctagtttgttggaaataaatcttgccgatctctaaagcactcttgcacacaaaatcaaaagagatagagcccgaaacctacatgaagaatatgctaatcagtaagtgaagaattggttatagtagcaatggaaagtgaactcatgtgtgtatcaatacagtccaggctccaaaacgtcaggaacggccagcacctatcaaattgctgttcaatcgggtagaaaagcaaacttcattcaagtcaatggaatgtaacctgatcgattcgatgagatggaaatatagacatactcccttcgtttcgttttatttgataccgttaactttttagtacatgtttgactgctcgtcttattaaaaatttcaaataattattaattcttttcctaacatttgattcattgttaaatatacttttatgcatacatataattttacatatttcacaaaagtttttgaataagacgaacggtaaaacatgtgctaaaaagttaacggtgtcaaataaaacgaaacggagggagtatttaatttacaccatagcatttctgatcccaaattaaccaccgaccacatggaggcggaggcaggcaggcacacatcaactcgatcattttgctcggcccaccgactgaccg

SEQ ID NO: 43202 - DNA, 5608 bp, Oryza sativa; identical to SEQ ID NO: 41048
  unsure (1)..(5608): unsure at all n locations

SEQ ID NO: 43203 - DNA, 3563 bp, Oryza sativa; identical to SEQ ID NO: 41049

SEQ ID NO: 43204 - DNA, 2135 bp, Oryza sativa
aaatagagttattttgtacttttctctaaataacaattaaaatatgtttattttttaatattattttcatataatatgttatccaaaatagtagctatacttaaaaaatagtctaataattgcctacagaatatgtagggttttcaatacaggagaatagataaagaaacaaaagctaggtaggtaggagatgaaaaaaaaatgatggatcatatccgaccccaagcgtccatcaatttagcattttctttacagttttttcaagagcaacttgttttttttatgaccgatgtttttttttcttgtgcggtattttcaaaccattttttagaaatggcgcgttttttcccttttttctatcagttttttcctcgcatgttttttttgcttttttttacaggcaatggaaatatttttttcccgcgctttttttatggacaacggaaaattttttcaatcgtgttttctttcgctcttttttcaaactttttctcacgcgtttttattttctcgcacattttttctgacttcctttttaaatagttagattatattagattagagatagagaagagatgataatgactattaaaacgaatagaaatcggatttttttttgccgcgccttttttccgccctttttactttttttttctcacctttttttttgccactttcttagggagtccgaccttttctattttttttattttttacgatttttttcttttctccttttataggaatcggatttttttattgctttctccaatttatggaaaatcagacctatgtttttcttttcctttttcaccacttctgttccccttttataggaatatgattttttttttatattttgccgttttaggaggaattggatctatagcgtgttttttttttggctttttcgccactttgggaatcggatatttttttcgctgtttttttattttgacggacgacggaaacactttttattttttaagtagtagaagagactagcgtaatgcctcccgttgcaacatgtcctaaataacattcatcaacataaataaaaatcctaaaccatatattacaactgagcataaataataaaggaaatataatcatagaaataacaacatgacactacaaataattttgaccggaattattaatataatgctaaagtccccttttattcatatagctataaataattcaatgcgaaggaaaaatataagtttcaataatttttattggatcaaatagtaaaacaaatactgtaaatagaaaaacaactgaaaactaaatttagctagaaattgaaaaaacttattttagcccatagatgaaatattaattttgaacgggtactcgtttctttgacatatattaaaattttccaattcaccaaacggtagcgaggaaagtgtccggatgtgttccacgatgtgactcgtccatagatagcggtggttggcaacaaagaaaaccaaaacaacagaaacgcgaccaacaacgatgtggtcctaacaggattagaaacgccaacaacgagctctagtggtgaacacggccgggtgagtgcgttaaaacacgttcgtgaatgaggtgattcctttttccttggacgtgctattgttggcatcgaagaaaactgaattaccaaaacaatgggaatgcgggagccaacgacatggtcccggtagagaaacagcaacttgacgagctctggtggtgaacacggacaggtgagtgtgtcaaaacgcgttccgagatgaggggattccgttttccttgaacacgctgcggttgacaacgatagcaagaacacgagtggcaatgaagtggtccccggaaaacaacaacaacgatctctgatagtgaacacggccagatgaatgtgtcaaaatgtgtttccgagtgaggggggttccgttttagttaacacgagggaggaacgaaagacaaacagaaatcaactaacaatattcatcatcttccctagcgctgaagccagtgtgcttcgggaggacgcactggcgagaagggatggagggtcgggagaagagtggcgcactgggaggagatagctgctagaagggagggggcgcacgggaggataggagtgctgggacaatggggcaaca

SEQ ID NO: 43205 - DNA, 1276 bp, Oryza sativa
agatattattcgagatataattgtctagctagcttactcgggagatgcaatggtgtgggtataatgttcatttatatgaatactcttgagtcacgacggtgattgtagagtagtatttggtagataagcgaggtgcataggctattgaatatcattatttgcgggtatatgctgtggatacgtcaagatgggccgttgatggtgacaactcagtacgggtattccaccgcgtgtgtatataatcctaagttactttcctggggagggtacttctccgtatttagccctggttggatgaccatgacgggttgtcgcaaggaactcggcaaccaggggtggtatctcgaaataccaggatggcatcgtaaggggtattggctatataatcatatagtactacctccgtcccaaatacttgtcgctttgattttgtttgtaacttttgatcattcgtcttattcaaaaaattatagaattattatttattttatttatgactttctttattatcaaaagtactttaagtatgacttatcattttttatatttgcactaatttttcaaataagacgaatggtcaaacgttgcataaaaaagtcaaagtgaccactaatttgggacggaggtagtagataatatcgactaaagtgtgtatgtatattagaagtataggaaatgattttttttcatattttttccacttggcctagaattagtatgtatgagaatagtgaatgcttctgattcgtgtcaccctaccctttgaattaaactgacccatgcctagactttgattattacaagtaacatataaatattagctcggttctctctattataattttctctcgggattaaacacatacgatacccttggaatacttttaggtgaaatgatataattgtatatccgcacgcttgcagatgaaattgtaaccataatataccacgagtgtttttgcgccattgctggtaattatatttctagtaatgtcgttaagaaataccaacataggtaaagataaagacaaataaaaccctgtcacctgtcaacttatagaaggaaacccaaataacaatagatatataaacttaacgaacaagagaagataaaataaaagacgagagtcgtataataagataggagaaggcacctacgccgatggataaacaagcaaacacaacaacacccccaaccacttgtggagagagaagtaaggggttgaagaccatcaaatcgatcaaccattggcggaatggcctcattcgattgttc

SEQ ID NO: 43206 - DNA, 848 bp, Oryza sativa
cgaaaaggacccttcataattggcacggtaagtagagcctgtagaggttgttcgtgtggtcaccgtgtcatgctaccaagatcattggatccaagttgcttcttagtttttgttgatatcaatattagtctctgtccgtgaagacatatccatgcaaggaactgatttgtgtgacatgtaaaaaactaatttcgaatcctaatacaagataagcccccgagctgcataagggagagttcgcagacgaagaaaatgaagacccaattctgtttgctaaaaccctaaacctaatcgtccgatcgacttgaaccgagaagaggtttgtgtagctatctcatgcctggtgaagactcgaaggctatcgacatcaagctaaaagcagacaattagatcttgatagggccggtgtcctatttcccttatgacacaaccaaaagaaaaactataagagaaataagaagaaagaagagaggaagaaccgcaaatagaatatatcaaacagacggcgaagacgtgtcctaggagttgattatttgaagattatgcacgaagcttatattttttctttctgttctatgccgctaaaaagaaagataatacctatatgctaatgagtttgtttctccatcctcaccaagataataagtggcaaatagcaatctggtagcccctaatgaattagtgtaggtagcaaattgcagattgcatatgctatgatagatttaattttatggcaataatacataccaaaccattatccgccacccaaaacgaatctaaccccggtcaaggtttacaaaatgacatatatattatcaagataaaagaacacatgacattatgttttt

SEQ ID NO: 43207 - DNA, 2942 bp, Oryza sativa
tatgttttatcattgtatataagttcacaataaagtaatgacaaaagtaaagtaaacctaataacactgactattgttccaaaaaaattacttctcccattcggatagtataataaatcaataataaaattagtagatttgtagtgttcatattttgtcccatttgactttctcttcatctcctctctcactcaactcatctgtcttataatttttaactaattaacaacataatataaaaatgatcaataattggaaagctaaataattatgattcttatgttatatttgatttttagtttatttgaattgttattttatttataattaaataaataattcaagatccatatcactcatatttcactttacaaaaataaagaaatacacaatttgagcatacacacctatcctttgcatgctaaccaaatataaaaaaacagagctttgtaaaaaatgacaataagtattgttgactaaatctcggcaggatccaccacataccatgtcttatacggaaactgacctcgagagagttatggataaggaaagacaaccagagttctccatggaaacgataaggattactcggattgtatccatattggtttccctagttctacttggacaaggggacacctatgggtataaatacaagcccccctaggaggacagggggacagacatccaccatgaagggatcaacatccaacacaatcgacatagaagccacaacatagaagcctacatactccaagacaagccgtcggatatcgacttcatggataagcacggctaataccctgcggtgtctgcggatactgtcaggagagacaaaagcgctatctctgatctcgccgggcacggattcgaggtgggaggctaccttgttgttgactacgagtcagatcgtcagaccgccatgtcaacaacagttagataggctaccccaaacattgtactggtgtgatatcatgaataagagcaataccggcttcggccaacaggatgtagagttattacctgacaattcaggggcccgaacctgtataaaaatccctgtctccatctcttttacctcagtctcgcatataccctagcaccgacgatccccataccatgcaaataccagaaccacgacatcaaacatcgacacatttaatgcctcatgcatgccggtgacgacgacgacgatctggacccgacgatgacgacagtgcaggcaccgagagctgcgtcggcgggaggcggcggcgcctgcggccagcgggaggaggcgagctcggcattgagagaggaggcgagccggcgacgagagaggaggcgagccggcgacgaccggatctggtgggcgccggcgagagagggtgagcggcggcggccggggagagaggaggcaaggcggtggcgggagagataggaagtgcggcggtggggttgccggcgagagaggaggcgaggggctgccgacgaagacctttggcgaggggcggccggcgatttcgagaagaattttttttcctttttctcctttcccttttatttatttctgtttttttatttctatctagatttttttagtagattgatatttgaataaattgcacctacggtacaataacttggcaggtgggtgcgatatagtataagaacttgagaattgaacgtccgaatgcaacaacttgacatgtgagtgtgttctagtacaagaacttaacaatttaatattttgatgtatcaacttggctaaacatatgctaggtgagcttttttttacgatgtcagtatgttattgcatagtaatcatatggatattaccttataatattaaatttaatctttaagaattattatactacacatagtagtacaatttacatccaattacctttaagattttttttgtggtcttcaccttctcaaatatcaactgaaatataaaaatttctacatccagtttagttgaccttcagttattagttattaggataaaaatataaatatacttatacaaatatgcgctagtatattttcaaaataagtacttaaaaattgaatttattgaaaaaatactccaaataattaagttgtcacataactttttaatttattgtatcaaaatcgtacctatcttgcaagttgttgtatttatacaatcacttataaagtttttatactaaattgcacctacctgccaagttattgtgctagaatgctaatttcttaagttattataccaaattgcacccacctgccaagttgatgcaccatggatgcaatttactcttgatattttttgggtgagaatgtggaggggtatactcaccacctctaatgaaagggtgattgcaaccactcatccatcccactcccccaaccaaacaaaaaaaatggattaccatatccactttcatccctacaaccaagggtgtgtttagttcacaccaaaattgaaagtttggttgaaattggaacaatgtgacggaaaagttaaaaatttatgtgtgtaggaaagttttgatgtgatgaaaaagttagaagtttgaagaaaaagtttggaactaaacaaggcccaaacaaaaaactggatcgccatattcactcaaaaaaaaaactggatcgccatatccagcaaaatatggaccgccatatcccatccaaccttgaccgggagccaaacacaccgtcaggatgccacgggctccaaccttctcaaataaatgctgccttaggagttaggtctgatttatggtttagttcccaactttttcttcaaactttcaacttttctgtcacatcgtttcaatttcaatcaaattttcaattttggcgtgaactaaacacaccattacaggtctcgaaaccacgtacaaactggttaagtgtttaaaaaatatatttaaaaattgaattctaaccaattttattgaatttcgtggtta

SEQ ID NO: 43208 - DNA, 3637 bp, Oryza sativa; identical to SEQ ID NO: 41050

SEQ ID NO: 43209 - DNA, 3031 bp, Oryza sativa; identical to SEQ ID NO: 41051
  unsure (1)..(3031): unsure at all n locations

SEQ ID NO: 43210 - DNA, 2420 bp, Oryza sativa; identical to SEQ ID NO: 41052

SEQ ID NO: 43211 - DNA, 3042 bp, Oryza sativa; identical to SEQ ID NO: 41053
  unsure (1)..(3042): unsure at all n locations

SEQ ID NO: 43212 - DNA, 2027 bp, Oryza sativa; identical to SEQ ID NO: 41054

SEQ ID NO: 43213 - DNA, 2077 bp, Oryza sativa; identical to SEQ ID NO: 41055

SEQ ID NO: 43214 - DNA, 803 bp, Oryza sativa
  unsure (1)..(803): unsure at all n locations
nnnnnnnnnnnnnnnnnnnnnnnnnnnnnnnnnnnnnnnnnnnnnnnnnnnnnnnnnnnnnnctgcaattaccatgaataagaagaattatacactgtaaccgaaaaatggttgtggcctaaaacaaagatagaggagatactcacatggttgctgagcttgtaacgccccaccaaatcaatgtagtatggcacgagagcaactaatcttgtcatctcagccatgttgcttgcatctggcagtacaaacttgaaagaaaggactttcttgtaagagcctgccagttgatctgaaaaatgaagtgagatgaaccatttcccaaatttctcaaaagctttgtcaccaaggacctgcagagaaacaggttgtaaaacattatatatgtatgccactgtatagcattgctcagtcttactaaagacatgcggatcatattgagccagcccatgacaaaattctgagcaaagctatgtcaatccttaattactaaaccttccatctaattttctttatcatagcattaagacaggctacttcagtcgttaaaaaagatatagatggcgactttggtagaactctagcagtcaaaaattcaaggtactccctaagttcttcgctatccaaatgtgcaaaacatcaacagctaggaacagtaccccgactttcccaagacaaatatggcatgttcaatatcaacactgccttatgcaaaagcctgatgatattattaaattacaaacataatgaaatgataatacaagccatcatcacattacttgatccacagttactattctgggaaa

SEQ ID NO: 43215 - DNA, 786 bp, Oryza sativa
  unsure (1)..(786): unsure at all n locations
nnnnnnnnnnnnnnnnnnnnnnnnnnnnnnnnnnnnnnnnnncaagcttgcaagccggggaaaattttatttgtttccctttttattttaattgattaaatgaactttgtgctattaaaattatttcttgagctccgaaaattcacgggaaatttcagagagtattttagggcacaaagaatattacaaaatattcccggccaatgatttttaaagaaaattttaatttcctctataattcacttgattaagttgatttaacttttatttaatttctagaaaatgtattattaattgatttttaatcccgaacgaaaatcggggcgttacacctagagagggggtcgggggagccctacccctggtcatgggagggggcggccgccgcctgacctcgggcccgatcccccctcggggggagccacgtggcgcctggggcggccttctccctctagtctcggccagggagtggacgacgccctacttcgggcccgacccccctcgggggagggctacgtggcattggagggcagcctcctccatccagtctctgggaaggagtggccgctgccctacctcgggcctgactcccctcgggggagggccacgtggcattcgggggcagcctcctccgactatgtcacgcccccgaactaatcccgaccggaactagcccgtgacgctccaaattaacctgttgatcgataccagtccaagaaacagtgctggtatcacagggagacaaaatatcacagcaacagccggctctttattatagagtagaga

SEQ ID NO: 43216 - DNA, 27421 bp, Oryza sativa
  unsure (1)..(27421): unsure at all n locations
nnnnnnnnnnnnnnnnnnnnnnnnnnnnnnnnnnnnnnnnnnnnnnnnnnnnnnnnnnnnnnctcaagcttccttccaggcgtctgccctcttacggtggcggcttgccgccgaaagatggccacagtggacgagcgagtgcgggggagaggggatccattcttctctctcaccctctccctctccaacccaaccacgtggatggatgtgaagcgcggtgaaggttaggactcttcttcgatggctagccggcggcgaggcgtcggcgcggtggctgcgcgtcgaaggggattagatggtggttctgctgaactggcatgcactttttaacgcgggagagtagaacaacgggcgaaagcctagccttcgggccggcaacggcgacgcctgcgggcgccgttttccccttggggtgttgccgtgttttctattttcccagtgggttcttcaggtgaaaaccttgtcctggttacctaggacgaacggcggcggcgcttttggcgtcgttttccttcttggagacgtcgtttagaagtcatattcctttgagagtgttgtgtgcttgttttgttttaaacaataggatcagacgtataagcgtggtgtggttgtttattttctttttcctgactatagtctcccaggactataggcttgtattttattccttctttatcaatagaaacatcatactatcttatgcgggttgtttcaaaaaaaatggccgggaaaacaaaataaggctttgcagacaattttttttctaaaccacaagatagtgttcattgaagaaaacaaatgtgggctaagaaaatgcctgagaaataaaaataggctaatatatgggttgttaaataggaatgtccaaactgaagtccaacaaacacgcatccgcacatggggttgtaggatcgtgtgatcgcgcgggacgttggactagcgatcgatcgtgcagtagacttattacccctctattgcccctatttatgtactgtacatacttgcatacagtagcagtttcggaagcatctgctgtgtactcgtcgtgccacagaaccggtcgtcggcgtctttcttcctatacacgccaatggcagtgacagtggcccccacacgcagtgcgccagtgcctatatataaggcacacaggctcctggcacgccgcgccatgcaccgcaaagcgacacacgcgacacgccgcctccacctgtatccctcaatcaccgattcgtcgatctcccctcctcctcctcctcctcctctccccggcggcggtggcggtggcctcccccagcgtgagagacagatcagagtgctcagctccccactaggtaggtgcgggtgtgttgccgcgtgcgccggccggcatggacacgtacgaggaggtgcggagcatcgggtcaggcaacttcggggtgacacggctgatgtgcaaccgcgacaccggggagctcgtcgccgtcaagaccatcccacgcggcaatcaccgggtccgagtccttctaccctcttcactagcgtaatagggttttggggttgtaggctggggtttggtgggtcttgctcgtgtggatccggtggccaacatttggttgttctgatggggctttggattggtttttgcgcagattaacaagagcgcgtaccgggagatcatcaaccaccgttcgctgcggcacccaaacatcatccagttcatagaggtgtgtatctattgttgtcttgttgatgaggagcaaacatttttggtttagaaaaaataggagcagatagtcagggattgttcactcattgttttgtccgtctgggttaattgtctgctatgccatgatttactagtttcttgagcatgaatattgaatgggtaaggattcgattttgtattttttttcctccctagtttgatgggttttggtgatgtgttttctatttgaaggtgacaattgtggaatgtaccatgtttcttcttcattctaatcactttatggtttaatctcggttttatgggtgcatttaagtttgatctccttttgatcttactcctttctctcataatcccatgccgtgtggaacaaaataaacaatgctttgttttcaatttgcacaggcgatcctaactcatacacatcttgcaatcgtgatggagtatgcatctggtggagaactctttgatcggattgtcgatcttgagcgatttagtgaggatgaggtcacaatatataatctctggttttgatttcaataatattttttaaagttttatgcttctaaagtttgtttcttctactcaatgcaggccagatatttcttccagcaattgatttggggtgtaagctattgccatcacatggtatggataaacaataaattggtcttatcttatcagcacattcaataatctaatgttccatgttgctctgtagtatgtgtagtagaaactgctagtatgttttctcaaataacgtgagtgggacctgaaaaaatgcttaaatattgcaaccatcttcgctactttctagaaaatatgccatagagatttgaagctggagaatgttctcttggatggcagcgcagctccgcgcctgaagatatgtgattttgggtactccaaggttgtctccaattattcagagtttgctcatgcttttagttcttttttagtttgaacaggaataattgtttgccatttctaacagtcatcaatgttgcattcaaggcccaaatcagcagttgggactccggcatatattgcaccagagatactaaacctccaggagtatgatgggaaggtgagttaaatagcttcttgtttacctatgatatgtactttgatgtttctttggtaacatttatcagaagcacgtcatttatcttggttccatatatggcttattttcttattttcctttcattatggcatgcatattaatactttccatgtcagcaaaaacctggaactggaagtacaagttgattatttagatatagaattattactttctaagcactttggcattgcctaattaacctagactattgcacagatatggtttgatgtaccaagaaccatcacattagcaagccatatgcgaataatggtatacgttcatgtgctttcatcacaagaatagttttgacttacagagtatgatatcgtttctagtttcaacacagttactattgattgaatcatggtactagttacactaactaaaattgacaaattgtggatgaccttgtcattgttttttttccctttgagataggtttagttcctgtgtgtatagcatgttagattcttcttgaagatgattttggagtaatgttgtaaacaagagagaagttcaaccagcgttagtgtgctatactctactatgatctcttaattcatagtacagttacacagttttggaaagataagcactgcagggctgaaatgaacttttagtaatgatttaactgattggttgcatactttgttatcaccaattgaaaactcagatagaagatatatctcttactttacaatggtactcctgtgtcacaccctgaatttcttttcccaagcctaaattgaatttataaatcgcctagagaaaatatcagtgtaaaagcaagagagaaaccctaataaattaatgcaaataataatcagaattggcatgtggaatttttcttgagttctacatgtcgaaatatgctaacaagatttttagtggaattttcaaagctctagaaataattttaaccaattaaaaacgagcacaagcagtatttaatcccaggaaaattcatttccttcttttttttttctttttcctttttccctccttttcccaatgggccgccagcccatattcctccccctccccgctgggccggccgaaggccacggcccagccggccgcccgagcccccctcctctctcccagggtcaccgacaagtggggcccacctgtcgggtcctcccccaacctccagtcgccgccgcgcatcccgcaaccaccgccgccccctcgctcccgtgcctcccgggcaacgttgcccacatcgccgcccgcgcccgccttccccgcgcccactccctctctttcccgcccgcgcccgcgctcgagacgttcaggattcaatttttgaatcccgcctctctctcctctcccccttttcccactccaccggcgaaatcgcggccatcccgggcacgatcaacccttgcgagcctatataaagcacccccgctctcccctctctctttttctccatttcgccgagctctcatgtgccctctatcgccctagcgccgtcgccctcctctccaccgctgtcgccgccgctccggtagccgctagccgccgcgccgagccgtgccgttgccgccgtcgggttcgcaagcccaagggccacgccgtctgcctctccgccaccgctttccgccgcgggaaccccgttcgcaccgcgcgccggtgagctccgccatggctgccgccttcggccggcgtcctcgccctcttccatcttcctctctctctctctctctctaacccctttcttcgtgttcgctaggtggttccggagctcgtcccgtcgtcgccatcgccctccgtcgctcgccatcgtcaatcgtcgtcggtgaggcccctcctcctcttcctctctctctctctctctctcaccgcttagccgccgctgtcgccgtccgcgtcgccacgacaccgccgccagctgatcgccgccttgcgccgccgccgtgcgccatggccgccgggccggcttgagccgcccgtgcgcgccggccacgcgctcccgccgccgtccgatctaccctcgggtagatcggggccatccaaccccgccgcccgcgtggctgccatgtggccgccacgtgtgcgccgtgtcgacgccacgtgtgcaccacgtggtgcgctgctccttccccggtccgtggacccggtccaccgcggaccgccctccccccgagtcactgccaagtggggcccgcatgtcgacgccgccctctctctccccgggattttaattattgcgcaataaatcaattaaggatttttctggttatagtaaaaacacagcgaatcttctaaaattcatatctaattcatccgagctccgtttaagcccattcaagtctcagtaaatcaagaaaagtgcatagaatccattaaaaatggttttgttcgctgttttagtagtcttatagcatgtttgtattatttgctttgtatgtcgcttagattccggctctcccgacgctccggtgtactttgaaatagtcgccgaggttcctccagcagcagagaaggcaagtcatgcttgtcacttgaacatgttgatcctatattgcaaatgctctaccgttttcctttaaatactgcattgttttataatgatactatgggatgtttacctactgttacagccatgctacttttgtaccatgctcctttgttagcttgggatataacatgactaaagattggactagggattgcttagccatgcttagttcaactagcacaccgtgggggaaatcacattaatgcatagacttcaggttctagtgttggtgttggattaaagccgccgtcctggtgttagtcaattaaaatataccttatggtgggctgtgggtgcatggttttgatggtcgcgcccatggcacttaaggaccggttcgcgggaaaccctggaagaattcctcgtacttaccacaagccagcgtgggcaacggctgggcttgtagtgtagctttcctctagttgactcatccaggcaagggtgtgcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgtcggcacacggaaacgtgtcgtggggctgtgtcttgtgggtacagttgtacacctctgatcagagtgaaactattcgaatagccgtgcccgcggttatgagcggtcaaccagattcaccgtgattagcctcaccctagtctagtgtaatggaattgattagttcaggtggatggtggggcctgttgcaacgtggtgtagcgttggacagtggatggttaatattgagtaattattacaactgatttactgctttcaactaccgtctttaaatgctcgctttatgcaaatgaaccgctcaagctgtccttcaattatatcctgcatcataccctctattccggtatgacttgctgagtacggtggttgtactcagtcttgctctatttttccccaaacccccagagtttgagtgcgtgtcagatggtgggttctccgaggagtaggcttcgtccgtgctgtcgaggatgcatgtggagtggtgttcccgctgcagtccaagtcaaggcttagctccatttatcttttaattttccgctgcatttatgtaagacttttataatgtttgtaagacgtggatctgtatgtcgactttgtcgtttgtgtaccccggccggtcctcgacgggggttttaatgcacattttgcttggaattctattcgggaatttctgggcgtgacatcctgttttttagacagcacagttaattaattagtgacaagtgtatttttatattgtagcttgcagatgtatggtcgtgtggggttactctctatgtcatgcttgtgggggcctactcattgaagacaaggatgatcccaagaatattatgaagaccgtcaaggtgatagctcagtcctataatctcatggatatatttcattggcatttctgtgaatatatttgcggtcttgtttacactcatgaattccggcggcttatcttcgtttgcagctaataaaagcaattcaatatgagataccccagcaagtccacatatctactgattgcagagaactcatatcacgaatctttgtcagtgatccatcgaaggtaatgaacgcaagttaacatttatctcggtttccatattgatatccataagtgactttattttcatgtggtgattaattatggcatgtggtaaaccatactagtgaatgagccatatcgagctgtggtcttactctagaactcaagttcgatgagctcttttcttttcctgtatagagaatcaccatgcaggaaataaagaaccatccatggttcttgaagaatttcccgagggagctcacagaagaggcacaatctatctacttcacaaagaatgactatttccctactttctcagcccaaactagtggagaaatcatgactttcatggaagaagcgcagaaaatacccaaatcattcggcgatggctatattgattacagatcagatgaagaggaaatgcaggaagaggaggaggggccagaagagaacgaggaagaggaagatgaatgtgacaagattctaagggaggtccaagagaaggaaactccgaatatgaaagcacttagcatcggctagatggtgctacttgtaaggtcgggcatgttgataattgcatcgctatgtagtttgcgtttggtaggttgtatgcaattctggctgcagatacaatgtagtctaaattatacctttttgcatcttggaacataattttagtcgaatatgtatgtgtgatcttaagattcactctgaaggagagatgttttgtacatgaatccatccgattgtcttttggataaagagattttccattgtgtgcggcaaagcatctcttaataatctggataatttggagtgaaatttttctatgcatacgacccaattgtccgattcacgtacgattggatttgatcaatagttgtaaacggccacagtgcatatgaagatgctctcctttaattgatctatggttgcatgtctatcgttgtacaactgggtcgtacgtatagcagtactctttggagtgcatctgtgcatcaacatagcttttgcctggttaaaagcctaaagaagatagatcgctaccatgttttcaggtccatccaaaatggtcggtgccatggttggcatgaccatgaacagtaggatcgaccgacttcctagattattttttaagagaaaatccatgaaataccatcgacaagcaccataatcccagaaataccatcgacaaaagcatcttcctaaaaatgccattgcatctttctcccaaaaataccatcacagtcaaactgttattaacatctctccgttaagttgtatgaaaagacaattttaccccaggcaaccatttgctcacacaacatcatttgcattgtttgctcacacaacattattttgcattgatccatatttctgttagcatctaaatacagacatcaattttgctatcaatcaaattattttagaattaaattcacataaatcaaattcacaaaccaatttcacacattcgcctcgtccggacgcgctgcacctccacacgaggaggagcaactggcaaacaccactgcagaggcagcaactcagtatctctgcatcggaagagaaatccaaaagaaacttaacctaccactggacatcggcgggaagcgagcacaaagagaaagaagaaaccccgaggccaatgtcattgctcctggttcgtgaggcgagtacggcggcggtgccatctccactccgaggtccagtagctattctctgggaggaggagcagggacggagccatcggtgggggcttccgccgctagaaacccgcctctcccttgcggccgctgtggaccgttgcgccgccgccgtggaccgtcgccgagccccgcaccatcgccgctatggatagccgcaccgccgcctgcgacctcctcgccgcgtcctgccccatcgccgctatggaccgccatgccgccaccgtggaccgacgcctcatcgctgtcaccgagccctgcaccgagctgccgctaggagagccgcctggatcaggatcgttctagggttagggttagaaattttcactgtttcatctctctttttcttttaccataaaaactgggtatattctgcactgaggggaaaatggtcattgttaaaaaaaaataacggttgtaatggtgttgaattgacggtgatggtatttttgggagaaagaggcttgtgcaatggcatttctagaaactaggaagttgcttttatcgatggcattaatatctcgatgggcaactgaacaccagatggaaatggaaaatgcttcgtgtcgcgcgtccgacgggaagacaaacatcggacgccagcttcctcctctatactagtctaaaattgatttacctttcctggtgtttttcctggtttctctttccaagttacttttactcagccgtatgcatgcacaacttgcatgcaagtatataggaacatgcaaattgagacatgatctttaaaactatttttcttccaaactaattatgcgattcatgatccgattattgtggtatatttgttgttattaaatcttgcatgattatattctgacgaaaaaaatatatatgtttctactgttaaaattcagtgtttcactcaatgagaaacaaatgtttcaattagatatggactatgttgcactttaaagtttttttttgttgcaatgggtttttgaaatgtcacatatagctgttgttgcaataagcatttcatgatgtttcagtagttttttatatcaaaatatagccatatgagatcttgttataaagattttattataacaaatctaatgatgcaatcaaattacatatcaaatatatattttaagagaaaagagttcaaagaataaaaatatatgtgtacattataatatagtgctagtagccgtacatgctgcatacacaggctagcacatgtagctgcatgctcttgcgctttaaatgtagtgctaggtgcgctgctactaagggctgtgagaggcggccgatatttcgttttttattagacgtccgatgggtaacctcctccgatggaaattggagacacttgaaccagctaaggagtctctctgttgtggtctttaaccaaagcaggattatacctcctcggtgcccatggcccatggcccatgggaaaccacgcagccacgcaggtggttgcgaaggttggtgggggttcggaattttcttctccgacccccgtcagtcgtaatccgttcggctacgaatcgagatttcgatggcgagtaaggaattttttttatttttaattttttttattaaaagttttacaaaaataattttccattttgaaaattgacggaagtagtcgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggctgcctgcaaatgggcggcgagggggggcatggaattttgcaggcggcccccttgccgccctccgcgagggcgattttgtactgtgcggggggccgcctgcaaatgggcggcgagggggcatggaattttgcaggcggcccccttgccgccctccgcaagggtgattttgtactgtgctctatatttttgtataaatatcaatagttatcaaatctttttatattgaaaactatacaagattaaaatctccaagactggtaaaatacaattttattattttttagggcatatttggattgttaccgtacaaatattttgttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctacataatctcaaatctagattacgtattaccaataaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtagactgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccgtgggagtacgtgagtcggtccgggagtacggcacggccaacccgtcctgcctgtacaggtgtgacctctggctgctcctgagtgtgcgcctctggagctcctccaagctgagaggagcctagtacgtcgtggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggcgagagatcgacgctccgtgagaggaagagctggcgaacgcgcccgaagaggtggcgaacgcccctgcggagctcgtggaagcgccggtcgtgcctgcgaacgcgctcgaaggcagacgaggtcctgcgatgaggaaacgtgcagttaaaacatggtgacataatcgtgcaaaagctgaaacaaaaatgaactaatatctgggctgaactgtaccgtgcgaaaccggtgctgtaggtcgcactgatccgaagctaggggcgctcgaaggcaaacgaggtcctgcgaggatggatcatcaagttatgacggggtgatgttttcgtacaaaaatagaaacaaaacttaagaaacctctgggctgagcagtaccgtgcgaaataggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataattgtaagaagtaatacaaattggatgtaccgccacgaagtagtctcggtcacggtgcgtgggatacgcgtccgtgacagcggcaacgtgcggctctggggcgtctggagtgaaggtcacacgcgcacgagtgcgaggaaggtaccaacgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcaatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaaagacgactgataaacttataacgcagcgaagttgcactaaccccacgtcgacaccagtaagtccccatcgtgtgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctcttttgttttttttggatttttaagtgaatataatgaaatttcacagaggagggactgggctttatagggggagaggcaaaaatcgccctcccccagggcggcaagggggccgcctgcaaaattccatgccccctcgccgcccatttgcaggcgcccccccccccacagtacaaaatcgccctagcggagggcggcaagggggccgcctgcaaaattccatgccccccctcgccgccaatttgcaggcggccccccgcacagtataaaatcgccctagcggagggcggcaagggggccgcctgcaaatttcgttgacggccgtcgcccgagagcgaacggccgtctgccacgtcattttcgccgccctctgagagggcgatttttaaggcggtaggcgactccttccgtcaattttcaaaatggaaaattatttttgtaaaacttttaataaaaaaaattataaataaaaaaaattcggcgagtaagtaggattgttctacggcccatgaagcggcccagatggctgggcccaagctggggccttcgcatagacttttcacgccttaatctgggcctgggatagtagtgatcaaacggtcatttgattgcctcggctcgtagcggacggcaggatcattcacaccctgattgagtgattgtgttgctttcgttgggagatgcagagcagcagaggagcacactgttctactcttctcgtatatgaacctggttatacgaggctcttcaaattattattggaataaaatgatttacaagtttaatgttcttgtttcgtcattcggtagtttggttctctacgtacccatttgttagtacttagtagcgttaaaatcttggtaaaatttgaaactatcaatttgttgataggagagagatatattgctcatatttagtttattataaatatgatatcagagttcataaaatatcatttaaatcttatttgcatgtacttttcagtgtaacatattggcttcgatcataggttattctacaaaagtgtgatgatgacactaaattaataaaagttgcatgtcgcaaactggagtcaaccggcctcatcttttcgcttatgcttatgcttatcaacgaaaatttaaattttcaatcttaaatttgaagttgatttttggattgttttttcattgaagtttatctttcagccttagcttttaggttgctaagaacatactacctccgttccataatataatgtattttggagggatgtgacacttcctaggactatgaatctggacaggctcagtgtcacatccctctaaaatctgttatattataggacggagggagtatataaaagttttgtttacaaatacttctcgtttgcaaatatgccgtttggcttattaaacaatgagactgaacggttgtgcaactttttgccaattttggctggaggttcacagatagaattcaataaatgtgcgttttattttttttctattggtgttagtaccggtgtgcgtctctatcagtttggatgtgtccctattatgtcttcctttgaggtgtgattatgtttgaaacttttttttaataattagctgtaattctgtgagcaaaggtcaggattatattttattatcttaaaaaaaataatgtcaaatttcgttccattgtgaagaaattttgccacatttgcattaccattggcttcaaacaaaaccattatattttcaatacttgtgaattgccatcacactacttatcacggattggaaaaaatatgagaaatcatgccatgtgtttatcccattgaaaaaagttcttcctcttgtggtgactctgcctacctaataagcaaacagataatatgaaagagaatgaggtgtaatccgagaaaagcttcataatcatacaagcttcttttattttccccttttcttatcccagaagaaaacctttttttcctcaattaaatctaacacagaaaacctttttatagaataaaccaaaccttgtgaagccaaactgcaaaaacttgtgggggagaagaagaaaaataaaaacttcgtcgagaaggcaaagcaaatcaagccaagataacgcggaagagaacgagaatatcacggctattaagacctcggaatccacgggtgatgaagaccaaatcctcgagcgttctcagcaactccttcccaatcctcctcctcatcttcctcgcggcggcagcatccgttccccagatcgccatgtcggccgagcagccggagcaggcggcccccgcggcgcaggaggcgaccgtgcagatcgtctacctggaccgccccgcggacgccgaccccgaggagttccacatccgcaccctcgcccccgtcctcggcaggtatactcgcggaatttggatcccccgcctggttgtttctactatttgtgcgatctatgttgctccggttgtaggagtttggattccggtggttcgattgagatagaaacttgtgtccttctgggggctcgattagctccaaatatgaccgtggtgatactgggtaggaatagggttttctgagaggtgtggattgtatggcgatttgctgattttggggttggttgattgcaccgaggagaaggcaaaggaggcggtgctctaccactacaagcacgccgcaagcggtttctctgcaaaacttactccccagcaggtcgaggagctcaagagtgagtactctatcctatttttctttcagaattatgcccgtttaccgttcttctatatctggaaaatgaaacgagaggaataaatctggtttttggctggcaccaaaccaatggatgaacatcggagtctcaaattcttattggaacataaatgtatcatttgtcaatctgtaatacagcggccgtactgaataacttccatcttgttgagtaaaattaagtatgatccttaagcttttagatctttggacttaggtgtgattgattggtgatgttctgtggtaatgttgatggttatcaaagtttctttcacactgtagtcttccgttgcaataattgcgaaagcaatcattcttttctctcacaagcccaggttcaggcttaagtgcacactcacaaatcataggattgtaagctactaagaacctgttcggggattgtacattataactataactaattcttcattgccccataataatgtgcttcagtcatatttgtcatgtaatatttggtactttggaaccaggaagtacaatatttcctttgtagaccaggatgtatcaatttacatcctacttatcccatatagtatgaacaatcctattgaaggatatttgtgaattctgatgctcttagctgttattgtaagtatttgccaaactgataagatatttgcaaataaaacctattccttatgaactggacttgcatctgttcattttctaggattatatatgcaaggtttttcttttcaccgtggattttattaataccattttaacttatatttctaacatgattcgatcttacatatacgctatctatgaccaagcagctaccggatttcttagtgtactgttctttttatcattaatcaagtaaaacttatctaatgtacatgccagtgtcgtgtggttatagattacaatacggcacatgatttctttggattttggttaagtttctgaagtatgtatgctaaagtcgccaatagtgcgaatcgtacttgggccatttgcacttctgtttgtatccttacgtctgatttggctcctgcctcttttgttgcagagcaaccaggtgttcttcaggttgtaccaagccagacataccagctccatggacccggggctggcactggcacaatgaacacctttagtcttgtgtagtgtaccggcctagctgataaggtagtgtaatgcaagtgtttctggtgtgtgcatctcatggcatggttgtaatactatatggtagtaacaataagagatgcaacacctgtacatccccagtggatacaatgatcttttagcttgtatcctaagtttgtaatgagtattaaaaaaaaggctgtaatgcactaatgtataacaagatcatttgatactatatataactatgtgttgatctaatgttattctcttttagaattttgggtcttcatgttgctgagtttgcacctgtggaagaccttccctgtcttcgtatttgctttgttattcacattcgcaaaagtagtactccttccgtttcacaatgtaagactttttagcattgtccatatacatatagatgtaatgaatctaacacatacatatgtctagattcattatatgatgaatgtagacaatgctagaaagttttatattgtgaaacggaggaagtagtaacaataatcgtttacgacaaaaatacgcatgggcccactagtcagtgtcttcccagctccgcacagtggggaatacctctcgcaaggtgggccccaccaagcgcccatttcttaaccgacgaaacgggctcacgtgtctgaccatcgctcgcaatcgcaattcgcaagttggcatccaactccgtcccgtccctccctcccccccaacccgatgggaaacgcggccgccggcgattcggccgccgagctgctgctccgcgcggcggcgctggtgccgccggcgcactacgccctcgccgccctcctcctcgcctgcgccttactgtaccgcttcctcgagctccacctcatcggcgacctcctccgcggcctccgcgggggccgcgtcgcgctcaccttccaccccgcctcccacgtctaccaccgcgtcgcatccaagtgccgctccctccatggcaggtgagatgagagaactccgagttgtgtggattcgtcggaatatttttttgcgatgtcatcgctaacatcgggaacgctggtcggtcgcgtaggtacttggcgacgccgtggcttgcgagccctcatttgcagacactgttcctgagcatctctgggagacccccttcgttcacgtataggaggtaggagtaaattcatgtcttggaattgtgcatttactcgttgcatttgtctacggtctctctgcaccaacgtgagtatttgtttgattgtacattggtatgagatgttaatggactgttctgatggctcaatggcctaacggtatcacttgaaacttctcaatatggatatgcttgtgcggttttagcttccttttttccctatgaagttatgattgttgcgcaccattttgtataaaaataaggggcaataaacttttgtgcgaaatctggtatatgcagaattgcggcatgctgttcctttattattatatgatatatattggtatttagtattctcatgagttccagttccaagttcagtaagatcagctactataaggtagagactcatgttctgttttggttggacattacaaattaaacttggaacggtgctgcagctagttatgacattagtttgccatatttattaaattcttagttatgaaattagtttcccatattcattgaactctataacacaggcagctgtacacagttcgcgatggtgggaccattgctttggattggttactagcctctgattgtgaaggtgctgatgtttttgttggatagcttcagatcaataggctagagatgcctgatagttagttctatgttgcagaagaagatgttggtttttgtgatggagttatctctagggatgattcgacgcctcttgttgttgtgatacctggattaactagtgattctactgctgctgtaagtccctatgatttctctaccaaactttggtttaaacacaatctggaattttccataaaatcaattttaggtatttgggctaccttccctaattgttctaaacaagatgcagctgtctgttgcagtatgtgaagcacttggtcttttctatggcaagcaaagggtggaatgttgttgtaggcaatcataggggtctgggtggcatctccataactgtaagtttcctcctattctatagtgatatgcagcattgaaaaatcgatggtgtcatctgctttaactgattggttttaatagccatgcttgtctaaactaaagtccaaagacaaaaggatgataaaatgaactacagggcagaagtttcgagagaggcattgctgaagcttactgtcgatctgcaccttccgtacgaggacaagcaattaattaaccagtgtcataagattaaatatggtggaaagcacatttgttacttgtgctcccttaaattctgttagctgaatgattcatgtttgtcttataaggtagatattaggattgatagcaaatgtaaagacactgcatattcctgttttgaaccacttgaacattttttttttattaagcttttgaaccatgtggtccatattcccagtctattacatgatatgtgcatgaaagtgaaaatgggtgaaatggtgttaggcctaaaccatcaatcaatgatgctgatgtggaaattagaaaatccttgaatacatgttctgactccaggaaaattatgtcccagaatcatcaatttggtagcagttgatgaaaaatgttcaggtggtacttgttcctcaacctagtatttattcttgcagtctgattgcttctacaatgctggatggacagaagatttccgtgagattgtcaattaccttcatcagaagtatccacaggctccattatttgctgttgggacaagcataggtgccaatattctggtagactttgtctgttcttaagatcttctgttttgttttgcataatctctcttgcttgctctcactccacgcatgcacgcactctgctatacactgtagttgatattgtaaaagtgagctgcaatttgtttatgttgttttcatctgttgcccttttaggttaagtatctcggagaagaaggtgagggtacccctgtggctggtgctgtatctatttgctcaccctgggatctgctggtcagcgtctacagtttttttttttttttgaatttttttttatggttctatagatattattttatgcataaataattgtttatttgttttgaaacacaattttgcattatgatacctatatttttgtttgctaacaatttcgctgtgtctcacttaatgaaataacaaatagcaaataatatcctcttctagtgtttcatttcacaccaatacttcttaattgttttcttacatctatccgtaatattttgttatatcaatcaatattgcaggtgaccaacagatttattcagcgcaagcttgtgcaacgatgttatgacaaagctcttgcaattggtctgaaaggatatgcaaaactgtatgttctcattacgcttctttaccagctaagcatttaaacaagactaacattgtatacaacttgccacaacctttattcattgaattactatagtttgtgctaatcaaggtttagtgattatcaaataaatcctttttcaatttatttgatttgcatttcaaataaaatacaatggcaatgatggtttgcgttttgcacctttagctaaagatccaagttcttgcctatatcaattgaaatgtgtgtttatgatctttgttaaaattaatttcattgtggacaaatcaagatgagacactattcttgagctcatggtatcaagggcctgcatcccatacaatcttgtggacaattgtagactagtatcctgggttagagtttatatgttaggtacaagcagtttgattagtgtggctttgtgatcatgttgctcattgcgacagaacccacataatggtcttactcgttgcctatcgtcaagtgctgtcttatggggatttggagggtcaagagggctttttgttaagtggtaggagagaaaccagcactaattgacaaatatcaaataagagaatgaggagagggtgggacgtccagtaaagaacttctgcttgcagtcaaccaagaatgattaaattagtaaatatgaagtttatgttccctgaacagttgtttttttgtatttcttcttactctcgagaaatttactgtagaccacatctcccttatggctttgctttgatggtgactgatgagtttccaatcccatgtgagccctaaggaaatgtttggacctttctgatgaattgttgcttaaacttgtgatctgatacttgaagagcaaatagctgttgctagctgaactgttaaggcactcgactattctagtgaggtccagactacattgaaggaattttctcatagttatgtgatagttggagtaatcggggtatttcatattgtgatctgtaactgatctgtgccgtaagaagatactaggtcttgtagcaaattcttgcagcactaactctcgagtagttaccatcttcagttctagtacaagtgccacaactgcagaatgtacactccatttactgataatctgattagaggacaataacttgaagtactacctccttactagattcatagtattaggatatgtccacatctagtaatagattaacttattctgggacggaggtagtacatgtttacattcagaccattaaacccatttccatctgcattaactctgatttttcttactttttgtaatttctaacaatgttaatgaatttaattgatacataatataccgaatatgcaaatgtcctgataaaatgtttaggcttagcagtctcgcaccatcatccagagcaacggatgtagtataagcccgtgctgcgtaatgacaaccaaagatggtgaatgcactttttcttcatactcaactactgagttttctccccattttgtttttgcagacaccaacccgtcttggcaagacttgctaactgggaagatattagaaaggtacattgactgactgaccctgttgttctattatctcatgtgtatatagtatgtactgtacattggaactttccctgtgaaccatgacaaagtattgagtgttgtttcagtttccataaaaaagggttatatattgtagttcacagaggctacagtagattacttttaagggtcaaaagagcaattgtccctttaaattaattggctggttacacaaatttgtacttatcctatcatcttctatttcattttttcagtcacgatctatcagggaattcgaccgtcatgccacttgtgtggttgcaaaatatgaggtattctttctaatgctagtgtacctgctaaatattttagcattgcttaatatcatgagttagatacttagatcaaatcaaatagcattgtgctgttccaattacatttgaaggtagaggtggactggcaaagcaacatacaactatttggttcaaacataaatggaccaaattaatttaccacctttgattttcaaagggatgtgatcagaattgaccataagctagtgcatcaaatccaattttgtaacaaataagcaaaattcaaattgaactgccagtaagcctcttaatctacttttaacaccagtaagcctctaacttgcatcagtataaatttgtcagacagtggacacattctaccgtcggtgcagcagtgcaaattacattagtaatgtgtcagtgcccctgctttgtatcagtgctcttgatgacccactttgcacaagggaggccattccctgggacgaatgcaggtaagcttacttttctttcaaaagatcaccatcctaaagttttattgtgtattgatgaggtccacattgtgtgattcagggcaaacaaaaacattgttttggcaactgcacctaacggtggccatcttgccttttttcaagggctaactgctggaaagctgtggtatgttgtttgcccctattatgaatagtaaggacaaagtaccgttacctttctgttcatggtctaagaaacttgaaaatagatatttgtaaggaattgcgattaccggggaaagcttgttttagttgtagttgataatttgtaggatattttagataagtagaagtaatatacatttataaacacaaaaattatgtattttgaggtgcaagcggctaaattatactattttgtgcggggatataattgggcagggatgaaaagacaattctttaatccgctttccactcacacctccatttttcacttgtgatgtttcttcaatatacattattatccaatagcgattaagtcagtgtgttcctttatgaatatttggtaggtgggtgggagctgtttctgagtttctacttgctctacatgatagcccctgcatgcatcggcaaaaggtagagattattaaatcgcaaactggcgtacgatagcatgaatacatgatataacatgtagttgaatgcaggcacaagaacacagcttgcacacttcgttggaatcatccattgataaaagcccatatgtgaatttcatggaagatgggatggtaactgcggtgacaaatgatgatgccaacaatagtgactcagataatcctatttccaatgaaatggaactccgcaatggcatggttggtgtgcaacaggatggaatcgccacagaaatacagaatgagtgtgacggtaataggtcacaagagaatgtgacgccagcccaaggtcctgtaggatcacaggaacagccaaaacaaaacatagataaaatccaggatgctattgctcctgtaaagatatccattaatcagctcattcgatcgcaggggagatctgtttggttgcttacttacattgcttttgtaacatcttggcctttccttggtgccctgggttttatcttgtttaggaaaaagttcaggaattctttgcctgctaaacggttatgaaactaaggcaattatgcttacagtacatacacataattgtttcacgtgtagtatgtaaaatgctggcaacaacagttcatatttgtgtatcagttcctaagaaaataaattatataggtgtaacatgctgtcatgcaatgattcaattcctctgtaattttctgtagttggaattactaaacatttcccagtattttactggttctgcatttcttctactctgcactactttgttattctaactacatttacaatgtttataggggatcagtgagggatttagctaatgtgaaacttctgtggagaggtagggatggaagtggatccacccacgggtacccccactaacttgtctctatttagtttataactataagaggtcgccatgtataatttcacggtaaatacagctagcacaaggatgcagtttgcaatttatcacaatcgattttaaataaaattacacatccatgttcgtggctactgaaccaaaacatgatgaaatcagatactgggtctagtatttctgtttttagctgttactagagttcatgaacaccagaatataaccgacgcagtaagttactagcagcaagcaactgaaaaacatcaggtgattaaacaccaacagttacaattctagaagacgcatgtctctaatcatttcttctaccagactaaggaacctttcagtcaatcctgtttgtcacgagcaagctgagcccgatgccttagttctgctctcttccatttcaccatcaaccgacataatgtaataagggagctaacctggaatagtaaaaagtgttcaatatgcatacaagatgaactgcaaatagatagagagcataacaccaactaattaataaggactttaataacagggaatggaaggtcttttactaaccacaatgaccatagatatgaagataaggggacccgaccagacgacagaaacaaaaactccagcgcggtcgaagtaatttcgtgtggcaatgctcttccagtgctctgccatatagctatttatcttttcagcaagataaactcctgaatctgcagataggcaaccatggaaccaatcagacaattaatcaaaccaagcagcctactctgatcaatcaaacaaccaggtttttattctagataatttactgccacctaacgtcctgagatatccgttgtctcttcctaatatcagaattgagaagataccaattatagaaactcacaatagccacaaactcaagctctgtagtagactttgagtggcacactagcagacaccaagaatactctaattctacattattgacagaataataaaatgttgatcatttatagtgcactccctctgtttcatattacaagtttcagccttatgcattcctttcacattacaagttttagcctcctgacataattttatcacattctttccactcaaacccttatcatagttcgcattgcgatatcctgaatatttgtcttgtgccaactgccaaggcatcacatctttagaaaggtttagtggccaattctgctttaacttctttgtgctcaaagcagcatctaggtgagcgctgtatgtgctaaagtttaagcaaatgcagtaactcggttaaactgttagttgctattgacccaattactacgacaaggttcggtttatgcaaatggaagattatactaccaaaatattattataccctagcctctcttctccgacgacaatgtctcagtcctaaacatactgcaaaaatatgcaaaaagaaacaagaaaactcacaggcaagaaacagcatgaagagctggaaattggcattcctcctcaacccgacggccgtgagcaacagagtcgcatggaataccatcaagcaaatcagccatggttcctgaaatagcctcagtgccacaagcacaaggcacgcgaatcatcagcaaaagagaaaggaggcggcgcggcgcggcggctggaaatcggtgatctccgctaatctggggatcggggagttagttaccgtccagtcgacggcgcggacgaaggcgagaaggctgtcggcggcggggccgatcccgcggcggagctcggcggagagcgcctggacgaggcccgagacctggtccaggtgcgccatcacggcggcctgcgcctcctccatcggatggcgcgtgcggcggagggcggcagattggcccagagtactcaggaagaagaggggagatgtgctgccgagagttgttgcgatgattcggttgcctgcatatttgcaacgtttaccttcgcaaattttctccaaaatttatcatagagatgttggatgacacacatagtaaggctgagttccccgcacgagaaacggtgggccattttggtttgatgctaaaatgatgccctaccaaattgttggtattttaaatagtagtttggtagtgtttggtttgctaccaaaatatgccaataagacacataagttgccaaaacatttgttactaccaaaatttgccaatgatttggtattgccaatattttggcatgatagcaaaccaaacaagcccggtgttattaagtacttaaatatagataatatgatttttttaaacaactttcctatagaaaacttttacaaaaaatacattgtttagcagtttgaaaaagcatgcttaacgaaagaggatgtttagccgtttgaaaaggcatgcttaaggaaagaggaagatgagctgagaaagaaggggaaagaacatatcttaataagtagacaaatccaagcgtgattaactaagtattagtctaaaagaacttgaaaatagagtagtatgattttttaaagcaactttcatattaagaatttttgaaaaaaaaaacacaccgtttaatagtttgaaaagcgaaagcgcgcgtgcaaaaaaaaaaggaactgtgaggtagcaaaggggaaaaacacagcatgagtaggcagatctgttatttgacaattggtgaccaggctctgtttggcaagactgcaactcaagaacttttgcagaaaatagagtttattatgaataaagaaatccaataatctgattttacacgaaagtaaagaacagtgatgatcttaatctggagctccataaaaactcgagttagagc

SEQ ID NO: 43217 - DNA, 13806 bp, Oryza sativa
  unsure (1)..(13806): unsure at all n locations
nnnnnnnnnnnnnnnnnnnnnnnnnnnnnnnnnnnnnnnnnnnnnnnnnnnnnnnnnnnnttcctatagaaaacttttacaaaaaatacattgtttagcagtttgaaaaagcatgcttaacgaaagaggatgtttagccgtttgaaaaggcatgcttaaggaaagaggaagatgagctgagaaagaaggggaaagaacatatcttaataagtagacaaatccaagcgtgattaactaagtattagtctaaaagaacttgaaaatagagtagtatgattttttaaagcaactttcatattaagaatttttgaaaaaaaaaacacaccgtttaatagtttgaaaagcgaaagcgcgcgtgcaaaaaaaaaaggaactgtgaggtagcaaaggggaaaaacacagcatgagtaggcagatctgttatttgacaattggtgaccaggctctgtttggcaagactgcaactcaagaacttttgcagaaaatagagtttattatgaataaagaaatccaataatctgattttacacgaaagtaaagaacagtgatgatcttaatctggagctccataaaaactcgagttagagcggtgccaaacagcgctgcataacacagtatacgacaatcccaacagttattactgcttcaaccagtagaagacatgcatagatgagatttactcataaatcaactcaaattatgtgatctagtcttgagtttctggcagcgtatctataaacgcattacacagcaagtcatggagttctcttacaaacgagctgctgcataacaacattcagatgaactaaaatgaacgatcgtgggggcaaatcaaacttgacgccattccagcctgcgtatattaatacaaggaaaacagcgtttcaaattaatcccccaacaagcgacaagctgaaacaacagcaaaagattatcttcacctatttcctttcgcttgtatccccccatggcaaagaaaagttgatggcccagaagaacataaaagagtctggcaggcaacaataagctaatcagcaactgaatagctaaagccagtgctgtgatatatctttgatgttactaggaacggagcattttaactttgggcatggacttcttcatctgacgagccctttctttttcctctttcttgcggagtgcctcggcgctcaatttggcctctgcctcttccataagttttttcttctcagccttcttcctttgaagggcttcctgccttagaccctgttgctccctgaaagcctcctgggaagcttttgttcttgcagcttcagttttggaacgagcctgcaattaccatgaataagaagaattagacactgtaaccgaaaaatggttgtggcctaaaacaaagatagaggagatactcacatggttgctgagcttgtaacgccccaccaaatcaatgtagtatggcacgagagcaactaatcttgtcatctcagccatgttgcttgcatctggcagtacaaacttgaaagaaaggactttcttgtaagagcctgccagttgatctgaaaaatgaagtgagatgaaccatttcccaaatttctcaaaagctttgtcaccaaggacctgcagagaaacaggttgtaaaacattatatatgtatgccactgtatagcattgctcagtcttactaaagacatgcggatcatattgagccagcccatgacaaaattctgagcaaagctatgtcaatccttaattactaaaccttccatctaattttctttatcatagcattaagacaggctacttcagtcgttaaaaaagatatagatggcgactttggtagaactctagcagtcaaaaattcaaggtactccctaagttcttcgctatccaaatgtgcaaaacatcaacagctaggaacagtaccccgactttcccaagacaaatatggcatgttcaatatcaacactgccttatgcaaaagcctgatgatattattaaattacaaacataatgaaatgataatacaagccatcatcacattacttgatccacagttactattctgggaaaatcttggtacaagaatagttatgaacataatagaatccaattggtgccaattcacccaaaaagtaagaaactcagatcaattcacaatttaattcctttacacttcatccatattgaagttagtgattaatgatataattgaagggagtgagatgtttctcgaatgtcgaatattgcacctttctcacttccaaattatttgatgataatttgtaatatataccgtttcgttttagaaggcacttacctatattactttcataaaagaatcaacatcaacaggacacctcactatatcatctgtacaatcttaccagaagaaccatttacccagtaccaccgaagctaaaaacagcaattctaaaaataagtaagcaggttaaatcatcacctggtccagcacggcttcagtaatcatatccccagcaacctcctttgactcggccactaccgcaagctcatccgcaacccatctcctcccggcgggtgccgaggtcagaaccccggcaaatttctgcagatccctctcctccttctgcatcgtcttggccgccttcttcctcgccacggccaacatgacgtggtccatggcttcctcgttcatcaccacctcgaacgtgatggtgtccttcctggggaacaccagctccaccagcttggacagcaggtcgtgccgcgcgcgcatctccatggtggcgagcatcccctggcagtaccgcctcccgctcgcgtagaacttgaacacgtcctgcccttccttcatcaggagcggcgtgtccttgccgtcgccggtgccgaggaggctgaagttcttgtcgaagatggagtccctggtggcgaacctggtggcccaggcgagcgcgatcgcctcgttctgccgcttcccggtgaagtagttgagcaggaagcagatcaggaagctgacgcacgcgatctcgacggtgtacgcgcggagcagctccgcgggccgccggggcggggctggcgccgcctcggccgcggcatcggccgcgggatctgacggggcggcttccgccggcgtggaggattcgtcggaggaggccgcttccgggacagggatgccctcgaactcgtcctcgtcccagagatcgagcgtcggggtggggttcggcggggtcagcgtcgggttgggatcggggttagggtttggagcggaggtggtggtggtggtggtggtgacgggaggggaaggagttgaagtggagagggagatgcgcggcggcggcgggagctcgacgtcgagcccctcgtcgtcttcgtcgtctgccgaggccgcgtcggcgtgggcggagtggaggtcgtcggagccaaagccctcgaagtgggcggcgagggtgagggagaaggacagcgcgagcaggaggaggactagcgccgcgcgtggcggccggatcgagctcgccgtcgccatggacggggaggtttggactctggaagtggggataattctcctgttcttttttttttctttttcgggtggacgcgtagggaagacgaaggagatgtttgctactacagcggcggccggctgcgatttgcgaaaggtgagagataaaggtaggcactcgatttgggcgctgaaggcttgtagcgggaggtggagtagttgatcgttggacttggatctgatcgatctgtggtttctcgaaatttaatgacacttcgcaactaagtgcacttcgaatggtaggatcgaaaaaaataaaggtataaaaaacacataattctgataaaaaaataaatgtaaatcagagttttataaaacacaggaaaaacacaggaattgccgtttgagtgaactacataaaaaacatagaaattggatgagaaagatagactcgaagaaaattttctaagaggttgtagctcttgctaagattcctccaaaatccatgtgcaatgagccattccataggaattttatagaatttgaaagctttcttgaatcaaatggtcacacaggaaaaattcctataggatttgaatcctatgaaatttctacataaaattctttgaatcaaatgggccctaaataaattgtgtgaattccagcatgcaattggcaattgcagttttatggtgcagatcaaattctcaatgagaaaaaatgagtgaattccataaaattactgtttactatagttaaagttaaagaaaatataaagttcgacatctaacacattaatctagaatctacaccctccgttcaaaaaaccaatttatatggatgaacataatgcttgcgcagattcattcctataagttatttttttatacgaaagtaggtactacagctcacataatcacactgttatcaattattttttgtattctcaacatttacaagtttaaaagttacattccaatcacttaaagtattttcgcaggcatccctctctcactcaatctctcatttcctctctcgccctgcacctcactatagtcgcatgtttcacccttgtcctctaaactgtttaggccgaataggggggacgacatttaacacccccccccctctctgcttcaacaagtttagtaataagttcactctagatccctcagtttgtcgcctagtctaattttcatccttagtccagaaaaccagatacaacgcatccatcaactcacaaaaccgtgcagaataggtccctcagcagtattatgctcggttttggatgacatggcacctatgtggctccctttgactaggtcatcatcccatgtggcattgacatggcgcttacgtgtgttaacgaccaaatttggcaaatcatagatcggattcgaagttaaaatcgaagaggatttggagagagtttgcttttcaaaagcaaagtgtatgtttttcgcatcaacaacgtgtcaattggatctcaaaaaataataaaaactgtaggacccacatgtcaaccacacacaaaaaagtttaaaaaggtggggcccatgtggtcccacatgtcatcccccctcttccctcacccccctctctctctttctcccctacactgcaaaaggcaagcggcggcgcaaagtagtgggcggagcaaaggggcagcgagtggaagtggagtggtgggcggagcgatggcgggcggcagggtggaagcggagcaacggcgggtggaagtggagcggcggagggcggtgggcaaagtgacggcaggcgccaagcggagcagaggggcggtgggtggaagcggagcgttggcggggcggtgggcggagcaacggcgggtgccaagcaccgagtggaacataggggcagtgggcggcgccgggtgaagcggtcattctcaacatcgaagctgccatcttncgccctccaccgccgccgccgccccctcccccccccccaaaaaaaaaaaaaacccgacccttccccgtccaccagggcttgcccgcaaggcactgctagcattgaccctactgccctcgccgccttccccacccgcgccttctcctcctccgtcgccactgctggtggtagccgcgtcgccccgatgcggctcggcctcctccttcggctcatcggctccctcacctccatccttttctccgccaccggaacgccgcagctccctccttgctgcctcgcaggccacttccgccactgctgccttgcgtcgccattgacccccattgggacccataggggatagagagagggggtgaggtggaggtagtacgacccacttacatatttttattttgtttgactaatatatgggcctcacatcttttgttgtaattttttattttccaattttattttttccggatcaaactgccacataagtgccacgtcaacgccacgtaggacgaagacttagtcaaaagatgccacgtatccacgtcagtcaaaaccgaggtcaataccacataggaacctcgtttgcactggttttgtaagttgggggatgcaatataccggtttttcgaactgaggatgaaaatcagactgggcgacaaattgagggacctaatgtgaacgtattccacaagcagcttattaccgcgttcacttccgttgctagctgggccaggcccgatggattaggcctctgtctttgttagtgcattcttgggccctgctacgcatgagcacgcgacagtttacttctgcgccgtcgtttaagttgtggttagtttggcttaacactgtcaggcgtttggtagatcggtggctgacgacgccgacccgtgttttggctgcacctactcttctagtgcctcgtctgcacccagatttgctgccatatattggtcacatgcagcgaagtgccaaagctacaatgcacccgtgtgatcgagagtagctagcgtacgtacgagcaatcttcccttgtaagccgtgccagtcatgatttctcttgctgaatagctgacacgcacgcacacgcacaaaatggttttcgtgcatcgttgctagtaatcgcgctactataccccaagcttttcccaaccatgcatagcaaggcaaaactgaaaaagttgctacgcaatttaatcataaaagcaaatacttcattatattacttatttgctcgtacacggtcgatcgatcgatcgatcacgacacgccacatatatatgcacacacatcatacatattccaagtagcaaatacgcgatatagcaaagctagcatgcatatgcaagctacatgcatgcaggcacgaagtaggtagcacatctagctagctaggatcatcacaaggttgccgccatgtatcatcaccggtcggttggatagcaaagcggcggcgcggtgatcgagcggtgatatattggtcgagatgatcaagggcacttgtggcggccgttgtgggtggtcatgttggcgtagcaggggcagacgttctcgttgccggaggtgcccggcggcacgcagccgcagcgctggcagcaggtgccgcatgctctcaggcacatcttcggccgccccgacttgctgcaccggtacccgcacttcgccccgcaatctacacgagattacatacatttgcatgcaactcatcagttcatcacactcacacagatcagaaaaaaagggaaaagaaaaactgaactagatcacgcattgcttaccgatggcgtaagcttgtccatgtggagcagtagtctgaagaccaaacaagaaataaacaggatcggatcagtaactgaaatatatacaattcaggaaaccgtttcgtttaggttaaaagatcagtttgaaatatctgattaattacctcgacgaggagcaggatggcgacgagcgagatgcacaagagcgacttggccatactggccatgatgatcaaacgactgaacctgaacgagccgaattcaactgaatttgcaaggtgaaattaaagtactggttctgtttgcgaggtggaggtgatgaacaaaagacgccggccggtagcccaatttatagggcgagaggtcggatggggctgccagatctatcacacggtgtatcccaggaggcacgcatacgcagcagcagcacgcagcacagcaagctctgcgtgcgccccccatccttggtggttccgtgttgggctctccacgtcgccacaccttgcatgcatcaatcgcttctgtgatcagatcagcgtgcaaacaattttaattatgtcttcgatgagaaatcagcggctggatatattagtgattagttctctgacgagcactaagcttgcatgcgtgctgtaatctacacgctccccgctgctgaacggagaagagtgagttcactttttggccaaagatataccccatcaacgcgatggactccactaaacctgaaaatatgtgtcatgtggtttcaccatttcagcaagtttacctttggttttaagcatgccaaacacctgaacttttgttacaggtgttgttctgcccatcttttctgggtgttatacacttgtactgttaacatcactagctgccgtcaaaagatttaataatctcggccaaatcaattcaggaagtaagtacaagctcgcaaagggaagggcagtacgtagccactagccagtaggaggagagtctacttagagcctgaggagtgaggcccaaataattcctagccggacttgctatcggaatatgggcctcatgcgcatatagtacgttggaataagttcatttagctcccttaacttgacagcaagttcggtcttctcccctcaattgttaaaaccagtcaaataagatcccaatacggtttgaatgacggttttgattgacgtggcatctatgtggctaattcgacttgatccttgtcctacgtgacagtgacatggcactagaagcaaaaaaataaaaaataaaataaaaatatggggcccacatgtcagtcagacaaaagatatcatcaaccggctaccgctgccgatgaccatcgcaatgagggaaatcattgtcggcatcccagcgacgagatccacttgaggcccaacgaatccactctccctagggccggccactgctccagccgccaccgccactaatgcacgaggagagcgtcgactggttgaggattcacccgcggctgacatgcgggggcccgcatgggtctcacgctaactcaaccggttgatatgtgggtcccacatggtcgccactgtaatttttttttgttgtaattgatatgtgggctccatgggtttaaatttttttccgggatcaaactgtcacgtaagcgccatatcaatatcatgtgagatgaagaactagtcaaagtagccacgtaggtgccaagtcagccaaacctggtaacaatactgttgagggatctcgtttgcactggttttgtaagttgggaggcttgttgtatctggtttttggttcaaggttgaaaatcgaacttggtgtcaagttaagagaccaaaaaattaacttatctatactatctatatagttgatgcccactaacttctaaagatcaacatgcaagtgtgccacgtcatcactcactattaattattatctaaagtattttaaatcacatacaagtgtgccacatcatcatccactaacaattattatctaaagtagtttaaatataatgcaaacatgacaaatcatttataattttgttattttttagaactcaatatgcaagcaatgttaaatcattatctccagatcattttcacattatttaaacatatacattattttccattctatgccatcgacaaagcgcgggttctacaagatgccattgacaatgctcggttctacaatataccattgaacgactcattttcttccttatatgccatcggtgttagtcagtcgttagtcatacaccgttaagggagaaaaaaatgacaattttacccctaggataaaattgagattttgcacaatgtcatgactcattaaataatcttggaggataaaaagacaagtgatttctatttttcatcaatgagaagaattagtggatcttgaccaatgaaatctgagtacgcatgataccctagggggtaaaatggacattttcttcctcttaacggaatttgactagctgttgactagcggtgatggtatgtaaggaagaaaaatagttgttcgatggtatattatagaactgagctttgtcagtggtatattgtagaatccgtgctttgtctacggcatagaatggattatctctttttataatgtataacatgcattttatctacatattttacaacaaagtgcggggtatcaactagttcctactatgttcgtggactggacctggccatctggccatgccttgaaaagacctgtctagccctttcacagtgcaagttcgtggcgcgttacctggtctacgtggaggaaaaagcgagtgggccgcatagctatgattggttttcgcatctctctagaggaacgagagcctggcgccttgctctgcaaaaaggccggtgcagccttggtggtgagcgtggccgtggtcctccaaagccggtgaagctgctcagccgtcggggttgccgttgccaagggtgccacaagcagatcgaccgtgtgccattgccgctcgaaacgagggcgctccagaccgccgtcgccgcctcgtcggtttgaagtgctgtcatgaagggagaggaggggcgccgaccgggggagctcgtggagctggtggagtcaccaccggggcccgccatgaccgtgccaccgcagccgccgacgaccgcgcctccctcccgttagcccgtcaacgacgccaccgcccgccacgatcgcacctccctcctgtcatcccgtcgacgacgccaccgccgctcgccatgaccgctcatggttgtcctcctcctcgcttcaagaggcggcctcggtggcggatctctacaccgccagccatcgcaccggttgcagatctcgagtggcggtggcgtcgtcctaagtccccatgctctactccacttcgccgacctcggtgtcgccggggagctcgtcgccgtgctgctgggtagctccccaaccaccacccttctccgcctcgaaacggaggccccggtgagctcttgcgcagctccgatccgcgccgtcaaggctccgctccgcgcttcctggagacgagcatgaggacaccgtcgccgctccactctagatccgcgctgccgctccagatccgtggcgccatcatcacccctccgccgctcgaagctgggacgagcccgaggatgtcgcctcctctccgctgggcgccggtaaatgggggaagtgtgagagagaatgcgaggaaagtgggagagagaagcgccggtaaaagggaaatgtagcagtagttgggttagggtgtttggcttggggatcccgtgaaagtaacttgcactgtgagatgagtggattctatatgcatttgtcctacgtgatatctaaggtaactcgaatgagagacttgcactggttagatcgaagccgagggaaccccggccttgtccgaggatgtacaccgcagtaggactggagtatcgtacgtcctctcaaaaggaaaggtacaacgtagtactgctactgtagattagtgtgcacatacagcccaactgaccttcctctcggtacaaaaacgttcaaaacgagaataatctgcccgtctggcgtctgctcattttgaccaaaattcgtggtggagaaccgaggcacccaagatgcgtaccgcagctgacgctgacagcgtactgccagagctcgcgagtcctaagcacgcaacgtcgccaacaccagccagccaatgagccatgtccggcgcccgccaagactagccatgcatgcatgtccggcgacccacggccccgtcaccggccacctggtcaactggccgctttgcttcagggtgtagttatattatatttatggcgccatatttttcatcaaaaaatagtcggtatgtatttatattgtaagtctctaaattacatatgtaattttagtgtatttacaatgtaagtctcaaaattacatatgtaagtactaaaactacatatgtaaattcgaaaattacatactaattacatatgtaagtgaggtgtaaatgaggtgtaactactgtgtaagtggctgaaaaaaaatcgactgtagcatatggcgccatatttctagcaactccgttgcttcacgcacccgtgcgtataatgggccgttttggacattaattttgacaatttgaccttttgcaaaaactaattttacaaataaactgctgccaaaacttattttaaaagtgacccttctgttcagcaccaaatcgtgtggcgctgaatttagacacatcaacgccaaatagcacgacgctgaatatacgttggcacgctgactcagccttccatccacggtagcacggcattcagcaccaggtgatgtggcgctgaggtgtttaagttcagcgccacatcatttggtgttgaaaaaaaggttacttttgaaataggcggcggttcatttgtaaaattagttttttaaagagtcaaattgtcaaaattaatgtgttttagactagtgctaaaaacgtgccttaccaacattttggtagtttgaatagtgtattggtggttttggttagaagccaaatcattggcaatgccaaggtccaatttgatattttctatattccactaaaagcttagtttttaaattggccttaaaccaaatacaactctaccctaccaaaatattggttgtgccaataccagtattttggtagggtattgaaccaaacaaatccaacatgcgcgacgcgtgacgagtgcgacccctcgttccatagtactagtagtgataactattccgtcttgcttagcgcaatttcaaatatcagatccacgatagaatagtaatttaaaattttatttaaaataaacgcaaaataattatccaaatattatcaacataatcgtattcacatatcaacataatcgtatccgactctatccgatatggcgcggcgcggcgcggatctttatttctaatgctggctgcttctgccagcagtgattggtccacgtgtcctctctcacatggcacataaatccgaagagcacaaagaaaaaaaaaggaattgagcagttgtgcgtctaggagtacgaaggaagtacagggttgtggcaggccagtcctcctatgccgatgaaaggctattctggaaggatcgattaggcaaaagcagcgaatgcctatgtcaatagagctcacatgctctacatatgtataagtactgaggtagtacattagtattacaaaaaaaatgttgaatgcatatacaactactcagttttcatacatatcagcatctttgaaaaattgagttagcatatctcaaaataaaaaaaaatattttacttctccgaactaattcgatgaatactattaaaaaatctaatttttttggctcatcttacctcctaaactgtaaaaaatggttcactttactccttaataatattttgtagttttcttactttaagctgaaatttgttggagtcatacattagaatattattaaagttcaaaaatatttttcaaaatgtggttgtttgcttgaacttaaaattttgatgtttaaatcagtcctatgtactttcaacctgcataaacggtgggaaaaaaattaaaaagaaatgttgaataagaaaaaaacaatttagtatgttaactactccggtgaaatagttcaggaattaaaattaacttctttttcttctaaaatcagcgaaatcaccacatgcaactcatcatcaacgtatatatgtcacccatcactaattagccatcaatacaaacacctatacaatgtttatgatttaaacccaatttagtattgttatgtcatcaaaacaaatgatgaacattgtggctcctaacaaaacaaaaatctgaaacacttttttttaaaaaaaaacaacaccaattttatcattagtaaacaatttaattataattttagaaaaacaatggaagaattaatagtatggattgaaaaaaagagaaaatttgatgattttctcaacaatatgacccgttatgttaaacttaaactcaaaaaattccattcctacgattttttatgagtttcaaggaaattaaattgatttctatattttttatgaacaatgtgctaattaataacacaaaaataatataaatgggatataaatcgagcgcgccagttggcgcttattttctgttgagnnnnnnnnnnnnnnnnnnnnnnnnnnnnnnnnnnnnnnnnnnnnnnnn

SEQ ID NO: 43218 - DNA, 11947 bp, Oryza sativa
cggcggccatcaacgcctggaacggcgtctcccagctgctgccgctgctcggcggcgccctcgccgactcctggctcggccgctaccgcaccatcctcctcgcctcgctgctctacatcctggtaaattaataccaccaaaacgccattgttttttttttctcttcttttctctcgtctgtttctctcctagatatagaaaaaaaaagagagaaaaaaaattcccgtttgttcggcatgggcgagagatctcaggagtgcgctagcgcggggcccacgtgtcagcagcacaccggagatctctgaaagctatccatggcttggaattggttcttggctcgtgactcgcgtgagcatgtttcttccatgaagatatttgttaagccagtagcagctgtagcactgagagttattaggagccagatcgcaaaaattattcgagtggttggtgaggtctcgtcggggatcgactaacctactcgtttgatcgtggaacacgacgaagagggtccctttctatgacgaaggcaaatcaagccatcaactttgatttttctagagggaaatgatcgatgattctatcccaggagagagagcacatcactgatgagtttctgggcaaatacggttacgcacgccctgcactttaaattcgcaataatacaaaaatttctactttcaatgtaaaaaaaaccaatctagcagcctcatctttttacatatccttttacagtagcatacccatactaaagctacggtaacatttggtaatgcacgtagtcacgtttttacaagcatatatatacatatatatatatatatatatatatatatatatatatatatatatatatatatatatatatatatatatatatatatgtatgtatgtatgtatgtaacaaataatacataatcatattcgcaaataagtcgcgaccgaaatcgttcatcaaaaatttcgaaacatctaggaaacaacaaaatacaaaaagtaattatgctagcaaacaactaaaaagcaaaaatgcttagagatgttatattaactgatccacttcttttctctgactccgaccgccttacatgatgagcacatgatattttggctgcttaatacaatctctacagcacatgctggctgcacggaggaagtattattttcatttggatgtatacaaataaaactcattacaatttgcaactgaggtgaatcaaaaataccatagcttggccttagaaagagagaaaatcagaatattctagaccaaaagctttctaaatcagcatacctgatattattactatatgaaaataataatccatgaccatcgacaattatatataatcacttcaatatacaatatatgtccacacaaaaagaaacagtggagttatttttatagatattcatataatcttgttagttttgacaagtataattcaagaccagaatctggataatttttcacacgatttccatgatccgcatcagaaaaacaaataatccttacccaaaaatcctaggcaacttggtagtcctacaaaaaccgatccttgtaagttgcaacctgaaatttatcggatctgaaaaataagaatgctaatattagccataaaacaacatttccaatatggcccatgaaaatatatacaacgtttgatgtaatttggtagaaaagcacttggtaaattaccatcattttcttgatttaccattgtcacagttgcccaaaggaattttactgaaaacaccttagcaaacaaatggtgtatgtagagcttggcaaacatcttggcagattcacatcttccaaaattcgaacagtgtattcatatttctcattctagttgagaatgccaaaaaaatctggcgttctctctcatgctcctccctctcaaagaaacatgtattcacagacagcacaacgccacactgccctgacatgttttccagtacagaatcctcagtagacaaactaccaacaatctggcacagaaattggcaatctgggaagcttgaggttacaaccaaaagaataaaaaataatttttcagtcgatataacactccatataatgcaactcaaattgttgaagaatcgttgatttgtttcttacccaacaaaatatgaaggcgatggatcgacggcaacctgatgtcagggtgacggagaccccagcaagccagcacccttgaccacataggaaagattccctactattgactgcatttacaccagaaaggctatatatatgattttatgattgcaatttttttttctataccacacatacaaattttcatcatatattttcgctaaacaaaaatgatatatgagcaaaagacgtcgctataattggacacatatctacagaaactctccaattggaaacaacaaaattggggaaaattgacctgatctcaatggagattagcagcacaaacaggggagcacaaagatcgttagagctgccacacagatcggtcgccggggagcgccatgctactgttcaagccgccacttgccaacgaggagcacaattgccgatggaagatggagcaatggcgctgtgatgttgccgaagatccgctgcagtccacgtcatgccggcgaggcgcctttcgctccagccactgcgccacctcggacagaaatgccgcgctgcacgtcgatttcaacggagatcaccgcgccaccgcttcaccatcgtcgaggactcatagtaggcggcgacaggggagagatgagggcggcgatggagaccacggcgagccggcgcccttgaccacggaggattgaaggcagccgcagcaggggagagatgagaacggctatggagattgcggcgagcggcgcgagccggcgcccttgacgacgaaggatctaaggcggcggcacgcggcaggcggcgattagggcggcggcgtggttaggggcggagaggagacgttgatctgggagagcgagagagagagtggggcgtgcgcgattcaggaggtgggaggtggaatcggcgattccgggagggggggaggttggatcgatctcgatcgttcgattttatatggacgatctgaaccgttgagtgatgaatgtaagagtgtaagagtgaaagatgagtaaaatgagttggtgaattatagggtagataagtcaaaatttgaatcatttgcttttagatcactaaaaacatgtatataaaaattttattcacaaatcatttcttgtttgcaattatgtcatttggcttttttcctcaataagccaaacaatgaccctatagatttggatgggacatcacctagtactttgttgtactcgggctctttatattcatcgtttacatgatagcatctggtaaggtgtacactggcccgtcgcgccatttgtgtccctcaactaatgaattgttcacttcacatccctcatcaccgattaggattccacatcagccaaaattgcccacaaaccactaagagagtctatttgcactggtttcatcagttgaaacctgttatatctgttattatggttctaaggatgtgatttaaactcaacctcaagataagggatacaaagtgaacttattcctgtttaattacagatgaagttgtgggccgatatgtgcataagttgggccttcaattcttttgcattcctcgataaaattataatggcaaaatttgctgtaggacacctaaaaaatgtgtaattagctgtgggacatcgcaaaaacgtgaattgcctaaggacactctaaaggtgtggtaatttgctgtaggacactgcacgcattaaaatataatatccacctaattgatgagagagaaaccacatcaaatgaccattttgcccttatctttatcttgcttcttccgacgtttctaaaaagaacaaaaaccaaatcacatcagcggggtgtaccactgtgaccttgagcttgagaacctgctgcttaactaggctgagaacctccgacttcgggctcagcacagtctgctaccatgcgcgccccgacgagctcctccacaccgcttgtggcacgccgacgtacattgtccccgacgtgctcgccgggtggctacgatagcaccaaggccgacctctagtcctgtagcatcatcctctattgctcgccggcgcgctactgttccaagacgagaacctggtgtgcatctatcacaagatgcggcaggtgacttcagctgcccgacgtggttgacaacggacgcacggaagctcatcaagatgttgttcgacctcaacccagacacctgcatcaccttcgccggcctccacaagatgcagtggttccggaagatggcacatgttctgtgacccatctcaccaagctcgcgcaggagccagtggacatgcttggcaatgtcgacaacgacaaggatgaattgcgcaaggtgctgaacgccttccacctgatgtcccttccaagggctttgacttgtcgccgttgctcgtgcgtacgaccctgccgtgtcgcaagggcgagccatggcgcgcatgggtggcatgtgattcacgacgcgcgagccggcgagcggcgtggtcacgcgattggaggcgctcgcgatgggcaacaccatgcccgtgcacgtgataacgagcagcgtgttcagggtgtgcctcaagtgtgaggagccatggggcggctcgccggcgcattttatttggtttggtgtttattcttttcggaagcatcggaagaacagcaggaagaggggaagaagataagggcaaaacggtcatttgatgtggtttctctctcatcaattaggttgatattatattttaatacgtctagtgtcctgcagcaaattaccacacttttgaagtgtccttgggcaaatttacgtttttgtgatgtctcatagctaattacatattttttaggtgtcctgtaacaaattttgccaattataaaatgctttactattgttccctttccaacttcgccgccatctgcgcgcgcgtatggcaacgtactacatcactgatcactcagcgcgatactgcgtgcagggcttggccatgttagctttctcgaccttgatctccaccggcggcaaccaatgcagcagcgccgccgtcgccggcggcaagacctgcccaccgtcgactctgcgggtggcgttcttctacatctccctctacatggtggccgtcgcgcagggcggccacaagccgtgcgtgcaggcgttcggcgccgaccagttcgacccgagcgaccccgaggagtcggtctccaggagctccttcttcaactggtggtacttcggcatgtgcggcggcaccgccgtcacgctggtgttcctcagctacgtccaggacaacatcggctggggcctcggcttcggcatcccctgcgtcgtcatggcgtgcgccctcgccgtgttcctgctcggcaccaggacgtaccgctactacgtctccggcagcaagaagggcgtggtcgctcgcgccggcgaggcactcgcggcgtggcgaaacagggcgaagtcgatcccccttcttccgccggcttcgcaggagtgccatccaacggcgacatcggcgccggagttcaggtaaaccagtaatgctcgctgcaatgcgtcttcacgcatctggtaatcttgcacatatggtgttcgataacatgattttttttgtctgcaattttgtagcacgggagtagaggaggacgaacaggtggtgggcaaggcgggcctcgtggagcaagcgaagggcatcgtccggctgttcccgatctgggcgacgtgcctgatctacgccgtggcgttagcgcagtcgtcgacgttcttcacgaagcaggcggggacgctggaccggcggatcggcgaccatatacaggtcccaccggcggcgctgcagagcttcatcagcatcaccatcgtggccatcatcccggtctacgaccgcgtcatcgtgccggtggcgcgccgctacacgggcgtcccctcgggcatcaccatgctgcagcggatcggcgccgggatggtgctgtccctggtgtccatggtgatcgcggcgctcgtcgagacccgccggctgcgggcggcgcgggacgccgggctcgtcgacaaggcgggcgtcccggtgccgatgagcctgtggtggatggtgccgcagtacgtgctgttcggcgcggcggacgtgttcaccatggtggggctccaggagttcttctacgaccaggtgcccgacaagctgcgcagcctcgggctggcgctctacctcagcatcttcggcgtcggcagcttcatcagcagcgcgctcgtgtccgggatcgaccgggcgacggcggcgaggggcggcagctggttctccaacaacctcaaccgcgcccacctcgactacttctactggctgatcgccgcgctcagcgcgctcgagctgctcgcctacggctacttcgccgtcacgttcaagtacaagaacaagaacaagggagctctcctcgcaacttctacgtcctgttgatgatgcacacaaattgtgctttaggtatgtacatgaatcagctgggtacatatctacatatttaaactttggggagatgttcttaattatgttattagtgttttccgaatatcagcctttgatctatcacagtaaagatgaacatattatttttttatgggaggggaatgtggttttattttcgcgagcttttgaatgggaatggggccgtaccacttcgaaaatcctaaacgtcgggcgccggcgcggctgcaaaaaatcgggcgccgggcgccagccctggcgtctcccaccgcgcgcgcgcgccccgccccgccacctgtcctctgccgccctcgtcacgtgtccctacatatactctattacaacaaattactcatatattttcgaaactctcgattaagggaattcgttttattttttgttccataaaaaatatttcacctagtgtacttacaatgttttactatgtatagatataatgttacagcgaattgaaacattcttttacaacaaatcacccacatattttagaaaccctctattaagggaattcgtttcattttttgttccacaaaaaatgtttcacctaatgtacttataatgtttcactacgtatagctcaaatgttgcagtgaactgaaacattttttcgctatttgctgaaatattgtttttatataaagtgaaataacgcccaattttttgagaaactgttgtttcatacgttgtagcaaaatgttttacgaggtgatttggttgtgtttcaactttttaaatcattgaaatatttttgatctacctagtgaaataattactatctacttagtggaacaatttctatatacttggcggaacagcgtgcaatatttaaaaataattcaataataagctaatttttttttcatcggattatattaatgtgtggtcttgttttaaagatttaattgcaacgagtttagtggtgcaatcggatcgtgaattggataagtaatttttgagaaaaattagtttaaagtttatttaaaaaacttgacacatgcatggctgcatgttctgtgcatgcagtgcctaaaaataatctctctgtgcatgcgtgtagtagttttgggtcctgtgattttctttctcccggatcggatggctgggacggccggacggccgcccgattttttgtctccccggatcgggcgcccgatctctagtgccctccgtaccacttcgtcggtcagattgcattttttttcctttactagcaattagcagagtggcccgcataaatcgggtggctagcatcgttttattttttttccgtataatactctgcataaaacatgtggctagcatcgttttatttttttctcatataatagtttaaatattttcacgttttatgattaaaatatattaaaactagcaacataactttaaattatgtactaacttaaccaaactaaccaatcacgaactaactaatgcgtgatatttatattgtattgtatatatgtgatatattcatattgtattgtatatatgtgatagttattaattatttttaaattttgaattttagatatttctaaaatatactttttatggattctagattaaaactagctaggtggcctgcgctattatacggctagcacccatacaaaattatctttttttacatatgattttattaaataactatcttatgttagaactttaaaagaccgactttatcatccccgtgtttttaatagtcatgccaattactacgccttatttcgttttcatcgctttatttgctttctcgatctaccattgttttcattcatcctcgttggaacctttactgttggtgatatgggcccgggggtatcaggtttagagggaggaggctgccccccgatgccatgtggccctcccccaaggggagtcaggcccgaggtggggtggcggccactccttccccagatactagtcggaggaggctgccccccgatgccacgtggcccatcccccgaggggagtcaggcccgaggtagggcaacggccactccttcccagagactggatggaggaggctgcccttcaatgccacgtggccctcccccgaggggggtcaggcccgaggtagggcggcggccactccctggccgagactagagggagaaggccgccccaggcaccacgtggctcccccccgaggggcgatcgggcccgaggtcgggcggcggccgccccctcccgtgactaggggtcgggctcccccgaccccctctctaggtcaccacgtacggtgggttaggtgtccacctccaggtgcccacctgcccgcatttatggcatcccgagcggtcgcgccacgccgcgttttatgcggtgtgcagtgcacttaaccggtctgtgaccggtcgaatgactgatgggacccaagatgttaggcgcaccatcacgtgtgccaggcgacgtgcagcccgacatatcccatcaaataatgatgatgagaggttctcatcctcttatcccagccggagttggtcctcccgctttggtcaaagcaaagctcccgtttcccggtgtaataggagtccagaagtcttcacccgttaaatggtgactgacaggggcaccccccgtgtcaggcggcaagatttgacaggccccatcatcaagacgacgtgtgcttggcttcccaagtcaagagacaagacatgcatttaatgcaaagattataatacttctccaccggagctaggttagattgttgggcccatgtggtaaccccttgaggtataaaaggaggtccaggcctagtggtggaggggggggatttccgagcgaactggcgcttgggtctcgcaaccccaagcacttgtgttctacattcaatcaatcatgcacaggagtaaggtattacgcatctcagcggcccgaacctatataaacatattttgtctcatcgtcttggaggggcctaaccccctcaagatcacacagctccgctcaccaagccctcgaatctcacccgctgcccctggccgaactcacaaaggggggcctcacggttccctggtggaggagttcattctctgacatctggcgcgccaggtaggcggtgcgttcgtgatttttgaggttcttttgagtgctggcgtggtgagtgtcgcgccaccgctacggggaaggcgcagcatccttaggagtgtcgtgccaccccaggcagggggcaaggccccccacatccccaccaggtaagcttggctaccaggtctttgtggcgagtcttcggaatgtccgatggcccccaaagttccggcctagcctcaccgagaagtacgacgacagcgtcaatcccttgagtccttccagatccacatgacgatcatagaggcgatggggggtgacgaccgggtcatggcgaacttcttccccatggccctcaggggccaagcgcggggttggctcatgaacttgctgcccgcctcggtccactcctgggaggacccctgcagttgagctccggctgccatcaaagcccaggatcccctgtgctggctcttccgtagcggctaactttggtcccaccggctggctatggtgcctggcccggctcaactaatcatcctctcatgttttcagtactttcaaattttcaactcatcaacctagtacagcttgaaatcttatatttatttccccccattctattctcatggccctgcgacgcccgcgtgttgctcatttgtttgctccctcggtggtaagagcccaacctctctccaatctacatgaacgattcttcgctaagtgtgggggctaagtcttctagccttatcctagccttaagttgagctctgggtgccatcgacgcccgggaccccctgtgctggctcttccgtagcggctggctttggtcccgccggctggccatggtacccggcctggctcaactgtggacaggaattgctggctctagagttttcggctctcacactcgtgcgaaagtaatcgtccatgtaaaaggaaaagagattggaaggaggccaccgaaagaaaagagcaaacaaaatgtgtagcgtgaggacacaggctcgtgggaacctgacctcgtttgctaagtggtcacagtcttcccaagatggttcggaacccatagtggggggccctcttcgagctaaaggtttgaaaggtcgcgatatgcaagcaaggtttgtgtttgcttcattcatacaagcaattctttgctaaaagtgtgggggctacgattcctagctctatcctagccctgcgtcgagctctggacgccgtcgacgcccggggccccctgtgctagctcttccgtagcgtctggctttggccccgtcggctggttacgacgctcagcttcgcttgatcgcaggcgaagattgctggctatagaaagttcagtcctcacacttgcgcgaagttaatcgtttgcatagaattattcttgcttatatttatctctcgcctatctcttcctcgcggtcccacggtacctatgtgtcgcgcgcaggcttgcctcccttggtaacaaaaagtttgtattcgcttcatccattcaaacgattctttgcttaaagtgtgggggctacgattcctagctctatcctagccctgcgtcgagctctgggtaccgtcgacgcccggggccccctgtgctagctcttccgtagcggctggcttcggccccgccggctggctacggcgcccagcttagcttgatcacgggtgaagattgctggctatggaaagttcattcctcacactcgcgaaaataatcgtttgaatagatgaagtagaacatgaacagaggttaacaaatggcaggggcaagcgtaaggtcacgggcccgagataatctaacaacgtttgctgaatatatacagaaaataagttcacagcctaaggcacgggctagcgagtcaccctcaggctggggcgaaaaaggcgcatgggtcttagtgccagcaaagaaagaataagagatctggtccacatgtcatttgactaacagagtggcgtcaaccctgaccacctaggaaaagttttggtcagggctaacgccgggggctactgtcggtgatatgggcccaggaatattaggtttagagggaggaggctaccccacgatgccacgtggccctcccccgaggggagtcaggcccgaggtggggtggcggccactccttccccaaagactagtctgtagcgccctttccgtcgtggcgcctagcgggaaaattatctcttaaaaaccctaattgcgaaatttgtttctttgcttgttgtctagtgtccgtgccatctcggatctcaatccccgatctatcgtcgagtccaattccgaatccaaatccttccaaatcaatccctccgcaaaagtctattttgcctcccccggggtcgatgggccgaatctctctcggcccat

SEQ ID NO: 43219 - DNA, 4112 bp, Oryza sativa
  unsure (1)..(4112): unsure at all n locations
gcttgagccggccgcgccgagccaagtcctcctttccgctccctcgctgccgctccccgcgcgtcgttcgcgcccgcccgcgtggtcgtcgcccgcgtcgcgtctgcgccgtccgcgcagccgcccggttccgctagccagcgcgcgtgcccgagccgcgccgctcaaaccaccgcgccgcccgttgtttccgcgcgcgcgtgccgtggttgccgaccgcctggtcgctgccgccgtcagcccctgccgcgcctgtcgctcgtgtcgctgctccgctccacaccgccccgccgtcatcgccgtcgtcatcgcctcggccccgcctctccgcgcgcaagccgccaagggacggaggcagagctccccctccctctgccgcgtcgcccccgctcccctcctccttttcccaaagaggcaagggacaagccccctttccctcccctttttttttctctttttccctctcgccggcgtcaccttctgttgccgttttggccgctagccggagcgccagctcgccggcttgaccgtccaatgtcggttcccctctcccaaaccgacattgctgcccatttaaacccaagcccctccccctccaatctccctcgttttcgtctctcgccgccactgtcgcccctgttcgccgtcgccgttcgtcgtcgcgtgcgtgccggaggagccggtgcgcactaggacgcggaaggggactccgggcgcgccctcttcttcctcttccccggcccgaggccggagagtttactcccgcgccgtcggcctctcgtcactgcgtcccgtccgcacggtagtgcctccctccgttcttcctcctcgctccatctctcctccttagttttcggtagtagcacgagtagcctccccgtagctagccggcgccgccccggccgttgccgccgctcgccgtgtgctcgccgccgtcgccgcccgagctcggaagcgccgctcgtcgccggcctcgctcggcgtagctccgcccaatccgacgctagcaacggattcccatagccgcgtaggtgctctcgccgccgggaattggcccctcgtgacctcgtcgccgttttccccttttctctccgccggttgccgccgccgcaatccgcagccgacggactccctccggcgaatccgagccgttggctcgtctcccctcgtcctgagcaaccacccggtgtactcgctttcgccggtatcgccgtggttcactccgccgctcgccgctgtcgtccgccgtccgttccggccggcgtcgtcgtctacctcccgccggcccgcgtagcggccacgtaggcgccacgtcggcgccagctcggccgagatcggatcgggccgatcccggtcagtccctcccgtgcgcgcgttccaccgcgagccgtgaggctgcgcgtgggcccgccgcatccgcatccaccgcgaaccgcgcgcgtgcaccgcgtccctcccccaccctagcgccgcgccgcgtgctccctccgcacggtgagccgagccgctgacaagcgggtcccacccgggaccacgcgtggtgagcccggtccaccggccctctctctcctcccctcccccgcgcgcgcgcttgggccgccttgggccggccggcccatttagctcggccggaccgccccatctctctcgggccgcgccctagccgcccgaggaaaagtctattttccctccctcttttcctttcttttcttttctttttcaaaaaggacttaattaaatccttttcctttagaccaaaaatccaataatcttataaattcaatatcttcccaactgtaaatccgtttgactccgttcaacttccaaaattcctcaaatctcgagatctatctaatggcatgcttagaggtcattaatagggctttattttcgccgtttgtttcgcgtgtagtttcggagcccgaagacccgcagcgcgaggatttcgaggatcaagctccagatctcgagcaaggcaagccacctttgaacatcttgagcctatatttgaaatttaattatgttgtttgaaaatattatgcattgataggatcgcacttaacctgttgtcccgtctgcaaggcagattggcggacctacctaatttgttgcatttgatccttcctttattaattgtgataccatgtccccttgtaaccatctagttgcacctcgatattcgtgcactctgtgcgagtatcgacggtcgccttcaaacttaaaatctgagtaacaacttgggtaaaacttgggttttacaaaagacttggaaaacccgacacctgggtcggtgcttgcgaactaaatgaatttccgaaaccgcggaccggggaacgtaccgggtgtacggttttccgctcttgcacttaaggaccgtttccttggaatttcatcaaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccatgggctgggtgatccgggttagtaatgtcgtgtgggtaaagtgtaccccctctgcagaggttaacaaactgttcgaacagccgtgcccacggtcatgggcggatgtgagatgattcctagcgtagttttgtttgactactgcttgtgaaattgctgttgtggaaaggggttcgatgtttgtaaaatctgcagctgatgggatcagctaggcccgggtggccgtttgaaagttgttggcccgggtggccgtttgaaaagctgttggccgggtgccaaccttgttttcaaattttaaagactgatacattgcacgtactccgaccggacgagacgcactgtctcaaccgtgtcgtttgagaagcactcacttagttgtttttagaaaagagttcaaataaaatcaactgcaaaaacaacagcctttccttgaagcctgcattaaacacttatttcccttggcttgctgagtactcccgtactcacccttgctctatataaataatcccccccagttgctgaagaagatgaagcggatcctgctgatgaggagttcttccaggagcaaaccggctacgatgagttttagggtttcggcctagttcccaagtcgcgcctgtgttggttggtcctagtcctggtttccgttcccttttgtaatgcagttgtgagctcgggatctgtccgtagcccaacatgactgtatctctactctataataaagagaccgctgttgctgtgatattctgtctccctgtgataccagcactgtttcctgggactggtatcgatcaacaggttaatttggagcgtcacgggctagttccggtcgggattagttcggggcgtgacatagtcggaggaggctgccccccgatgccacgtggccctcccccgaggggagtcaggcccgaggtagggcagcggccactccttcccagagactggatggaggaggctgccctccaatgccacgtagccctcccccgaggggggtcgggcccgaagtagggcggcggccactccctggccgagactagagggagaaggccgccccaggcgccacgtggctccccccgaggggggatcgggcccgaggtcaggcggcggccgccccctcccatgaccaggggtcgggctcccccgaccccctctctaggtgtaacgccccgattttcgttcgggattaaaaatcaattaataatacattttctagaaattaaataaaagttaaatcaacttaatcaagtgaattatagaggaaattaaaattttctttaaaaatcattggccgggaatattttgtaatattctttgtgccctaaaatactctctgaaatttcccgtgaattttcggagctcaagaaataattttaatagcacaaannnnnnnnnnnnnnnnnnnnnnnnnnnnnnnnnnnnnnnnnnnnnnnnnnnnnnnnnnnnnnnnnnn

SEQ ID NO: 43220 - DNA, 12120 bp, Oryza sativa
  unsure (1)..(12120): unsure at all n locations
nnnnnnnnnnnnnnnnnnnnnnnnnnnnnnnnnnnnnnnnnnnntgaattttcggagctcaagaaataattttaatagcacaaagttcatttaatcaattaaaataaaaagaaaacaaataaaattttcccctctttgtctttgggccgctttcggcccaagatcttttcccctcccgcggcccgcgccctctctctccctctcccggccggcctccctccccatctcttgggccgtcggcccgtttcccctctccctcgcgaagtctgttttacgtcccccatccagctctccctccctctctccccgacaggtgggacccgtggaccccacctgtcatccccttcctccagctacaactgccgccatggccccccgagccgccccacgacgcggccgtttccgcccaccttctccaccccccgggcgcgcgctcgtccgtgggacctcgccgccacgtccgcgccgttttcccccacctctcccctccaaaaccgccacccacaccccacgatgccgcccacgccaccggcggttgccgccccgactccgcctctcccgggctcgatcccgcctcccctcccctataaaaacaatccccggccttccctcatccatttcccccatttttcccaagccgccgcgccctccctcgctctccccgcgccgagcccacgcaccgccgctctccggcgaactccagcagcgccgcgccgccgctcccgtccaccccgcactgcgccgtcgccctccccggcaccgcagccgccgtgcacaccccgtccaccgctccgtcctctccttccacccccgcagcaccattcccacagtgcaagccaaaaccaccgccattcaccgcctccagccgcctgctactgccgccctagggcttgccgcgtcgtgccgtttgtgtcgtcggcatcactgtgccgagctctaccccggcccctagtccttttcccctccccaactccgaaacaccgccaccacgtgcaccacctctctccgccgtcgccgctcccgcaccctgccaccaccgcagccggcttcgccgccgcgaggacaagcctgtcggccgctcccctccccaaccgaccgccaagctgtcacctccactgccaacccgaggccgccgccgctttcgccgccccggccaccgtttaccgccgctcctggccgtcccgagccgcacccgtggccatcctcagcgtcgccgcgcctcggtcgccgcccctcgccgccgaaattccacgggagcccgcttttccccgttcaaggtcccggaggcccccggccgtcactcgtcgcccgtcggccgccgttggggcgccgccgtcgtcctcgcccggggagcgccgccgctacctcgcctccgtccggtgccgtgccgcttggtgagcatcccccttcctcctctcctttccgccgcccttcgcgcgccttctcgcgccgccgctcgccgccggtggccgtgcgccgccgtgcgtcgtgtctcggccgggccggctctgagccgtgcccgtgctctgggcgccctgcctcgtggccgcccgatcagctcgagctgatctgggccgtcggttcctgcggaccggcggtggaccaccccgtggtcccggtccacggtggaccgattcccttgacccgctggcgtgtggggcccgcctgtcggcgccggcctctttgatgacgtcagcacttaagcttttcctttgtaaaaataaataataattgcgcaataaatcgagtttaattctagaaattcatttaaatggctcaaaacttctaaaattcatatctaattcattcgaactccgaattgagccattcaacttgcaaaattcatctaaaattgagctctacatgtttgtttagtttttatgtactattttcttggtttttattagagtttttcctcgttttgcgtgccagcgtgtagttcccgtcgtttcggaagatcgcgttcgcaaggataagagttcagaagatccaagtgaagaagcaaggcaagtcacacattccccttgagcatgttgatcccaatttacaaatgttttactgtttgcaaataaatatgcatgttttgctaattacatggggtcagggttttacctatctgctcgcttgtgtcatgtttacttgatatctgtcctttgtcaaccatgggtaataaatcgcctagctggtgttactttgatgacctagctagaactatatgcttagccatgcttaattaccactagctcagtcgatgggataattgcagtattagacattctagtatcttgttgagctgcgtgctcgagacatctggccatgcttcatggtcgtaattatccaactaaaatgcgactgaatggtgggctgtgggtgcatggttttgctggtcgcacccatggcagttaaggaccgattcgcgggatgccctggaagaacttatcgtacttaccacaagccagcgcgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgactagattcaccgtgattagtctcacacttaataaatcgacccaatacactgtagtttaggtgggttggttgggcctgttcaacgtggtgtagcgttgatcagtggagatttaatgttactttaattactcaacagttttactgttttgctcaataaaatgttttacaaccgcctttatgcaaatagccacaaaccatccttgtatccccttgcacgtctgcatcgttggtgtggcttgctgagtacggtggttgtactcagccttgctattattcccccttttcagaagtgtagtgcttctgagctgaagatggagttagaggaccaaggctcagaccccagttgagtttggcctgtggagtggagctgaagccccgctaggatcgtttttttttccgctgctgctgcttttgtttcggtgtgaggactaagtgcctcttctgtaagtattttacgcttattttacgtttggaactgtatattacttgtcgttttgtgtaccctggctggtcctggacagggatttaatacgcaaaatagtctggaaatttgggttaaatttctgggcgtgacactaggtcaccacgtacagtgggttaggtgtccgcctccaggtgcccacctacccgcatttatggcgtcccgagcggtcgcgccacgccgcgtttaatgcggtgtgcagtgcactcaaccggtctgtgaccggtcgaatgactgatgggacccttgatgtcaggcgcaccatcgcgtgtgtcaggcggcgtgcagcccgacatatcccatcaaataatgatggtgagaggttctcatcctcttatcccagccggattcggtcctcccgctctggtcaaagcaaggctcccgtttcccggtgtaataggagaccagaagtcttcacccgttaaatggtgactgacaggggcacccccgtgtcaggcggcaagatttgacaggccccatcatcaagacgacgtgtgcttggcttcccaagtcaagagataagacatgcatttaatgtaaagattataatacttctccaccggagctaggttaggttgttgggcccatgtggtaaccccttgaggtataaaaggaggtccaggcctaatggtggagggggggacttctgagcgaactggcgcttgggtctcgcaaccccaagcacttgtattctacattcaatcaatcatgcacaggagtagggtattacgcttctcagtggcccaaacctgtataatcctcttttgtctcatcgtcttggaggggcctaaccccctcaagatcacacagctccgcttgccaagcactcgaatctcatccgctgcccccggccgaactcacaaaggggagtctcacggttccctggtggtggagttcattctccgtcatttacaaatttgaccttgtggttttagagttcattgtatcgttgggttttatttttataatttttagaagtctcaccaaacgccaccatgtactcctctacggcccgcccgctgcctctcatttttattatcgttgagatttgaatatcgaacataattatcattgaggtttttttgttactttctagaaatcccgccaatcatcgagaccgtgctgcttaacgaactgctcgtcgtccctcctcttaattatcattaaaattctattttgagattttgtttatagtttttatatgttccatctacctacgccactctattttcttatgggtctattgtttctctcatatgtattataactagcatggtggctcgcgtagattacgcggctagcatcattatattttctctcatataatagcatatatgttttcttaatttattattaaaatatattaaaataacaacgtaattttaaattttgtactaactttacgaaactactaatgcgtactattcatattcatattgtattttatatacgtgttaattattaattatttttaatattatatatatatatatacacacacacacacatacaaataactaaaatttgatattaaaaataattaataaataacacgtatataaaatacaatgtgaatatcacacattagtagtttcgtaaagttagtataaactttaaaattatgttgtcattttaatatatttgaataatatattgagaaaacatatatgctattatatgagagatactataatgatgctagccgcgcaatctgcgcgggccaccatgctagtttgatatattaaatgtagactaataacaaaacaaattacagattccgcttgtaaactgcgagataaatttattaagtctaattattcatcattagcaaatgtttactgtagcaacacattgtcaaatcatggagtaattaggctgaaaagattcgtctcgtaatttacatgcaaattgtgcaattggtttttttcctacaattaatactttatgcatgtgtccaaacatttgatgtgatggattttttaaagtttgaagggaattaaacacatccttagttttaagttacgaagcccacttctttcatatgtggcagcgcgttttgcttttgtcgactaaatctaccatataattcaccaactcattttacttatcattcactcctactcttacattcatcactcaacggttcagatcgtccgtgtaaaatcgaacgatggagatcgatccaacctcccccctcccggaatcgctgattccacctcccacctcctgaatcgcgcacgccccactatctctcttgctctcccagatccacgtctcctctccgcccctaaccacgccgctgccctaatcgccgcctgccgcatgccgccgccttagatcctccgtcgtcaagggcgccggctcgccgtggtctccattgccgccctcatctctcccctgtcgccgcctactgtgagtcctcgacgaaggtgaagcggtggcgcggtgatctccggtgaaatcgacgcgcaacgccgcaattcgtttctgactgaggtggcgcagtggctggagcgaaaggcgcctcgccggcatgacgtggactgcagcggatcttcggcaacatcacagcgccattgctccatcttccatcggcaattgtgctcctcgttggcaagtggcggcttgaacagtagcatggcgctccccggcgaccgatctgtgtggcagctctaacgatctttgtgctcccctgttgtgctgctaatctccattgagatcaggtcaaatttccccaattttgttgtttccaattagagagtttctgtagatatgtttccaattatagcgtcgtcttttgctcatatatcatttttgtttagcgaaaatatatgatgaaaatttgtatgtgtggtaacagaaaaaaaaattgcaatcataaaatcatatatatagtctggttctgaacaaattacatatcaggttaattcatgtggatcatttggttaattcagacaaaaaaattgctgtacataattgttcaaagaaacctttttttaagacaaatatgagctcatttttagaagaaaaaaatccattcctctacttcaaacagtgatcactccaagtgcacattctatcgaccatattatgatttaatgagatgcttatagcccttctggtgtaaatgcagtcaatagtagggaatctctcctatgtggtcaagggtgctggcttgctggggtctccgtcaccctgacatcaggttgccgtcgatccatcgccttcatattttgttgggtaagaaacaaatcaacgattcttcaacaatttgagtttgcagtagatggagtgttatatcgactgaaatattattttttattcttttgtttgtaacctcaagcttcccagattgccaattcctgtcctagattgttggtagtttgtctactgaggattctgtactggaaaacatgtcagggcagtgtggcgttgtgctgtctgtgaatacatgtttctttgagagggaggagcatgagagagaacgccagatttttttggcattctcaactagaatgagaaatatgaatacactgttcgaattttggaagatgtgaatctgccaagatgtttgccaagctctacatacaccatttgtttgctaaggtgttttcagtaaaattcctttgggcaactgtgacaatggtaaatcaagaaaatgatggtaatttaccaagtgcttttctaccaaattacatcaaacattgtatatattttcatgggccatattggaaatgttgttttatggctaatattagcattcttattttttagatccgataaatttcaggttgcaacttacaaggatcggttttggtaggaccaccaagttgcctaggattttcgggtaaggattatttgttgttctgatgcggatcatggaaatcgtgtgaaaaattatccagattctggtcttgaattatacttgccaaaactgacaagattatatgaatatctataaaaataactctactgtttctttttgtgtggacatatattgtatattgaagtgataatatataattgtcgatggtcatggattattattttcatatagtaataatatcaggtatgctgatttagaaagcttttggtctagaatattctgattttctctctttctaaggccaagctatggtattttttattcacctaagttgcaaattgtaatgagttttatttctatacatccaaatgaaaataatacttcctccgttgaagcaagcatgtgatatagagattgtatcaagcagccaaaatatcatgtgctcgtcatggaaggcggtcggagtcggagaaaagaagtggaccagttaatataacatctctaggcattttgctttttagttgttgtttgctagcataattactttttgtattttgttgttttctagatgtttcgaaattttgatgaacgatttcggtcgcgacttatttgcgaatatgattatgtattatttgttacatatatatatgcttgaaaaacatgactacgtgcattaccaaatgttaccgtagcgttagcacgggcatgctactagtatggataggttctgaagaataatctacactatagtttaacaaatatttttactcattcatcatgtgacacatccaactatccaaattcatctatggggtaagatccgatggctccgcacctccctctgatcgcgcctctctctcccgcatcccctctcccctcctctctctctctcgcagtctcgcgctgtcgcgcacggtacacccggaaatcctcactcatcccttcaatcacgcgctcctcccgcacgccgcattcatgccttcgccggttcgcccttgcgttgcatccctccccgtcgcctcgttgtcccacccccatgctaggaaccgcgcctcaccgccgaaccccatgattcgccgtcgccgcagatccgccacgcgcgccagaaactgcctcggagcctcatcggctgccgcaccgaccccactcctccattcctccgccgcggtcgacgaattatgaactactataattacgaggacagccgacggtggggtcgcctcgtcgcatggcccgcaccccccaccgtcggctgcgccaccaacgccggtctgcgacgcgcccgctccgcgatgaccccactcctttgccgcgctcggcgccttcctcgtcgcacggcgcgcccaaccgtcagctgcaccgtgaacgcttgtccgccacgccgccggtatccccatctcggatccccactgcgaacgcctgtcctctccggacgtcgtcgactacttctagcatccgccgcaatcggcttcgcccctgccgcacagggctgagccctcgttcgccactgctcgatttctcctctcccacgcggctcctccatcgtcgtcgcatcccgtcacgtcgatccggcggcggcgtaggtggagtggcggctcagggagcggtcggcacggcgatatgctgctcccgtcgatccggcggcagcgcaggaagcggtcggcggagggagcggtgtcttgccaatatctcaggtgccacctgactaccctcaagcaccgctgccgccacgccacgggtggacaggtacttctccgcctcgccggcgccaccgtctaccacgcctccgctgttcgtcgcatcggctggcacatggaggtagtggacactgctgctggtgttgccattatatcttgtaatctaccctcgatttttttttttttgcttttttacacttgtgcctgccccaattcagttggtgatgtactgttaaagattgccttgaaatgctattacatcacaaatttgagaagtgaggtgacttgtacttacatgcaggagctgaagccaaatcctagctgccgcttcagttagcatcaacgctattgtatttcttccaagatgatcccggagctcaatgctaaggtgagcgttaatgtcatttaccagatctcatgttgggctatgcttgtactatcatatttgctaatggtttcttgataagctagcaggcggctgcaggaggtgatgtgggaggcagttaagcaaagaaagaatgtgttcagaagctgctcaatctgaaaatggaggtatgatcgatttattcagcagtcatctttgatgtccctgactttttctctgatcatggattagtgaattgcattattggtaattcaggaaagaaatcttcaagaagacttgggagtgtggtaggttgcaggtgaagaaccacatgttggcgaatgagcttgcactgttgaatgtgtatgtttgtgcatccaacctgaaagatgcaaattcttgcctatgataagtggaatgcatttagttgttttttgtccgttggattgacatatatgaacattcagcagtagtaagagatccttaagttgaccacttgataaatatatatgtgaactgttagaatgttgcatactaaataattacaccaaattgttccccctgctgaaactagatgagcactatctgaatgttgcctttttatatgtgatatttctctaaaactgaatgtgaatcctttattgcagaattatgtcagtcccattttacaaagcttagatttaatatgatccaaactgaaactcgattcacctcagttgcaaattgtgacgagttttattgtatacacatccaaatgaaaaaaaatttactcccgctgttccagtttagagggtgtacgagtattttgccgctgtcctgcaatacacggcacacatttggattaacaactcttttcatatttatacaatttgtgttttatttgagggatagtgatcaggtgattatattggcctttatttattgttcatgcaagcactgcagataagaggaagctataatgtaattattactagctgaaatggtaatgtacgctcagctaacattgttcaaattatcccatcaattttaagtgcatagaaagcaattcaatcctgataatcatcatgggtattcatctgtttatttacatgcgcagcagggacataaggacatgtatcaatcatcaatctgcgatgtaataatatagattatttatcatgtcattcaattgcttaacaaaaatctgtgtatgtacttatcacaggagatatagtagtgagtgatcaacaatgtacttgttctcagagtaactttggattgttatctctaacacagaatatcattttgctgataataacggcattctgtatgcttgatttcctacgaggcaaccctgttgacttgttgtatgatattctgttagcaatagttttttactagcccaaaagtcaagaacgacttattatgtaaaactgaatcgtttctagctttgtttttcagtgctaaacacggtgattaatgtgatccacaactttgggcacgttgcaatgtaatatactccctctgtttcatattgtttcatattgtttgacttttttttcttaattatgattcttaaagtttgatcaagtttggagaaaaatatactaacattttcgatacaaagcgaacatattatcaaaatatattcaatattaaatttaatgaaactaatttggtgttgtaaatgttgctaatttttcactaaacttaaataagcctaaagaattttgactaagaaaaaagctaaacgacttataatatgactataactaacaactaatcagtatggcaatcttgctaaaaaaattcataatagcaaccctgaagtaaattaactgtatattttttaatcaaatgatttttttttcttttaaacatgggttctactatatattgccgtagcgttagcacgggcaaattactaatctattcttggtatgatttatttatggtgttaatacataggaggcttggtatcaaccatagtgagcagcgaggaccggaattacactgtgagttcgctggttctgttcccattcagcacacagtgagcacgaaaaacggagcgatccattagtgtgtgattaattaagtattagctaattttttttaaaaatagattaatttgatttttttaagcagctttcgtatagaaacttttttaaaaaaacacatcgtttatcagtttgaaaagcgtgtgcgtggaaaacaaggaagaagggttgggaaaagggatatccgtgcacatatgagtagaaacacatatggcaaacggatgctatgtgaaattattgatgtgatgggttcataagttgatttcagtttctaactttctatgagcacacaaaatcatgaagaaaatatttagagaaatgaaaatagaagagtagaagaaatccatttgtcaattcaaaagggaatttgtgctgcgtgggctactggttcgtaaaaccgtgaaatttttactgtacgtcacgcatgccacagttgacaagctgcatgtatggcttgttttccgtaggcccatctggcctaggtaaggaattaggaaaaagtacaccgaacgtccctcaactttgtcgtcgagttacatccctcaactaacaaagaccggtcataataggtttttggtagttttgacctcggtggttttattccacgtgatgctaagtcagcatgggaccacatgtcaggctgtcacctcagccaattctctctcttttccccttctctccccccttcatctctatcccttctctcactcagccggcgggaggaggagggcgtcggcggacggacgcggcggcggtgatggcggcaacgggcgacgcggcggcggtggggggaggggcggcgcgcgggcggcggggggaggagcagcgcgcgggctcccccgccggccgccgcccacgagtccgagggagaggagcggcgcccgacggagtgtagttgggcgg

SEQ ID NO: 43221 - DNA, 5166 bp, Oryza sativa
  unsure (1)..(5166): unsure at all n locations
tccgagggagaggagcggcgcccgacggagtgtagttgggcggccccttagtccccgcccccgccgccaacgtggcgctccccttcccgtcccggtctcccctgccgccctcgattcgctcccctccccttcccccgccgaccgccgctcccatccccacccccgccgccgccgctctgaaacgagccggtgttcctgaggatgaaatggctaacctaaaaaggcaactagcgccaggaccttccacagctccaccagctccaagcactgctactgctcctgctaaccggatgatgaactttgtcagtgctggagtgcaggcataggctgagagcagcagcaggcaacaacaggctgctgctgctaacaatgaggatatcgagctgcctgatgagagcgacgaggaggaagacgatgaccaaattgcgaagaagagtgttcccgctgcggtgtttggagagcttggcaacagagctgcagagaacagggaggaggaaagctctggtgcccaggagaatgggcagcttggcgcccttgagaggatcaagcgaaggcgtcaatgatctgccactgtcaagatgcccacagagctggtgcccttgtaacaacttgtaaacatgattttgagtggtgtttttgctcttgtacaagaatttacgggagttattaatccgttattgatctgcgaccattttttcgtgtactaactattgggtacattccccgctttttattctctcttctaggctagaaggcaatcatgcattattcaattctttttcatttttgcgaggaaacattatttgatttcgagagtgtacactgctactggagtgttgaaacctgaaaaatggaactaggagacttcatttctgttactgtctcatgtggtttagcctttcatttgcaaagttattggttgagctacggttttataaaccgagtaatataatgatggtgatatgtaaacaaaactagaaatttcgttaactcggattattcgaagtgaaccaaaatagtgtattcctttgatcacaaaataaccatcacaaaactgtcagaaattttgaacatatatttgcaatttgagctctgaaggtaatgaatagtggaaaagaaaacatgtagtgaagaaggccagaatagaggaaagcatgtacaatttgatcacaaggtctctcattcgtcgatgggccggaacacctcgagcgactcgcgcagcagttcgtcgccaatggtgctcaccaccttagccgcgccgatggccaccggaaacgtgaagccgccggagctcacgacctgagccggagccgggcttcttgccgcggtaagcgcttgcggtggcggcggcgacgacgccaatggcaccacccatctggagcttagtagtagccaccgatgcggcagactaggcgtggccggagagcagcccggagcggctggtccagctcgcctccgacgagcacgccacggtgcgcccgttctggctagccgcgtccacggccatctcctgccgcggctgcctcttgtcacactccttcttgacgacgtcgtcctgcgtgtcgttgacggcgccgcctcctccctctccccagcgttggcgtcggcttggcggtggtggcgaggcgggaggaccgtgtcggcgtcggcgctgggagctagagcggcaggaggcagggacaaactgcgttgcactccagctccagccccggccccgcccgccgccgaacccgatcccctgctgcttctgctgcgttgtcggcggcggcgtgaggatcgtcgacggcagctgcatggcgagacgtggccccaccgccatcggcatcccccgcgtcgagcccagcggcgcgcggtggaggaaaccaccgccagcgactccgctcagcggccggaaagaggcgaagaagaaggcggcggcaacgaggacggcggcgttgcctccccggccgccggaccccccgcgccgcgtggcggcttcgtccccactcgtcggtcgccctgccgcttgccctgagaagagagagaggatgggaaataagagagagatgatgacatggcatcttacatgtggggtccacacgctgactcagccgtcatgtcggataaaaccggggtcaaaaccactgaaggacctcaagcaaacggttttcttagttgagagacgaccggtatccagtatctgattttatggttggaggatgattttataacttgatgacaagttgaggaccttaggtgtactttttccaaggaattaccttaggagacatccaggtggtggcaatgggcagaaggcccatccgacctaggaagaagcggaattttttttatttttagattttttttaatatttacagaaataatctatcggtcaaaaaaattataaaaatagatcctgctgtccaccacttgggcggcaagctgacgtggcaaacgggggagggacaggcggtgacggagggagggttttttgcaggaaaacccttgccgccctctgttggggcggcaaggggtcccaatgcaaaaaagccagccgggaccggccattttccaggcggccccttgccgctctctggtcgggcggcaggcctcgctgcctataaaaggcatgccgcccagcccctagccctcattcctccccccacaaatctagtaaaaaaaagaagaaaggggaggagaagagaagaaggggcgaagccctgccggattcacacgccaatttcaggtaatattcattgatcctatatgtgactattgagttaaatattgtgtattttttaaaactttgtttgaataaatgcattatatttttagggttttagttgtactaatctagaagtgcgtattgtagatatcggtaactacgtagatctgctagtttggaatcagtactttaccgttgcattgtcatacacaaggagatattacgttgtaggtgtttattgcatgaaagaataatatgatctagttatttcgttgacagatatgtcgaacaaacaaatattccaagtttaccatggcccatgaaacgtccgttacgggccaactggggtagatctgtcagaatttattgtatcagaaaggggaattgatagaccggctgagaggagtgtaccttctataaaaggatggttaatgaggggcttgagagttgatccacagacaagtgacataacaatcaatgttatagtaagtcgggcaactgagggtttttattgggaactaatgccagttcaaaactctcgagtgtggagatggtatgtggaaaatgcattgcaacgtgggtggtctctagctatggttccgtttgttcacccgaaggatccaggtgtgcagatgaacatgaatgatggcgagggaccaagtgctgaagtaaatgagacttttgtggaagaggtcaacgcatgagaggacgggggcgtagtacctccagtgggcattcaaccaagtggagtggtcgacgagggggagactgtcggtgccattgtggatgaaatgaagagggaggattctgacaacgagcgtgtagaggaaggtgattcgtcagatgatgagacggataatgaatacgttgttgttatatgtgcacgatacctttcgacgcatgcacgatacctttcggcgcatgcacgactactttctgccgcaccgatgcagcctcctttattcgagtgcgatacgagtatttgcccgccatttgccgcatacgaccaatgtaactttcggcgccaatcaggcgtacccaccatgccccgccacattcacatgtcagggatatcactcgatttttggtgcctatataagtcgccttaacgagcgaggcctcacaatctttcagaactcagtcacattcagtactttcttccccacttgcttcattacaaatcctaccggctttcgtcaatggctagacgcctgggcgttgaggatccgaactggcgtagcgatccttgtgtatacctactaccaccttggtgccagcgtcctctctgcctatgcagtgatcgatgccaactaatggcttcgaggaatcctgatattcgaggaaggtgcttttttaggtgccctaactatgaccgtgaggtattttattatctgcatatgcttattcattccgtatgagcaatcgttttattcttcgtaacactactctattcggcagacccgcactacggcttgcgcatatatcaagtgggtcgatacagaaaatcccgttctcgacctaaccacttgtttacaagaaggtcgctggtatttcgcatccgaaagtactgagcaatacttgcagagaaaagcggcttatgaacgacaatgtcatgaacaacggtgcgactagcgggtgctaactacggcactccctccatgggaagcccgtccaggatgcaggtgtggtgatcgttgtcaagttcttcgttccataaagcctacaatattgggtcgaaggttctttgtttgtccaaatattcttgacgacgatttcatgataagaatattttgattacatgaatccttattttctcacaacatttactaactttgctcgcttcatatctattctttcctcccaggaaccaccaaggagatgtcaatatagagaatggatagacaccagaagggttctaactccacctagccgtgttgtgcagcttgaactaccagagcaatacagggttactaaagcgcggtttgagagaggagagggatcctcacgtaggggttagctattatcggacaacttggcatactgaaatttctactgtcatgcttccttgtcccattactacatcgtcgttgtgttcaactattgcactacctccctcctagttcgaatctaatatcatctatgtaaccgcaatggaaatagttgtatcatgttcaaattgtactactatttcttcatgttacataattctccttgtttaaatccatataatgtttctacgaccgagactgcgataggactatatcaattctccgagtactaatacgtcaaataagttacaaaataatatcttacttaacatatgaaattacgaaacaaccaacttcaatacatttttataacaatattaacaagttttaccaataaatacttctttaattattnnnnnnnnnnnnnnnnnnnnnnnnnnnnnnnnnnnnnnnnnnnnnnnnnnnnnnnnnnnn

SEQ ID NO: 43222 - DNA, 9104 bp, Oryza sativa
attttctcacaacatttactaactttgctcgcttcgtatctattctttcctcccaggaaccaccaaggagatgtcaatatagagaatggatagacaccagaagggttctaactccacctagccgtgttgtgcagcttgaactaccagagcaatacagggttactaaagcgcggtttgagagagagagggatcctcacgtaggggttagctattatcggacaacttggcatactgaaatttctactgtcatgcttccttgtcccattactacatcgtcgttgtgttcaactattgcactacctccctcctagttcgaatctaatatcatctatgtaaccgcaatggaaatagttgtatcatgttcaaattgtactactatttcttcatgttacataattctccttgtttaaatccatataatgtttctacgaccgagactgcgataggactatatcaattctccgagtactaatacgtcaaataagttacaaaataatatcttacttaacatatgaaattacgaaacaaccaacttcaatacatttttataacaatattaacaagttttaccaataaatacttctttaattattattaacataacatagaaaaattatttggcagtactttttgcatctgggtcccttgccgccctctaggggcccaaatgcaaaaagtacgagccccaagctctttatgggctgccaaaattgcatttagccccttgctgcccgggctaaatgcaattttggccgacggcggcagacgacgcggtcgacccgccgtctgccacatcagcttgccgcccacctctggggcggcagggtctatttttgtaattttttttggccgatagattatttctgtaaaaattaaaaaaaatctaaaaatgaaaaaaaattcggtagaggcgaggctccctcgcactgtcgcacaacacatgctcatgcctgatctagcgggcatgtggaatatacgagattgacatgattatggctgacataccaaaatttttgatagaggacgtgcatggcatgcgcttgcgcgcggatagtggatggacgaaattcccaccgacaaccttacgtatattttaagtaggtatagctagataagagaccagctcgagggatgatttcaaaaaatccatctctttccatattcatggaggatgagaacccttttgctgtcgatctcgccgagcacaacgacggcaagctcgttgtcgccaaaagaaagcaactaattaatcagacacggaggcacccaccgaacaccttgatgacgatgacgacgtgctagtgtgtgggtagaaagatttagtttggtggcactctgtgaccaggatgacagacacggtagctggtgttgatggcatcgacatatatatactgacatgctgtaacgacattgtgatgcatggtcttgttggatataggggcattttgcccaaattgtgaagatctaacaagatcagtgtaacacgccagtacccacattcccggagtgctactccttgaaagtctccaccgcacttacggacatccatatgttaggaaacctatgggcttgggcccatgaagtcccagcccatgaatcgaagaaaaggagaagaagcaaaggaaggagaggagcatcgccggccgcgccatggaggctgcgacggcgatgccgtccttaccaactccatgccagatcactgcgcctcgtcggctgcgatatgaaatagtatacaaggaagaacgatgagaaattgggggagggagagtcgatggcaccatcgtccgcccctcgtcggccaccgcaggtcatcccgcgtcgccgccgcacggccgcacccagtcgccgcctgacctcaccgcccccgcgccaccccgcacggcgtcgtgccatgagccgtcggctcgccgcgcctcgcatggacgcatggccgccgacgccgagcccgcgcgcagcccgtgcgccgacgccacctggccgtggcgccgccgaggctagccgccgctccaccatgacgccgccgaggctggccgccgcatcgccgccgccacgccggccgtcggcctcactgcaccgcgccccgacccgtcgccgcacgacaggtccgcgccgtacccctacacgccgccgcgcgccgccgccggacgcgctctgcacgacgccgcccgcacggccgctgccaccgcgccctcgccgccgcgcgccgccgccggacgcgctctgccctgcgccgcccgcacggccgctgccaccgcgccctcgccgccgcgcgccgctgccggacacgccctgcacggcgccgcccgcacggtcgttcccgtcgcgcccccgccaagcagcgcagccgcggccccgcatggcctcgccgcaccgccaccgcagcccggccgccgcgccgctgccaccctaccgcagcccggccgcggagctgcccagaccggccactgccacactgccggttgcaccgttgaccactgtgcgccggcgctgcttggccgccgcgcctcccgcacaaggcaactgcggagtcaacgggaagagaagaaggaaagaggaggagaaaaggaaagaaaaaagaaaaatggaaagattcccgtgattttgcatgaaagcccctgaagttttgggaaactaggtgcatcctcctctgcataggaaatcttgccttttaaacccttaacttttcaggaaactcacaaatagccctctgtatttgggatatttgtttgaatggcattcggaatttgcaaatatcaccggaaatcatattctcgcataaaaagagaccacggacattgacctttgacctcgactttgcatgtgccttttattgctgatgtttatgattatgaaatttatttatcgcatttacgattattgattatttgtgatgcttttattacttttagttaatatcgttgaagttgaattttgtgtaccattatattgcaacacatgtgcattttaccggcatttaatttgcgcatattttttaataacgaaagatgacaggcatcacgaattagaaaatttgcaaaaactagaatatctctgacatatttatttaatgtcgaaattacgatagagcgagaaactctatggtaccattaatctaatcgcgacatgtgcattgactcgatgagtttgatctagcatttcaaatctctcgtcagtgcctccaagctactctcatgaatgagtacgaatgagcgcgttagaagattatggaccctatctctcgtagagcaagtactatgagcaagagtgggtatttttcgactatagttcactgagtaaatgacccagagagtacggtaatacggtgcaccgaatttgcactgaatactgtagaaactcttaatgttctgcccgaacgcaacaaaagtcgcacgcaaacatcactagtgtacatacaaagaagtatgcctaactagtcgataatagaattgcgtaacgtttaggataatgttcactacaagagcattatcttccaaaaccaactagcacagttgataatgaattcaacacgagcagctagcccggtgcacttacctcaatgagaaaagaggacaaggggggagtaaaacacatgtcaaggtgaataatctatgaacatgaaaaagaaaaggacaatcctaatagcacactcatcatgaattgagggggagagctcctagcctattttcatgactatgggcatagaatctcctatgctagataggataagccctgaaatttatgtcagagtgccatagctgttgagcaagaagctcgctatgaagttaattgaatccgatgtaccagaatactttgttgaatcaatacacttcgtcatcaattgttgcaatttttgaatagagcattgcatcgaataaatggttcttgcccaagcagagcacacattttccctgcaatagagaattatttccagtataaaatagcatatttaaggcatttactattttgttgctcctttctagcacatagttataatgctttgaattttgtgtagtgtccaaacataaaagaaaaatgaattgtggtccgcataaccacaaataacactttaagagaaagagttatttccagacccatagaactggaaatattatgactgttgctagcagcaagaactgaatttgtcggcctagaatgcgccacagtcatattacctatggaacaatcatgcactttatagaagcatatattgtccgtcaacccctttgaactctctaaaaagtgtgatgatttgggctacacccttttagcaatggattttcagctattttcggtcttagaattataagaataaatattacaactcgtatggtcatagcacatatatgcataatttttctaaatcatgaagatttgtgtgcaagaatgcaccgacaggagatcaatgcataaactgcatatagttctaacatccttgaaccggattgcgaagaatatatgtggctcccatttggtactatatggataaatgcgcttccgaagcagcaaacatccagtgtctcttagacaccgtgtctttgccaaaactgatccggcaagatcacgtgaactccaatagaactcactaaatcatcttcagaagtccacgaggacaatgctagcattgcatttgatgattgatgaattggcagcacgaagtaccaaatattcgcataagcggactaagtataagctatgaatcacaatatttcctatatcattgttgtaatacctgcagtagaaaaggacatgtagtcctgaaagcagcggacacgtattcagaccatcggcatgaacatccatcctgcaactagtgctatcgcatctgtttggtttatgtgcatatcccactatcataatacgttgcaaaaggctctctccgaaagtcggaaaccttttacggagatagttatgaagcctaaattccttgacaaataagtattatttccagtcatttagggggagagaatgaacccctagataggaaatgtcaggaaatatgatagtagaaagggactaatgcatgttacaccgcactagtgaatgcagtttgcataaagaattaaaactgccaaatcactttgtaaatacttttgtgatttcgaagagtttgactaagttgcatgaatgaaatgcaccggaggagggtgataccaaagaaagtaaaggtacccctcatcttgtctagaagcctcgaacaaagaattggacaagaaacttcggatcctcacacccctaaagtaaccggagacgtctggtgaaaacagggcaaaagggactatcatactcaaagtcacaaaaggtaccctaccaaatagaaggggagccagttgagatctggcaaacggtacggaacctccgaataggcgtaccgcaccttcccatcaaggaagaaaactagctgttggagtgcacactaacgctggtacatgcccacatcaagaagtattaagcaagaagaagaagaagcatatgaaaaatgcatctcctcgtatatccatggatacttgcatagagtctcatgaaaccaatagaagttggtaatgagattgattatgggcaatgtctcctttagacaacaaaactcaatggtagtcaaccaggagttgaataaatgaactagaagttgaaaagaagaactcaacctgaatattaacaagcattgaagatgttgaagatagaatcaatgaatgcatttcaggagtttggattggacacttgcataatagtacatgaagaagtattaggtcccgaaccaacataaaagaatagaataaaccagaaaagaattgaagaaaacaaactcgttcgttttgaatttgaatttgatttgaaatatttgaatccaaatcatgctgacgcttgcagctaaaggcatgcgatagatggaagtctagtacatcagtccaactgcacttagaaatgttcatggtgcatggctttggaatagtcaattatcgccaaaatgggacggaattcctaaacatgagtgtcatagcagcacatgaatacttggctaattgaactaaaccgaactaagcatcattgaactactcagagccttagcatggctttgagagatggttacccgcgacagcaatcgcgatttgaaaactatcttaacccccaccatttatgaaattaaagtagcatatgttgcacatatgagttatgtgagaagcaaactcactaagcatatgagcccccaaactcttctatgtacatgaattgcatagaagcaacgaactaagtcatgtggaagtcttgcagattcatccactaactcattatttacatcttcccttgaataggtgtgcctgagaaatcggaataatgaaacttagagaaatgcaaaattcagggggagaatttcgctaactcatttcagaatcttgatatagaaaatcaagtacccaaaatcaatctagaaagattgaatgaagaattgggtgaattgtactctttttcccttggataagttttcccagcagtttcttatcaaggtttttaatgaggcaatttgtgcaacattgcaagcatatgctatgtactctttttccaaatttttcccactgggtttttgtggagttttaatgaggcatagacatcacgcggtgagtgcccaagggggagtgttaggaaacctatgggcttgggcccatgaaggcccagcccatatacactaattgggcccacaccgaaaccttccatatatggaggaaggctatataaggaggagaggggtgctcatttgtacacacttgtgcttgaggtgaatagaggaatgaatgaaaagagagtctcgcccctacattttgtgtctcctttttgtagaattacgggaccatcttggactacttcgtgtagcaggagggttgcgtaataccataaacatcaacgataatattcaggaaagaccatatggactatcagtctatcacggtagcagaaaacaacttatgataaatctaaacacgatgtgagctagtctaataccaatgcgaaactaagattaattttaggggttgctatatgatgggatgataccaatcacagaatcacatattatatatggtacttcatagatatcaacttgtgcctacactactacaaacccctcataggtagtggcttatagatattgcttcatttacacgtattgacattttttcaccttcgcgtagtgaaaaaatatagaatgggtagatgctggttctaagaaaaaaagtaccaatattatttataccaattttttaaaaaaaaacagacacctataatatactataggtgccattcagttaaaaaactggcaccaaaaatatattatgtctcggttttataaaaaaaataggcactaatataaccgagccgagccatccatagggcagaggtttttttttagcccaagtcaacaatcgttcttatcatttcgcccattttccccttcgctctcaccccttctctcgttttttctcgcccgcacccccttgctcttggtctcaccctgccacccccttcactctccactgtcctcctcgacgtgcagtgtcacccctaccccaaatcgcgtcggcgcgccttagatctagttggacaagcgaggagaacgacacaccagatggtgaggaggttgaggaagttggcgaaggcgaaagcaatgagcacgacggcatcggagcggcaccctacatctcataatataacaacctataaccggatgagacaaatcttagtattacaaaactagatagacactcaaagtttatggtctttaggacattcaaagaatgtgtatttgctataggattaccacgaaaacatagtgaatagctataagaaagtgtgttagggttatggataaggcatacttcctattcttggggtcgtgagatatacggatatgttataccctcaagtatatgggaaggtacctctgaattgaggaaatcggatgatctataaggaaatcgtctctccggatagaaggtgttagagttctattcagagaatataaggatttttgtgatatcgtgtgaggacatgtatctccaagctatacttgaagaacaagataatatacggtataaatagagaatccccagaaggggtaaggcatagaatcttagtgcaagacacccactatagcagaagcaatccagaggacttgaagccaactcgccgataggtctcgtcaagccgttctcgacagggatctcgtcggtgatctcaggattatgttgttctctattatactctatggttttcttcataatcccatataaactggaatagggctattatctcacaaggggtctgaacccgtatattctttgttccctgtgtgcttgatgtcgtatcatgtggatccccatatcaacgtaccccaataccctcagaatacggtcagtgggtaccacccccccccctcgacgccgtgaacgtgttatttttattatctactttttgaaaagacaagtttgtccaaaggagtgagaatggactggatcgatcaggggggagataagggtagggcaattaaggcttgcgctctaggctgatgaccaaattcccattaaaatcttatgcaaaatactgtaaaaagctgaagatataaagagttttgctaagaacacatcaactcagctctgctcggccctagacgtgatcaattgttggctccgccacttagatcgatcatgggagtaagaatcatctagatctggttcgaacaagacccaatcaccttacaaaccgatggacgcatgagcaaattggtactttccacgctatttctttcttcatttatatcggatataaaataatgtgtttgatgttcagcagctaattaccatattttcatggtatcacgtaacacatattccctctatcccaaaatataagcatttttagaatagtgacaagtcaaacatttttaactttgattattaatagaaaaaataaataaaatcaataatgtaaaaatgatgttattagatttatcattaaaaatatatcataatatgcaactctttttatttaaaacatcttacttttatagatattattaattaaaatagtatctttaaaactatgtagaagttaaatat

SEQ ID NO: 43223 - DNA, 21002 bp, Oryza sativa
ggctccgccacttagatcgatcatgggagtaagaatcatctagatctggttcgaacaagacccaatcaccttacaaaccgatggacgcatgagcaaattggtactttccacgctatttctttcttcatttatatcggatataaaataatgtgtttgatgttcagcagctaattaccatattttcatggtatcacgtaacacatattccctctatcccaaaatataagcatttttagaatagtgacaagtcaaacatttttaactttgattattaatagaaaaaataaataaaatcaataatgtaaaaatgatgttattagatttatcattaaaaatatatcataatatgcaactctttttatttaaaacatcttacttttatagatattattaattaaaatagtatctttaaaactatgtagaagttaaatattgtttatattttgggacgaaaggagtaggtgtttttatatcttgcagtaaatatcacggactttaagtgtcttcgcaaatttttccaaagacttataaatcaatactcgtaataaatacagagattacgccagggagctaatcgcgtacaaccgcgcacctacagttgtggccagaaaacgtttcgcgcgcccacgaggcacgtgtttcagttgatactgttggacgtaaacccgtcggcccaacaaccagacaagaaccaatcaaaaccactgcaaaataaagccgattttggtatacgtctcacgacagattttttgcctcaaatcacccgaatttgcttccgtcggatctcttgggcatggtttaatttgacggtcatgatttatccccctaccaccgcggcaccacctagcagtatctttaccgggcacacaatgaacaatacaaataaactgatgagtacgggcaaaaatatgaacaccatggtttaatttacagtgtatttttattaaaattacagtgcatctacatgctatatctactatttttacaaatgtaattttagttataaagcactgtaattttagttataaatgcaacatttaacacttcagatacctggacggtttctcaagcagtgcatttgtactaaaacgacaaatattctagttaccaaaatttacagtgcatttgtacttaaaattacggtgcacttacatgccatatttattgtttttacaaatgtaattttagttataaagcaatgtaattttttgttacaaatgtaacatttaacacttcagatacctggacggtttctcaaacagtgcatttgtactaaaacgacaaatattctagttaccaaaatttacagtgcatttgtattaaaattacagtgcacttacatgccatatctactgtttttacaaatgtaatgttagttataaagcactgtaattttagttataaatacaacatttgtgttaatctctactaaatactactctattaaccaatacaatcacaagctatacctggacggtttctctatatttttttaatggttagatgtaaatataaggagagaaaaaatattttttctcgaaaatcacacgacatatgtctagacagtcccaaataaagcagtagaaagcgccaaacgcctccgaatcagtaccccttccactactactgctcgtgctcgatcggccaaccatggcgtcgggctccaccgatcccctcctcccccgcgccggcgccgcacgccgccgccccgccaccggcggctggaggtccgcgctgttcataatctgtaagcacagctgccaccccagatcgcgtctcctcgatcgaaagctttgcttgaatcgtctccgctggtttttaggggtggaggtggcggagcggttcgcctactacggcgtctcgtccaacctgatcagctacctgaccggccctttcggggagaccaccgcggcggcggcggcggccgtgaacgcgtggtccggcgccgcgtcgatgctgccgctgctcggcgccgccgtcgccgactcgtggctcggccggtaccgcaccatcgtcgcctcctccgtgctctacatcacggtcagttgagtttcagatgctaaccgaacagcaccgtaccctccagccttatccattccgttctcgatctcatcgatgcgttttctttggggattttgttcaacctgctcaattccctccgtacatttgctacttctacattttaacctattgttttatttgttcaacctgctcaattcctccgtacatttcctacttctacagtgatccttgccataatttatcagtttattctaaaaaaatatttattagccatcttgcgcagagttcgatatagtatcaagggttacgcctagtgacctgagtagtattccaaagatcctaagttcaaatcttctatgcagctaattttaaattgggttatttgtggggctaagttttttatttcaatggtcgtatatatctggttggacgtagatgccagttaaaaaatacccttctcttaaaaaaaaaaggatttgagagatctcccacgcaatggcattatccgcacgcggttagttggaagcattttccgtttacgctgcgctgcggatggaaagtgactttacacgcaagtccaagcgaacccgttctgaattgtgatttactgaatttaacaagactttgcgtgcagctgctatcttattacgcccaagtcaaatgggcatggtttttcagttgatattgttgcacgtaaacagcatttcctgacgtcccgggagaagtttcagtttcaattggttaatttaattgtcccttaatttatagcctgggtcgtgtagtttccagtggccggtagtgatcatgctcaacacgttcagtggagtgagaggacgtatcaggcatgtgtttatttgcatactagtctccaaatattgttttctaccaataatagggttgttgctttcaatttagctagtagtctattttcgaaggaacagggtagtagagccagccacatcaataatctttcatgccattgtgtttactgtttagtgataggatcacaccgcgtcttgcagaaaatatttatgtacctgcccattgcaattgaagttcttcagctcagtgtctgtttggaacacattaatttcacatggatcagtgtctgtttagatcccaccctaaaattttacaccctgtcacatcgaacgtttgaacacatgtataaagtattaaatataggataaaaaataactaattgcacaaattgcgactaatttgcaagacaaatctttttagcctaattgctacatgatttgacaatgtacttttacagtaaacatgtgctaatgatgaattaattaggcttaataatttcgtctcgcagtttaccgacattatagatggccatctgggccgcccggcacggcacggcccaagcccggccgtgcctgggccgaggcttgtcgggccggcacggcccgaccgatgcaccgggccgtgccgtgccagcccacgggcggcataaacggcccaggcacggcccaatactagtcgggccgtgccgggccggcccgaaggcacgatgggctattgtgctgcctcacagaaagagtttatatttggtccctcaactctgtgggctgtgtttaaatggctggaaataagtctatttttgatccctcaactctgtgggttgtgtttaaatggctggaaaataagtctattttgtatacctattttcttgggccatgccttatacggttatataagtctattttttgtccctatattttttttatttgatcgggccgtgccgggccggcccaccgtgccgagggtgcagcccaggcacggcccagctatcgggccgggccggcacgggcacgaccctagtcgggccgggccgtgcttgggccgggccaaaattgcgggcttcgtgccaggccgtgggcctcgggccatatggccatctataaccgacatactataattagttttttttattagtgcccaaacaccctatgtgacaccctatataatacctgatgtgatacactaaaactttgcatcccagttcaattcttgtttgaatccggtaaaataccgacgttacaattacggttttgcatgagaaaattcctcggaacaggacctaaatatatttgatctcgcaaactgcgctcacctattcaccatggccaaacaacggcagggactgggcttgctagcgttgtcgtccacgttctcgtcgcctcagagccaacaatgcagctcctccggcgatggccggcaagtttgccggtcttcctccgtgcagagggccttcttctacgtctctctctatttggtggccatcgcccagagcggccacaagccgtgcgtccaggcgttcggcgccgaccagttcgacgcgacggaccccggcgagtcgtcgtcgcggagcaccttcttcaactggtggtacctcgggctctgcgccagcgcgaccgtcacggcggcggtgatgagctacgtgcaggacaacgtcggctggggcctcggcttcggcgtgccgggcatggtgatgctgctcgggctcctggtgttcctgctcgggacgaggacgtaccggttctacgacggcggcggctccggcgcgttctccggcgtcggcgaggccgtcagggcgtggaggaagagccggcggcgaggagaaggcggcggcggcggcggcgccacggttgaggcggagcacggcgagctcgcggaggaggtgagggggatggcgaggctgttcccgatatgggcgacgtgcctgctctacggcgtgctgttcgcgcagccgccgacgctgttcacgaagcaggcggcgacgctggaccggaggatcgggccgtcgtcgtcgttccaggtgccacccgcggcgctgcagagcttccttggcgtcagcatcatcccctgcgtgctgctctacgagcacgtcctggtgcccgcggcgcgcagggccaccggcgtcgccaccgggatcaccatgctgcagcggatcggcgcgggcatcgcgatgtgcgcggtgacgctgctggtcgccgcgctcgtcgagatgaggcggctgagcgcggcgagggacgccgaccccggcgcggcggtgccgatgagcctgtggtggatggtgccgcagtacgtgctgttcggcgcggcggacgtgttcgccatggtcgggatgcaggagttcttctacgaccaggtgcccggcgcgctcaagagcctcggcctcgcgctctacctgagcgtcctcggcgtcggcagcttcatcagcagcttcctcatctcggccatcgacgtcgtcacgaggagggacggcggcaccagctggttcgacgacgacctcaaccggggacatctcgactacttctacctgcttcttgccgcgctcaccgtgctggatcttcttgcttacgtatatttttcgatgtcttatatttacaggagaaaggttgtcgatgttcaatgatccatggatcgatgcacgcaatgcgcttgtatagatgtatattaacctgctgaattcagcatggttataacagtataatggcaatgccaggggtaaaatattggtgtaaaattccctctttacctttattttccttctagttacaaataaagaagtgagaatcgaaattcattgcctgcactcttggtggtccgccctttaaaccgtagtacaagcacatcttctatcccttggattggtccggagataaaaaaaaaccattcagataattatgttgaacaactaatcggcctaatttgaccaatgcatttgtgccctcgccatgtgacagttttagtggtgaaaagttaaaactgcagcgaaccaccaaactaggtgatgattctcgtaaagcatggccatgggcagagcatggtgtcgccacgttcaagcaaataccgaggaacgtgatatagcccgtcttaggggaaaaaagaagtacatatggacaagcaagtccaatggctacaaactaaaaaacacgggcacacaacatgaatcttgattcttggatttgatggcattttcttttctactatctgcgaagtggtgcagcagaatccctcgagttcgtcaatgtcttccctcaagtgtgcttttttaaagttagaacgaacactagcgtggcgcctcctgggagtcatggaccatcggaaaagcctctgaaacattcgtggcaccaatttacttgttactggcatcaaatatgtcctaacatttttatcttgaaactatcttattcccagttcgatgatacgatgaattgctctcgcagcagcaacagaagggatctactagcaggaatgcaggacaacagaagtggtctctgcctctctcaactgagagaacaggatccggcaggaagcataaagcacgaaaagaactcttttggctgaaagctgtgtcccaaacaaattgttcatgggtcaaaagaagtcttaaatcgtggaaagttcagcattagtaagattttaaaaatcgcgtggagactccttcaatcatggcaaagtctcagaaattgatgggataataactgccagtagctcaaggcacacaagcatctgatgttctcgactctcaagccaccacagcataaaacgtgtaaagcactggagctaaacatacactcaaacagggatttggatcctctgatgcctacaaaggcagaggagccggatccctcaaacagacactggagctttatccctttatcccctctcgaaatagtaattcaacaccggataaaaattgccctgatcaaatatactgaagtagtagtagcaccaaaattccatgtccatacaaattctgatccattgcctaacattacgacggatgcagagaagccgtagagcatagcagagcagagctgacctactcgatcactcactcactcaccagtgtgaccagttcactcctcgagctctacgaccggctcgggcagcgtgggcagcacggggtagttgcgcgagaagcaggcgtcgcagtagccctccgcctcggcgccgtagatgctgtggagcttgccgagcgagaggaaggcgagcgagtcgctgccgatctcgcggcggacgccctcgagatccatccggttggagatgagctccccctcgctgggcgtgtcgatgccgtacaggcacgagcccaccaccggcgggctcgcgatccgcatgtgcacctcgcgcgcgccggcgtcgcggagcagccgcacgatcttgctcgaggtggtgccgcgcaccagggagtcgtccaccaccaccacgctcttcccgcggatcacgccgtggaccggtgccagcttgagcttcacggcgaggtcgcggatcgcctgcgtcggctggatgaagctgcggccgctgtagtgccaccggatgaggccctgctggaactccagccccgacgcgcgcgcgaacccgagcgcggcgtagaaccccgagtcgggaaccgggatgaccacgtcggcgcccgcggcgggggactcctccgcgagcgcgcggccgaaggcggtgcggcgctcgtggacggcgtgcgagaagacgacggagtttgggagggcgaagtagatgtgctcgaagacgcaggagcggcgggggcggtgcgggacgaggcacgctgaggagacggacatgtcgcggcggtcgacgacgaccacctccccgggctccacctcgcgctcgtaggtcgcctcgatgaggtccagcgcgcaagtctccgacgcgaacgcgacggtgccgttgcggcggcggccgagcaccagcgggcggaacccgtgcgggtcgcgcacggcgaacatcttatcggccgtcaggaacagcagcgagtaggcccccgcgaggcgctcgcacgcgtcgcagatgcgggacagcagtggccgcgacagcgacgtcgcgatgaggtggaggatgacctccgtgtccgacgaggtgttgaagatggagcccctcgcctccagcttgttccgcagcgcctggtagttgacgaggttgcgttgtgcgcgacggcgacctgcccgaacctgtacccggccaggaacggctgcacgttccgcagcgacgcggcggcgccggcggtggagtacctcacgtgcccgatggcggctggcccggggagcgatgccagccgtgcggggtcaccgaacacgtcggcgacgaggccgagcccggtgaccgacttgagcttcccgtcacccccgacggcgacaatcccggcaccctcctccccgcggtgctgcagcttctgcagcccgaggtagcagagcgacgacgcgtcggggtcccccacgaccccgaccagcccgcactcctcgcgcgggtggtcgtcggactcgtcgtcctcctcgtaggagaacggggtgacccggtcgggcagcagcgccccggccgccggcaaaaggcgcagccggggcagagcgagagaagacggcttggaggaatacctgagctgctgctgctgcttcgacccgtcggcggcggcgtggtggtggtggcggaggaggagaaggcgcgacgttgacgcggcggcggcggcggcggccattggtgagtgggggaaggggagcggcgcgagggattgggggggaatggatgggtttcccctccgagggcgaggtcaaggggcgggatttaaagagggttttgctcgtcgccgtctctccgccgtaggatgcgatgtacggtgctgaatacataccatcggtatccgtatcgtatctcgtacgtgtaccggctgctgttgcgttagaaaaaaaaaaggaattctgagtgcgtagtggccgagctcgaggctcgaggagaatgggccactgatgggtgggccctgctatggtggagtagtagtagccgcctcgagcgctagtggatttgaccaggccgtgtgcaggtcggcatatggcggcggctggtccatttccggtccagggttggggtcccacgtgtgggtactgtgtcggtttcagacttttcagtggacacacacgggtgtgggctgtcatgcgatctcctttttgggctggagttactgtgggctgccatgagacctccttttgggccggagttactgtgggctggataggcggccttgtcggagacagtcacggctcggcccgtcccatttgtttgatggacccgaatactgtcgcatattgctgatttgcagttcccctctggtaaagtgcaagatgacgttgaggaggtggatgcgaagatgcccgtcagcacacaccatcacttttcaccttatcacatcactaaccaccgctaactaaaactctgaaaacacactaaagcatagaaacacataataacactccagtccaaggaatcagtcgttagcacggaggaacaaacaccacgttagcaaatacgggaaaaaaaaccctccagtacagcgaagaagatgaatgacaaaagaaaaaaaaaaggacgcacgagacagcaagatgcagagacgaacacaaagcaccagcaactaataaagcaactactgttaattcatacggagtataccccgaacacgacttgaagagtgacgaccaatcggcattcgagcgaccggctctcacaagtgacaaaaccgggagcaaaaaaaaacaatggaaaaacacaaggcggccacgcgggaggtccatcggccatcgcaattgaagcacggcgatgggggtatctgcaggttgtcccgccccgcagggaggtggggcctacgactacgatgaattgggatctggatcgcggcagaggcggggggagcgcaggaggcggcatgtgagggggcgtgcgtgcgtgcgctgtcgcggtggtggagccgtccgcgagatcgtgccatcggtccttcaccgtggatgctaaccacgctgcatttatatttgctgcgtaaaactcctctctgcttcccggctccctgctacgcgcacccgaccgtgtgattgatattgatactgataagcagtgacatccgtctgtaaaacatacacactccgtcccataaaaaacccaatcttatttacgaacctggacatatacgtgcccaggttaatagctggggtttgtcttttttttttggacatagtagtatttttttcaacaaaatacgtactaacacgtaaaagaaaaacagaatatgtagggtgacaactttcatgtctaccgaaattccaccgagtgtatttaatggtatcgcgtgatctctctttacatgagaacctagccatagtacattctcattttaccgtcatcaccttttctaccctagtgcgtgttgtgcatctaggggtgggcagaataagaccgaaccgaagagaccgagaccgagatcgaaaaattcggtctcaactattgaaagaccgaaatatattcggtttatttggtcatgggccttaattaaccgaattgaccgaaataaccgaattaggctcaatagatctagttggtccaataaacccactaataagaaatcctaggggcaggtgcgtcacagcctcacaggcatcgacgcatcgtttcatccccatccatcctggagcggcgccgtcccgactcccgtctccatcccatccgcatccttcttcgctccatcgtcgggcgccgcttccgcctccaccgccggcgccgcctccagccggcccggcgccgcctctagccagcgtgccttcacctccaccgcctggcatcgcccccagccggcccggcgctggctccaccgccgggcgccgcctccactaattgttgatttgctttgcttttgctgtttttacaaatagttttgttgatttgctttgtttttgctgtttttacggttagttcggtctatgaccaagaccaaaccaaactaaccgaagaccgatttgctcagtcctgagatttgttggagaccgatcggtcttgagattacaaagaccgaattttaaaaagaccgagaaaccgaaccgaatttttcggttagaccaaatacccacccctacgtgcacccgacactattggttcaatggcacacacttccgttaacaaactctatggacaattgtaggttggacatttgaaatgttgagtaaaaattcaagatcaacatatctttaattcaacccaatggcctactccctcaatcccaaaaaaagccaatctcccctcctagtacaacgaatttggatagccctttgtcacatcccctcctaggttgtttttttttttgggatgaacattatttaaaagtctgaactttttttatttaaaagtgttgtggcaggtttgttctaaacaacccggttacctccggcatttccgtccttggtgcccattgtgagtacaccaagcaaaatgtccatgcaaattgaagaataagatactcatttccacctcttcctctcaagttattacacttgtttccccccatttccctccaaccccggacaccccgcacacgtacgaacaggccacaaatcctcaaatatcggacagcgcagggatcgaacgcagaggaaatccaaaatccaaaatccgatcccctcgaaccaaagaattcgaagcgcgcaggcgggcacacgccccaaatgcgccggcggacgacgcgcgccgccgcagaagcagcacggcgccgatgagtcgcgcccctccggacgccgccggcgacctcttcgccgccaacctcaagggctccctcctcgccgtcgcctcctccgcgttcatcggggtcagcttcattgtcaagaagaaggggctccgccgcgccggcgccgccggcccccgcgcaggtccgccggccttatatttttcttggttctcctggtttgcagcctttgggcagcgcctctcgcgttcttttggtttcttgggcgttgttatgaggtcatgtggcgaggaatgtcctaaaggcgccccattttatggccaatctggtgctcttcgtcaacgatgcgctgtaatcattgtttgttcatggtgaatttcaggtgttggaggctatggatacctcttggagcctctctggtgggttggaatgattacaagtaagttcttgctttcttaggttgcttatttcttgaggggctagtgcaaaattattcgaaattcttgataattttttttccgaatttcgtagtgctcattggtgagattgcaaatttcgtggcttacatgttcgcaccggctgttctggttactcccctcggcgctctcagcataattgttaggtacaactgggatgtgttccctttgcttgtaaaatttcctggttagaacccatggtttgaattagttttaatctgtccatgcacatgcgtggtgaatgcgtaatctttgtggagcagtgctgttctagcccatttcatcctgaatgagaagctgcaacggatgggagtgctgggctgcgtgctctgtatagtcggatcaacagtgatcatccttcatgctcctgaagaggagacaccgagctcagtggagcagatttggcacctggcgacacaacctggtatatccttgtagtttccctttgtactttattatcgtcagtcatcacaattgtactttgtattttctgcagcctttctttgctatgtggcctttgcactggtggtctcactgatcttgatggcgcattgtgctccccgctatgggcagaccaacatagcagtgtatataggaatatgctctgtgattggatctctgacggtaagtgatctctatggactatgaaaatgcctttgttgttagcttggtctggtgtttaataggtttgtttatcttatttttgttatgctaggtaatgagcataaaggcagttggtattgcaatcaagcttacaattgagggcataaaccaggctggctatttccaaacttggttatttgcaactgtttcagctatatgcataattatccagttaatttacctgaacaaggtacacctgtagtcattttgtttaggtaacagaaatattgatgttaatttgcatgttcacatcatgataaactttcaggcactggacactttcaataccgcagttgtgtcccccatctattatgcgatgtttacatccctcactattttagcaagtgccataatgttcaaggtatgcaggttttagtaagttccacaaatgccagttagtttaagtccatttactagaacaaaaatttgagaatatgttttatggtttccaggattggtctggacagagtataagcagtattgcttctgagatctgtggatttcttactgtgctttctggtaccgttgtattgcattctacaagagaatatgatcaaactatttctccaggtaattatttctgagttttagtcaatcaatgcttggctattcttatatgagaagatgaatatttgttctgtggtacatcatgctgataatattattcatgcaaacataaataagtggttttcccaaagttgaagttatttagtcactgcagtttgagtttccaatctccttttactagccttgtggtaacaaagctggtgtaagttgtggttgttgagagttggtgctttactttagtattaaaatcactaccaatttgataattcctactgaaaattgtttggtttcttttagcagtgaagttactttaatcaaaagtcaatagtattttgcctcaaggagatagacttcgttctgttaacagtagttgtcataggcttactcattgccttcatagttatggatcaagaaagaaatggcctgtggattgaaaagtattaatcaagcctactatttatggtgtcttggcatatctgtccttttcaactgatttaaggcttgcctctagatagttatacaatgctaggaatccctcactttttttagtgcatgttctttaaaaaaaggaaaagtaacggcaatgggatttctccaagatattactagcacttcacaatgtctatgatattataggttacccaatactgttatcatatatatagagtggtactgtaataatttcctgtttttatttttttactacagacctttatactcctcttcccccaatatactggcatatccaagggaacggtgagacggtgaaacaaaaagaggatgattcactctctgctgacttcatcaccgtggtgcgacaagattactttgtctaaagaatagagaccgtcctgaatgctcggtaatctcctcaatatcgtctttcagcagtgacaagaccaaatcaactgcaaattgtaggattgtaggattagctcgtgcatgatcatgctgcatccaagccaacaccctccaaaggagcatcgaagcagcctggcttttttttgcccatttgcacgaaacaaggtcttctgcttgtttatcaaggtggtgtgacatgatctgttatgtgtatctgttcctttgattcgaggagcaagtttatgaggctgctcttgctagtttgacggatgtttttttggcttttagtttttgaggtttgtctgttgatgcatgtatattgtacagtctaaatgaatgtaagaagctagatctaccctctttcggtgaggttgaaaccattcatgtagcctactagcggttgctcaccatattagcgctgcagagtgtgaaactctgctgttacagttcacattggcatagcattgagagtcttggtatttacttacagtgcacattagctctttaagcttttctgctgctgtcctattcaactcctgacatgtaataattactgttcccgtgcaaatattgctgaaacttgaaatggttattgctgctgtgtgctgtccaggaaaagcacaattttgctcatctattctattatatactaaaagtctattaaacttcctacaaacgctcttaaaccgccacatggcatcctacaaacgctcctaagtcgccacatggcatgctaataaataatagaaattcctagaaattctaagaaaaaaacaaaacatctgtccatccgttttcattaaaatcagtggacccaatgtttcaagccgtcagatttatcttaaaaaaaaaagctttccacctccacctccttcctcccacacgtaacatcactttccctttatatgtagtcacgtataataaatatataacaattgatttacacatgtacaggtgtagaatagattagatcaaatcatattaaagtaattaatccctctcttctaatctcatgtgtatttgcgagagataaataaatatatactattcatccggagaaaatatatgtatgtatatatgcatgtacatgagactattatttggaaaaaaaaaaagaaaacatgcatatgtccgtacataaaaaaaaccatattttcctacaaatactcataaaccaccacgtgtactcctaaaaacacttctaaaccgtcatgtggcactctaattaaccggtggacccactattttagatttttcagctattagatttacaattatatagtggacctgatattatacgtcattagatctatttttcaaaaaaaaagaaaaagaaaatagcatcgatcccctcccatcccgcttaagtacatttccatttacgtgaactccatctgtgtacgccctcccctctgttccttttctctcctattttcatgattttcatgctattttagttagatggaaattagaatttataataatattttttctaaaaaaataaaactaaatcactgtccttttgtagaaacggacgtatgcctcctccttcgtgttccaaggccggtgtccaccctcctttttttatatattatttaaattcaaactagactgaatatttttaaccattaaattattaaattattattattatatcaaatagatttttaaaccttttgattaacaaaatgcactaaaattagaataatttaagtagtttaattagaaaatacagcacccaaagtattttaaattagatctaatattaaatgtatttataaaaatagataactctaaattatagtgcacattcgatctattttaaaaacagtaatctcctcccatcatcctgtctttcgtaataccactctcctcccactctggctcttgcatcctctcctctccaatgcaattatcgtctcttttattttttttctaactaacataatataaaaatagtcataactattattttatttataattaaacattcattagctatattttgctatataaaagttaaaatatatcatttgaaggtggaccctatcgtttgcatgaacactaaataaacacgaaaattaattgaaaatatgtatcgtgttatactaaatcattgtacacaattaaaatcaattaaatgccctcaagagtgttcgtaagtcaccaactacataattaaagcaaccataagctacatatatggaatactcctatgctttttaaatctgtgaaaccattatttctaaccattagatctatcttatatataaaaaaacaagcgtgtattcatggtacatcacattttaaaaatattactgtgtaattatatttcgtcgttatcgtattcatgttaggttgcgtggagcctctcactcactctatatgaaatgaatgttcaatggatcatctctcaaactacatcaatcattttagtctatataaacctgtcccacccaattcatcctttagtacactatgataatatatatgcaactaaaaaaagaaaaccaacttacttttactgacatgttttctaaagaaaataagtctaccttctttccaaatgatgaagaagattataaataattgcttatagatattacttaaatatgatttaacataaagctaataggttataaacttataaaagcaattaatgccatgaaaacaatttatagagaaatcatgagaggtgttctccggttaatatttcacttttataagtatcttaaacttagcgtacgacacatgcccgcgcgaatgcgcgggctaccttcctagttcaaatttaaaacacataagttttctacagtgatgtgcaattgccatggttttattgtagaactccatataatcgtgtgcacagaacactgataaccatttcattctcctcaaatatgaccagataattgttcagaagctttatttaaccctttcattccactcaattaggaacaaaccaatcaaaaaatttacatcaaactgcttatataagtacttgtaacctacaacgttattaccaaatttttttctactacaacttatcaaatcagatgctactctacattgtaccctatgagaatgtgttctatcttgatgcggttcctttcaaggctcctctcgtgtcgtcttccgccatgggcggcacgggaggcaacgacccggccatcccttcaccctcacctccctcctccgcctcgccaccgcccgagtggccaccagcaaagccgcgcggtaacaaggacggcggctacggggcccctctctccttgcgctccggtgaactggggagtcatccagggaggcggcggcgataaccgccagatcctcgccgctccggccggatctggcggggacagggacgacgtcgacggcggtggggatggcgatggcggtggggatggtgatggcggcggggatggcgatggcggtggcggagtttgcggatccggcgacggtgcggcgtccgacagtggaaggatcatgcggcgtcggtggcctgtccatcgcccgatgctgccgcttgtggcgtctgctggcgatggtgatgcaaggaggacagccggattctgctcctctaggtccagatctggcgcgtcctcagtcggaggtcaggtggtgtggagtccggtcgtcgtgcaggtggtgtgaatagtgccgatacctttcggtgtgcagttggcatttgggagcttccgctatggatgctttggttaacagggtctccgaggtgaaaaccttgctccgcttctggtgctagcaacggtgactccctcgagtgccgttctccttctttaaggcgttgcttttggagccctcgtttcaactccacttcaagggaattctccgggtgaaaactttagattcgttaggatcggaagttgccgtcgttctgtcggcgttaccttcttgaaggctttgttttaggagtttcttctctttgttggactactgttctttggttcagtttgtcaatgccgggttttcaccggttttcatgaaattaaccgtgttgttgtaagatttttgggtccagttttccttataaactggatcgactatcttcttctatagtgaaattgcaggagctccctgcatgtcccctcgaaaaaaaagaatgtgtttgaccatgaaaaatctacggaaccctaacttcagacgacccatctacagatatgcaccctgctcaatagagattgcttgcgtccgatctatcgagccccatcaagaacataggcaatggaagcatgcttggctccggcgaaacgaaggacggtccagcgaactctggcgagcgaaacgaagcatgctcatatagtccttttgctcccgccagggcccaagtcttggccttctccttgatcttggtcaccacgtttgccgctaagagttctttgtgcctaaagactctctggttttgttccttcaagacttcccaggccgttaggaggatcagggtacgtaatccttttttcggcacccccttggtggtctctagccctatccaccattcgtgtaccgttgtagctgggccccaactttccggtatgatatgttcacgggaggtccaagccaacaacgttctccaaattctcgtcgtgtaccttcattccatgagaaggtagaagatcgtctctggggtatgcctacaaagcaggcaataggtgttgttcggccatccgtgagttgccagtcagtcagatgtccaattctattttgcaccaccagccaggcaaaaattttacactttttaggtgcccaaggcttccaaatgatcactctatagtttgtactggttgaagttttgtacgccaatgccgccgtgtatttcccgtggtttgtgaggttccaagtgacgtgatctatctcgccgtcggtgagctgcattccttgaattgcattccatacaactgacataatgccactagctgagaggttgaggtcttgtaatggcaaatagttgctttgaagtccatgtgtgtaaatagagccattttttttttgaaaattttgcacagccatagttgacatgaaaaaaacggaaggacgttcaccccagtgcttaaaagagttccccccccccattttattgttgtacagtagaattgtgaatcggagtcagtgcttcattcaacataccattttacatttctttctcaagtatagcatctcaattgataagaaactatttttgacttcaccccagtgcttaaaagagttccccccattttatggttgtacagtagaattgtgaatcggagtcagtgcttcattcaacataccattttacatttctttctcaactgtagcatctcaattgatcagaaactatttttgacttcttttcagtaaataagaaacaaatcagtaggtgaacttacatcaaactgcttacagaaatagtgacattcctgcagttgcagaagtagtaaacaaaaacctactgtccatgcaactgagatgctactgctgaactgcattacaacctgaagactcttttcgaacatatacagaattagggataaaggacttgacaatgtgattgagcacaactgcacaagaaccctattaagtcctaatgatttatctacagacatgaaccctgctcagctcgggagctagctttcctccattgcttgcgtctgatcggttgcatgctagcgagccatcaagaactttgggagaggaagcatgcacggctccggcgcgacgaaggacggtccggcgaacaccgcgtgccgtggcttgctgatctccttgttcgtcgtcagcctcatggtcatggcggcgttgcggtcctcctcgccgtggagcgcgtccgcctgcagccacggcttcttctggatgtcccagcgctcgtcggaggacgcgcggctcgacgacgtacgaccgcacggcgtcgggagcagcgcagggagagcggcggcggccacgaactgcgccgagcgcgccatctctcgcggcgaagcgcgggagccgtgaacgaacgaacgacacagagcccgagcttgcggagaagaaggtgcagttcgttgtgggctcggaatacgacggcccactcggcccagtacgggcccatacaggcccatctaggacgaggagtaaatccacatctcggcggagatccaacggccaggatgggagcaaatatccactacactgttttaattggagcccacccgtttcggctatctcctccactatccccccctcgccatggcagccgcttccttggctccgcccaccgcctccttctcgccggcgccggcgccggggagggttaaggcggcggcgcctttgctctccaggaggcctcccgggcggttccttctcagggtggctagcgaatcctcctcggttcgtagaccactccaagctcccgattgttttacaaccgctgtttccagtggttcttgtcttgtttctggtttccactctgctgcgtggatttggttcctgtgccggcattggggttggttcgatatctactgtgtggataaatccctagctccggggtccggggtcttgtcccgcttccatttaccctttcttttactaatttgcgtctgtttatggcaattcttggtttggagcaaagctcatttgtgagtagtaccatcctgacatttcgctgctttgatcgtcttatgcttgtatgattagatttctggtgacacgctgctgggattgtatgagaaagagaggttaagccactcgctatatgctaacgaagattacgacaaagagatgttctgggacaacttggatgcggatttgcgctactggaccagatccctgcgcccagtgcaggtatatataaggtgtgctttagtggaatttaacaagcatatgtgcggaatcttgtactagctctaatg

SEQ ID NO: 43224 - DNA, 875 bp, Oryza sativa
acaattaatactttatgcatgtgtccaaacatttgatgtgatggattttttaaagtttgaagggaattaaacacatccttagttttaagttacgaagcccacttctttcatatgtggcagcgcgttttgcttttgtcgactaaatctaccatataattcaccaactcattttacttatcattcactcctactcttacattcatcactcaacggttcagatcgtccgtgtaaaatcgaacgatggagatcgatccaacctcccccctcccggaatcgctgattccacctcccacctcctgaatcgcgcacgccccactatctctcttgctctcccagatccacgtctcctctccgcccctaaccacgccgctgccctaatcgccgcctgccgcatgccgccgccttagatcctccgtcgtcaagggcgccggctcgccgtggtctccattgccgccctcatctctcccctgtcgccgcctactgtgagtcctcgacgaaggtgaagcggtggcgcggtgatctccggtgaaatcgacgcgcaacgccgcaattcgtttctgactgaggtggcgcagtggctggagcgaaaggcgcctcgccggcatgacgtggactgcagcggatcttcggcaacatcacagcgccattgctccatcttccatcggcaattgtgctcctcgttggcaagtggcggcttgaacagtagcatggcgctccccggcgaccgatctgtgtggcagctctaacgatctttgtgctcccctgttgtgctgctaatctccattgagatcaggtcaaatttccccaattttgttgtttccaattagagagtttctgtagatatgtttccaattatagcgtcgtcttttgctcat

SEQ ID NO: 43225 - DNA, 789 bp, Oryza sativa; identical to SEQ ID NO: 41058

SEQ ID NO: 43226 - DNA, 1753 bp, Oryza sativa
  unsure (1)..(1753): unsure at all n locations
nnnnnnnnnnnnnnnnnnnnnnnnnnnnnnnnnnnnnnnnnnnnnnnnnnnnnnnnnnnnccttgtttagttacaaactttttcttcaaacttccaacttttatatcacatcaaaacttttctacacatataaacttctaactttttcatcacatcgttccaatttcaaccaaacttctaattttggcgtgaactaaacacacccttactttgttataaatacccaccactctacttggtttgaacacacggttcaaaattttcaatgatggaaagttataaagaccatcagtttggcattccatcctgtaatttatttatttttcaaatgcccaccactccacttagttttgatgtaacaaccacccagtgcgcactggcttaaccaaatcagctattattgctactgtagaggtacccccagactaagctagctgagtcaatcttatcgaggtacttgtatttgatttattctttatatttcatcgatttttttaccgtacatagcaaaaataagtgcgacattgtttaatctctcatcaacaattttatttatggaatctcaaaaaaaaataaagtcaagattatactcctaagggtgtgtttagataatgggaaataaaggggagattgggattagaaaataaatgaagggttaggattaaatggaagagagagaatgaatggttatgatttaaagatgtcttttggtgagtgggaaatcatttccttatcccattagccaaacagtacctaaaagtatttaggttgttttctcttggggtaggaaactttccccagctcataaacggagtggtagattagcatatgattaattaagtattagcttgaaaacttaaaaagtgatttaatgaaaacttgaaaagcaactttcttatacgattttttttggtaaaaaaatgtatcatttattagttcggaaagcgtgtgcatggataatgagggagtagaatttaggaaagtgtagtgccgaacacagccttagctttgattaagatcacgttaactgctcacaatttatgaaaacaaattgattcggttaaatatgtgtatattagggaggtttttgcaacaaatgatttatgtgggggaacgtaaaacttcaagtaattttatggggtgagttttgcaaattttcctctaaagaattagtagatatatgatctaggagacatttccctattttctccatcccaaagtatagctatctttagaggtatatatggagattaagaaaacaagtatagtgaagtggtacatggttgtgattggttgagatggtaaaaggtagctttggacaaatttaaattgtaaaaaacaattgtatttaaagatggagggagtagattcataataatattggtcctatgtggtgaacttgagaacttgatattataagaagtagcagatgagaattaaaaatgctgagtttgttagcttttggtttcatagtttattttactgtgtggagcggagtggttcggattttaaagcaatggtttactagtgtgaagatatgggtaaaacagttgtgcttgcaagactatgatcattcctactactcctatattctattgactggcgatcgaaatcaaagaaattcttggaattagattaggcctggtaagatccattgaaatcaatggtggcacactggcgataccggtcctcttttttcctcactcgatagatttcacacgaaaactccagtcctaatctaatttcaacagac

SEQ ID NO: 43227 - DNA, 2063 bp, Oryza sativa; identical to SEQ ID NO: 41059
  unsure (1)..(2063): unsure at all n locations

SEQ ID NO: 43228 - DNA, 3901 bp, Oryza sativa
  unsure (1)..(3901): unsure at all n locations
tcctaatccaacaaacttgccaccggaatgaaaaccatccgactggccaaagtcctctatgcgttagctaaagttggccaaccaaaatgacaaagttgtcttaccacgcatgggccccacacattttcccctttctcctttcctgtatgtattgtctttccatcccagatcgagcaccctccctgcgctcttagatcgagcacgaggccaccacccccttcccagatctagtgtgcgattgagcgcacggccatcgcccccttcctagatccaacgcatgaccctattgcgcgccgccaccggcgtctatctgctacgccccttgtccatcgccgcgccatcgtccactgttgtggccgccgccatccccagactgaaagttgttggccccggatcaagcgctcgatgctaccgtcgtctctccggtttccaccgtcatcaagagccctgccatcgtcgcccaatccacaccgactcctacagcctacaggttaataccctcttccacaaaaatagccaattttgttggagatgctcttattagagcaagtaatatgctatctaaactaatatggtaaggtggaggggagaagaaaagagagagtaggagttacaacttaacttacatggataaaattaggggtggcatttgcctcttctataaaacttgctcatagacagaaatttttgttaggctcttcaaccaaccgaaattaatttggttataattcggttagcactctcgattaattgacattaggaaatagacctaattatgtatcttgatcggtgttaagttgtaagttaaatctagtcaaaagccatgtgtgttgctgcggcactataggatgaacatatggaaaaatattaattatgctccacaacactcaatattgtacactaaatgaaaaaacatactccgtaccaaagaaacaaaattgattgtggataacaaatctgtgatctatataacccatgttcttcgttagggctagctgattcttgtcctttcatatatccttttcatatccacatcattacagattaaacaaaaaattccctgtcaaagtttagtgcattagccattaatgcggtaaaaggcaaactaccataataatatcgttgaccgttgtaaacatgtaagaatggttgaaaaatatagtaaattcanaattaaaatgaattgcatgggacagacccaaatgttcgtaccaaaatgtaaacctacttgatagagtgtgttgcacttaagcaaaatgagtaaccgcacaaaataaaatcaagcaaccaatttgccaaagaaaaacacccacgagcaatctcaaatggggagaaaaacagaacatctttaaaatctgagactaactcaccaaatcaatggtatcgtgtgatcgaattgatgcatatataatataaaagtcagacaaagaacacatgtactacaattgaagggaaagcggagggcaatatgtggtttgaagtgagaagtttatgcaatagtctaactatttttatagtctaagagatagaaaaagtaactgcaatctttgaagatcacttaatgaccagaagtattacataggggaaagaaggcagtttcagaagaggaaagaaggcagtttcaggagatcaattgatcatctgttgtaatggttgcatgcatgcatgacaatagaagaggaaccggccggtgtaaagaagtgtagatgggctaggcttggtctaacattaacagaagatcaaatatggctggttgctacttggtgattaggagctaatctagacacacaagttagatccaacggttagcataaagtaagatgatgtggctgcaccatagaacaaaaaattggtactattgattacaccagagaacaaagaattggtattgattacagttagtggggatcaattgtttaagtatactagattactatgattgatgctcttgatgagttgatgtgttatatgtgctatttaattgtcaacatatatgttctgcagagagaaaagttgctacaattttactaccacacatttcggttatgactaaagaccggaccgaaccaaccaaaacataactattcattcttgagttttttaaaaatgtaatttgatattgagttttaaatgactgaatttccttaaacatgtcatatacttgcgtgctatactccttttcctaacttatgtttcctcgtttttcgtgtgcacatttttcaaattgctaaactattaaaaaaattaggaaagttgctttaaaaaatcatattcatctattttcaagtttgtttagataattaaacttgggcttatgagtccttctgttttgttggaggattagttaccaaaatgcaatgccagacattgcctaaggtttgcgttcggaactacaagttttcatcttctaatatctcattttccgtagcacgttttccgaactactgaacaatgcaacttttttgcaaaataaaaacttaagtgaaattgtttttgaaaacttatattaatccggtttcaagtttatttaagttaaaacttagttaatcatgtgctaatgagccacctcattttccgtgtatgaaagagaagttcccaaccttttctctcgaacgcagccttaagtggtgctcgaccccatatcttcttttcttgcctcgcacgggaacatatgaacaatttgtatgataaaagcatgttagcaaaattttgtaataatatcgtgattatattgttttagcttaacacacataaaaaatggatctttgggagaggacctactcaaaattgtgctaattggtcattgacacaatccccatattcttattctcaagagtaaataggcacacctatcacaaaactactggctaagcattttttacataaaaccctaccgttgggggcatgttgtatcctacaacccatatttctttgctctcctcctgccaccggttacatgacctcattccctatttccacaatgaggatgcacttctctgtgctctccgcatcgtcgctaggcgtgaagtattggcgccaacctagcatatttcctgtcatttctctgccctagcccaacagcgcagtacgtgatttaatcgatgcctaatgaatgatcaaggagacctatatgaaaggagaagagaagcctgttctgaacttcgcagcaggtaataattctnttcccccacttatttaatgcagatttggctatcttaacaacccataattgtctatatggatgatggatttgaaatttcccctctaattgcaagtactatgctataaaagtacttattatttatgttacgtagcatccactaagctatatactctgaagacatccaaataatctaccatatcttaccatcctaaaaaattggtgattttctagaaacttttgcacataccaatatataagaatatttggcattggtagcaaaccaagtaaaacccacacacttcaatcctaccaaattttggtgttgaaaggttaattctagcatcaaactgaacaaacccttaatcttttaagttgtactctctatggtcataaatatttgatggtacgaagatatcatcaaagttttgaaatttggccatcaattcatattacatctaataatttttaatgttatttaatattttttaatataatatgcttataccattttttttaagaactatgcactttgagaagttattgataacataagccttaaaagttcgccctaacctattctaaatatcaaatattttattatcactaaagagaataatatgtaattataataattttcattatttactcaattaataaacaatatgaaaacaaattctattacttaccatttctggccctattgtcccatatttccgtaacacaattttaccggtataa

SEQ ID NO: 43229 - DNA, 1850 bp, Oryza sativa; identical to SEQ ID NO: 41060

SEQ ID NO: 43230 - DNA, 1767 bp, Oryza sativa
atctacaatccgattacgccgttttattcattttcacccttcaatttaaatctttataagcatgaccatattatgagaacaattgataatattgttaattgaaacatttttatatactatatgaaacatcggggtgtaacgattgaaacatcacttaatatttactgaaacatccaaataatacaaggtgcaacattaacaaatgaatcaacaaaatatcaaaataagtcacatccacataacaccacgtacaacaatagataaaaattgattataacatgaaaaattaaaaatgtccaacatatttggattccaactaaaacattcaatgtgcaacatatttggattccaactgaaagattctcttttcttttcacacgtgaaacatcgaatttgaacggtcgaaacatatatattattttgacgatataatcatgttagatcttgttatgaagtttaattgtaattagtacgatggtataaatagattcaagaaaagatgagtaatttaaaagaaaaaaagtatttaaaacttggtaataaaactttatcctttattacacataaggcacatggtaggttgcacgtgtgagcagaagcacacactaggctgtaggtgtgaagagaaaaaaatagaacacataaagtataagtagcatccgattttttccacaataaagtatagtagtagaccgatttaaagtattttcggtattctcattgaccgttttaacgtattatgtaatatagtagtatgtagtatcactattggcaatgagatctagtgggtgagtcaactatatgacacttccattcacacttcctccccatatatgagcgtttgacaggagataagaggattgagaccattaacgcatgattagtgtgagtattaactattttaaaatttaaaaatagattaatattattttttaaagtaacttggctatagattttttttcaaaaaaatacacggtttagtatattgggaaacgtgtgcgtggaaaacgagatgttctctctcaatcttccaggtctcccaggaacgaacaaagcataatgctcaagtgaatcatctgctcgtgtcaagccgtccgcggtttagtcgctacagtcataattcagaatttgttctttatttttttttaaaaaaagaaggtaagaagtttgccttatactagctctgtattaattattttaatagtagatgacaacgttggtttgaaaaataatgtttggctgttcgttttattaaaaaatataaatacggtaaagtgtaaatcatatttaaaagtttatttaatgataaaatatgtcacaacaaaataagagatatttatataaatattttgaatacggcaaatggtaaaactggcgaaagtcaattatgttgtctagtttcttaatataaactggcgaaagtaacatttgattatttgttttattaaaaaattaatataaatatgctaaagtgtaaagtttatttaatgataaaacacgtcacaacaaaataagtggtatttatatattttgaatacggcgaatgttatggcgatgccaatgatgtcatctatcaaagagacgtagaggatatatatcgatgaagaagatattctgaccagaattaccggaaatggaaggaaaaaagggccaattgcatatttgccactagtttgaaccggtatcgtggatttgccactgtaaaaagtgtaattgcatatttgccatcaaaaagggttggaattcaatatacttgctattggactg

SEQ ID NO: 43231 - DNA, 2313 bp, Oryza sativa
  unsure (1)..(2313): unsure at all n locations
nnnnnnnnnnnnnnnnnnnnnnnnnnnnnnnnnnnnnnnnnnnnnnnnnnnnatgatttttatacaggttcgggcccctgtattgtcaggtaataaccctatatcctgttggccgaagccggtattgctcttattcaccataatcacaccagtacaatatttggggtagcctatctaactgttgtcgacatagcggtctgaaggtctgactcgtagtcgacaacagggtagccttcctcctcgagttcgtgcccggcgagatcagagacagcgcaatgtctctcctatcagtatccggagacaccgtaggggactagccgtgcctatccctgaagtcgatatccggcgtcttgtcttgacgtatgttggcttctgttgttctgtagattgtggtgggtgttgattgtctatgttgatcgtctccccctcctagggggccttatatttatacccataggtgtccccttgtctaagtaaaattagggaaaccaatatggatacaatccgagtagtccttgtagtttacatgtagaactctggttgtctttccttatccggaactcctcctatattcgcaggttatttccgtataggacatggtatgtggtgggtcctgccgagatttagtcaactactattaggtatgtggtatccataatcctgacagtagcccccgacttcaatgcaaatgaacgaattcatattctcaaccacgcgcagactttggagtaactgttatcgagctcatgtgaccgttctcgatgagttcagagataacgttagacttcctttatcaacctcgtgcgggcacctaaagggtttgtctgagtcaatctctgatgtcaactaagaaagtagagagcatacgactaagtctcccgtcttgctgtaatcgagaatttggattgaagtcaagaaattttatctcggcgggtacaccatctcttcattccgtactccttgtcgagatccaccaaccgttctcgagtaatcgagtaggcgtagagtctgcgacggagccttgtcaacatttgtcgtactcgccttagtcaatcttggtgtagaaccatagagacatggagtcttcgataatgtcgaatagaattttccaatgttttgtatatgagcgtctaccgacttcgatcagtcagtttgttaagttatacactctccctagcccccagccttgtcatcggagaatcgttctcggataatgaggctcttggacctttgacctgcctcggttgaacaagcactgatcctagcccccagccatgaagttggaaaatctatttccgattacacggcttggttaatacgcacggcgagaactcttacacgactagatcttacatggtctttcgtctctgaagaatccgacaaggccttatccgctctgggcgtccccaaccaaagttcccttaggttcctcggaggccttgtcaggacgacgtaaagggacattaggataggtttcaacgctaggtgtctttgtggtaagggatctctgggtaaaacacttggcgatactgtgcacctgatatcaactttgttgaagtagaggtaatgggagaatcgctacacctctggtcaagaaccaggtagtagtcgtaactcaaccactagaagtaaatgtacgagagatcgctccgattgactagttgagaaccagtgagtaggtatctctcgatcatttgaagtcgtagtacgaggaccgttgcgttattgctgtagtcatacctcgaccatctgaggttgcaccaatggaagcgttagagttggtttattacatgtgcatctcatgtggccagcatgactcacacacccaactagtagcatatccggatgtccgttcgcaatcatgtcgggtgatcaaaccgacaacgttcacaaggaattatccgttaacaactttttctcaaatagtccagccatggccggtgctatgagataggtcatcggtcttcgttggtaggttgggcacgacgactctgcatttgtcgagatcgtcctcgataatgcggtgtacttgaccacaacctactcgagtgctcaattgttcctgcaaaatattttctagaagacaagatatatagcagataatatcgagtatgtactcaaaaaactgcatggatcttctagcattatcaggatataacgagcagattaaatatcagggcattatgtaaaccgtaaataagcatgatatatacataggaaaatagagcgagcccccagcattaaaccgttgtcgatttaacatcggggacacttgcacaatatatattgtataaaaaacatgctttaggtaat

SEQ ID NO: 43232 - DNA, 907 bp, Oryza sativa
acgtttgatgtcgcgattccggtatttgcatagtatggggatcgttggtgctagggtatacgcgagactcaggtaaaagagacggagacgatgatttttatacaggttcgggcccgtgaattgtcaggtaataaccctatatcctgttgcccgaagccggtattgctcttattcaccataatcacaccagtacaatatttggggtagcctatctaactgttgtcgacatgacggtctgaaggtctgactggtagtcaacaacagggtagccttcctcctcgagttcgtgcccggcgagatcagagacagcgcaatgtctttcctatcaatatccagagacaccgtaggggactagccgtgcctatccctgaagtcgatatccggcgtcttgtcttggcgtatgttggcttctgttgttccgtagattgtggagggtgttgattgtctctgttgattgtctcccctcctcctagagggggccttatatttatacccataggtgtcctcttgtccaagtataactagggaaaccaatatggatacaatccgagtagttcttgtcgtttccatgtagaactctggttgtctttccttatccggaactcctcctatattcgcaggttatttccgtataggacatggtatgtggtgggtcctgtcgagatttagtcaacaatacttattgtcattttttacaaagctctgtttttttatatttggttagcatgcaaaggataggtgtgtatgctcaaattgtgtatttctttatttttgtaaagtgaaatatgagtgatatggatcttgaattatttatttaattataaataaaataacaattcaaataaactaaaaatcaaatataacataagaatcataattatttagctttccaattattgatcatttt

SEQ ID NO: 43233 - DNA, 836 bp, Oryza sativa; identical to SEQ ID NO: 41061
  unsure (1)..(836): unsure at all n locations

SEQ ID NO: 43234 - DNA, 911 bp, Oryza sativa; identical to SEQ ID NO: 41062

SEQ ID NO: 43235 - DNA, 3533 bp, Oryza sativa; identical to SEQ ID NO: 41063
  unsure (1)..(3533): unsure at all n locations

SEQ ID NO: 43236 - DNA, 3640 bp, Oryza sativa
cattttctctcccatctcttagatataagatatagattttatctcaatttatgttaacatgattttaagcagttaaacatcatatttcgtagaagatgttgttttaaaatattagataattatattttttaagtttaaaataattataacttaatcaataatatgctaatggttttttcgttttacgtgtccatatagggtcgaagcaggccacaagtatccagagattctagaggaggaggcaggaaagcggaaaagtgagtttttaggccggctcctcgtccgtctcgatccgttgcatggaagaatggcatcctaagccttctaattcgatgcattgttgcatggcatcatttggcctgagatttgtgtgtttgctgccatgtgtggtgatgtcgctgtcgttttcgacgaggccacgttgcatgtgaagaggtagtgaagctcaagctgaagggttcttggtttgtttggctggctggtgttatgggtttgttggaattgtgccatgttttgggtactgtttttcttgcaagcgaagttggagagctggattgataggtgaaatacttaaagaactgtggccctgaggtatcagtcctgctagtttcttcagattcagaaacaattctcctctgctactgttcaaatgtgaataaatgtggtagaaacaagaagattatattacctgccagcaccaaatgagatggcccatgatggtgtcctctctttcaattcaccaagagatgtttagagacctgaggccttgtttagttcgcaaaaagaaaacttatagacgtcacatcagacgtttaaccggatatcggaaggggttttcggacacgaatgaaaaaactaatttcataactcgcctggaaaccgcgagacgaatttattaagtataattaatccgtcatttacacatgttggaaggggttttcggacacgaatgaaaaaactaatttcataactcgtctggaaaccgtgagatgaatttattaagtctaattaatctgtcatttacacatgtaggttactgtagcacttatggctaatcatgggctaattaggtttaaaagattcgtctcgtgattttctatggaaactgtgcaattattattttttaatctatattcagggcttcatgtatgtgtccaaagattcgatgtgatgtttttggaaaaaaaaaatttaaaactggcctgagtattgatttttagttgctgaatgaccacacatcatcaggacatctctacccaacaatgtaggtagtaaacaaatactatcaaagctgtttggtcaggtaaatcattaggttggttaagtctccattacacataactgaacttgttgattgattggtgatgcagctgaacagtcaggtcatcactagcctactaccacccacgtcctaaaatacaaacattcttagatgagcacggatgttaaaaaaaatacgtagaaatgattagagaaacaatataattggttgaaaagaaaaaaaatagataaaaacaattaaatggctaatggttatgatttatcgagagaagaagtaaataaaagaaatagctctattttaaaatagcacactgtactacaataactatattttgagataactatatgcgtttagtttccccctattcctaacttttcatcacatcatatcacataaaaactttcctacaaacataaactttcacaaatttttttaaactctcaactttcttcgaacttccaaccttttttagaaactaaacacacccgaaatgaaccaacaggttattgagacatttgtcagttgggtctacggttaggcacacctccaggatcactgcatctgtagttgcattattgaagctgcagggaacagtgtgtgtgcgtcagtggtcacacaggcaggagaaagcgtgggaacggatacatgtagcacaccatacggccggccccaatattagagggacttgtgcctctgccaactgacgtgtgggctcacgagggtgggtcccacgtgccagtgacacatgtccatctttactctacgtcggaggaactgcttcccaatacggccatgcattttggttggtctcttcaggaaatggagcattgctatatgtttgtaagttgcctgctggtcctgctattggcattgtgaagacactgttttagacatttcctttttcttgctcatagatctgatctggggtttatggtgagttggtgacagtacatacaaaccaaaaaaaaacaagaagaagaaatacatggataaaggttttaacattatcaaatttcggtagggtaaaagaactacccgacctcgacgaagtgtaacacattgtgaggcgctaactgttgccgacatgtgctcgaaatcttcactgatctaagttcaattatttgctttgatattgacctttttggcggaaaacaaaaaggttagaggcagagggtacaaatctataaaagcgagtactactgattagcgacgaaattcagaaaaacaagagtcttagagcacccacaatgataaattaaagtgctctctataaaatatatacatctcagcaatagactagattaatagtaaaccacctcaatagtatgtctacatgggtatctataactctctaatgtattgtctcgtttttctctatagactatctccaggttagtagatagctttgttctctctcttcatttaatctcttccaagtagaaaaatatgctgatatgaatctcttgtagagagcctataaataaccattacgggtgaccttatcaattatcaccctactctgtgtactccaaatcggcaggtactgatcaccgtgatctctgggaaatgaaatttgacaacatgtaaccctataaccactaaccttttgccttttggttgcacggctctaggcctttttgacaatgctagggaaattttaatgcagagttatggcagcattatgggcttgattagttggtgttaattcgtctttgttgttctgtccaagttgttcttgcataaggtagttgaggaatgaggattggaatgaggaacaatttggccaagcaaaaagcttctgatgactttttttttctttttctctgcttttatattttggagcgtctctgttactactactgtaccatggcagtacattgaagtgacacactctctctctcagacagacaggtgatgtaccttgacagtgtaatgacacgcggtaagtgactttgttgactgtaattttttcctccgtgagttaatagcacctttaggccatgtcgaaactgacatactgaattctaagagcgttcacagagcgtcacccactttcactgttcctcaaataccacctagattaggaacactattagccacacccttcgcagtgcaggtttattgtcgagggtcccaccatctctctcaagttccttcttttcgcctccgccaggggtcccaccatctctctccttccttcttttcgcccctcttttcgccttcccctagccgaggaagcgaggctaacgtagcgacgctggtaccggcaacgggcagcggcgcacgagcagaagatgacaggagctcggcagcgctgtaggtatcggcggcggcgcagcccaagcggcgccagcgatg

SEQ ID NO: 43237 - DNA, 1137 bp, Oryza sativa
  unsure (1)..(1137): unsure at all n locations
nnnnnnnnnnnnnnnnnnnnnnnnnnnnnnnnnnnnnnaaacagtgtgtaaagaagataaggcagagagaggagtaggggctaatggattgggctatcgcaacgtgttcgcggtctacgaacacccgccattagacttacctttattgaaaccatgggatactagcaaacactaaataccattaattactataagtacgtaaaacatcttgctttagagcgttttgacgaactgtcagaaacattttggcggcttatcagttgggcccatttgtctgtctcagttggtaaaagtactcccgtaatagtgtctgtactttgtactggtccacagtaatagcattcattgtagttgtagttcacacatggagcttcagaccaaaaaaaaaatagtttacaagaattaaataagtctcgtcttatgaagtgctgtaattcgggcgccaatgcagaagttataaagcagacatagaaaaaaattgcaattatttcattgaaaataaagatttgcaatcttttggaactcgaaacggaaaggaccatttaaaatttggacttcaaatgggtggtaggagtagaacgttttgacctttgaacgacgaagtcttgtcgtgaagggattgcgtacaagagcttcgtggcctttgagctacgcaattcctactgctgaatgaaggcaaacctcgaagtcctgaacaagagcaaaggaaaaccaaaatcagttactctgatgtctaaaatagtaatccctccggccatgaaaataagacgtatttaatttattttatttcgtttggacgagacgtggaccaattataaaaaacataatcttaaataattctaaataatgacattatttttatgcaacaaaaattatgtccatttaaagtaattattaatcaaagcctaatcgtaacaatgttttaaatagcggaataagacattcagcggttagttttctcaaacagatatagcagcttaattgtacatgagagcaaatagctagaaccatttacaaatggctatagccggagagattgtaacaacacaaaatacacctctataattttcaacggnnnnnnnnnnnnnnnnnnnnnnnnnnnnnnnnnnnnnnnnnnnnnnnnnnnnnnnnnnnnnn

SEQ ID NO: 43238 - DNA, 1006 bp, Oryza sativa
  unsure (1)..(1006): unsure at all n locations
nnnnnnnnnnnnnnnnnnnnnnnnnnnnnnnnnnnnnnnnnnnnnnnnnnnnnnnttaacccaaatttccagactattttgcgtattaaatccctgtccaggaccagccagggtacacaaaacgacaagtaatatacagttccaaacgtaaaataagcgtaaaatacttacagaagaggcacttagtcctcacaccgaaacaaaagcagcagcagcggaaaaaaaaacgatcctagcggggcttcagctccactccacaggccaaactcaactggggtctgagccttggtcctctaactccatcttcagctcagaagcactacacttctgaaaagggggaataatagcaaggctgagtacaaccaccgtactcagcaagccacaccaacgatgcagacgtgcaaggggatacaaggatggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattaggtcgatttattaagtgtgagactaatcacggtgaatctggtcgaccgcccataaccgtgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcagacaacgggcagcccccctttcgtgccgcggtgaatccggaagccgatcaaccggacaccccggccgacccaactccatcacgcccaccctcgcctgggtacgtcgactagagaaaagctacactacaagcccagccgttgcccacgctggcttgtggtaagtacgatagggtaccgagctcg

SEQ ID NO: 43239 - DNA, 734 bp, Oryza sativa
ggcggcaaccgccggtggcgtgggcggcatcgtggggtgtgggtggcgggttccggaggggagaggtgggggaaaacggcgcggacgtgggcggcgaggtcccacggacgagcgcgcgcgcggggggtggaggaggtgggcggaaacggccgcgtcgtggggcggctcgggcggccatggcggcagttggagctggaggaaggggatgacaggtggggtccacgggtcccacctgtcggggagagagggagggagagctggatgggggacgtaaaacagacttcgcgagggagaggggaaacgggccgacggcccaagagatggggagggaggccggccgggagagggagagagagggcgcgggccgcgggaggggaaaagatcttgggccgaaagcggcccaaagacaaagaggggaaaattttatttgttttctttttattttaattgattaaatgaactttgtgctattaaaattatttcttgagctccgaaaattcacgggaaatttcagagagtattttagggcacaaagaatattacaaaatattcccggccaatgatttttaaagaaaattttaatttcctctataattcacttgattaagttgatttaacttttatttaatttctagaaaatgtattattaattgatttttaatcccgaacaaaaatcggggcgttacaccttaagagggggtcggggaagccccacccttggcatgggagggggc

SEQ ID NO: 43240 - DNA, 2051 bp, Oryza sativa
  unsure (1)..(2051): unsure at all n locations
nnnnnnnnnnnnnnnnnnnnnnnnnnnnnnnnnnnnnnnnnnnnnnnnnnnnnnnncacttcagtccttcacgctgtttttcttcccttttcttttgaacgaacatgcttaccgctgcgtgaagaggccatgcaccagtactgcggactgcggtacatattgcagaaaaggccgtggggcgccagggccaggcccaggcccaaggtcgcacagtctagctagatgcaaagcccatcccgcacacgcacgcaggcaaacgtttacgttttttttcccgatctctttcgatgcgaatacttcacccatcacacatggcagtttttgagtgagctctaactaaatttgtagggtgccacgcgcctaatgaaaaacaagagcctagacccagaaatcggtatcagagatttactttcattgcagtgattttgttgcagctagcgttcgcattttttgttgttgcagctagaagcacctaaactagccacccagtcccgcttcgcgcgaccctgagcgctggcataaccagcatataggagttgacgactgatcttgataattacaggataatttttgtgagactattctctctgttttcaaatataaggatttttatattgtttaagaaagattatgttcgatcatataaaactttatatccctttaccgagaaatgataggagttgagaaaatagtcgagagtaagatattttttctttaatgggaggttagattgaaggtaagttattatataaatccttatatttttgaataaattttaaacatttgtgatgcttatatttgtagatagagagtagatacctttatgtttttttgaagggattaaggagagggcaataaaattaaatgggagggttgtgttttatttttgtttttgatagaaactgtgaaggttatggttgattaagataaagaagtatatgatgaaattaaatagaaaatggttgtagttggttgagatgaaggaatatgtgaagtaggataaattatatatattaaaggtagctatattttgagatgaagggagtagggccttgtttaactggggaaaatttttgggtttggttgtcacatcggatataccgacacacatttgaagtattaaacgtagagattccgctcggaaactgcgagacgaatttattaagcctaattaatccatcaatagcaaatgtttactgttgaatcatattgtcaaatcatggcagaataagacttaaaagattcatctcgcaatttacacgtaatttgtgtaattggttttttttgcctacatttaataatccatgcatgtgtccaatttattcgatatggtagcataaaattttttatttttgaactaaacaaggcctaatagaattggcactacggtggatggatttctgtagttgcgggtcaatgagacgagctgctggtgctctccatctatactaggtttgctttcactactaccatatgaaactatatgtatatacaccgatcgatgcataggacctattaatctggaactttcctgatgtgtgattggtataacacaaatggatccaaacgccnanntttattctactctcatcctagggggctatatattcacatgacctgcttntttgagaaagcttgttgctttcacatatgtagatacctangccgagtttagttccaaacttttttttaaactttcaattttcttatcacatcaaaacttttttacacataaaatttcaattttttcatcacatcgtttcaatttcaaccaaacttctaattttagcgtgaactaaacacacccttaagcatcaaatgctgtttcaggagatgctcattctgtcatcacaggcttgttctcgctggccttgggcctctgctcttccattttttctgtcttgagaaagggcagtgaaaagttagaaatcttgatttcaagtgagcacatccattataagtcatgtaggagttcgtgataacatcaagggagagagatattatatactccctccgtcctaaaatgtagcaaccttatattagatgggaca

SEQ ID NO: 43241 - DNA, 4239 bp, Oryza sativa
  unsure (1)..(4239): unsure at all n locations
nnnnnnnnnnnnnnnnnnnnnnnnnnnnnnnnnnnnnnnnnnnnnnnnnnnnnnnnnnnnnnnnnnnnnagtagggccttgtttaactggggaaaatttttgggtttggttgtcacatcggatatacggacacacatttgaagtattaaacgtagagattccgttaggaaactgcgagacgaatttattaagcctaattaatccatcaatagcaaatgtttactgttgaatcatattgtcaaatcatggcagaataagacttaaaagattcatctcgcaatttacacgtaatttgtgtaattggttttttttgcctacatttaataatccatgcatgtgtccaatttattcgatatggtagcataaaattttttatttttgaactaaacagggcctaatagaattggcactacggtggatggatttctgtagttgcgggtcaatgagacgagctgctggtgctctccatctatactagttttgctttcactactaccatatgaaactatatgtatatacaccgatcgatgcataggacctattaatctggaactttcctgatgtgtgattggtataacacaaatggatccaacggtccaattttattcctactctcatcctaaggctattattattcacatgacctggctttttgagaaagcttgttgctttcacatatgtagatacctaggccgagtttatttccaaactttttcttcaaatttttaactttttcgtcacataaaacttttctacatacataaacttttaactttttcatcacgtcgtttcaatttcaaccaaatttccaattttagcgtgaacttaacacactcataagatgtgcacaattttatagcatacacctataaaatgtgcccaggtacaacagagagcattttcctggcaagtaaaggcgtaaagtctatataaggccgagtttagttccaaaatttttcttcgatcttccaacttttccatcacatcaaaactttcttacacacacaaactttcaactttttcgtcacatcattccaatttcaaccaaacttccaattttggcgtgaaaatatatgtgcaagcttcttctaaaagcaacttgtaatttgcattttgcagccgaaagtaaatgcattcagatactaacttgttaaatatcatattatacgcataaatattgatcgctgttcacttttattatttttcatgtaattcaggacaattttatgggtcttttaaccttgtacagtactggtgtattgtgttattagggtaagttctacttagcattttgcactacaggagaagtgatctttactgggtcggctgattttcataatagttttgatgcctgcaaaaaatgtttttagtatccccagttaaagaaaaattgatctttaatcccggttggtgttcttcagtcccggtttaaatttttttgatatttagtcctggttaaaaactaaagatgatatttagtcctgattcatcccctgtcagggggccgaggagctttagtcccggttgataccaaccgagactaaagatcaccactttagtcccagttggtactaccaaccgggattaaagattatttagatctttactcccgggactgaaaatccatctttagttccggctggtaactctaaccgtgagtaaatatttctctaccatatttgttcggttaagtcccagacgagactttcctcctcaccaaaatatctagataagattggatttgagagcctccaacacctcagatcccttcctcctctcgtcccctcccctcctgtcatccgcggcagcgggcaggcggccagcggcggtagggccgcgcccggcggggtgagcagcagcaggcggtgaccgtggtgggcgacggcagcccgcgtagcggtagagggaggcggcggcctgtgcgtggcgggtgacagcggccccgcgtggcgacggcgcggtggtagaggcggcgggcgcagggagaaggcggcgcggatgggaggcggccgctgacggatttgtggatttgtggatgattttgtgatgtaaatttgtggatgattttcagatatttctatgaagttacaaatgaatctgtgatgttgaatgattttgtctgtgtggatgaatttattattgacttcagtgcaaaatcaatatgaaagtagcaaaaaaaataaaaaaagaaaagagaaagagaaagcgctacgtggcgcttttatttttactcccggttggagtctccaaccgggactaaaaatccatttttaatcccggattttttcttccggttcgttacccgggaataaagggggttacgaactgggagagatgtgcatctctccagcagtgttggctgagaaaaaactagataagtcattagcgtataattttaatcaaatattagttattacaaacttaaaattagattaatataatttttaaagaaatttctatataatttttttcacacaataacagtttagtaatttgaaaatcattttaaagaataacgagtaaattatcgtttcaagtcactcgaaacgctaggaccacgatttggccagacctaacaccttcacctgttcagtccaggctattagacttctccctcagtcccacaaaatatcaaaccctataatcctaagaaagtagtggagagtaaaaatgaccaaaatacctatcattattagaaaaagtagtaatagtgataggtaggtatagggtatttaagggataaaagtcgtcgctttatatgctgagagtcgatagagtgttagaagttgattttttatgagataaaactcaaattccagaaggtgagtttttttacgacgaagggaatatctctggagtcgagtcgatttagaccagcgaaaacccatagaactacctagtcttttctgacccacgtgatacaaccaaccaatcatatataagggcttgttaactttgtagccactttttaccctactaaaatttgccacatttgtacattatcaaattttaatactgttggatatgtttagtttaaaaccttacaatttgagggaattttcaatagtgaaatcttgtaagggcttgttcgttttggaggaaaaacaaagaatttggattcctaaagatcaattcttatgagtgtcattcaatttatatgattgaagtataagaaaaccaaagaaaaaaaattccttttctacaagttatatagaggaaacataagaattattccatccagtcaaatctcttagaaaaattccaatagattgatgtgtacaaacatttatattccttcatttttcctattcctatggattcaaattcctccaaaccgagtaagccgtaaagttaccaaatattggtaagatagcattgctatatatgtataagttcagttttttactttatcaaaagagtaaattacacccacagtacaacacgttgatacgtgggttctatttaggacaagaagaatgtgacgtctaaagtgcaataacttagcaagtgggtgcactttaatacaagaatttgataatttaatattttggtgcaataacttggctagatatgtgctaccttggttaatgagtgctatgtaagttttttcacgatgttaatatgtcatcacatagcaattccgtagatataattaatcttataatgtttgatgtaatctgtaagaatatattgttcacctaattagcaacattgatttagatttttttttaccatctcaaatatcaactagaaatttcttacacagtaattttttttacttttaaatttttttactcagacttttagttactagaatgcaaagaaaatatgcttgtacaaatctacataagtttattaacaactgggtaagtaaaaactgtttacatatagccaaaaatacataattaagtttttacaccacttctcaagttattgcatcaaaatcacacccacctttcaaatagtcgtacccataaactcatttattaagttgttgtactacgttgcatccacttagcatgttgttgtcatagcatgcttatttctcaaattccttcactaaattgcaccaacttactaagttgatgtaccgtgaatatgcaatttactcatatcaaaatttaataggattggtagtaacgtcaaagtaagcaagcccataatccctgaatgaacgtatgcaaagaaaacctacggttcaaccgaagacctgaccgggtcaatcactggtcgggggat

SEQ ID NO: 43242 - DNA, 933 bp, Oryza sativa
  unsure (1)..(933): unsure at all n locations
ccnnnnnnnnnnnnnnnnnnnnnnnnnnnnnnnnnnnnnnnnnnnnnnnnnnnnnnnnnnnnnnnnnnnaagcaagggggtagagtctcgtggtactagctatcggtctcaatgtttcgaagattgtttaaggcagatgtgcattctttaaattttttttataaaaataatatgtgacaggtttataatgagcgatatagaccatcaataattatgtatatcatggttttctaagattatatactttttcatagagaataaaaaaaagtatgaataactaacttaacgtgtgtagatgtgtaaaactagactaaagccagccatgccaatgctactatacattagttgttttttttaacctatggacagtcagccatcgaggtaggcacgagcatgagccacagtgtcacgagccatggagaggtaataggtgtgagagtatatatcaagggtagagctaaagtgtaattattaacgggtctaatgacccagtgaacttctataaactttatggtaaatcatttagtcacggttaagaaaacaagattgactctatggtacaacgtatacaacacaagtgaccctggtgattttttccccaagatccaactttggttggtatggtggacaaatattaaggtgcatgggagccgcaacggataaggtagatctagaagatgacgaactcacgcatacttgttggcggtaccctttattgatatccgcccttcaacaaattcaatatctacatcacatctagaccacattatggtttaccctcaccttcaccccctgtgttttgtcgtaccatgcaagctcatatttagatgtgctagattgtatgctatgttactttgaaactcacgattataaaaatagaggtatacgtatgggaaaagagcaatgcactagaatttagcacacatgaatttg

SEQ ID NO: 43243 - DNA, 1858 bp, Oryza sativa
ttcggtagtacaggttcccaactcctcctcctcgttttccacgcgcacgcttttcaaactactaaacggtgctttttttgcaaaaagtttctatacgaaagtcgcttaaaaaaatcatattaatctattttaaaaaaaataaactaaaatttaattagtcacgtactaaaacgctgcttcgttttgtgtgccggggagtgagccctcactcccaaacagagcctaagtatagttaatgctaattctctctcctctcatgaagccacatcgcatcaattgctttaagcctttggagattcatcaagggtgtaaattgcatctcttcatatcacctcaattgtgtttaaccttttgacgatttatcaagggtataaattacatctattcccccaaaaggcacaccatacaacccaatcatttataaactatagataattaataaaggtacaaaaatatatataaacacataaaaaaaatcgtatagtaggtaagaaaaaaaatagaactcatatatattattatcacacaattctcccttagcaacacgcggggtacccatcttgtattatttaagcgcagtaagtcaatagcggttgtaacagtagttgctaagtgctgtagcttccactaagtttgaatacactatttttgttcccctactgctaaccttggtcaacaggtcctaaaatggttattaatcagcttaggttgagtttttatcagcatgacttcctcgtttatcacgagcatgttcttaactgttaaacgacatattttgtgaaaaaaaattatttaaaagtattttaaaatattaaataaatctattttccaacatatagttaatacttaattattcacgcccaaataatccgtcccattttatgtacaattaaaaagttgaaggtaacatttgttttgaacacaaccttactctgagtttcaattagctttataaactttttcaaaaaaaaactttttatatgaaatttattttttaaatttgtaatagataatattcaatcaatcatatgctaatagttttcttattttacgtgtcattaaaaagctcaaacgttgagcctattcgaataaggttgcattctgacacttggtttttgaaagtcgaaatggggtgattagtgtcaatgtttgatgtcgcgattccagtatttgcatagtatggggatcattggtaccaggatatatgcgagattgtagtaaaagagacggggacgaggaattttatacaggttcggacccctgaattgtcaggtaatagccctaaatcctgttggccgaagccggtattgatcttattcaccataatcacacctgtacaatatttggggtagcctatctaactgttgtcgatatggcggtctgaagctctgactcgtagtcgacaacagggtagtcttcctccttgagttcgtgtccggcgagatcagagacaatgctagatccttacggccggcctctgtaggtattgaatagggtcgatccaggcatatctttgatgtcgatatccggcagctcgtcttggcgtatgttggcttgtattggcttctggctttgtggcgtctatgttgattgtccgtctcccctctcctcatatagggccttgtatttatacccataggtgtccccttgtccaagtagaactagggaaaccaatatggatacgatccgagtagtccttgtcgttttcatgtagaactctattcatccttccttatgcggaactcctcctatatccgaaggttgtatccgtataagacatggtatgtggtgggtcctgttcagatttagtcaactactattaggtatgtggtacccataaccctgacaattagtgtga

SEQ ID NO: 43244 - DNA, 841 bp, Oryza sativa
cccatttattttatttttacttttttgttgattgtgacttcacataagtgccacgttagccgttacataggataaatactgtgtcaacgtgccacatcatcgaaaacgaccgttaatactgccgagggagttattttgcacatgttttaatagttggaggagtagttgtgtggtttggagatatagggataagattcgagctatagttgagggagtcaagttggctatagttgagggagtcaagttggactttttcctatctctggtatagttcaacttccacctgaaatgaaggctcaaattagagctgaaagccacattctttgctggcctatgggccgcactctcagcactcgtggatcttagcccatcatacccttggagatgcacttaaaaatccacgggaatttattattggaaatcatctccaaccaagaaaggtagtgtgaagaccatatgcaagtttcagtttggcaaaaaaatgacagcgaagtgttggaatatccgggcacctttcactgtcccaactcggtaggcgtactgcatattcctgtggttggtgaagaacagatccaaggcagcgtatatatataaaaatttcttcacaaaaagaaaagattcagtgatctgactgaaccaaccaaccaaatgagagagacatgctttgccagtagaaaggaaaagaggagaaaaactgagccgtcagagcagaatccaccaaccccccatggtgtgcatgcctgaactaatggcgacttaatttggtggtagctcagctagctgcaaccaggttgactgatctgcagatcttgccaaccaatactatacttgatggcaacta

SEQ ID NO: 43245 - DNA, 2385 bp, Oryza sativa
taagtattaactattttaaatttcaaaaatggattaatatgatttttaaagcaactttcctatagaaattttttataaaaaatacaccgtttagtagtttaaaaagcgtgcgcgtggaaaacgagactcaatcccccctatctccccagaactaacagagccttaatcttcattagacattcaaacaccacctatatatctcattcaaacataatctcttctgttttgataggcccgcttttaggccaataacttggcctagcccaagcccaccagacccaagcctaggtctaggcttcctagctacaaaccatcttatcattagtaaaaccttctacctccgtccaaaatataaaatataagaagttttaaagttgaacacggttaataaaaaaaatagatataatcaaatggtgaaaagttgttattggttaagaagtaaatttatgtgagaaaaaagtaaatagtggagagttgcgattggttagaaagagaatgttaccgaagaagttatattttaggatggatgaagaattaattattctaccttttcatcccaaactaaattcctatacttaattagctcttgctagtccagagcaaaacgatttatcctcctgacaaagtgtagctaaaacaaaaatgcccatgtttggcacgccctaatcaacgagttaacatgtgatagtgctagtgctagcttagcctttaaaagatgatgggggccccactctcactgtcccagttgaatcggtaggtgtacactctcgtgtggttggtgaagaaatatgctttgtatctttgcgaggccaaacaatatatctgcatttttaatgtgagaccaaattaagtggactagcctctattttttttcttaagattataatttagaagtggacaagtaccggggagtttggctgcatgcaccaaccatgaaccgacggcgacgttgcccccacgactccataaaaagagaaagggaaagatgggcagccaccggcgggtgggcgcttctccaccaccaaccccacaaattatcgtggaaattatccgtgaaatcggactcaatggcttaagaaaaaaaattatgacggacgatgagcctggtgtacgtgtggtgtggatcgtgtgatcctacgtgcgccgtcggcgtcaatcaatggcggctaggctccgtcccataaaaaaacaatctaatacggtatgtgacaaatcttagtactgattagaagatttatggtattaaaatgtgttgcatcttttattggatttgtttttttatgggatggagagaatagttgagcagccttatatatacgtgccgtgcaatatttgttttctgtcaaaaacaaacttgtgcaatgtttcatatagacataagatacgggataaagtagagaagatattactatctttgtcctaaaatattataatctagaatgaaatttgattcatcctagggttttgttttaggagcttaagattctgagaaacaactggttagaagctaattggtgagaatttggagaagctgagtttagcttctgacttctaactaattttctaagattttacaactgcagcttcataggaattgtatgaaaatctatattgtttgaaggagtttctagcagctaaagattctagaaaaaactgtagttatcagaaactcccctaagcaaatcctataatggacataaatgacaatgtttatgtaccatacacatctccatgtttttttacggatcttagttgacatggcgacagctgcgtcgattcccgtaaacttatttagtcaaaacattccattaagatcttaatcccggagtaagtgctaagcaaggctatgcttgtttggtctttacacacttcaaagaaagatgttctctctttcttaattcctttgctcctactgccactaccttttactacgataccattcgcacctcaacaattttgcacatagtttaagtttatcgataactaataaaccatgtgagctgatcaaataagcaagatcatcatgacggtatcttcgatgaagtagtgtataaataataattgaaccccccaagtatgtagtgctatactccctctgtactcataaagtaagtcgtttaggacagcgacacggtctccaaaacacaactttaacttattgtaagctataattcagtacgtgctccattattatgtggtttaattagtgttttggtttagtggtaggtgtttgatttggcaacgatgcgttaacacgagttacatgcagctgattaatgattaattgttgtttggggtgcagtggtcgtatgtcactttctggacattgagttttttctacaggcttggtgtaagaaaagaacaattaattaataatactagtgg

SEQ ID NO: 43246 - DNA, 1528 bp, Oryza sativa; identical to SEQ ID NO: 41056
  unsure (1)..(1528): unsure at all n locations

SEQ ID NO: 43247 - DNA, 6422 bp, Oryza sativa; identical to SEQ ID NO: 41057
  unsure (1)..(6422): unsure at all n locations

SEQ ID NO: 43248 - DNA, 1135 bp, Oryza sativa; identical to SEQ ID NO: 41077

SEQ ID NO: 43249 - DNA, 3784 bp, Oryza sativa; identical to SEQ ID NO: 41078
  unsure (1)..(3784): unsure at all n locations

SEQ ID NO: 43250 - DNA, 1650 bp, Oryza sativa
  unsure (1)..(1650): unsure at all n locations
nnnnnnnnnnnnnnnnnnnnnnnnnnnnnnnnnnnnnnnnnnnnnnnnnnnnnnnnncccgcgctgctctgttcttcgccgccacaaagtttttccggccgcaacccgtcgtttcaaccgatctcggtgagttctttcgttttaaccatctatgtactccctagattctattttagcaattggtttgctctaccatgccaccctctgggctgccgacgtgagcacggccaccgccaatggaggagctcgtcggcaaatatattccacaccttgccgaaggtcggcaagctgcttaaacccttctaggtacctgatagatgctctagaacccctccccgagccatgtctaactcacataaccctgatcaccttcacggcttaactatgccaccgccgccctagccgctagctcaaccacataccaaattaacccctccgccgccgctcaccgtcgccggagtaccctagctccctcccatcctcggccgcaacccctcttctcctccatcaccgccgcaatcgccaatcctagcaccgccagccgtaaatagggatcggctggaggtagaagaagagaagagagagagagagagagagactgacaggtgggacccgcacaccgtgccatttcacatttaattgattttcaaactttagaaacccatatctttgaaaatataggtccaattccattgaaacttggaccaatattcttctaaaatcattctctatcttttgagacccattttgttatttttctattttattttattttccctatttttcttatttttggattgtatctgaattccttttgaatttgaattttatatgtctaaccctaggtcttgaggaatcttttgacacactagataatagcaatcaatctcaggacatcgagcaaggcaagttaccatataccttttgatcatttaagcctatattttacaaattatttatttatagcattcttttcaatattctattttatatgcataattcaaccatagaaacccagataatttagtattgcttactttgcttacaatctgcttaaaattccttaaacttagattgggacagtacgtaaggtttggttgatttctgggtggctagtactgtctcgatcgatatagtttttaccaggtacttatgtcgaacgaacgggtacgaccacagtttctagaatggggatagacctagttattatgttaattaacaatatggcacctctgtatagtggttcttatttttaagtcctcgcgcaggaggcaactatagcagcgaaaggcaacttttaaccattaccatgtacaggtaaatggtttgtgatactcgagtataaattatatggtatatttctaaaccctaatcgagatgacgtggtgtcatacgattagttccccttaaatatctcgggaacgccagaactcctcttgctgctgttaacaatacgttcagagcatatgaggatataagttcatggaataggtgccacaattgttaataacttaatattgggccatgactatagccgatgattatcagcaagttgtggattgcgggtaaagcgtacatctactgcagtagaatatctttgaaactattcgaatagccgtactcatggaattgagtaccaggactcatatg

SEQ ID NO: 43251 - DNA, 2082 bp, Oryza sativa; identical to SEQ ID NO: 41079

SEQ ID NO: 43252 - DNA, 1964 bp, Oryza sativa; identical to SEQ ID NO: 41070

SEQ ID NO: 43253 - DNA, 2153 bp, Oryza sativa
  unsure (1)..(2153): unsure at all n locations
ctcaaaataaaataaaatcttggcaaacttgtgggatccatgcttcttaagttttaaatctaatttcattttagcatggatatgaacaattaatcttgaggctatgataaaatctttgtagtgcttcgagtattttttttttgtccactaaccttttgcaggaaataaaatgacaatcaaggagcagtgtacaataacttcaaacacttatatcacgctcctttgtccatgggaaagagatgcacatggaaccaagcagaacatatgaaaaacagtttgcattcaattgaggttcaaagcttggtaagacctatctgataagaatcctcaacaacttgtgcatcctcatcccatgttttcatcctgccaaatccatcgttgccataaaaaaagaaaatacaagaaaataaaacaaaataaataaatgtggctccttggtcttccaaccaagtgagtcctttttgcttcactcgtctttgtttttcttttttgtgtccaataaagagccccaggtacaaagacatgtgtgggggtgatcttgcacatcaacgccgaaaccaaagcaagatcaccctatgagtgatcagccatgacgaaccacacaaggggaattgatgcagtcagaaccaatgaggggacagtcgaacctccagttcaactgaaccacctctatcatgaatcgttctctgttttatacagggctcaggtttgcacaatttcctcgggacatccattctatcttgagtttaatttgattatcaattctaaaatatcgaagataattaaactcaagctagggatggtacaattagagttcatggtctccctgaaaataacatgcatgcctattattctttgctcattacttgtttcttgtagtgacaaatccaatagggatcccatgctatcaaggtaattgatgaatgtgatatagtctgatgatagaaatcttgctcttcatgttgtacacttgggaattttataaaaagaaaaaaaaacatataatgatgctaaattcctcattgatctttttattcctattagagccataggttgatcattcatgattagcttgctacatacgctgcttgtcatttcataaagcgttgtcaagttttgtgaccctagtgaaatgcttttcatactttcatggtcaagatcacacacaccccacatacacgcacatatgcttgacttatacactggaagttagcattcctcatttgtcattcatttcatccatagtccacaaaataaatactccatgtcatttgtgcctcttcctccaaagttctttaaaaaaaagagagagagagaggggcatggctatgaaaaaaaagtgctcatacaagtatggagcatgatgatgagaaaaaaaaaagaaaaaaaaagatagccatgcactctcccaaatttcaaaagagaaaataaatggaggaggaggcatacaaaaggagttattttcattttcctttttccactcacaaatttaccatacacatacacatgcacattcttgaccagaaagtatgtcttgtatttccgtggatccattattttactttgcaatatatgtgatgcaagcaatgctctactcttttccataccctgaactccacataagccttattagatggtaggaaaagaaaaggcacaatcatatgcctttgtgaggaatcatacactttgagtgatcgagagaatcaatggaggagcaaagcaaagttataatattcgtcttacttgaaaaaaaccccaagttgttcttcctgaaaagttagggtgacttgaatcaagattgttccatttctcaattgcccaggactgcatggtagacactacaaagatccacaagtacaggtatgactttgaataatttgtttgcatgattgttagtaaggaagtcataactctattgtagagtccatagccttcactcgggatgagcaaaggttaagtgtgggggtgttgttgacggtccttaaatcataatatctgaccgtcaatacctgcatatatataatgaaataaaacatggtatccaacttagtggtaggtattattactaatcattaccactagtgttggtgcaatatgtnnnnnnnnnnnnnnnnnnnnnnnnnnnnnnnnnnnnnnnnnnnnnnnnnnnnnnn

SEQ ID NO: 43254 - DNA, 1161 bp, Oryza sativa
  unsure (1)..(1161): unsure at all n locations
nnnnnnnnnnnnnnnnnnnnnnnnnnnnnnnnnnnnnnnnnnnnnnnnnnnnnnnnnnnnnnnnnnnnnnnnnntggggtagcctatctaactgttgtcgatatggcggtctgaagctctgactcgtagtcgacaacagggtagtcttcctccttgagttcgtgtccggcgagatcagagacaatgctagatccttacggccggcctctgtaggtattgaatagggtcgatccaggcatatctttgatgtcgatatccggcagctcgtcttggcgtatgttggcttgtattggcttctggctttgtggcgtctatgttgattgtccgtctcccctctcctcctatagggccttgtatttatacccataggtgtccccttgtccaagtagaactagggaaaccaatatggatacaatccgagtagtccttgtcgttttcatgtagaactctattcatccttccttatgcggaactcctcctatatccgaaggttgtatccgtataagacatggtatgtggtgggtcctgctgagatttagtcaactactattaggtatgtggtatccataaccctgacaattagtgtgattaattcggtattaactaacataaactttaaggtggtagcactgtggcagggagcaggagctagagccaaaggggaaacctctatgccatgagttaggacatctacaccttcccaccaccgtctcgccttcttgcccacgggcatcttcatcatcgcaggctcatctgtgcgcttagatctgactcgactgcttgacctcaacgggcagccacatccaatgcctcccttcatgcggacaagtgggcgagatcgacctcgacagggctcgccgggtgccactgccacaaccccttcccgcagagctcgaactcaatggggtggtgccagcatgtgcgtggtactcaagctcgagcaaggcgtgttccaaatctgctaccgcctaggcttcggtggaatggtgaatgcggtagctcaaggttgagttcgatggggctcactgaccaccgttgtcatgttccctccatcacgccacactggagccaggagtcaccatcaactcgctgtgcactaccggtacctcgacccaatggtagatgtggtgtagaggcaagggtggttgtcatcctgctacc

SEQ ID NO: 43255 - DNA, 2318 bp, Oryza sativa
agggtcctgtttggatctcctggtaaaaattttcgccctgtcacatcgaatatttggatacatgcatgaagtattaaatataaacgaaaaaataactaattaggcatattgcatgtaaattgcgagacgaatcttttacgcctaattgctccatgatctgacaatgtggtgctacagtaaacatttgctaatgacggattaattaggcttaataaattcgtctcgcggtttacatgcggattctgtaatttgttttgttattagtctacatttaatactttaaatgtgtgtccatacatcagatgtgacacgccaaaactttacacagcctagatcggacggacgaaaagtggatgtgacagaaaaattactacaggcctgtttagattccctggcaaaattttacaccccatcacatcgaatgtttggacacatgtatggagtattaaatataaacaaaaaaaactaattacacagattacatgtaaattgcgagacgaatcttttaagcctaattgcgccatgatttgataatgtggtgctacagtaaatatttactaatgacgaattaattaggcttaataaacatatgctaatgatggattcattaggcttaataaatttgtctcgtggtttataagcggattatgtcatttgttttgttattagactatgtttaatattttaaatatatgtccgtatattcgatgtgatacgccgaagctttacacccatgtcgtaaacacaaccacgttgatttggcaatgcctcttcggattctagcggcctgcgcttcggaatcggactcgcacgctctccgatctcgagttctgcttcttctcgagttcccaaggctttttcgcctataaaaccaagccatccgtgaggcctcaacgcggcaaccccatccaaatcactctctgcctccgctgctttgatccgaggagttcgccgcgaggctcgccgaaaccctagaccggtagacctttcccctccgatcgccggtatcaatggcagccacggtcgctgccgccagcagccggaagcgtgggttcatggacatccttgacgacccgtgcccctaccgttgcgccacctggcgaagcgcggccggagctcgtcttcgccgcctccgcggctgattagatcacaaccggatttgccacatcgtgaggtgctgcaaattaaggtgaaagattagttttttttatagatttggtacttgtttatgtgtttccgcttccacctttataatttttgtagcgtcaaccttgtgtttgcattgtgttattcaacggattcgattatgtttccttgtgaagtaaaacaatggaaaactgattatgttaagtgtttatgtaagattggatgcttgggatttttgtccgtgtataatacttataattaatgtgtataatacttataaattttacacaccaacacatcgaatgtttggacatatacatgtagtattaaatataaacgaaaaaaataactaattacacatattacgtgtaaattatgagacgaatcttgtaagcctaattgcgctatgatctgacaatgtggtgctacagtaaacatttgctaatgacatattagttaggcttaataaattcatgatggattaattaggcttaataaattcatctcgtggtttacaggtggattctgtaatttattttgttattagactacgtttaatattttaaatatgtctccgtatattcgatgtgacatgccaaagttttacacttgatgtaaacacaatcacgtcacgatttcgcgatgcctcttcggattccgagccgcagtggcggacgtaggattttataaatggggtatgataaactaatctacttataaaacaataaattatgtaattgttgtacaatattttctctaaagaaatataaaaaacccaatatatcataaaaattagactagaaataaactaaatcttatttttatctctagatcgcattgtaatgcattgacatgtaactagtaaatatatatataacattataataattggatttataacaagtgtcaatctctaattcatccataaaattttttatataattatatattgttcaatattataaatctttatagcattctagattatgtttaataaaaatatctttccacttattaaaaaactagtcaggtaccttatataaatataataatattaataaagataataattattgtttacacatgtaaaaacatagataattgttaacgaccaaatttggtaaggccatgggctgggttcaaagctagagtcaaagccagatttggaggaa

SEQ ID NO: 43256 - DNA, 3446 bp, Oryza sativa
  unsure (1)..(3446): unsure at all n locations
ttatttgaagcatatcttgctctttatcagtctgccagtccatcttacttgctagattgatctgcgttttatatatttcatttaccctgttatcttagtatagagtcgtactggagtactagccgatacatgctaggtttgctgtatcggctatgctgcgagcatacacaatctttactttgaggcacatttagatattaagtgatttatattatctcggcacatcgtccgatctattccaatcacttggtttaaatgtatttcattagatagactgtgtatcgttgacatcttcaaccgatcgagtagatctaataatctctacgctttatcttcccttgccgatctgatgcaagttacatcgacttggctccaaacgatatgtcattgtcaatccagccgatcggctatcgttgacggatttaactttgtccctttttatttcttgttggttgcaggatcaaaccaactggcacactcagaacccgaaggtaatcgctttggacctgcactagagttaagcagatctctcaggccagtgcgtgtttttcgcgtcaacaataatatatattacggagcgcacacacatgagttagctactaatattcatgtgcaaataatagtgttggttgtggcaatattattataaaagaataagaatgagaaaacaagaagaagatggaacaacataagaatataaggttaaagttttagtttcacaccgtattacgacgaagaacaattttaataatattagtatattatcgattaatgtgagcatataccataccatggatgtgagtaacttttccccacgtgtgtttgagctagtgactaacctcctctttttcttaccttcttttgaagttctcctaacgtgtttgataaaaaaaatgttttgttttgaatgagataaacaaacaatttgactagattgttttttagagagaatccattgtgtgccgttgactttgtccctgttctataatatgccactgagtttgtcaagttatacaatatgccattgtactttgcttatcctctataatataccgtcgccgtccatttagactccgttagttcggtataattttgtcataatgaccgaaatatccatgggacggaaattctaaaatttggcaaaaaatccgaaatgtcattataaacaaggcagagaattgcgcatctcaaactttgttacaatctgatatttgtaatttttcgtcctaggggtatttcggtcattatgtcaaaattgtacaattctaacggaagctagacgacgatggtatgttatagaagttaagcatagtgcgatggcatactagaacttggcaaacctagtgacatattgtagaacaaggacaaaatcagtaacacacaatggattctctatatatttttttatggttgttcagttcattacctatctactattgtgcaaaatttttagaaaaagttaaatagtccatatcttacacattaaattacatgcatataatataattttcgcattatacaatgccctattcacattttataggagaaatataaaaaatgatttattatctatttaattatgagaaaaatattagtccaaattaatgtatatgtagaaaaaaatttaatatgatagaattatggaaatgcctactgatataatcattgtatatcacgtagtgagaaaaggagaccagagtcgaatgctttattgttgagcgtaattgatggcattaattttatcttttttagcttaatctatctaaccataattaattaacccgtgttagtagaagtccatatcttgatgcatcaacatatcatgagattattagtaatagctaagtacaccgacccaaccacacttagtatatcacaagactgtcgggtaatggacaactcatctttaattatgctaaagacttagtatatcacagtagtatcgggcaatggacaactcatctttaataattgtgctaaagaaaaaaagtaaattatagttcgtactatgtattcttaaaagttttcatactatgtcatctttaaccattcttttcatttacaaaagagctaactttacatttcaatttggaccaccctattccatccatatccaagtccggtgtgacgacgctctctctcgtggcccgatcttctgatgagggggataactctcactttgatcgagtgcgacgtttgcgatgtggctaccaaccagaacaagtctaggacgctgtgcaatcgctacaccataaacgatgtcgtaccaaccgtggcacacggttgatgatccctacaatgcaaacgagagaacactacaagaacaagataagatgcaatctaaatattgcgaataggtaattaagtacaaaggaacgagttgcgattgaagtggtagatctaatcgacccggcaaatcaacacaccaactattgggggctctaaatttatagtcaccgactaatcgagcgaggactagagacaaggtgaatggcacttggcaaaattcaactaaacaaaacccaatttttctaaagggtgtgcatagacatttatagaggaaaatagatctagggttatgttctaattcgtggaggtggacggagacacttccgagatgggcctagtctattacaaggctgaaagcccaagttcggtttcagcaacaacactgccttgttttgatgattcccgttgactcggaatgaatttggatatgagactggatgcatttgaaaggtaatgagataagctttccatcaagtcgaagatcacccaaatcggagttggcatgaagatgctaggtctgtttaaagttagtgttgtctccggagaccgaactatattccacaactcattggacttgaatatcttgtagatcctctattcatccgatacattctttgacaatgttttatatttcttatgcttggttacatatacttgatggtcacatcacagtgactcaggaaccactccgcacactaactctctctctctctccattttctttttccctccaacaattggggaaccgctatattcagcaagaaggagcccaaatctagtgtcttcgctcttcatcgggtcgactcctgcctcctccttgactccctgtgtctctgtaagaccgacaccaccgaccttaatggcgaccataatgatagtgtgcatgacgagaggggacgagaaaaaagggtgacccatggaggataacttgagggtgcgattgcacatgcaaaggcggagatgagcaacgatggtggctcatggagaaagagcggtggtggcgatgcgtggagtgatagttgttggtggtacgaggagtttgttgtcgatacgatcgctaatcgagtttgttaattcttgatacgtgggcaannnnnnnnnnnnnnnnnnnnnnnnnnnnnnnnnnnnnnnnnnnnnnnnnnnnnnnnnnnnnnnnn

SEQ ID NO: 43257 - DNA, 2249 bp, Oryza sativa; identical to SEQ ID NO: 41071
  unsure (1)..(2249): unsure at all n locations

SEQ ID NO: 43258 - DNA, 1211 bp, Oryza sativa
tttgtcagcgatgaacatcccatccaatgggtctgaatgggctgagctagttgtcaaggagatgtcctctgctctagatttggttgatgccaagaaccgagcctttaggttacttgacctattcgagaaatccactgcagcatgtatcagtccagttgaaatgcggaagatgcgcgaggtaacaaatactactccatccagttataataatgtcgtcttgaattatcaatatcttccagttatgaaagttatggaagcttgactgatcaacttgactgatacttccaggaacacaagatactgaagctgatgttaggaggccttctcgaacagaacggtgtcctgaagcgcgcatttcttaaacagcacaatcggctcaatgattatgaaaagaaaatgtcgcaggagcggtcgcagattatcgacacgtacgaaaaggagataaaggcgctacaggtttgtgcgtttatcacaacattcattaattttcagttcttttatgttatttctaatgcttgttctaacaagaatcttggttgttcatctcttatcttgcagcataggaattatgtcctgtcattacatcttgcccaagcgacgcaacacggcattatctccggccattgcaatccagacgtcttctaggtgatagtgctgctacaactgctaacttgtcatctacaccgcactgaagatactgagcttggaagatagcaagatactgaagctgcaagctgagaaagatcctattgtaatcagattatggcgcattttgatcttccgaaaactgtacttagacctcgtctatgtgaaccgaaatcgagtgaacaaaggacattttttatcttctgaattctgctagcaacctcgtgccatgcacagagtcctgtttgttatggaataagcatggcacaactgtagtggagaattgtttaatgctgtgtaaaatgacagaataatatatgtatgccctttgttttagctgccacaatgcttcttgatctgaatactaatcttctatagcatgatatactatagtccaatcgcaattcacatgctcatctttaaatacgatatcgtccgtaaacaattaacaatctgttccgagcatgtactgcatgtttaaatacaatatcgtccgtaaacaattaataatctgttcaaagcatctactgcatgttataaggtttatgcacaagcgaaattgcatc

SEQ ID NO: 43259 - DNA, 1824 bp, Oryza sativa; identical to SEQ ID NO: 41072
  unsure (1)..(1824): unsure at all n locations

SEQ ID NO: 43260 - DNA, 8718 bp, Oryza sativa; identical to SEQ ID NO: 41073
  unsure (1)..(8718): unsure at all n locations

SEQ ID NO: 43261 - DNA, 1129 bp, Oryza sativa
gaatccatctctgactatccacatctcttccatcgtttctccttctctcatctctccttcatgcaggcctcatcggatcgtcctcaaaacgagagcgacgatgtccttggtgaatagcaggtgtgatggcctcggcatggacgaccagtgggagcggcagtgtcattggcaagcagcaggagtggcgtcgtcgtcggcgagcagcgggtgcggcgtcttcgacgtcgacgaggcattggagcagcgggagcggtggcgttttcgacgtcgatgtgcaacgagcagcggagcggcgatggccacggacttaggcccggcggcagcagcgaccccgacgagcagtggcctcgacctccgacaagcaacagcggcatcgccgcaatctcaacattctgttagtattggcgatgattttattgatctcatcgatctttgattttgatctgagtcttttttttggctcatcaattttttttcattgatggaaccgagttggacacaacgaactatgcacacggttcacacaacttgctcgggacatggaaacagacggacgaacggaaatttgttctttgcctcggcagccagattggatgctcgtcctttgaaaatttgtgacttttttttttggaacctttagtgcttacccgattggctctccatggctattatgaagatctttgggctgattcgatcacaaccggatttgccacatcgtgaggtgttgcaaattaaggtgaaagattagttttttttatggatttggtatttatttatgtgttttggcttgcacctttataatttttgtagcatcaaccttgtgtttgcattgtgttattcaacggattcgattatgtttttttttttaaaacaaaacaatggaaaactaattatggtaagtgtttatgtaagattggatgcttgggatttttgtccgtgtataataattataattaatgattgtttgaatggatttagattgatactttaattttgtgtcttgtaattcgtacataacgaaggctatcaccagggtcctgtttggatctcctggtaaaaattttcgccctgtcacatcgaatatttggatacatgcatgaagtattaaatataaacgaaaaaataacta

SEQ ID NO: 43262 - DNA, 1062 bp, Oryza sativa
  unsure (1)..(1062): unsure at all n locations
nnnnnnnnnnnnnnnnnnnnnnnnnnnnnnnnnnnnnnnnnnnnnnnnnnnnnnnnnnnnnnnnnnnnntggctgcggtctgtcacaggatcaccttatctgtgatgggccaaaagacaaagctgtcataggtgaggcagtgacgggttttccctccaacccatcactggtatcacctcacctgtgacgggccgcgtaattataagccgtcacaggtgatgggccgccacctgtgacggatttgttttctggccagtcacaggtaggtcgatacttgtgacgggcaactcaatttaagcccgtttgaggtatgaacaacacctttcacgggctttgtgtacctaacccgtttgaggtgtgttgggcctataaatactccccaaactgccaactgctttccatctcgaccagtttactgtgcacaaatcggttgggagggtagggggggcgaatttttgctaaattgaaggtaaaaaacatattattctcccttcattctcagtcgatcatcatatatttttcttcctatgttgttgatttcagatggaccgtagtacttgaacatcactacaatgaaactcaacgacacgcatactcgttctgctgggagaactttctgcactgggctgcataaaccatgtatgagacccgcatatgggagcgacacaacaaccacgctcctcgccgttctcccccttctctatgccgctgctgtctgtggcatgttggatggagaggtcaagagccatggcggaggcagtgtaacacgcttcagtggacagaggaggaagaagattattgggggaacgattgtgagccgctagatgagattggacggtggatgtgcaggaaccaatgttttaaatagcgggctaagccatttagcggttagcttcttaaacagctatagcgggctaaatggagctatagctgttaaattgtacatgagagcgaatagttagaacccttttcaaacaactatagcgggagatagcggcagctatagcgggagatttaaaaccctgcgaggaactgcacgcctctgacgttgctcttgcacgt

SEQ ID NO: 43263 - DNA, 1577 bp, Oryza sativa
  unsure (1)..(1577): unsure at all n locations
nnnnnnnnnnnnnnnnnnnnnnnnnnnnnnnnnnnnnnnnnnnnnnnnnnnnnnnnnnnnnttgcctaaatggtgaagatatgattattagatatcgatccgtaaacaactgagaaatatatagattatcgagcattagaatcaacatttggataaggcctgctttctaaattaaaattcatttactttggaacaaatggaatggtagtaagggcttttacaatgcatatagatgtcattcaacatcaacttgccacataaaagatttcacgtcattcaacatcaacttgccacataaaagatttcacatcacatctgcttctcccattaccaagtgaagaatggaaatcccaaatgagacacgagttccttattaatattcatgagggatttttcagggagggggagaggaacagcgagcgttgtacgttgggagaagtgttgccccatgcgatgccctcataacccgttggagccagcgacgatgagctgattcgaggtggtggcggtcgtcccgagttgctccactcgtggttgtcactgatcgaggcaagcccaatgcctgatctagcgagctcgacgaggcagcgacgatagcctagtgagagacgtgcgcgggtgaggagaagggaagatggaaatggtggacgaagaggaggcggcggatctagcgtttaggacctcattgttgtccccattccgtactgtcaagctcgttgttgcccctcgaaccaaccgatgttatcgtcgtgatcgacctatgaagaagcagctcgacgacgaccgcctcgacctgtccgtagccgctccgtcggagctgccttgacctcctcgtcgcttcttttcgtcgtcgtgtcaatctcctcgatgttcacccggttcaaggcgatggcactagggagctcgttgttggagatgggggagggacatcaacagcaattttaggaaaggaaaaagcgactatacctcccactctctgccgctgagctcatagtagtccacccttcccacatcaccgagctcgtcgacgcgccgattagagtaggagagccaccgaacagtcgtgggccatgggaggacgagataagagctgagatgcggtcactgccgtgggaggagtcgaggagagaatcgagagagtgacggaagaggggaaagaggggattttattttttttctagattctggtattcattgttaaattgtgtacttccacacaaattgaaataaatatgagagctagaatagatagtagcaaggtctgaaataaaaaaaacaatgccattcctagagccacttacattataaaaagaataattttagacttatgaccctagctagacttcgtggtacagacgtacagtactccaaggctcaaatgaagatcctgcactgtgagtgacggtcactcacgttgccacacacacatgcataatttccgagctactagcactctagcagctgcaaaccctagagttcacgggccacaacggcgagctcgccactctatataaccacaccgccataaaccctagatcgatcgcacaaacacttctagctcctcttcttctcccccc

SEQ ID NO: 43264 - DNA, 5011 bp, Oryza sativa; identical to SEQ ID NO: 41074
  unsure (1)..(5011): unsure at all n locations

SEQ ID NO: 43265 - DNA, 803 bp, Oryza sativa; identical to SEQ ID NO: 41075
  unsure (1)..(803): unsure at all n locations

SEQ ID NO: 43266 - DNA, 3552 bp, Oryza sativa; identical to SEQ ID NO: 41076

SEQ ID NO: 43267 - DNA, 1373 bp, Oryza sativa
aaaaaacttattggctttgtttgatggtatagtccggtgatataaaacatttgaactatataaaaacaaagtgatcaatcaggagcgcatttgctatttgagaagtcgggtcaaaaatatgtggattttcatttaggatgttaaaaatctttgcgttgaaatggcactgaatctgcataaatcatatgagcaagattggccattcttgttttcagaatttatatatgtatatatatcagttgagcacagaaagcaaagaaagaaatgatgcatagcctgccttttgcctccttgaaatctgaactagacaccaaagccttacccatagtccctcccatggagaaatttacacaaagctaacaaaagtaacacacacccaattaagctttattacattgagcatgccagagtgacagccctgtaattaccagacccaatctctctgaaaccattgggtacacatatatcatatatctacacaaacttcaaaaaagaaaaagaaaaagaaaaagaaaaagaagaaaaattcgagcaattaaaaaggagcacaaatacagtgagcaatccattgctggttgatgcaacgcattgagtccatggtggattggatggattcatcgccattgctggtgtttcttcttcttcttcttcttcttcttcaacctttggtgcttcgccgcgatccggacctcgacaacgcggccaccctcctcagcaccttggagatcttggccaggctcggcttgccgccgccgccgccgaagctcatcttcctcgtcgagaacttgagagcctggaggcagcagagctgcctcaccgagccttcctcctcgtcgccgtcgtcgtcgtcgtcttcctcgtcggcggtcgcgtgttcttgcttgcgttcgacgggggctcgttcttgcttgcgtttcgccttgctggcgccgcccttggtggaggtggggccgccgccgccgccgccgacctcgtaggcctcccagagcatgtccatgttgtcgctggacgactcgacgacggcgcggtcgcggcggagcttgagctgcatccgttcctcgtagagcttgcacgccaacgtccgcttccactccttctccttccgcggcgacccctcgccgacgacgaggaggtgctccgacgacgtccgcgagtgcacccgccgcgcgatcgacgtcgacggccggaggggatcctcccttggagattcttggtccggccgcgtccttgaactcctcctcctgatcatcgtgcgattcttgcagtcgcatctcgtgctcctgcgattcttcttcttcttcaggttgcacgccattgtcacaatcttgctcttgtaactgttcttcaggttgtgcatcattttcagaatcttg

SEQ ID NO: 43268 - DNA, 1191 bp, Oryza sativa
tcaatagcagtctggcactcatgctccttcatttcagcaatcctcctatttgtagaagtcccaacaaatcaattaatattcagatgcaaatacaatataaagataaaaggagcaaacaatatagactttttagtgccgaatatagatcacctgcagtgacaattatgctagctacatgaaatgatttggtaaattttaagtttttaacaatgaagcttgtgactcaaaaatatcgatgcagtatcaactagaatggattaaagaaagacctgaccctccatattcttccatgtagatttactagtatattataagtgacgctcctatatgattcatattaaaaagactagaaatgacgttagagctccaggttgtctcccatcatttaaccattgaagctagcttttataatttcaagcctcacttgcaatctacaatattcacatgatttcattaacccaacctatattttatttctgtaattagttgagaaattttctaatccaacatatatgtccaaataacaggtagcttatggactgaagaggtatcacctaattggttgttcttcatcagcacaacaaaataaaatgccattctaagtgaatgctgttttttattctatcacaaaagtgcaacgttgtctgtttaataattaattaatacaatttacgcttgaaatataacagagaacttgaatggggaaaaaataaggatagcagcatgtcgacctcctgagaccactaaacacttttgacaaagggcatttgtaaataacctgtgaaggcagtcctcaggagaaccgatgctatgttcccagcggatcaaggtgtcctttctttgattagatagttcttgaagttgctttgccgcagcaactgggagtacttgtggctggttcttcaacaaaccacacaagaagcttccttcccacgtttggggctcgagtggtgcattgacactttcaaattcagagtcatcaggctttgcaccagcaactgtagtccgtggacttctggtactgcatttagatttccaattcaacatacttccctgtgttgcaaagttgatagggcagcaattgttatgacaatattctaggcgaaacacacgcacaaatcaatgatgcaacaactagattaaactaatgcagagggcatgaataaatcagactaaattcggtaagaatca

SEQ ID NO: 43269 - DNA, 705 bp, Oryza sativa; identical to SEQ ID NO: 41085

SEQ ID NO: 43270 - DNA, 1086 bp, Oryza sativa
tatagggcgaattcgagctcggtaccctggtgctgaaaaatatcattgtatcaaaaaacaaaattatagtatatatgtgtcattgacgtgtaggttcagtcctcacgcgttattcttactagcataacactactaagttacaacggatttcttttaataaaaatagctcattgtatatattttttgaagcccataacaaattatttttattatctaatatattatatatgattatgttaattttgctgttactttttaggtgcctattgagctagagctcttaggatttgtgggggttaggaaataagcaaaatctctcgtttgtgtgtcctacaaagtggcaggttattactagaaaaaaaatgctcgtacgttgcaacggataaagattatttttatcttattattattatatggtttagttaaggtgaaattcactgtgagaattcgtttcgatatatatttttctagaaaatcataagctgcaattagaaatctggtcatctcaaattagcatgcgagctttttaaaaagacttcttatacgactctttctgtatttccaaaagtgaactaacttaaaacccgactcaaatacggatctgtatttttaaaagcgaacgaacttgaaaaccaactcatacacagatgacggaccaaaataccgacaaaaatatctttaattttttgtaatagtagagatagagattacagagtataactatagatggcgatgatatttgctattcgcgtgaaattacgattgtacttttttttgagttatttgtgtgttcatgggagtacttcctccaattgttgtcctgatggattcggtggataacagtggactccatgcaaccttctctctggatcctcaggagcacgtcgagcaagtcctcctcatcttccccggaggctctgttttcttggtgctccgcgataatggcgtccaagaacgcgaacacctcctcgcggggccgcctcatccggcgaggcatcctgctgacgaccatggcaaggcgcgacgacgggtacaggtccggcaagctcggcgtcacgaacagcttgatccctcgctcgagcatcg

SEQ ID NO: 43271 - DNA, 4012 bp, Oryza sativa; identical to SEQ ID NO: 41086
  unsure (1)..(4012): unsure at all n locations

SEQ ID NO: 43272 - DNA, 3297 bp, Oryza sativa
ttccccataggaattcgatggacatattttttttagaaaatcatgagctgcaattaggaatccgatcgtctcaagctagcatgtaatttttttaaatagatttcttatacgactccttctatattttaaaaaataaacgaactttaaaaactgactcaaatacggatatgtattttcaaaagagaacgaacttaaaaccgactcatatacggatgacgtacctgtcatagttacgaataaggcatacttactatcctatgacatatgaaatatacagatacgacataccttcgtatgtacgatatacttccatatacaacaaggaaaatgacaagagactatgaaaattatcctcatggacaagtgaatagtagagccctaccttgaggattgggtttatattatatcgtgcagggtccgtagtctccgagttctacttggagactaaggtgattcacggtataaaagatacatcccctgagggatccagatcatcgaatcatagcgccaataccaccaccatagcctacaatccggaggacgtgaagcctactcaccgggagatctcgtcgaaatcatctcgacgaggggtctcgccgccaatcttgggattgattgttctctattctaatatgtagttttccatatcaatctcatataaactggactagagctattaccttatgaggggcctgagccagtataatacttgtcttcttgttttcttgatgtcgtatcgtgtaaattctcataccaacttaccacaataccctattcatccggtttatgagatttctcgttgacagtgctaaagtactggcaaaaagatattcaatttttataatagtagagataagttctttctctaattttcgccttttttaaaaaaaaatcgttgtgtacctccttttaggtccttgatattttttttgtacgttgccaatccctttactttaggttaggatcaagaagacattattttaggttaagaatcaagaagacataagcttcgctgcaaatcctgtaacgccccaatttccgtatacccttaaaaactatttaataaaattctatgttcaaaagtttggttatttgagtgtatctaggtttgagtaccaaagatctcaattaattcattcctttgtgaactcaaaatcttgaccaaaatattctatcctaaattaaatttctaagattcaaatttcgaggttcgagtcccctcctaaaccattcaaaaattcatacaagaactcatataaagtcgtagaatcattagagttccaaggtcctaagcaaagtccctcgaaatttcatttcctaaaattcctggaaattggaaaatattactattccggcacaactaacggaggaggaggaggaaggggaggatgaagagcggcagaagcaagatgaggtggtagagctgtacaacctccgccatggctggtgggttagcttggatcaaatcaaagcataaaggattttgtatctaagcaatggagtttaaatgcttgcattttgcttgctgtttttgctcaataggtggctgattgttgggccttgtttaggggagccgcagatttgatattcttctgcttggtaaccaacttctgaaaatttagagacgctgggtttttcagcttttagatttttcattttctggattctacaactatggatttttagaaaaatttgggtaacaatatggaccgtttgaggagctgaagattccgggtgtgtttagatcctaaaatattttggctaaaaatatcacatcaaatgtttggacacatgcatggagcattaaatgtggacgaaaaaaaccaattgcacagtttgcatgtaaattgtgagataaatcttttgagcctaattacgccatgatttgacaatgtgatgctacagtaaacatttgctaatgatggattaattaggcttaataaatttgtctcacagtttacagacgaaatctataatttgttttgttattagtctatgtttaatacttcaaatgtgtgtccgtatactttaaaaaaatttggccaaagaactaaacacggcctctgtgagaagctatagctgctaaaagctcttccaaacaatcccttgttcttagtcagctctgcattctgcacccagctagttttttgaattagaaattattgccaaaaggaattatgaaaattaatggaatctttgtgtattctatccagtgtttcataaaaaaaacaatttgttgctagcgtttcgttggttatcagaaatttagaaacaatttaatgaaatttcgaatttaatttgttttaatttatccagattactcagcggtttcttgataggaaccggctaagataactgatggccacagtaaccaggtgatattttaactacttgatcattggatcgttattttgaggaatctaattatttactatgatagatggatgatactcattaattcggtatatggtgacttttatatccctcattgcactaacgagatggttgactaacctatatcggttcctgatttcctacaattaaacgaattgtaagaacaagtgatcaattaactaaggctatagctatagcctcgattattggtcagatctgcatcaacctaatgaattactttcaaagaaaactaatgtcatctctgtgtataataacagcctgatcactaagcatctaagccgccaaagtaaatagaaaaggcatgctgctaacattcgcatcccacgccatactcgcatcccgctaagctacgagctcatatatgatatatacaactagccaggcaactgcacgtacatgataaggattttctatacatggatgtcatgaaacccatcatttacgcgcgacttagatagttataggaaaaagtaacattaattgtgatgttataaatcgatacacaaacgtacaagattagattgatatacaactagagaaataacactactacacgaatgatttttcatggacgccgggcccttttgggcgggccatgagtggaaccgcacgggataatcgagcgaccggcatcgggcggacgcccacacgggaaaatcaattatcccgtgctggcatcttaatccaaccgcacgggataatcctcattatcccgtgcggtcaacttaagtggaccacatagaaaaatcgattttcgcgtgcgggctttttaagtggaccgcacaggaaaataaaatatcccttcctattttctctctcacccacttcaattttttttgacaccctctcttctttttccctattatattcctctcctcccct

SEQ ID NO: 43273 - DNA, 1441 bp, Oryza sativa
ccggtgggctcaagggtgcggcggaggctgccgacgacgatgacgacgacgaggcaacgcggcggccgttgccgccgacgacgacgaggaggcggtggccgggagcagcaccgccgctgcctccacttgaccactcttcccctcctcccaacgctcgcgcaaggcgtccgggagcggcgccgccctccccactcccggatccggtggcggcggctaccccacgccggatccagtggcggtgggagccggcgcggcagtggcggcagggtgccccgatctatggttaggatttcaattttttgaaattttatttttttttcagatttttatttttccgtgcgggtgacataagcacccgcacgagaaaatcacgattttcccagacagcccgctccaaacgggcgaatctaccgcacgcaaaaatcaaaacaaccacacgcaaaaatatctattgtagtagtgtaaaaataatagaaactgatagtaaatagaacctgtataacgcagataaaatttattattttttcttcatgtgtagatcaaatttagacttcatatttatatagagtcttatatcgtcatagtttatcttatcaaattttatgaattttttatataactatttgaactacatgcatacacttaaatgttatggcacctgggtgtagaaaatacttgcccacgtagactagcatcatgtgcaaacacagtagcaacagttctttagctagcttgagaaaattcattgcaatggcaacctctggctacacaactgcctccctaggctcccatcggatggcctaataagaaaaaaaaccaaattttaaattttcaaacttaattttgagaatgactttgagatattttcaacgtagatttttttagcattggcttttaaatcacaaagaacacatatataaaagttttacctacaaattcaatttttattttctaataagccgttttggcttattagaaaaaaagcgaaacgatggcgcccctaaagtccctatggtggagctttagctcgtgcttgtcgcagggtgactgtgaggcagagagaagttggggaaagaaagagagtggtgctaacaggtggcactcatattttggtggtgtttgtatctcctgaagattaagataaagataaagtgtttcaggtaaaataaggtgataataacgtatgattaattgagttttaattattataaacttaaaaaaatagattaatctattattttagaacaactttcgcatagaaagttttcgcacgaaacacatcgtttaacagtttgaaaagcgtgccacgaatattcaaaactttatccactctttgtggtggaaacgagacctttattttattttactgacagatgggcagtgcagatgttttctataattcagcatgaaaccagcaggggcggatcgaaatagtgctaaa

SEQ ID NO: 43274 - DNA, 2437 bp, Oryza sativa; identical to SEQ ID NO: 41087

SEQ ID NO: 43275 - DNA, 756 bp, Oryza sativa; identical to SEQ ID NO: 41088

SEQ ID NO: 43276 - DNA, 3290 bp, Oryza sativa; identical to SEQ ID NO: 41089
  unsure (1)..(3290): unsure at all n locations

SEQ ID NO: 43277 - DNA, 737 bp, Oryza sativa; identical to SEQ ID NO: 41090

SEQ ID NO: 43278 - DNA, 1494 bp, Oryza sativa; identical to SEQ ID NO: 41093

SEQ ID NO: 43279 - DNA, 3509 bp, Oryza sativa
tatagggcgaattcgagctcggtaccctaatgcttaaaggtgtcgattctttattttattcatagtgcgaagctaggttggaaaaggcctataggtgtcggttttaaatgaaccggcacctataagaccggtccctatatgggttttttttagtagtggaaataaaccatctaaattcctaatcacagaaggacaaaagatctaaccaccaaaagaccaccccaccctgagcggctgcgcttgcttcgcttctttcccttccgatctctttttttcttgttggtttctataaaataaacaaacaatttaaatttctaattaaaaaaggacagtgatctataataaaaaaagacgaaaacatgtctcaccacatcgttcatattttctttcatcatgatctcattttttctttatctttatctttacatatttaaaatatttgtagtgtttagagatggcaacggggaattcaccgtcaggggtcacatccacgtccccgtccccatggtgataaaatttcaccatccccgccccgtcaaccataacggggctacatttctccagtcccgatcaccacgtggtgaatttatccccgtggttacagcggacgacgtggcagcggacggcgtgctggcgagtggcgatggagggcgttggtggctcccggcggcgcgacgacagccgcaggcgctgcgcggcgcgacaccggcgctctcggcggtgctctcggcagcgagtcgacggagggacgggacaacacccgtgcctgtgccacgcaagaggaggcggcggcgtgcgcgtttcgagcagtggtgctcctggtggctagggagtggcagtgcacggcggtgtgcctggtggctggcagagtggcgaactggcgatgcacgcaggtgcagcgccgcaaccgagagcaggaggactggaggagagactggatctgaggatttggattatggagtttgaccggttgacttagggttaggttttatatatatacctattaaatgggcttcagtattatgggccaaaatgtataaaaagtctagaattagtcctctatatagtaaagtcgggtcaccgcgggggcggggacagggaatcgtgcaccgtccctgcccccgtcatcctcgatggtaataagtttgtaaccatttcatcccccatagtggatacatattaaccatcaccgtcacctaatagatgaattcaccgtagggaaacggtgaacgggaccccactgccatctctagtagtgtttctattattcgtggttgtatggcgtacattaacgattttcgtgtttctgcactggcgccctagcaacacgtgcgagtctgattgctcccaaaccaaaattcaccgcttccacgtcgatgatgaagcatcccacgtgtcagaatccaataggatccacactcagcacatcccatttgccttcccacgccaggcgcacaaccataaatcatatcctattttggttctgctccatcggtaagtttacaatttaaatgacgtcaaaggatcgccaactcgtgaattaggaaataaccgagtcattaatataacaaagtgtataatagtaacaagcatcataatccatatgacatgtggacccatgataactagaaaatataaattaatatttaattaaagtaggttcactctttttaatatacacatggattcgatctacatgaagtcatgaacgaacaaacacccaatttaagaaataatacatctgataatttgaataatatattcttgaggaagcgcctggtgcctggaagcttgaagtggccgctgacggtgacccatacgccgacagaggccatgttggtggtgtcgggtaggcctacgctacatttaaggcagcgatgtagagtgtggagatactcgtaatgggaggcaaaggggtcggtgtcgctaggcattagtaaggcccaacagtggaagcagtttgatgaagatgaggaaacagtgtagttgaggatacgatgggagtagaacaggagcccacgctttgatcgcacaagcatgaccattatatgttgaatggatttctcaattattgtgttgtaccgccaccacaagggatcagcgtatggtgtccaagcttttcactccaagtaattcctataatgcaggaagggcaaaagcagagttttgtcaatccgtctactaaaaaaaaagtttctgaaaaaccggtgaacgtacacaaaaatagagaaaacaaccatagaaaaaaaagttgaaacacactaagaaaaactgaaaacatactactccctccgtcccataatataagagattttgactttttgcttgtattgtatgaccactcgtcttattaaaaaaatttgtgcaaatataaaaaatgaaaagttgtggttaaaatactttggataataaagtaagtcacaaataaaataaataataattctaaaattttttaaataagacgaatggtcaaacagtgcaagcaaaaaatcaaaatcccttatatcatgtgacggagggagtataatagagtggaacggaacatttaacccctcttactagatcccatgcaacacacgcgcatatttgctagtagatacaatatataaagtacttgaaaacaaatctatgccatatataccattttccctttttcaattaaacacttgacaaaccattggtggccactctgtacaatttaataaaaatattatcctaaatgttaaatatttacaaacgaagggagtatttactatatcatatttaatctgttgtaacggtggtgatagtgccatatcatctcatcagcacaaaaatcgctttgcagattttttttaatgataatatgtcatctgtgcatgtggcttctataagattgcatgttacaaattgtatatatgtagaataagaaatttgtagtagtagcagctggcatttatttttttcagataagatcagactaactactgtagctggatctctaatttaattaatgtaataaattagtattagattatctataccactagagcatggtaaaactgtatgttaacataatgtatatagcgatctgttcggtcctggctaagctgcatatgccactacttgttcaaatcagttgacccaaaaatgcacatattaattagtcaaagcccgcaaaagctgcaaacaaacgtgatgtgagctcgatcggaagaaatctagtagaagtccaaggttccaaacttacggcatgcataaaagagcgacatatatacacaataatgttaaacaaattccgtcaaagctcactactttgtcaaaagatcacaaatttatcgacgggctagccggctactcgatcgactgttaaactatatataaggcactcctggccggccgtcgttgcttatagacttagcactctcattttctaggtttagatttattggtttaagcttttaagtcggtcttttgactttcatgatttatgaattggcggatctaatatcataagtttaatggtgaaa

SEQ ID NO: 43280 - DNA, 3082 bp, Oryza sativa
ccaaccgtgattaaagtggtgagttaccgatcgggactaaagatccttggcccccgacatacatctgacaggggatgaaccgggagtaaagaaccaaccgggactaaagatcataatttttataaccgggactaaaaacaatctttactcccggttctttttggatccgggactattgtggattttgccggatcgattaaagatggtttctccaccagtgaaggggaggatgaacagcaggagaagcaagattcaaaattcatgcatctcagaatattcatggctggagggctagcttggatcaaatcaaagcttcacatgcatgtatctcagaaatggagtttaaattaatgctttcatttggtttgctgttgcagctcaatagctggctgattcttgtcagctctgcgcctctgcacgagcgagtctttttgaatgagaattaatggccctaaatccatgtgtattctaaccaggttttataaaaccgtttgcccaccgaaatccgctccctagcgttttcgtgttggttatcataaacttagaaaaaaattatagaaatttcgcacttaaatttgtttttcttaatttggcaggcttactaagtggtttatcgatgcaaactggctcaagacaggtgatagtcatagtaactaggtgattgtcgattttttaatataataagaataatttcattaaaaatataactacgcccggtctctacatcaacccgaaatgcacacacagctagaaaagaaaaggaaaacaatctaagcaactatgaacgtatcatattgtttacatcaactcatacaaaacacaataatctagacaagaatataaagtgatacacatctactctgaaacaatgatttcaagaaggacctaatgcttgtctatcacagccataaaaaaacaggactagattttttttattgggagcttgagataacaccttcaataaagaaaataataaacaagcatcgacgctgtcgaatctagataaaccatattagggttttcacccagagtactaatgacgactctgggtgagcacgatctgctcacaattgatcgtagctgttgaactgattttagcaaccacgaatcttccttatcaaaatagaagtcgctacctgcgtacgtagtagcaaccaatgcctgatcaccaacaacacagaccaagcagtgatgatttgtagcacgttgggacaaagcgctactaggtaaatggaagaagccatcattgtaatgaactcccgaaaataggaataaaattatcaacgaacatatccaagtgtctcgcctggtatcatcatcgattagactagcaccactttatgggagggcaccatcgtggccttcattaggtaggcatatctcccttattggatcttgttcaaatcaatgcgatgaccttcgcggcgcttgtttgttaaactaaataaagcgatctgctggttgaaatagaggaccaacggtgaaggcctgaactatcggtcgatctccctactagtccacaccatggttttatctttccgatctacatccgccgcccaccactgctgatggctatagtagaggcggagcagatcggatgaggaggcgggctagggttggggagcctccccacgcaaggcaacccaagaggccgtcttttctattttttttttcttaaatgattctaactacttgatcgcccattggatcgtagtgtttggggaatcaaacaatataataatggatatatctttcctgagattatttcatgaattaggcatggtgacttttatacatagcttgtactggacgagattggttgaccaacctgttggtaattaaacgaattgtaagaacaagtgatcaattaactaagactgtagttagcctcgattaatggtcagatctgcatcaactaatggattattttttgaatactaatgtagtctttgtgcatagaacatcgtgatcacgagtactaagcatctaagccgccaaagttaatataagaagtaagctgctaatattctcgcatcccccgccaggtgttaactgccaataccctcatttatacaaatccatctaagcaacgtactacacgtgactagcactaggtgcgacaaacggtagcaacgtttttctagtttaagaaaatccgaggaacgcttaggggttctatagctagctccgcaaggtgatagattagcaggtctagttttgaagtctaaccccttttatttatttgataactagaaaaaatgcctatgcgttgcaacatgtgaagactattttaatcttattattattatatggtttagttaaggtaaaattcactaaaattcgattggatatatatatttttttaaaatcatgagctataattaggaatccgatcttctcaagttagcatgcaattctttttaaatagatttcttatacaactccttctatattttcaaaagcgaacaaacttaaaaactaactcaaatatgaatatgtatttccaaaagcgaacgaatttaaaaaccgactcatatacggatgacgtacctatcatgattacggataatacatacttcctatcctatgacctatgaaatatacggatacaacatacctttgtatgtacgatatacttctatatacaataaggaaattgataagagattatgaaaattatcctccggagcttcgattctcttatccttctggtcacttggaatagctttggaggtagcacaacgcgcgcttatgtctttgacaacatcttttccccagtctaggtgattgacgatattccaagagcggtcgaatattgctctccactggcaaccttcacataggggtgtatacatggatccacactccgtccattctataatatatggtatcctactttttttttatattaaggagaaaggaaaagaaactacgtacggtccttatttgtcacaccagtttgagatttgccatgaaagtgtcttttccacagtctaggtgattgacgatattccaagagcagtcgaatattgctctccactggcaacacataggggtgtatatatggatccacacgctccgt

SEQ ID NO: 43281 - DNA, 1478 bp, Oryza sativa; identical to SEQ ID NO: 41094

SEQ ID NO: 43282 - DNA, 1922 bp, Oryza sativa
cctttaacggacgaggagacatagggcttgttcatattgatgtcattttcaaccataccattttttttataaagttgccaaaataatatacgtttagtttgttgccaaaaatttggtaaatatggaagaaatcctagcaaaattttggtattggctacaatctgaacatgcccatattcttaagaaatcaaaacatttcttttcctatatggatgtaacaccatacactatcactcaactcaatatattctttttcaataatcaactttcagtcctcaaagaaataacaatcaaaattctcaacgtgagatgcgtgtggagagatctgtccaagtctaccatccagtctctcgcccgccaccgcgcgacaccatcttaccatcatatccaaacaacgtgctacccttgtcgatcgatcagtgatcgatgttgagaccgacagatattatcgcaggtacatgcacgacatcgagcacgtacgcacccgcgctcgcaccgcatcggacgtacgtcggcgcacgcgtccgtgatggcgtgtgggggcatgtacgtacgttcagggtaagttttatagtggaggtggatgtcagatctaatttggaccatgtcatcgtcttcttattaattaaaaggcaacgcatacaacatatcacatctaatacacaaaccaaaatattagtttactctcacatcatttttcacttttcttggagattgtgtagagcttgccccttgtataagagcaagtttaatagtatagcatactactagcttcaattcatccgtagccaatctaatagctaattcatacaatagttgcttattatacttttaatatatggtcccacatgtcatatacatattgtgtcttggagtccgtgctgcagctggctacagatctgtagcccgttgttcttctctatcatcttttatcttattaaaatatgtttatagctagctaatagtatactattgtacctgctatgagggatggcttattctctctcttcttcacctcattatctaccggcagcagagccgcgccgcggcggcctatcctcctgccaatttttgcttctccaaaaaaaaaaaaaaaaagcctctctgcaaaccgcgcggtattgtcgccttgttcaggctaccccatgctagcttagctctactaactgcacatatcgccaatctatgggcgcagttttccgtgaaggcgccgtgggcgtgctctcgcgctgattgggtacatgtggttctctcaaggtaactcttttttttagagggaactcttgttcagttttaacttcagtttacaacattttttaaacagtatttcaccactttgtttggagaccacatagttcatcacgtggattatttacctgtggtacagtctggctgcccgctgtgtgtacatgcatgtgaaatttaacatcccccaatttatttcttgaggttaattactccttttattctttttgcgagcattttttttaaataaaaacgaagccagacttgctgctgttatattaaataggaattgagtatatttacatattcactaacggcgcaaagaagaaaggaataaaaacaacaaaaatacatttatatctttgcataggcactagatatgaactaaggtataatattcttgcgatatctttggcgccatacatatatatatatacctcacacctagattaattttatctatgattttaaccattagctgttgcattggagtttctttatttctgaaagcacttttgtttctttcacaccaaatcttccacacaatgcaatcagcataggtagtgacttcattgtcttagtcttgtgtttgcgaggaattaatcttatgaatcactctagctactcctagcttgctagtcttgcatttaatttaccatctctaattgagggattgg

SEQ ID NO: 43283 - DNA, 3917 bp, Oryza sativa; identical to SEQ ID NO: 41095

SEQ ID NO: 43284 - DNA, 2240 bp, Oryza sativa; identical to SEQ ID NO: 41096

SEQ ID NO: 43285 - DNA, 1678 bp, Oryza sativa
cccgccgggccgcagccgcctccacaccgccgttgttcggggagagggcgccgcgccgttggttgtgggggagggcgccgccgccgccgctcgcgggaagagaggcgccgtcgccgccgctcgggggcgcggaggggagggcggcgatgtgagatgggagggagggaaatgggctagggtttcggcggctgaggagaaggaggggttttgtttccccgatatcgacgctcggccgtccgatcaaaaccctaaagatcggacgatcggtgtcgtccaggccgaaatcagcccaagagggatcgagagtgaggccacttttctggcccaagcccaggttgtggcctggggaggggaagtgcacttgcgcgtgcacaaaaggccgtggaccgaccggcaagggccggaaataagtctattttaggtccctcaggcccaaaaaaagagaataagttcatttttagtgctcattttttcagaagcattacaattataagttattgaatgtgtttatttcgaagcaaacctaaaaggaaggattttctttctttttccaagtaaataattgttaaatgacgtttgtattaataaaattaacaattaagctctgaaaaattcaaatataatttcaaagagcgtaactaatcatggagaatttaaaaaaaattaaatttaaccatgtcattttatttctcacacttgctttacttgtaaatttatttaattatacacatacctacttaaaaataccaaatatttcaacgaatttgtattttaattaattgcatatttttctaatctgtacgcttcacattgtaacacacaggcacttttgctagaccaaacaacacttttggtcaatatacacactccgtaatcacccggtgcaacgcacgggcacttttgctagtggtcttataagtacatctattttctctatctatttaatgcttgaaattatggaaatttacccttttattcatatattaattgaaagcagcaagacattgagatgatggacataagttggaagacgaatatgtgcgtacaaattctaaattccaaccaaccaatgtaatgaaactacttattttccctccacatgttccacatgtgtataagaatcgaggaaatccttttttcaaaaaaaataattttatcttcttattccttaaatataacgttctaagtgcataacattaaaaagttcaagttacacagtaaaggaaactaatgaattgattatttgtttgaaaatttggtactcaaggagcataacgtttgcatcaagcgggagcaaaagatgtcggtagcattcttttcccaaaattttaccttaattttcgttagtacacttttcaaacatcggtgtgtttcatgtaataaaaaatctatgtggaagttgctttaaaatatcaaatatatcaatttttcaagtttgtaataattaaaacttaattaattatatgctaatagttatctcgttttgcatgtccgcatttaatctaaatcttcgtcagattcgaacacagtaatctcatttgctagttcattctatcctgaataaaagattgcaaagaggcctggcttttttttattattgtccttcccagtccgcagtccccactcttgagtctcgactcctccgctgctctccactcatcaatctgctcctcgctcg

SEQ ID NO: 43286 - DNA, 2706 bp, Oryza sativa
tgcttctcgggccagcggccggatccgcagcccacgataccttcgccctccgcatccggaagacaactcccatattcccaagccgatgtgattatcggcgcaaaaatctagtagtgagctttggtgctggacaaagcaccagtgagtgtgagttgtgcgatacagctagcgttgcttgcgtccattcacttactctctgcctcttttgctcatttgcatcaccatccagtatcccttagtataggctcggtgattttggtactcgcctgcaggcatgcatgcatgcatcctacttgggtattttcctctctacaagttcaacgaaagatctaaagagaaccaatgatcctagggaagacactgcttgattttctttgctgaaaatatctcaacacgtgccttaatttagcaccaattgcaggtaattttaaccagttctttggtgttctaaatggaaggagtataaataaaggacacgagagggtggttcgccgcggcgtcatcggccgtgacgcgcaggtggcggaggatccggcaggccaccactcactcgcacacgccgcctcctctcctcctccgctagttagcgcccctcccttctcctgatccgggccgatggccagtgccgtccctcttctttctccccgggttcaatggatctggcaagtctgtattggcacgggcgttctcgagggtgactcctgtcggtgagatagaagcgttgaggaagggcggcagcatggcggcgggaagcacaggggagggcgaggtggccaggcgaatgtgaagaagacgagcccaacgccgttgagggagaacatgaagcgggtggtcggccgcaacgcgcgggtggcggaggagccagtggattagggtcgagcaattctgcaaataaaaaatacagtaactccgtagttttacgatgaggtccaccgcaacgaactttagccgtcgatacttaatcaaacggtgcaaaaggagtgccaaggagacacgtggccaggtgttactggtttcgggccctacaatcggtatataagatttgtcactcttaggagtgatgataaatgatttgccactggacccatatgtcatagatacgtgagggctcacatgttatagacagcgagtggcagataattaattgccacatcttaaaagtgacgaaaagttaaatatccctctaatttcacaatcatataaacttttttccaaaaaaaaaatattacagttccttacaagtggttgttggtttggacacttttccaagcttctaccgctatataaacggtgtgttttcttaaaataaatatataaaatttgttttaagggtgtgtttagttatttgggtgtaaagtttttaagtatacggacacatgtttgaagtattaaacgtagactaataataaaacaaattatagattccgcctgtaaactgcgaggcgaatttattaaacctaattaatccgtcattagcaaatgtttacagtagcatcacattgtcagatcatggcgtaattaggctcaaaagattcgtctcgcaatttacatgcaaactgcgcaattagtttttccccacattttgtcagggttatggataccacatacctaatacatacctaatagtagttgactaaatctcggcaggatccaccacataccatgtcttatacggaaactgacctcgaaggagttccagataaggaaagacaaccagagttctacatggaaacgacaagtactactcgaattatatccatattggtttccctagttctacttggacaaggggacacctatgggtataaatacaagcccccctaggaggacagggggacagacatccaccatgaagggatcaacacccaacacaatcgacatagaagccacaacatagaagcctacatatgccaagacacgccgccggatatcgacttcagggataagcacggtctgacgctgtctgttatacaatatcaatttttatacaatatcaattatgcgagtgtttccgatgttaaatcgactacggtctgacgctgtctgttatcttctgtataaatcatgcttgtttacggtttacataatgcctgatatttacatctgctcattatatcctgataattctagaagatccatgcagtttttcgaatacatactcgatattctctgctatatatcctgccttctagaaaatatttttcaggaataattgagcactcgagtaggtcgtggtcgagtacaccgcattatcgagaacgatctcgacaaatgcagaatcgtcgcgcccaacctaccaacgaagaccgacaacctatctcatagcaccggccatcgctggattactcgagaaaaggttgttaacggataattcctcgcgaacgccgtcggcttgatcacccgacatgattgcgaacggacatccggatatgctacaagttgtgtgtgagagtcatgctggccacatgatatgcacatgtaataaaccaactttagcgcccctataggtgattaagagactcctactcctggttctcgaaccagtaagacgcagtgatctctctcgcctcactttaagtggtcgagttacgactactgcctggtcctcgaccaacgatgtagcgtttctcccactacttccacgttaagtggtcgagttacgactactgcctggtcctcgaccagcgatgtagcgtttctcccact

SEQ ID NO: 43287 - DNA, 741 bp, Oryza sativa
tacgactactgcctggtcctcgaccagcgatgtagcgtttctcccactacttccaccttaagtggttgagttacgactactgcctggtcctcgaccagcgatgtagcgtgtctcccactacttccaccttaagtggtcgagttacgactactgcatggtcctcgaccagcgatgtagcgtctctcccactacttccactttaagtggtcgagttacgactactgcctggtcctcgaccagcgatgtagcgtctctcccactacttccactttaagtggtcgagttacgactactgcctggtcctcgaccagcggtgtagcgaatctcctattacctctatttcaacaaagttgatagcaggtatacaatatcgccaagtgttttacccagagatcccttaccacgacgacacctagcgttgaaacctatcctattgtccttttacgccgtcttgacaaggcctccgaggaacctaagggaacttcggctggggacacccagagccgataaggccttgtcggatcctgtagagacaaaagaccatgtaagacctggtcgtgtaagagttctcgccgtgcgtattaaccaagccgtgtgatcggaaattgagttttccaacttcacagctgggggctaggatcagtgcttgttcaaccaaggcaggtgtcacacccgaagttttcctcccaagtcaaaatggtaatttgcaaatgaccctaagaaaatgcaggtgaaatcagg

SEQ ID NO: 43288 - DNA, 1353 bp, Oryza sativa
tactcggtcgcttgaagatgtcaacgatacgcagtctatctaatgaaatacatttaaaccaagtgattggcatagatcggccgatgtgccgagataatataaatcacttaatatctaaatgtgcctcaaagtaaagattgtgtatgctcgcagcatagccgatacagcaaacctagcatgtatcggctagtactccagtacgactctatactaagataacagggtaaatgaaatatataaaacgcagatcaatctagcaagtaagatggactggcagactgataaagagcaagatatgcttcaaataaacgagatcttaatataaagggcagatttagaagatcgagaaccataaaaggcacaagacaactaaaccagataagatcagctgaaaccccgatgctatctctattagaaatcataggaaaagctagataaaacgattcaagacatcacttaacagatcgaacctaaccgatgcagcattatgcgtgaaaagaaacataaaatctaaacaaatcgatgaagactcattcaagatggtagatacgctgtataatctagctcaataccgatatctaaatctatcggttcttttcgatgatagaggctggccgatgaagttagatgacgggatcgatctaggctatacagcatatatgataacttggcgatttacatagacaggattagagtgttatagagatgtaagcactaatcccgataatgcaaaccgccataacaagctttacctcttcgtcggagatcgaacttgatgcagcccaactcgaaagcaaagaactcgtcgaaacaatagaaaaaaggtggcgatgcgccgaagtattattgaactgtcgtcccatgattacaaggtgtcgggtcatatttatacccgaggtacataacatgtccttgctggacacgactcttatctctattacaatttaaaatatgaacaagtcccttaggcggactcttaccaaaaatatctctaaagaaaagcgtcatcggcttgtcttcatcggatttagcgtcagccgatacatacgacaggcgatgccgcctgtagccgattcatacggcagccgatgatgctcatagccgatacgcactctcccttccttaaacagaattcctccaaatctggctttgactctagctttgaacccagcccatggccttaccaaatttggtcgttaacaattatctatgtttttacatgtgtaaacaataattattatctttattaatattattatatttatataaggtacctgactagttttttaataagtggaaagatatttttattaaacataatctagaatgctataaagatttataatattgaac

SEQ ID NO: 43289 - DNA, 1028 bp, Oryza sativa; identical to SEQ ID NO: 41097

SEQ ID NO: 43290 - DNA, 971 bp, Oryza sativa
tgcatgaaatgcactaggccaatggccatcgatttatacatgtgttcccaatttccggtgacttaggtatctctggtcttaatgcccggtgcaaattacaaatgggcacaattgatctttctttttccttgtcaaaagttaaatggccggtgaggctagctatgagaggaaaggaatctttgccttaagaagagtcattatatttcaagctatggatgtctatgactcaagaatttactattctttcttctcatagtgagagaggagtacggtttttatgatcacatctcatgagtacttttaaaagttaaatttcatgagaaaacagttttctagtgtaaagattgcctctcataaatcaatctctagtagattataacacaaataaaaatactggaagcaattacctgatggttaattttctaggggacattatgcaaaaatgattatgtcaataaaaacatcaacaaataatgtgccataaactgaataaaattatcaaacctgcatctcatcgctagttggtgcggcagcatcttgcgaagcataaatgtacctctggtatctctcaagcgtcttaagcatgctgaaatatgaattagagatagatggttaactagcacactatacagaaaatatgtttcccctaaaagaaatagtatattaataaagctgttaattatgtcttccgatcaatttgtgaatgtttcgttgtcattttcttcctcaggaaaaaaaaaatcaagcctcctttagggtacattcattggagagggttgggaactgttccctctcgcacacaaaacaaagtaacgcacgattaattaagtattagcttaaaaaaacttaaaaatagattaatatggttttttataagcaactttcttatagatttttataaaaaacgtattgtttagcaatttgggaaacgtacaaagtaaacgagataatagaagttgagaaagtgtcta

SEQ ID NO: 43291 - DNA, 9715 bp, Oryza sativa
aaaccatggataaatttgttacttatggtgttgggcctattaaagtcattagacaaaatttaaaggcgagaagtccatgtatttttggtattttgggacgagggagtatatagtctaattattacacaaaacttttataaaatcattattaccttcaacccaaaatataagacacaaccttttcttttctaatgtttcataatataatgcgcacatacatgcatgtaattaattagcatctttcttctaaattcattttatttaaaatcatccacctttaagatctctaatcctattaggtgtaaacattatatttattgaagtggtaccagaatgtgataatagtattgtatttatagagggagtacaacacaaacttaaaccaacaaaattaatgacaagcataaattactaccctacctgattggtcttaattttcactggacacaaaattaaaatccattaggaggtccatttcaattcatgatttctacataaaatcaaactagctcatggccttccaaaatttatatactgtagatgagctctaattatgcactgtctataaactaaagcgcgccaaatggcgcgcctattttctagtatatttcttttttttatttcctatatctggtggttgtgtcatgcaggcttcggacatgagcaagttaaggtactctcaattgcattataagctcaatttgtgccatttagttctattgatgtaatctctaaaattttgttagtggagcacttcaagttgcttatgaggaagaccaggtagatggtagttgtaattctactttcacctaaaatcactttttaatgcttttattgatgaggatctcctcttttaataccactaagtgtatagctatttggtagaggttttggtaaaaaaaaaaagttggtccctccaatcaacaattttcgatgttgggagtttttagttcagtactctagaattctaaagttggatacacatatccatgcatactgctttagagatcatagcctctgcttggtagtatgccacaattttttccctaatgtttgttttagttcaaacgttaagtggacatgctcttatttgcagtggttttcacggatgcagagctattggaatttggaacaaactcctttgattatatgttatggacaacaataagaacttcaaaagtaggttttgtggacacatttttgggttgtactcatcattttttgcgatataattgtccaggcgttggcatcagttttttcatactacattggacggttgaattgttgatgcctcggtgcataatgtgtggctcacctgggaggttccaaggtgttctatgttctccacatccttcttttaaaggcaaacctctaaggctgtgttcgcatgcaccttttcccattccctctccttcgttttccgcgcgcacgcttttcaaactattaaacggtgtgttttttgcaaaaagtttctatacgaaagttgcttaaaaaaatcaaattaatccatttttttaaaaaaattagctaatacttaattaatcacgtgttaatggaccgctccgttttccatgcacaggagttaggttcccatctcccccatccgaactcagcctaagtgttcttctacttcttgatgaagctaccgctgatatatatagtcttgttatttctatcaataatagccctgaatttgttgtatacagtggtcatgactttatatggaatgacggaatgaccttgtgggtcttggttttttaaatcactccaacaaacgttatatgtgttgtttggttaattttatgagtgttttgagctaaggatataatctctaataacgaattccatgcgcgttctcggccagatagccccgccacgtggcgtcgtacaattgatggaattggctctcacccgcatccgttggataagaaatcaatggtatagagaaaacaatggatctaactgtaaaatattaattttcaaggggggtaaatggaaaagatggcatcccttctggagaaatcgtgtcctgttgcgatttctcgatttctcctcgcctcttcctcctctgctcctccggcaagtcacgagccatccccgacgccggccgccgccgctccgcatcagcgccgtccctcgccgcccttccgcaccagcgcctaccctcaccgatccggtgatccccatcccctagaaaccctagcccacagcgccgccctcactccacctctcctgtgcgtacgcatctcacgagccgagcgccgctgcctcctactcgccccctttccgtccgtctgcctccttcctttccggtgcgctcgacccggcgggccagcggttgagcttggcgcagcactcgagtgggatggccggccgagcgctggggttggactccgctggcatagtggtcgatcccatccgtcgccgtcaacatagctgcataatcagttgggcgatttttgtttgatgtccatagctaatcctagaattagaattgttcttcggtgattttgttcttcgttgatcctgtgagtctattaatatatgaaaaaccataagtgcggttgataaggaaccttgagaaagcttgatctgttgctcaaaaacatccaggactaccacaagcatgttctgctggtactgtacagtgtacacagaccttggctgtaggtacctacgtttttttttttagagaagggtattttttacccagcctctatattcaaccggatatatacggccattgaaatagggaacttagccccacaaacaacccaatctgaaattcgctccatagaagatttgaactcaggaccttggggtactactcaggtcactgtaaccactaggctgtaggtacctactgatctttcagtatctaatgcagaaagtgaaagtgttcccatccaaagtcatttaccatatggtcattgatttctgtagatggattatttactgccctccttattgctgccctttcttgcttctcgatattatttgttcatatcattgttttgttctatttatttctttttgcagatgttattgaaaaaattattgctgtctccatctccaatgcagcaatgatatctacaagttcatcagattttaggatgagaagattagagcctatattatccaataaaataaggtaataagtatccctatttattttaaatatttctgttagtattgcataatatttaatactttatttttttcatgtagagctcatcttcacaaatggagtcacctcaagatattcggataatgatagttgagccatgtcatttggacacaaccaacatcttaagcaaacaaacctatgaaaacaacaataatctggtacacaactgcacatatttcttttttaaatatactgacgagacaaggaaaatatccatgtaactgtagatatcttttgggaaaggtatactaacatatcatgattcctctttgcttctctattctattacagtgaacattgcagggtgtggtggtctaattatgttcagctaataagtcatggtagacttttataagtatccttaaaatttggaatattcagcgaaagaatcatatatatgacccttataactacacctttatgcaccaggtaattccacacacttactctctttgaatagttctcatatatttaatagcttgatgtttcaagcgtgagaaaaaacttggattttctggacaaaaaaaagctatatacttgtatgcattgtggttgatgttgtctttgacttactaatggcaaacatgattacatgttcttggaactaattttgagtcatgactgagcagggtaatgtatatgctgtagtaagaattgcatttattcgagatagagtatacaggtatatcctagagtaagaattgcattgctgatctaacgaaaaaaaaattatttgacacgttctttgtactttgaatcaatgatgttaagctttttttgtataccacaaatgtgccttgcatgctctctacaattatatgacagtaacaaactagagaagatgtttggggtttgcctgttgtgttcactggaatgattttgtagttgaaagtaaatttgaagctttcatatataagcaagctgtgatgattctttatataatcttagtattatgaaatttaactgtttggcacaaccttgttgtccttgagtcctgaaaactccagcaaaatattgttgtgattagaattaggtacaggcatctgattaagttattgtaaatcacatccaccatctgatttggtgaaggtatccctaaaacaaacaacatggatacaaattaatcaccttacaaaggatgattcctctatcttcacagagaatgattcctcttatctttacaaagttaaaaaaaaaatacatcacttgcagcaaaaagagtttcttctctacatagttcaaatatattatgctgaagaacattattatatagtacaatttatatactttggagtcatatattagttttgtgaaacaatgaagcaaatgtaatccatctaataaaatgttttatgataccatttacttattatttatattattgcttttctcagtatttactattataaaggatgttgattcactgtttcttaactgccttaattttctaggtttttactttagatgttccatgacaaccatataatcattcaatatattacataaatatttatactattattatcccagaaaagtagtagtgaagaagagtagaaaacactgattatcatttgattcaaacaaacagtaaataagcgctctgcctgataacatatccgataaaaactgcatacttttgttatatggattatgcacagcactaacttttggtgtatttatagcagatgcattacatgtccatcgagaaaagcgacgattcaaaacctatactcatctagctagcttaatttattagaaaattgaaatagggctttatcaaaagctttgatcatttcaggtcctgaacaatgtatgtctatataatagacagtttatatttatatattcaataatctacaatatgtctaagtactagactaaagtaatgcaaaattatggttacctactattgagatggctctcataaagttccagtttagatgttcaattatcattgattaatcaattgccggctttatctatttacatgctgaagtactccactgtactcatttcaatgactttgtcatatacatgtaacattttattacaatttgttcctggatctggaattcctgattcgattgggcactatttcatatagtgctggggctgtctcctaaatagttttaccatccataaactgaaatttctatctgttgaaaatggcgattaaacggaaaagaatcatttctgtagaacagcacgatggttaaacatggaactgagagtttttttttttcagaggggaactgaggatttcgggctttgcaatatgagcatatgccaatcagaacatgattagtgccctatttagctgatgatgatgataaggcttaataatacggtgtacactgcgttcaattgggctggcctacgtatacttccgcgcgaagcagcggttactttctagtatatgacgatttagaggtgcaatattagctttaagatctttcttaccattttgtttgtcttacataatcatccatacacatccatacagtttcaacacaagtaatttaactagttgtgtaggatctgtctatacatcactcagacagattttattattattattactagtagtagtatagtgtaacaaacaaaacaaatctttatctttacctattataaaagtttaaggtgtttttgccagtaattttcgtacgtcgtcctgttagcgcacgattttttttccgagtccgttcccgtatagcgaaccaatccagatcgctatcgcccaaatttcccatccgattcccacccagattgctccctcccagatcagttcaaacctattttgctcatatctcaatccaaacatcacaaaaactccaaacataagaacaccccatattacatccaaacaccacaagaagaacactgcatacatctattgtccgtctcactcacaaccgcttcgctcccatcccatacgcacgtacggatcaaacatgccccttgaactagatatcaaatccgatccaaataaatcacaaaatcacaaatccattgaattacaaaatcgcaaatccaacaacaatgaatcaaaatcttccaataaaaattatatcaccggtgccattgttcatcggagccgaggacgccgctgccccgaggccgtggtggcttggcggcgcgccgccgtgcgccccgaggagggtgccgccgtgaagagggtgccacttctgtgccagagaagaggattcctcggacgccacccgccagggaaagggcaccgctggctgggggggcgccgaccgccaaggggagggcgccgcccctcgggggaaaggcgccgctggcctggtggaggatgccacgtctgaggcaccgggcgccgtcggccgggaggtcgccctggctgaggggtaggaagagcggtgccgccggtggggggaggaggagggggactgggggagagggtgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacgcgcgcgctcgctcgcctcgccaggcagggcaggcggcgcgcgtgcacgacgtacgtgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaaccgacccttctctatataaaccgacttgccgtcttcacgcaacacttgcgaaatcaatctagggtttgtctcctactctgtactgcgccggcgctcgtagactactccatcccgctcgccggcgtgcaccggcgattgggagagcaggtctccggaacctctgccttcgacgttctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgacctagcaaccggtctttccgtcacctcggtacgtgttcaatatgttgcgcatatttgatctgttcatgttgtactgtgtagtttacatgtatagatctaatgatgcgttcatgctagttttcatctgtaatgtcatgatttatttatggaatagattaaatcattatatgtctataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctaaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcaaaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttgttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtacc

SEQ ID NO: 43292 - DNA, 745 bp, Oryza sativa
gggcgaattcgagctcggtacccacaaatgtgacgcgccaagatgtcaatgtgagcatggcaatgtatgaggccagcctgggccgtttgaccagcacaaactatccccttgtcaatttcatcatggccactgaagcagatttcttcattggagccctgggatcaacctggtgctacctcatcgacggcatgcggaacaccgcaggaaaggtgatgtctggctatctgtcggtgaacaaggaccggttctggtaagcaattcagaagctgctaaaccttgttcattgtattttagctcctctgaatagatatgtttggcctaagtttgcttctgtacggcaatagggcatgtatatatgcaccatcctagcagataactttagcgtgtgaaacttctgagctaataggaaaacagtatcgttatatcaaatcaggtccatatattttgatctggtatccacttaatcctagatatatattatcctgaggtccagtgtacccaagaaaaaagaggatgcacttaccaaattttcagtggtactcataatgctgataagtggtacacgagagatccaattgcagaattttatagtagtatgacagtaacagctatgccatgtaaaagaaattgacacacatgttttctgtagaacatcggtttcaaaaaaaaaaagtttcctgtagaacaaccagggcattctcctctttgtcaaccatttgatttgttgaagacatgacccaaaaaa

SEQ ID NO: 43293 - DNA, 718 bp, Oryza sativa
ccaaggacggcagcggcaaagggcggggcggcggcggcggcggaggcggaggcgtgctgcatctgccagcgacggtgaggatcgacatcccggcgacgagccccgggcgggcggcgctcaaggtgtgggaggagctcgtgaacgtgctccgcaaggacggcgccgaccccgccgcggcgttcgtccaccggaagaagatccagcacgccgagaagaacatccgcgacgccttcatggcgctctaccgcggcctcgagctgctcaagaaattcaggcacatcttccctcttcatctttcctttttgccatatctgacaagctaaaaccacgaagtcacggtattttagaacaagacttgccttttgcgtctatgtatattgtcttctatgccatgcatgatgcatatatatacgcatttgtaagctatttagaattctgatggccaaacctcacactaatagcatgcaactgatcgatcacactaattgcatgcacacacatgatatagatagtttggttaactgaccaactaggaaaaaaaaattaagagtgttcttcatagatgcatatctaacttattactactatgaatattagttgcagcatgagtcatggagcactgtgtgagcagcacacaactacacctgcactgaacccaagcatgcagtacagtagtagtttagtcaaatttcaacctcgttttgcatgcaagcatccg

SEQ ID NO: 43294 - DNA, 1071 bp, Oryza sativa
  unsure (1)..(1071): unsure at all n locations
nnnnnnnnnnnnnnnnnnnnnnnnnnnnnnnnnnnnnnnnnnnnnnnnnnnnnnnaagataaagccaaacaatttttgtttcaccaaaaagggagtggagtagagctgtatcacaaaatgaactagaggagctgtatcacaaaataaactagaaataaactaaacaattttaagctctaccaaaaatgggagcagagttatctcacaaaataaactaaaaaagtggagctggatttaaacagctctaccccagactcaactcctgtacctaaatttagaagttttagctctaccaaacaaacccttgattttagccaaaaggccgagagttgttttgaacaagcccacctgcttatatacatagcgaagcgccctcctccgccttccgttaccgaggtggtactaaaaccaagaaaaaaggcgcaaacatggcatgagtttttgttttagggccgaaatccaagccatatttctcgtgttagtggaaaaaggaccaaaattataactgtctctatctgtcaccacggcacacgatggtaatgggtcggcattgtgagcattaacaacaattcttttgatttttcttttgcctatccaaggtgtttgttagttgcacaaccttaagctctgtgtttggtggatttgatgaaccattcaatactcatagttgcatatcattgttctctatagcctatgcagtttcctgcttttcattactgcccacatggacagtcatcttcctggcaacttcacgaccgaatggtcgacgcgtctcctcctcctcctctcgccctatcgccgggtgccactctggcccaggcgcccaccccctcctccaccgaccagtccggccctagtgtcctcccccgctagcacaggtttcatcctcggctatcctccctttctagagagagtcagcctcggctccctctctggcagctactcggatggggatctgccagatctgcttcgccctcaattcctcctggcaaaactggtcagtgaggcagcggatgcgcgtccccctggtgccagccaagatccagcaggttcccccctgggtaccgagct

SEQ ID NO: 43295 - DNA, 854 bp, Oryza sativa
  unsure (1)..(854): unsure at all n locations
ataaacattgtgaagcaacatttcttaggaaaattggcaaacattatgaaatggaagtagttatgttttatgtaccatatgaaccaacttacgaatctgttacttcgagtgaattaacttattacttgttattgttgtggcatatgcatagatagatatatgcacttggaaattgtatttcaattttctatggagaaatcccaaattcgtttgtttatttatagaagagatagcttctcatgacaaattttggaagatttgccaattattgcctctggcaatctaggcgagatcaattaccaccttatgccatgttctgatataagttcataaaatgatacccataaatgtaaataaggaattattgatctcttcccgctgacaattgtttaatatgaaacttttttcaggttaaagctgcttacaagcaagctcttttgaaattccatccggacagagtatcaagaagtgatatgtatcaacaggtcaaagcagaggagacattcaagttcatttcacgcctgaaagagaagatgcttcgagtttaatactagcatatccctgttcagttaaatacaacctctgaccaatatctttatgttaaagttgtggctagattaatttattcataggctgagttctcatcagccggcacatagttccacagttctgaatgccattcttagaagactaatgcttagcattcgttatcctctcttgagaatttttagtggtaggggagtcagcagtgacagtgagcttgggcgccttggtatatttcttggtttttgtaatggnnnnnnnnnnnnnnnnnnnnnnnnnnnnnnnnnnnnnnnnnnnnnnnnnnnnnnnnn

SEQ ID NO: 43296 - DNA, 7827 bp, Oryza sativa
  unsure (1)..(7827): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcagttactctcaaaacctccaggcctgtgtgccaactgccaaccctattccaattcctctcactagcatgaatgcatgatagaatctagtttgtcttttccttatgctgaagaaccttctacagaagaatgttttgcttttgcttactaatcatagcgtggtcagctgaatgatcttgtcaagccttcatctttactatttatccctctaaaaacaaagggttgcaactattcaatgcaggaccctgacggacaacatcatcgtaggggtatcaaaagggtttgacaagaagcttcagttagttggggtcgggtaccgtgcagctgtagaaggcaaagatctcgtgatgaatttgggattctcgcatcctgttcggatggctgttcctgaaggcctgaaggttaaggtggaagagaacaccaggatcatcgtgagtggctacgacaagagtgagattggccagtttgctgcctccataaagaagtggaggccacctgagccgtacaaggggaagggaatccgatacgccgatgaggttgtcagaagaaaggagggtaaagctgggaaaaagaagtagaaaagctcttctgcttcatcatcgtttcgttcggctggtattatatatacttccttttggttttgatttttccccatgtgtaagtgtaatccatcttttacgaacaaagagaacaagctttttgaatcatgtaatctctcacggcttgtcgagatataggactcaaaatagtggagtcacactgtagagtcactactgtttccatcagcccatgttttgcccttgcagagtcacaccgaaatactactgaattaaactaaggctggttgattaaccttcacgttgttgctgcactggagtccaaaggaaccagactttcagaaacccaagtttgacaaaacagtggtaaacaacctggaagtctgtaagcagtcgccacgccatttaagggccctgagaaaatccgacgcggccgcgcatcagccatcacgtggtccgcctctgatattcccggttccaataccgcgacgcgcgagcgcacgcaaagctgacgcgcaacgcaacgcaacgaaagcgatctcgccggacacggccgcggcgcactacgccccgaaccgaaccgagcagctgaccggtgatcgaagcgctagcaccgtagcacgcgtgtgcacaccaccagcgcaccaaaaaacctccataaaaacacgcccttttgccgctatctactgctcgtagcacctgcttttttgcgtgggccggccggactcgtcgatctcgtcttcatcatcgcgcgctgaacagaagaatcagcggcggcgcatgcacgccaatcgaggcagcgatgatcgtccaaacctctgacctacacaaagtcacaaaccaggctggactggactactgcagtgctctacgatcaggtacaataccattctataataccattctcttgatttatctacttaaacttattttaagtagataaatcaagagagagaaaagcaacgggctacagatttatagctagctgtagcacggactccaagacgcagtgtatctatgacaggtgggattatgtattaatagtgtagtatgtaactattgtattaatgaactattagattagctataaatgaattggagttagtagttggctatactattgaacttgctctaagtcagttatactaacttataaacacattttaaaaagataaaagaagagagagaaaagcggcgtgctatagatttgtagccagctgcaacacggactctaaaacgcaatgtatatatgatacgtgggaccagatattaaaagtgtagtatatatttatatgtaactattgtataaattggctattaagtaactatagatgatttgaacctagcagctgactgtactattaaacttgccctactagctgcggtgtgtgtggcacttttgatcttctctgtgctctcagcctcgctcgatcgccacttaagtcgatataaaaattggacgcctactccagaattgagtagtgcaacaaccgccagctacttggaaaattctccctttcgtgtcatcatgttccccttctctcgcaatcggcaggtgatctacctgaaatcctgatcagcatcaattaattcgatctgctaattaagtagtatcactgattcccttctttgtgttgagtaggtgccatttctcaaagtggaaggcggtgttgacctacttggctgcatctagaatctaccacatattcaacccagtgtaagtatactttataattagtaatatatttgcaatcagcttatttgcacgatgttagttagttgcctgaggctgtttgctacgcaagtcggagctaatactagctgcatttctttataagctagtgagccctttttttcttcacatcacatgcgcaggaacacgaatgaagaaaagcattatacaaccaaacagagcagtcctaactcaccaactaacccaaaagaaaggaatatattgttaacttctcgttcgaataaaaacaagctactttttgtgaagccagcaagcaatctggttgcatcgtagctcaggcacggcacgtcggcagccaacatatcatgccgattcctttgctcctaatctcacttaaacagaagcatgcaccggccactttcggcgtcgcgaaagccggtcggtcgatgagatctccgcccaaatccacgtgtcagtgcacacggagacgcgtatatatacattggcacgttgatcgagcatctaagcttaactgaaaattttggaatcttactgtaaacgcaatggcttgcatcttttgattcagtcactttgctgtagcggtaaccaagcagtagtaggagagagaggaggtagcgattacgacggccaccgacaccggccgccatcctcccttcctttcgcacgcctcgtggagatgcccggtctgcctcgcgcgatcgaatgaccgatccatccatcggccaccgatcgatgaatggtaggttccacgaggcgacaacgaccgcgcggccgggttggcgaaaaaaaaggcgaaccagtaacgcgaccgcgcgagatgggagcggcaatcgcagcactgttcgggcgggacaggattaggtcacgcccggttgggagctcgagaattttctcatctctactcgatcggtcgccagctatcatgcaacaggccaatcgatcgcaaaagcgcgcgccgtggctatcgcctgtatatcgcgaggtggggtggtggattggccgcgggcaacgcaagtagcgcgagcgacacggtggcggggctcggcgcgttgcggcaacgtacgggggctcggttgttgcgagcgcgcgcgcgcgcggacaccgccgttttctgcgcaaccaccgggcacggtggctggctgggcggccgtggggatgggatggatagccccgatgagtacgtcgtccgatgagaatgccatgtgcgccgtgccgggcggtggggatgggctcccggttgttggcggtgttttggctttggctcatggctccgttgcgccgccagttcacaacttcggatccatcccgtcccgtccgtacgtggccccccgcgtcggattcattccgcccgtcgtctggccgtcggatcaaagacggatggctcgacgtttttcgctgtagtttttgctttgttgtcttattttatctgtgttttttgcgggtcctttcggtttcggataggaaagggcgagcggaaagtgagaaaagaagggggtgaaaggcgtaggatccctttctccgaacgggacgcttctatggggcttgtgacgtgctacggtattccatttcccatagtttgtttttgtcctggttttggacgcacgagtcttacaccacggcatttgttattgggaagacgaccaatggaactgtgagttgaatggtagccatggaccatggttctcaataacaacatgtgaaaaagagataaaatggctcatgattcttgaaccattgaaccttacgcattgcccagataaatgtacgctttcaaactcaaccaatttagagcatcaccaacaaattatgtataattttctcctaaaaaattgtttttggttttctaaactgaaaataagaagtgaaaaaattcttccgtctaacagatagcctaaattcaatcctcaaaacttaaaagtgggcccttctattaaactaccaagagaaaattctgtttttttttctttcacgcgcagaaagatcgctatctcccacgcgcgggaatgaaggagagaggcgggattgcatgattgggagcgactttcgcgcccgcatataaacggagcgagcaaccgggggaagagaactccaaaactcgagtaggagggtaggggatctgttggaactgatttagactaaaatccctcaattagttttaggaatcatataggtagcctgttggtgatgctcttagtgcttgggtcgcctgtgcggcatgtataccaacatgcatatacgtgccaaaacgcttcttttctttatgtcatcatctgttttatctctgtcaacttaagttattggtaaattggctaatgcattgtactacacaacattgaaaattttagaaacatcacttgtaaagctgtactgctaatcaattatttaatgttagttgtgcctatcaaaaggccatggaaccaattattagggttttctgtgcgtatcaaaaaggtcacatgatgttcttcgttagcactgtgagagtaattgcatgcacactactgtgtagatgacgtgttcgaacattggactctcgtcaaccgcaagctgatcccattattctcattggccgcatggatcggcagctgcagctgggacccatccacaggtacaagccacattatggctgtgtttagattcatagtttggatccaaacttcagtccttttccatcacatcaacctgtcatacacagataacttttcagtcatatcatctctaatttcaatcaaaattaaaactttacgctgaaacacaacctataactaggatatatacgtactgcacgagagaacgtgctggtgcacgagacttgcggcttgtgggcgcacggcatgcatggtccaggtttccaaccgcagcctgcctgcttcgcccatccgtgcaacgaccccccaactctgaaaggctgctccgaaatctctgaactatgattagcagattaggtttgacattataatcacctcattaattactgccaggtgtttactgtcattctccctacttgacccattttttgtccccgggtcgacgtcacaaaaaaaggctgagcatgattacgcaccgctagtttcactttcatcggttgggtgagtgactcatccagccgtgtgtatgtacaaagtgagatgagaacaccaaactcaccgtcacgtcaggtgagtacgcgcactagatgaaaactgtctagaaaattatcgaacaactgaacatcttttctgggtaaatgatactccctccgtcataaaataagtgcagttttacactattcatgttcaacgtttcaccgttcgtcttatttaaaaattttgttatgattagtattttcattgctattagatgataaaacatgaatagtattttatgcatgactaaatatttttaaatttttcacaattttttcaaataaaacggataattaaatattgggcacggatatccacggctgcacttattttgagacggaggtagtataattcttatttcttttctaaaaatacctcaacgttttaaatatgacgttaaatagttagattgatagataaaatcatagaaattattttcgaagggatattaccgttttgaccctttttatcccggtgcatcgtgtgcagcaaactttttttttcttggtggagctggcactgtagctgtaggccactggtgatcatcctggggaagaacgccaggtaacaacagccgtgacgcgacgggcgcgcgacctgttccctttcgggtgcggacgtgtggttgattgtgtgtgcgagccgaatgctgcctactgccgccgctttttttttttcttctttcctttcttctccctttaaatcttctaggtacttcttcctgacttcctcctccctttcttctctcgccgccgagagacacgaaaaagatggtgggtgtatagctacatattcacgccacaccgcatcgtcatctacacatctccacctcccgcggcatcaccactcactccaccgccgcgcgcttgttcgcagctcttcctcctcctcgcattgcaggcggctgccgactgaatcaaggtgagtggtgtgtgttgtgtgccttcctctctgtaactctgttcatcagtcggagttaaaagacttaatgagtttatgtggtaggattgggtattaattttgatggtgctagctggcgttcttgatgattgcaggaaggtgactgtccttccaaggattaatttcagcttttgattttttggagtgtgtttcactcttcgaactagtcctttgctttttcttccttcgtgtgcttagttcctctcttctttttgtatctagtttggtactggtagtcgattatgtagtcataaatcagttgcaatcagatcaatactttggtctcaattcttctccgtctttagtcttctgtagtagaggtttagtttctcaaccctgctctgcttttgaagaaaaagaatattcaggtaggattctgagttctgatcagtgggagctttgcgttgcagatgaagcggaccatcatcgtcaaagtggacttggaatgcgagcgctgctatgccaagatcgacagggtgctcaccaggatcagaggtaggtgctctcgtcgcacggtttgcagtttctaggatcaaatggtgtttctggcagcttttgagctgggttaatcgtgacaacaaagatgaatctttgagagttcttgcgtgcgcagacaagggtgagttcgtcatcgacgacatcgagttcgacgtgaagcacaacaaggtgatcgtgtcggggcccttcgacccggacaagctcgcagacaagctctgctgcaaggcgtgcaagatcatcaaggagatcgagatcgtcgacctcccgccgccgcctccgccgccggcgccggagccggagccggagccacccaagaaagaagagccccagccaccgcctcctaaggaggaggagaagcccgagccgccgccggcggtgattatcgtggagccaccggcgccggcgcccgagccggagcccgagccgccgaagaaagagccgccgccgccgccgcctcccaagcaggagccatgcccgccgccgcccaaggtcgtcgaggtcccttacccctggccctacccctacccgttcccgtcgtggccgtccgactgctgctgccaccatggccacggcggctgccactgctgctcctgcgggaaggcgccggagccggcgccggcgccggcgcctccgccgccgcagtacatcccctgctacccgccgcagcagccctacccttgcggcggctacaggatcgtctgcgaggaggacccctcctacgcctgcgccatcatgtgacctaat

SEQ ID NO: 43297 - DNA, 17863 bp, Oryza sativa
  unsure (1)..(17863): unsure at all n locations
ggtattaccatgtggggtttgttttgatagtagtatttggggtatgtatgcatggatatctttgttggaatgcagcatgggaactactgaaactgcccctgaactgacagaacatacccaggttccatcgaagatttgttactcatcagtggcaggtgatcatccctggagccaatcaaacgcagcctctttggttagatggcccttgtggccttgtaggcctaggactaacaacttgagaaacaaaaaagaatctataatcagatgagcataaaggtaggcagccaccacacagaccagacagcctcctctgtgtttactgtttctgaacatttgtgatatctggattgcagtgttctagactcgttatccccttatccttaccataacaacagttttgagtttaggactccccagccaacgggtacccacgaggcggccgttcagacgtcctatcaggtggccagggtgcttacgtgtggagcaccgctgctttgcttgacactgtcccattagcaaatctttcgtcctttagccgactgatctgtacgcatccaaccgcagcctcccacctatcatgattcctgacctgtatgtatccataatccattggacatacgtgcgtgattgcacttgcatagtttgcatcttgcagtgcctcgtgttttcagtgtttgattagcacacgatttttattaggagagcctacgtaaaacttgaaaaaaaaaagcccattttgatttcagttattttttgacggttagaagaacatttagattcgtgtgtaaacattaaaccatctccctctttcttcttctccaccgtaacttgctcgagcagaccaagttcgccagcacaccatccttcccgcaccacccccacgcgccgcttctcaacctcgctaatgccggcgagacccactaaccgttagagatgcaagtggatagtcccactacccgcatacaaacctgtttgttagtttatttttcatatgatagtataaaatttagaagaaaaaataaactagaagtgaaataaacatgctaaaaaaacccgctcgcccgtcccacttgcattcctactgaccgtccctctgctctcttctccctcctcacctaagacacgcccttcattactcacagtcatcattttaagctcaggaaaaacccttcatttttcccagcccaacccctcctttaccatgactgtaaccttgaaccctaattagttgggcccgtcctagccgcactagagctggaggagagggatgccgtcacaaatctcaaagtgattttgacggtccaaaatttgatgaaaatcttacttaaatttatatcgaatgaaggttaacaattctgatttgtattataatataccttgcattgaaacaagcccatacattataaagcaatacctttttaatcaactactgtctttttagttttactctagcgtattttctctctcttttttttttcagagcattgtggttttttttcaatgtgcaaccactaattttggtttcctgtgattttctcctttttctctcactactttacttcgacatacgatgcacgcgaggggagcggtggaaaggaggatgacttctcttttaaggtactccctcggtccttccatcccaaattgatcatccctagattatttttgaggttttcctaaattgatcattatctaagtgttatctattcgtttattcgcgtaaaagtatttgtgcaaagttaatgtcatcgttgcatgtttgttcttttatctgtgcaggagtaaatggcactaggactttaggcgcgcttcgcagcgccctaatgttcgttaagagctatgtagcttaggagcatttacaaaaacattgaatagtactcaaatcagagcaaataataggactatgcgagaactgctgagaccagtattatggacaacgaaaatcacattacaacgggcaagtaggctttgcaaagttctactgggattatttaaagcatgtcatcatatctgtaattgtatataacttcactgtcattcaaatattgaaaaaaattatatcaaatcatcatttttttttaatatcccatttagacttagatcaagtacacagatagccataagcacaatcgatagattctataatcactttaaattacatattgtcggtaagaaatgttacaactttaacaatggatttatcttagtaaacatgttcttaatgtattcattctaacagaaaccgctatacaactcgaaccctgccatcacgtgaggatcaaaaatagagcttgaattctgcaagataaaatcacctaataagttagtccaaaatccatgttaacttatcctacttaaaagagcaagcaacaaaatatatatatatatatatatatatatatatatatatatatataagtctatatacaaatggacctaatcattcggttttgtaaaaaagagctaattaagtaccattatgtggcaatgatatattatatgttgcagaccatgcacctaaaagcatagatatcaagaaacatctgcttatgttaatgaagcagaaattcatttgtaggacagctcccccctaaaatagtctctgattaactaaatgttttttatgaggcaacagaaaagctagttggttagataagacactctttagaaaagtcatatgcccaagtaatacattactgaaatcatttctgatgaacaataatgttttggataactaatcacattactccaatacacatgggagttctacaaagtatgtggcatgggttctcagtctttatagttaataccaaaatctgaaacgtcacttccaaaatgcacattatagataaggctacagtagtagatgactaataagactgcaactctacaatgcttgaagaacataagtccagaaaaaaaatcgtacaccatttaccaaaatggacatgtacaaagcgaagaacaagcaacacataaaaaatctgacagtcctgttatatggtaagttgctaacaatgccctataaaaaaaagcacgcaacccaattatatgtatagaacatgtttacctccaaagcaaataatagtttcagatttgttgttacttgccgataccaatattacatttatgaagcaaacttgatttgtcaacaaattaaggagtgctcatgtatgtaaagaaacaaagaatttgggaatggaaggttatagtagaaatgagcattcagacatgtgggatctgatatggaaccttcggtgggtacaaattaactgacaaagcgaacttcatcacacaatcatgtgcaaaatcaaaacaatatagtgacatttgtcaaacttacctgagtttctagctttgtcagattcttggagatttttcatttcaaagaagcatcatgtaaactcacaaaataactgtgtaataagtaaaagagtaaacaacaattaattcactttccactgattcatcccactactgcactgaaacgcagaatccttcagcaaagcagtacttgtgtatgaaatcccttgtaattgcaatatggatgcaaaactgcatctttagatgctagcaatctgacatggtggcaaacaattagtaccaggtgctgaccagagcaagtcgctgagaagaatgaagaggctgtactctcatggaaaaagcagcactgcaggcgcagacagagaatgggaggaagatcatgagtggatcgagcataaaggaggtgattatttggccattgcaacaacacatcttcttccccagtagcaaaattgtgccatatcgacctcaagccctcaaggtgcctgggattaccatcaacgctggaggtagaacatcgaacgcaattcaaattgcagagccgcacgccaccaacttgaaccaaagtcgaggtcaggctccatcccaccggatcgagtggttgcgctgtctctggtctccactcagtccctcaccttctcctgatgcatcatcacccagagaagaagatagatgagtcaacggtagcgtgagaatgcaaggggaggaagggagcccaagagtcgtacgtaagggagagctaggagggagagaggcggcggcggcggctatgccgacctcgagcgcaacgcactggattgagaacttcatgttgagcttgagtgcacctacccaaaatcaggcgatgggccaacagatcgatccccacacagccacaccatcgatctctatcacagtgcccccaaagctagctccgcatggtccactccccctgctagaagagaagggcctgggtcagcagattgatccccatgccatcgctgggaacagatgagaaggggaaggcggggccgacgatggcgtgaggatgcaagcgaagggagggagggagcgccaggagatgggcaggataggggagagctcgaggggcaagtcgtcgtcgccggcgaggagaagcgggggagggaagaaaaagcggcggcggcgcaaggacaagggaaaggaagagaagggattggggaacagtagtggctagggtttcgggggattgggtgttctttttttttttcagaaaactcccttattttctctttttcagagcgctgtcctatacttgaaatgttgtctctttcacgtaagatatatcttgagggcctttacataataatacataagacaacgaacttacattgaggaacttaagaaagattatcaaggtaagggagggtttttttttgcaaacttaccagctccagcgctctctggtcgcgagatgctgatcggacggcgctgcggacgagtaaggagagcgcccgagggcctttacataagaatacataagacaacgaacttacattgagggacttaagaaagattattaaggtaagggagggtttttttttttttgcaaacttaccagctccagcgctctctggtcgcgagatgctgatcggacgacgctgcggacgagtaaggagagcgcccgaaaaacaccagccttccaacgcgcgggggacgtggatagacgcgcgtgcgtccacgccgtccaaaattctctggtgcgagcagatcgccccaatctttaactaccccgattgctgcatgcctcgtatgtattcaattgcatatttgcatgcccatttgcatgtataatacaacaccttaaatcgataaggtgtattttcagaagtaatgatgttttctagtcttgatgttgatgttgttcgtaaatatatgatcaaattgagatggagggagtagtagagacggggttcataattccgacgaaaactggttgaattccacgaaatttcgaggtttcaacgaggctcgaaaatagaacccgtatgatatttcgacgagtttcatccaaattcaaatttgaattgataaaaaaggaaaataaataaataaaatattataaatagtatgatactcatagaatctattgggatataaattttcaaaaaaaataatgtatttcgtgtatttactaaaatttacagtaggaaagaaaagaataacaaattaaaaaaaggaaaacactttcagtttacctcttttcaagttaccgattgacatttcgatgatttcgctcggaattttgttaaggccgaccagtttttcacgaacttattggtaaactcagggaatttatattcaaattttagtttataaccccacaaaaaaaattagtttataaaatttgttcggaatctatcggctttccacttgattttatgaaaaccgttattccgatagagcctgaaacggaaggccatctcggaatcgtaaaccctgagtagagatagttgagacgagcgtgtgattctctaggcctaatttgaggaagcccacgaggatttcagacctctccgggaagcccaagaagaaaaactcaaatggaacgatgggctgggagcctgggaccatgttgaactggtgtttcttcgtgtttttttgcacgcggagaaaagaaagatgagtctccagttaactgaacttccttctatggatcatcggcatctcaaattgttttttcttgaaacaagacttcctcaatttttggtacgtgagtaatcgggatgaacgaatgcacagaaatcttttcatttgcgttgcagctgggaaattccttgctgagaaagttcggctcgtctagggaataatgaattccagccggtaaccggatcacccaagccaagcggaaaagtacaccagaggtccatgaacttgtcaccgagatacgaaaacgtccttgaaccgtaataccagacacccgaggtcccctaactttacaaaaccggacaccggaggtccctcggcggttttcaacccggttttgtccgacgtggcggctgagtcagttgggacccacgtgggccccatatgtcagccggccacgtcagcctctctcttccccctttctctttctctgtttctctttccttcctctcgctctctgcttgcactcgtagggacgatgccgcggaagcggccgggagggagcagcggggcacgccgtcgatgcggcggcgaaggaggaggaggacactggcggtgaagggcggtggccagcccggagctcggcggggcgaggcaggagaggcggccctatccatgacagggagcatggcggcggcggcggccccatccctacccggaggcgccaccgacgacgaggccgagcgccgccactccctatccgcggcggcggcccgtgggaggaggacatggcggcgcggtgatgcgggaacaggaggcggcatctcccctgccagccgagcgccaccactccccatccgctttccccctgccggccgccgcgcgcctcctactctcccccggccgccgctgttcttctccccagcttgctcccgcctcgccgctgctcttctggtgatcgccgccttccaattcctccaccgccgccgccatctacgctcacttcctcgcgcgcctccccgctgtcgccgatcccgatgccttctccttctcgcgcgccttccacgagctcgccgccgccaccgccaacttctcctcctcctaccgcctcgccgccgccgccgcggcgagttcttccttgtcgttccgctgctccctccgcggccaccccgccgcggtcttccgccgcccgctccgccgcgaccaggcgcacaacaccgcccgcctcgacgtcctcggccattgccaccacgagctcatcctcgacgcgtcgccgccgcctttgatttgggtttccgccgatttgactcacggcggccttagcccagagcgaagagggcgggcgggggaggccgccgccttgcttcccgccgctgccgccttgctcccccgctaacagagacaagagtgagagagagaggaggaggaagagagagaagaggggggagagggatgaggctgacgtggccggatgacatgtggggcccacgtgggtcccacgctgactcagccgccacgtcggacaaaaccgagttgaaaaccgccgagggaccttaggtgtccggttttgtaaagttaggggacctcgggtgtgtagtgttacggttcaaggacgtttttttatctcggtgacaagttcagggacctccggtgtactttttccaagccaagcatccaagcttggacctgtgtgcagttggatgcaggacactagtatcaccgtgtttagttttaaagttttttttcaaatttccaacttttccatcgcatcaaaacttttctacacataaacttccaacttttccgtcatatcgttttaatttcaactaaacttttaattttagtgtgcactaaacgcttttatgtaggatgtgtctgtccgtgtaaatagaaaatcgcctcggagtgggtgtttctcccactctctcattgccatgtggtgcagttccattcgtggagtaaattttaattgtgccgtacgagcagtttcgttggaacacccaacggagcactgtacgaccataccgattgcagtcttgctaggtgtacaattggagtaacgatatatcgtgcgtggtgccgtggtgactggtgagcagtgagccgggtgattattcgtcgggatcgatggtaatttttctcatggttttctacagtagctcgtgcctcgtggtgtcgtgggtttgtggtctcgcacatgaaagcagcatgccgggctcagggctaacggggacatatatttatgccttttgcatattacaattttgctttgccaaaagggagaaaggcatattcgatgaaaaagaaaaggttttgaaagtatacatgtgtgtctctgttgctttatcatttacaaccctatcgattaatgaaacaatgtatacgtgcgtaccttgctaggcacgttcgaccatgaaacaatgtactggctctagctattcacatcattaagatattgctcaaattttccctgtacacgaagggcataggcaagaagaacaatagggagccatcgtttcgcttattcgtgaaataagcgaaatgacatatttataaatgaaaagtaatctgtgaataaaacttttatatatgtgttcttagcgatctaaaagtaaaggctgaaaaaataaactttgctgaaaaacctcaaaatcagctccaaatttaaggttgaaaattcaaattttggctgataaatataagcataagcgaaaaaagagaccgatatatcatgtaataccattcatctctacctcttttttctagtatatcttgtggtcgagacatctcttatttgtctctcttctcccttttcgtatatccacataagcaaaataatgggtattccctttgttgtaaaatataaggaccatatttctaaaaattattgtaaattttaactaataactaaagtaacaatactatatatgttgagtatcatgaatatgatatcattaattagggttcctttgaaacgcagtattctcaatatacttaaaaaaatacagaattgaagtattctagtaccttaagtcttgtggattgaaaaaaaaacagagaaaattctcacgaattattgtttagatggagcatagaaaaatgtacagtaactagaagatagatggacacaaatgatcttttccaataggttgaagttcacgttagaattccttcaaaatctctacgtctcgagccaatctaaaggaatttcataggatactttccttttatccaaatgaccacgtatgaaagttttttatagaattgattttttttttcttctaaaattcctcaaggaatattttgttccaaaggagccaatagtatttgaaattgcattcatatgatgttcaattttatactccacctgtttcgaaatataaggtgtatttcttgttttctgcaaagtcaaaatttatttttttgactaataattaaactaaaaatatgaatgttagtctcatgcatgtagtatcacttgatttatattttaaaatatattcatacaacgttagttttttagttgctgataacatattataaaaatagtattggtcacagtataatgttggagaccgtatagaaacataatacgcctcatattgtcagacacatggagtaactgttaatactattacgaaagaaattaaaagtgaaagttttatgttggagaccatgaaaacttgtatggtattttgaagaaaaggagtatatataaggctttgacttgtctagatgcatatgtcaaggtacaagctatcaacatcgaagggtgcactacaactccatatatgttttgtcgcataagtcaacaaaggaaaggatagtgaaatatctttcacacagcaaatattttcttcactttaaaatatagtattacactgatgacttctgatattatttccatcccagtttgatcactacctaagaaaaaggcactaaaaccaaggtcactaaaacatttatcatagtaaaattaatcctcatcgattaatgtggtatgtcggttcgtgcgaatcatgtccaacaaaaattaattcatactttaaatgttgcatagattaaaccaataaaaattagtcttggttagttgacgtatacagttatatacatgcagggcactccacggtgcacatgtactatttgcacaaagaaacaaagagaagctttgttaaatgatgattattttgaaaaaaacttaaaaatcttggatgatgatcaaattgggatagagagattatatcgtttgactatgttttgattaaaagtttagtgtaaaatgtaaagttgtaagtcatgcttaaaatatatttagtgataaaaataagacacacatgcttacatagttttagttttctctaagtaagactaacgatacaaatatcatatctaaaagttaatatagtccatatattttaaaggggaagatgatagtttatgtttgttagaatttaaaaaaaaagtattccaaacatataccaaataagctaacaatatggaggtgtagaattgtgggtcatgtattggagtcaaaggctaacttgaagtactactaaaataaggatagatctatgacaacaatttttaatggggttgtttggcgggacttgttgcagcatctttgctacgctgcgtaacctcgtcgcttggctacagcctacaacagtggacagacttgagggcttgaggccgctacatgtaggatgtagcggctgctcgttgttggtataactagttgtagctgttgtagttattgttggctggctgctgcaacaagctcttccgaacaaccccaataataaaacattcaacttatttactcctacgatagttaggctctgtttagtttgcgaaaaaaaaaatttttggtgttagatcggacgtttgactggatgtcggaaggggttttcgggcatgaataaaaaaactaatttcataactcgcatggaaaccacgagacgaatcttttgagcctaattaatccattattagtacatatgggttattgtagcactaatgactaatcatagactaattaggttcagaagattcatctcgagatttcctccctaactgtgcaattaatttttatttttatctatatttaatgctttacgcatgtgtctaaagattcgatatgatgtttttaagaaaaacttttggtgaactaaacggggcctttattaaaactttaggaaattgattattctttagcgtaaatcgaatagcactggatttcatcatctgcctcatagctcaaactcacgtgtgtcagggttatggataccacatacctacctaatacctaatagtagttgattaaatctcggcaggacccaccatatactatgtcttatactgacactgacctcggatatggatgaagttccggataaggaaagacaaccagagttctatatggaaacgacaagaactactcggattgtattcatattggtttccctagttttacttggacaaagggacacttatgggtataaatacaagaccctctaagaggagaggggacacggaacaatagatcaagacataagatcaatatacaagccaacatacgccaagacaagacgctaggtatcgacttcagagataggcatgactagtcccctacgatgcctatggctaccgtcaggagagatatagagttgtctctgatctatgcggattcgaggaggaaggttaccatgttgtcgactacgagtcaatactacagaccgccaggtcgacaacagttagataggctaccccaaatattatactggtatgattatggtgaataagagcaataccggcttcggccaacaggatgtagggttattacctgacaattcaggggcccgaacctgtataaaaatcctcgtcgttatctcttttacctaagtctcgtatacatcttagtaccaacgatccccatactatgtaaataccggaaccgcgacatcaaacgtcgaccgacaacgtggtacagtataaaaaagtttttaaatatttttaggtctgatcaaaccatcgaatccaatcaatacagggcctactctaccaaagttctggcctttgggaagcatttccccatttttttagcacttaccacgagtggaaaaggacggacttctgcgcgaggaagaagaaccggatgacgttgtacggctttcctctctcggtttcccgacgcgaccgcctccgccgccatcgccgcctctcctcacctcgccgcgccgcgccgccccgcctcggccgcgcgcgtcccctcttccccgcctaagccccgcatcccgctcacccaccccacgcaccaacccccgcctcgcctcgccgtcgtcgtcgccgtcgccccctcgcctcgccgcctctgcgtggtggtgaggtagtaatcgctgttgcttcggtttccctttggttgggaggtgggaggaggaagacgaagagagggagagagagagggagatattatcttgggctgccttgccgtgcagtgtggctcgctgtcccactcaggtgcggcgctattccaatccgtgcttatccccggcagaatccaatccccctcgcggcttttctccaaaagcgctccgccttctcacctatttcgctcgctgccgcggccatgattccccgctgatacctccgcgcgcccatttggttcctcctcgccgaatcccccttcgcagccggtggttctagttgaggaggaggaggaggggatttggttgggggcgagggggaggagggggttgtggagtgtcgtcgtcgcggtcgaacaaccgggcgacgtgctccggagcagctcggcgcggtccaagcacagcgcgcgggtggtggcgcanacgccgatggacgcgcagctgcacgcggagttcgaggggtcgcagcgccacttcgactactcgcgtcggtgggcgcggccaatcggtcgggcgccaccaccagcaacgtctccgcctacctccagaacatgcagcgcggccgcttcgtccagcccttcgggtgcctgctcgccgtccacccggagacgttcgcgctgctcgcctacagcgagaacgccgccgagatgctcgacctcacgccgcacgccgtgcccaccattgaccagcgcgaggcgctcgccgtcggcaccgacgtgcgcacgctcttccgctcgcacagcttcgtcgcgctgcagaaggccgccaccttcggggacgtcaacctgctcaaccccatcctcgtccacgccaggacctccgggaagcccttctacgccatcatgcaccgcatcgacgtcggcctcgtcatcgacctcgagccggtcaaccccgtcgacctgcccgtcaccgccacaggcgcgatcaagtcgtacaagctcgctgccagggccatcgccaggctgcagtccctgcccagtgggaacctctccctgctgtgcgacgtgctggtccgcgaggtgagcgagctcactggctatgacagggtgatggcgtacaagttccatgaggatgagcatggtgaggtgattgctgagtgcaagagatctgatttggagccgtatcttggcctgcactacccagccactgacattcctcaggcatccaggtttttgttcatgaagaacaaagtgcggatgatatgcgattgctccgcaacgcctgtgaagatcatccaagatgacagcctaacacaacctataagcatatgcggatctactctcagggcaccccatggttgccatgcacagtacatggcaagcatgggctccgttgcatcacttgtgatgtcggtcactataaatgaggatgaggatgatgatggagacactgggagtgaccagcagccgaaagggaggaagctgtgggggttgatggtctgccatcacacaagcccgaggtttgtccctttcccgcttaggtatgcttgcgagtttctcttgcaagtatttgggatacagatcaacaaggaggtggaactggctgctcaggcaaaggagaggcacatcctccgcacgcagactcttctctgtgatatgctccttcgagatgctcctgttgggatatttacccaatcacctaacgtaatggatctagtgaaatgtgatggtgcagcattgtattaccaaaaccagctttgggtgctaggatcaacgccctctgaagcagagataaaaaacattgttgcttggttgcaggagtaccatgacggttctactggattgagtaccgacagcttagttgaagcaggttatcctggcgctgctgcacttggtgatgttgtgtgtggcatggcagctataaagatctcttcaaaagatttcatcttctggttccgatcccacacggcaaaggagattaaatggggaggagctaagcatgaaccaattgatgcagatgacaatggtaggaagatgcatccacgatcttcattcaaagccttcttggaggtagttaaatggaggagtgttccttgggaggatgttgaaatggatgctatccattctctgcagctaatattacgtggctccttgcaagatgaagatgccaacaagaacaacaatgcaaagtccattgttacagctccatctgatgatatgaagaagattcaggggctccttgaactgagaaccgttacaaacgagatggtgcgcctaattgagacagcaactgcgcctatcttggctgttgacatcactgggagcataaacggatggaataataaggctgcagaactcactggattacctgtcatggaagccatagggaagcctctggtcgatctcgtcatcgatgattctgttgaagtggttaagcaaattttaaattcagctttacaaggttggctctatgttgaacttggcctttttgtaccatccaacttaatcataatgtgtccattattttttgggtgactaacttaggtcttctttcttgtatttcaggaatagaagagcaaaatctgcaaattaagcttaaaacatttaatcaccaggaaaataatggacctgtaattttgatggttaacgcctgctgcagtcgtgacctttcagagaaagttgtgggggtttgctttgtagcacaagatatgacagggcagaacattatcatggataagtacactcggatacaaggggactatgttgctatagtaaagaacccttcggagctcatcccccctatatttatgatcaatgatcttggttcctgcttagagtggaatgaagctatgcaaaaaattactggtataaagagggaagatgcagtagataaattgctaatcggggaagttttcacccaccatgagtatggctgtagggtgaaagaccatggtactctgaccaaacttagcatattaatgaacacagtgatatctggtcaagatcctgagaagcttctttttggtttcttcaacaccgatggcaagtacatagagtcactgatgacagcaaccaagaggacagatgctgagggtaagatcactggcgccctttgctttcttcatgtggccagcccagagcttcaacatgctctgcaggtgcagaagatgtctgaacaagctgctatgaacagctttaaggaactgacatacatacgtcaagaattaaggaacccactcaatggcatgcaatttactcgaaatttgttggaaccttctgacttgactgaggagcagaggaaacttctagcatcaaatgtcctctgtcaagaacagctgaaaaagattttacatgacactgatctagaaagcattgaacagtggtgagtgccgtttgttccactgtagtctgacatatagatatttgccaacttttattctgagcccttccattgttcttgaaatcacgctttaatgatttttaaccatagcaaatttagatggtcttgcagattcagaactgaaatcaccactgtttcatgccttttctccaattatatagtctatatgtagaacaacatgatatgtaaaaaaggaaactttctatttagtggttggaattaacctatacacggaaaattccattggtaccataacagttccagcactacaaaataagttcatataaagctgtataatatgcctattccatttgcttttttcacgcacaagatctgatagaatacgtattggttactaactctgtgctcccacagctacacggagatgagcaccgtagatttcaacctggaggaagccctgaatacagtcctaatgcaagccatgccccagagcaaggagaaacaaatttccattgaccgtgattggcctgcagaagtatcatgtatgcacctctgcggggacaatttaaggcttcaacaagtcctagcagacttcctggcatgcatgcttcaatttacacagccagctgaagggcctattgtgctccaagtcatccccaggatggaaaatattggatctggaatgcagattgctcatctagagttcaggtaagccacccatttgccttgtggaacttatagtgatgtttcttgaactgcaagtacagctttactggtaatagaaccaacttaaactttgcatgcaatgacctaatttccattactccaactcaacttctctggggagaaatctgtttgttaacatgcgttcagtaagtactagaggcgcactattgagttccagacacctttattcctgcagcttgtgtttactgtccatcttatcaatagaggcaggacactcagtagtcacataaaaactgacggttcaaaataggccttccatattatctcaacataaacatagcataaacataaaatgcaatatcgtaacatctgagtaatgactatataaccaattcaatgatgcaacccttacaactatttaagataacggataacccggccgacaacccttaaaactgtgagtaaaaggagattgattagatgatgcgaagctttagattgttcgacgagcttgctggggcacaaccccacttaacagaagcgtaatctaacatctgcccaacggttggctccatgcaggcttgtccatccagctccgggcgttccagaggctctgatacaagagatgttccgccacagcccaggtgcatctcgagagggccttggcctttacataagccagaagctcgtgaagacgatgagcggcacggttcagtacctccgggaatcagagagctcgtcgttcatcgtcctggtagagttcccggtcgcccagctcagcaccaagaggtgcaaggcttccacgagtaaattctgaacttagggctatggccaaaattcttgtgggtgctgtattgttgttgttgctgctgctgctattagcagatcaggcagtctgaggagtacgttagctgaagatgtatcagatgtgtgtagcttgtgaaagtgaaggtagtggttggatagatgtatttgtcacgttgatgtctggagagctagtgagcgagctactaggtgttagtgtaatttaaccggcaaatgtatgaacgaattatgaataaaatcttcacttgtgttgtcatgaataaaatcttcacttgtgctgtcattatttccgaaattattcatcaaattcgaaaaaaaaagaagtgaactatttatatattttatcggacaaatacacaaaaatcttagaattatatcgagttgtgtgtgaattagattgcgaataggcccttggtaaaaatgaaaaaaaatatgggggttttcagtttttacaagcccatttggtcaatactgggctagccgttgttggcccgaccgccggaggctcactcgcagcggtcgatcatggcggggagggagaagaggcggcgggtggcggcgctcgacggcgaagagcggcggcggcggcaggaggaagcggcgaccctcctccacaggatcagaggtgcactccccctccctctcgtgatcaatcgcttaaaaaacttctgaatccttcatcaaccgaagtaaacactcgt

SEQ ID NO: 43298 - DNA, 40537 bp, Oryza sativa
  unsure (1)..(40537): unsure at all n locations
agatagactaaaaagaaaagttaccaagaggttaagcttcttgctaaattttctccanaattctctatagtatcgtccatttcataggattttcaaaggattggatagatttcgatcctctgtctcaatgggctttatagaagatgttcctatagaattgaaatcctctaacattattatgttttcctcccggtagagcatctccatcagtcttgttaaatttgcctctctatttactcatttgccagccctcaaccatttgaagagccctccaacccatttggagagtacagtttagttttccttgcaacagtctctcctatatactctcaaaactgacggtggaacaagtatgtcagtctcacattagcaatagtcttcccatcgagcaccggtggcgattcggttggctagctccggcggctcgtagagctgccgacccaagcgggcaagctcttgcgtctaaccggcggtcgggaggtcgcgactcgtcaggctggctccggcagtaggaagaggcggcgacccggcggtagggaggccgcgactcagcgagctagctccggctgcgtgggacaaatactcaaaaatcttagaattatatcgagttgtgtgtgaattagattgcgaataggcccttggtaaaaatgaaaaaaaatatgggggttttcagtttttacaagcccatttggtcaatactgggctacccgttgttggcccgaccgccggaggctcactcgcagcggtcgatcatggcggggatgtagaagagccggcgggtgacggcgctagacgattaatatcggcgtcggcggcaggagaaagcgtcgaccctcctccccagaatcagaggtgcactcccccttcgtatcgtgatcaatcgcttaaaaaacttctgaatccttcatcaaccgaagtaaacacgcgtccctcgttttttgcgcagggttggtgcgctgggtcgtcgccgaggtcgccgccggccgctccccgaccgtcgcgctccaccgctaccagaactactgctcctccgcctccgccgccgccgcgtccccatggtcggtttccgcgtctcgccctaccctaccatctcatcggccgtttcaaattctcaccccgctgtatgcgcttgcagcgcctgcagctacgacgtccccgtgggcacagatgtactctcgctcctccaccggggctcccacgcctcccggctcagtacgcgtcgttgatttttgtctcaacctgcgtatctacgatcatgttaatgttaatcagtttgggatgttttaatcgatgtgcagatgtgctcctcagggttcttctcgtcgtgcagcaactcctgcagcagaacaagcactgctccaagagggacatctactacatgtacccctccatattccaaggtctgcataggttccatgcctccgcttctgcttttgtttcctgctgtgtgtgacaattggaattctgacacctgtttttgtctaaatactgcagaacaagcggttgttgaccgtgcaatcaatgatatatgcgtactcttcaagtgcagccggcacaatctcaatgtggtatgtaccgcgtaatctgtgttattttccttcagaatcttcagttttgcttctagaagttgcgtgtgcatcacataataagattccactttccagctgctacatcctttgtgcccacatttctgtcattaatcacctggagccttttttttctcaatgctgttttacatcttgaattcatgtgtatgtactgtcataactgactggaatgtgtgctaccttggctgcttgcaggttcctgtggcaaaagggtaggaactctgtcaactatcatagagttggagtgtctgaagatatgtttaactcattctactgtcctattgattgtccatgccaatacttaataagataacttctaaccccttatcttccaagcacttggtctgcttaaaacaaaatctggatgtaaatagtgagatgcttctcttttagcaagggcttatagagcactgtgaagctaccattacagtgctatgctcatatattcttcacctattcatttcccctgttaaaaactcatcaatgtctttattattccagcttggtgatgggctggattagatttttagagggagaaaaggaagtctattgtgtaacgaatgtcaatgctgtaagttctatgagtttcctttaatcactgtaatatgtttctttctttttattgatatggtttgatttttgccttcttcaaatgcaggccttctctatcccagttagcatcgaagcaataaaaggttgttcagaaatttaaagatctaaaattcagtatttatgttactgttaatctgcactgaaaataattcctttacaatttgctgacatggattgcgtgaggggttggaccataatctcaattattcagaattagccaccatcctttgttttgagagaatccactttgatatattctgaatcgaatagctaggattgatctcttagcaaggtgctgttcattagactaaagaataaagtcagtgcttagtatctttacccgtcttgatttaagatatgccagaaaaagactggacaacaagtgaacccacagtttattcttcattttccttacaaatatgcggttgattatacttatatcttttactcactttatgttacagatttcctctcttgttatctgtgaacttcagtgttatccctgatgcctgaattatatctcaaggaaattaagctatcttaggttttctcttgtagatgttgttagtgttgcggactacatacttattgtcgagaaggagacaggtatgaggcttaaagattcctcatgtgcatgtgatacttgtactcttccagttccagccttcctacagttcgcttctgtactctccttgcagtgtttcaacgtttggctaatgacaagttctgtgaaaggaatcgctgcattgtgattacagtacttactaactgctgaatctggtgttatacacaaaatatcttcttgcatttattcttatctagtttgatgttgttctgtctgctcagggaagaggctacccagatattccaacaagaaggcatatactctttgttatacttttctcttttatttttctgaattgatatttcaaatgtaaatactttatttttccagattcttgcgctaccttgttgaacagctgcatttgccagtttactgtttggtggatgcagacccttatggtttcgacattctggctacctacaaatttggttcactggtgggtcatgatttatctaattagctgtttgctttgtatttgctattatgcactatctgagcatacctgttaattaaaaatcacatataaccactttatgcaaatgactactacactttccttatcagtagctcccaatagctggattgacctttatgcattacatttttgtccagtatcaaggcacatttgaatcaaacagtatgccttcagtttgtttggcagctctaagcccttttagcatgtcttgttttcacgatattctgtcccattttgctggtagatttggaccttgcaagtttatttaattttccttgaaagcttggtgtatttatttgtgttaactaactaccttctgcaatgcgcttgtgtaattctcattctatttaagcaattggcatacgatgcaaatttcctgcgtgtgcctgatattcggtggcttggggtcttcacatctgattttgaggattatcgccttccagactgctgcctacttcacttgtcgtctgaaggtgactaaactgagggatataaatgactgacatttctacaactttttcttggaacttataagtaccttgtttgttcttattcaattgtcaacctcatgcttcatgtattctgttgcagacagaaggaaagctgaaggaattctctcaaggtgttacttgcacagggaagccccacaatggaggtaaggttgtacttttcgtacccgtattacaagcaattcatgattatgatgggagtttacaagttagagctcggacttagctagtggaacatttctttgcttttgttttaacagtagttaaagtcatttttttgaagactttcttatgaaaaacaggccagcttactaataaaagctgtactcctaacttagtgccttcccttcagtctcatttccttagtttgaaaaactccactacgcccagtaggtgcaagttttggggatgaattttagtgtaccacttgcctaggaagacttggcccattttatttccagtaactttagccctgaattttttacactgatatactttatttggcaggttggagttagaagccatgttgcaaaagggtgtcaaatttgagattgaggcgttatctgcatgttccatttcctttttatcagaagagtacattcccaagaagatcaaacaaggaagacatatataagattggttgtacctgtatctatccagaaattttcatgtggcaaaagtcttattttgtttttgtcatgctaactgtagtcacatgtatggcactctggtagtttaacccccagcaagtattttgtagcaattgtttatatatgacggtgatttggtgctgtctcaagaactgaaaaccacaaatttacagcaactgaaattttactattactatctctgctactaagagcatctccaaggtatgtctaaaattaggctcctaaaaacctgtattgggagtatcacaaaagatattgggctcaaaaatcacccacatctccaacagtatcccaatacctgattccaaaagaactttaaaatctgccatatcatcactggtgggttctcttaaactgatttttctccaattgggagtgcgtggaggtgcccaaaattagctcctattgggttggattttggatgtgcctaaatattgggacctcctttgggaacctgttggagggttggttttacccttaattcccaaaatttaacttttaggaacaagattaggcctctcttggagatgctctaacaataccacctaaagagttgtgcagctttatttggggtttattgcatttctaacagaaaccttttataagtgaatacctctatagtctgcaattatgcatgtcttttctcattttctgccagatcgtcatcctgtggaagctgagattaactatcccgatcttacctgagacttagtctccagccatcatcagccttttttccttgcagagttgcagttatggagttaagaagaacgggcaacaaaacaaaggaaaggttgcttaaattccaggtgaaatctacacccacacaagttatatcatttgcacataacaagccgaaagcattgcattgactgaaaagtagcttatcgagtttcatatatagtctccagccatcatcagccttttttccttgcagagttgcagttatggagttaagaagaacgggcaacaaaactaaggaaaggttgcttaaattccaggtgaaatctacacccacacaacctatcatttgcacataacaagccgaaaacattgcaatgactgaaaagtagcttatcgaatttcatatatgcaggtgtgtgagctcggtgttacttcacaaatacttgtctcttacacatgttcaggagctgatccactatgttagatgtaggaggtaaggaccactcatttcttttgttacttactgaattacccgtgggcaattagatagagtataggtgataattagcggaagcaaaggaaaccgttgaaacaccagatcaatggaaaaggcatctgttttcactgagcagattgtgctagggtcaggtcatatggggagagagtgccagagtggtcgacatcgagcttttcaaactcctccagaaaagaagaaatctcctcttggttgatcttacccagttctttgagcttgtacacaacaaattctgcagcactgcacagaccagatttcatatatcaacactgattcttttagggacacgatggaataaaaatactctatgtgagttgtgtacttacccaacttgtcgatcatcatccagatcggctgcctcaagatccatctttgtcattttccgtgtgagaacccaattggccagcattttctgccgtcgctcggtgtagatctcagcaaggtacatgaagaattgtgccatgatgatagtgctcgtgataatccaaaagaccgcgaaaacacgtcccagtttggatgagaagcttttatccccataacccagggtagtgattgtggcacatacacagtagaaggaatcaacaagactcagtttctccactttccacagaaatacggtcccagaaataatggatagcaccagaagcagtgcatttgtgtaaaatttgtactttatcctgtttgtctcgattgctctaagcatcttggtctcaccacccttcagattcgtgtgcaatgctttgaagaacagcacctcctgcttctcaacaagataatctgctactttgctgacaaagagagcaacaactgccatacccatgaagacgaaagcacaagcaagcagttttgttgtgtcattgtttgggacgaggtctccatagccgacggtggtcattgtgacaacacagaagtacaaggcgtcaagcactctatttgttcgcttgcctgatatctcatccatgacagcataaaaggccaggacgcccactagaagatagataaaaaggagaagtcctactagtctgaaacttggcctcatctccttgaataactccttggctttaactgatgagcccttttcaggggggccttgaagaggatccgtggaaggagtcgacctgcatcgtcgaaaccgatttactccttctgacggcttccgctgcagcacattagggttatcagctagcagtgattgctgaatgctgttgtcatccattggattagcctggatctgttacggtcacagccaaaaacctaaaattcagaaaatggcatgaacgttgtgcaatttgacaaataagtgggatggaaagaaaggatttgtaagctcaaaagttatgtaaaactaaggcaatatttgctggatatcacaggattgcacagagaaccgaggggctgcattcttctaagcattatttttttgtgaattattacatgctagaatcctacaatatctgattgctccaattgcaggtgtgctacgccagaaaattccagtcacctgcatatgcctcctataaactgaattctatcggaaagaggtgcacggctggtcatgagcaactctaattgagcagcaggacgtgaaaccattctgctccatttccccaggtgagttaccatcatcctaaaccctaatcagctaatgtgttatttgacttgagcattattatacgctagcagcagcaggcaagatgatctggttaaggccaaaatcaaagcaaggcagcctgacctttttgaccagttgccctttggtcacgggaagggtgcaggtattgactattgaggatctctactaccctgatcggatctcccctcgatctgtccatttctttgtcgaccaagtccccccacctatctctatcctcattcgtttagataatatttctccagttctctcttcttctccataaaaagggcatcaaaccgtagaagaaatttgcgagacgatgcagggattgactagggtggtcgaaacagcaaataaggtactagcacacatcaagaacagctgctctcgatacagtcccacggccatatgccagtatgccactgctcttcgtgcgaagaaagcaagggaggcaacgggagacagagagagcttctcttacctttcctccggctgaggggacgccgcgcgtcgatctcctctccctctcgcccgacctgccctgagccgcctgagacggatgccccgcgcgcgcgcgccactgctgctgcgcgcctgcggggttgagggctctggctcctggctgcaacaccacaccggccaagattctgcgcgtcgttgccgcgtccggggctattctattttaaggcgtccggctaactccaccggaacggtggatgttgtcaacgttggggctagcccaaatctatcaacgagctcagcgtacgcagccgcaggtgtgttctgacttgtgaacttgtgacggcaactgcaaccagcggccacaagtcgcagtcacaggctggatctactactagggctgtgtttagacgtagttttgtaaaattttggcgtgtcacatcggatatatggacacacaaacaaattacagaatacgtctttaaactgcgaaatcataacgcaattaggcttaaaagatttgtctcgcaatttacacgtaaattgtgtaattagttatttttttcgtttatatttaatactccatatatatgcccaaatattcgatgtgatagggtgtaaaattttaccaggggatctccggtagaacggaaggcagggattggtttgcacgaaccaaaggggaaagaaaaagaaaaaaaaggttcggtctgacatatggcattgccctgcgtccgtcgtcgtgcaggatgcgtccattaaggggccatttgaatagcaggattgagaaaatatagaaataggaaaaacgtaggattttgatagaaatataagtgtaaaatagaggattacaaaacacaggaaaaaataagaatggggtcccttttgaaacgcaggataggaaaaacacaggaatatgaaaaacgtaggaattgaagttgtatgtttttctaattctacaggaattgaaaacacaggaaatggagagaagagccctttgattataccacatgataccctcaacaaaggaaagtttcacaagaggtctaacctcttgcttatttttctatggaattgatcatagaaatgcaatcctatggaagttttcctatcatcttcctatgaatcaaagggcaatataggaaaaaatccttaggaaaatgaatcctccaaaattcctttgctaatcctccatttcaaaggggccctcgaccgtttaattgaaccacaggaaaaacgcaggaattggatgagagagatagactcaaaagaaaagttaccaagaggttgaagctcttgctaaattttctccaaaatctctatagtatcgtccatttcataggattttcaaaggattggataggattcgatcctttgtttcaaagggctttatagaaaattttcctataggattgaaatcctctaaaattcttatgtttttcctccccgtaagagcatctccaacagtcttgctaaatttgcctctctatttactcatttggccagccctccaacccatttggagagccctccaacccatttggagagtaaagtttagttttccctgcaacagtctctccaatatactctccaaactgacggtgggaccagtatgtcagtctcaccttagcaatagtcttcccaacgagcaccggtggcgattcggttggcgagctccggcggcgcggagaggcggcgacccagcgggcaagctcctgcggcaaaccggcggtcgggaggtcgcgactcgacaggctggctccggcagtagggagaggcggcgacccggcggtagggaggccgcgactcagcgagctagctccggctgcgtggagaggcgcaccggcggtgattcggtcggcgagctccggccgcgcagagaggcggcgaaccggcggtcgggaggtcgcgactcgatgggctggctcccgcggcagggagaggcagtgacccagcggtagggaggccgcgactcggcgagctagctccggctgtgcggagaggtgcaccggcagcgcggagaggcggcgaaccggcggtcgggaggtcgtgactcgacgagttggctccagcgatagggagaggcggtgacccggcggtagggaggccgcgactcggcgagctggctccggcggtgtggagaggcggcggcctgacggctaggctccggcagcgcggagaggcggcgaagggagcccgcacctcggcgggctggctccagcgacgcggagaagtggcagcccgatgggcggagatcgcgtggaggcggtggaggtcgcgcgactggccaagtccggcaggggcggcgaggctagcagtggcgcggagtacaccagtcgccgcgggcttcctccgcgcgtcgtcgtcgtcgccgtcgccggagcggatggtggtggcggcagcggccggagcaggtcgccatggcgtcacaccagacgtcgtcgtccctcgccacggcggcactcgaagccgatggtggttggctccagcactggagcacgagagaggacgggattattgacgtggggaagtgaatccatgtggggcccaccatttggcgatgcgtttttgcctagccaaagttggctatccggttggccagcatgttggacctcttttttacgtttgaatggccaaaatttaacttggagaggctgttggagatgctctaagtcttgaaagtttcgaaacatttgccattagaaaatagtattagcttcatccgttttataaaaaatcaatcagtatcagatatgacacttaggtaccttattaaaaatcgttttaacagttgagggatgcgtatggtattgttgtccagagacaaatttcagactcaatgataaattgaggacctaaagtgaacttattcattcgtgcaaacgtttaacaatcacctctttgcgacttcctcatatgtcttctctagtgtgatgatcagattctcctcaatgttttggtagggattgccactatgtaaggattgttgcaaaaaccatgggattactaagaaaaactgagagatttaaagaaccgagaggattatcacacgagataaccgtgataattgaggagataactgcatcggtttagtagcgatagaaactcatgagacgtcgttagtacagtagcagtcatgatacacataggaggggaaactgccacgctgatttcagaacatcgagcggttggtgctaatcgatctgagagaagtatgagagtgttgagataacttatatctccggttaacttcgtatcatctttagacaactacttcaacaccatatatgttgctccctccaatctaaaatgtaataacttttagcaaattatttggacaaaggtatgtctagaaacatagctgaaaattactatattttaggacggaggtagtatatgcaagaaaagagcaagacaactctgatcacttggaaaaactatgctcaaatgtctcttccatttctctcatcaaaacaaaaggtagctcggttgatgaaatttatacccgtttctatattttgaggtgtttttacaatgatctttactggtagtagaattaatctaaatcatctatattttctaatccgaaatatcatactccttctgtcctatagatcagacgagacatttcatattacaacaaacccgtcccatggtatagcaatgaatctggatatttcatagtatatttagttctaagttgttatattatgagaccgagggagtatatattatacaccacctcaactactggaagttgaattttttttactgatagtaaagctcataaatcaatggctaaagattattttcactgatgataatgttattaatagaatgcactactagtaaaaatcacccaccaccgtgtagatactcttctattttaccttcaattcacctgttaggcaatggctgacgtagttggaggtagactagagccatatcatacagcacacatgaaacaatacaaccacagaatcaacatcacgagagaaaacatgtagtatcattcatttccctgcaggatcaagacaaatacctcgagctggacagttctcttctctcgacacacccattctggagaggacccatctgaccttttcactacgggccacatgctggcatggcgaaaaagccatcgccaatccgccattggtgttctcagcctcaagcccagccttctggccagtactgcctacttgccttcatcccaaggactcatcctcctccacttctttccctccttgttctcttccttatatgaatgcaatcacctttcaaaaaagattgaatgcaatctttgttcttcatcgatcatagtagtttggggctgtccagtgacagaagagaatgccttcttcaattatggcagaaagctctctggcttgtcctgtttcctgacgtcggaatggcttatgcacagaagaccatgtattaacatgtaactatgtaaggcaaggaaaattcagaacattttggattcaattccactgtgaagaaaaagggaaatttcagaacatcaccttgtatagtcataatattgagtttcaaacctatgatacctagaaatttcagagcacttattttgcaggaaccatacttttcctaagatttgcagaacaaaatttcttggcttcaaacttggaagagttattcggagaacagatactggtgatgtgcagtgtaacacatccacagcatgctccaccagagcaaagatgtggagctcatatttaaggcaatccctctcttgaaacatacgccatttctctcatttgttttcacttgaaaacggcagcttatttacctaccctaccctgaattgacagactcttaaaatcataatttacgcattgctaatgagcctaattaaccatgttccagatgtaagttttttcatctccttggtccatacttggaggttatacttactctctggattcaccaatgaagccattcaatttcaggctccagcagtggtatacttggaggaggttgtactcttcagcagagccattctctttatcatgttgtagtctcttatctctgaacttctctgaaacttcaattccatccttgaactttctctgaaatagcaggagcaattcagcactcatgatcatttcttcacttccagctattgcatgagattatatttcactagcactcatttctgacaagacagaacgatttagaagcgagattaattagtaagggagtgattggctgattgcactacagtgagagcaaagaaaccctgacctcatcaggataaaccaaggtctgaagagaaggttagctgggactcttgttacgtgcgcagccagcagccgataaagcaggaaaccgtgataggatcccgtttggaagcgttcgtagctgacaaaatgtgagccccataagctgtcaatttttagcctggactcctttctctacttaagtagaaatgcgccgttgtgttcaaccgtttttcttgcgtgcccaaagggagataccctgatgtcgacacgaatcctctccatcggctgtcgtttcaactgttgctgatgaactctaagagaaccgcagaaatcgattgatgccatctcttttgttctttctttgcgtatgattcaaagaacataacacgaagcgatgtacgggaatttagctggtttttttcatgagattggttatcaaacattcgctcaattcattgcaacaagtacttgtttagctggcagagttgagacttgagagtccccatcgattcaacctgaggccaagagattccaaggtcactgttggaatccacattatctttcggcttgatcctaaccttggttgggaatcactcacagttccatccaggagaacggatggctcacgacaccaatgcaaagtcgataataattcgatttatttcataaggagcacaaatgtgtgcatggcctccatgttcttgcaggtctcactcagctaaaaaaagacggcaacatcatgctcgttatctaatcaatgcatatatagcagagatcgatcgatcgatgtcatccggccgttagcttcagcaaattaaattatgcgtgtgtaggatcttacttcacggctcttttgatcttggaccttcttgctggtcattaattgtgattgctacatgtattttctttaaggctaatgtgatcgtttgctcactgttaatcctgcctaactcgtcttggtttttacatttcatttagtttcctgatgctgcatctgcttctatataaaccccttgctgccttgcagcttttggccaagcaagagctaaaagctagccgttgtgtgagggactgagagctagtggtgcactagctggctgtgaatctagccatggctctgtccacgttcgtccttgccgttcttgtcatgagcggcgccgccgcccttggccgcgagctcgccggcgacggcgccgccgccgccgcggcggccgacgtggccatggcgtcgaggcacgagaagtggatggcgaagcacgggaagacgtacaaggacgaggaggagaaggcgcggcggctggaggtgttcagggcgaacgccaagctgatcgactcgttcaacgccgccgcggagaaggacggcggcggcggccaccggctggccaccaacaggttcgccgacctcaccgacgacgagttccgtgccgccagaaccggctaccagcgcccgccggcggccgttgccggcgccggcggcgggttcctgtacgagaacttcagcctcgccgccgcgccgcagagcatggactggagggccatgggcgccgtcaccggcgtcaaggaccaaggctcgtgcggtacgaactccggcgaacacgaacaaactaatgattacttgatcttgcatgcgtcaactggtaattacgtaattgaatcgaataatcacctgataaaatttgcaattaattaactgggcgtgcgtgcatggcatggcatgacacgtacccgcggtcaaacggaaaggtaaaaatggtcaatccaagtaaacagaagattctaccgagccagtctacagaacagtctacgcatgcacttttagtcaactcgagagtcaaacatagctaaaactgtttgactaatatgtgctactaatcacaaagaagaagctgtattagtgagctgatggattgactaattaatcaatatatgcatgggcatgcaggttgttgctgggcgttctcggcggtggcggcggtggaagggctggcgaagatcaggacggggcagctggtgtcgctgtcggagcaggagctggtggactgcgacgtccgcggcgaggaccagggctgcgagggcggcctcatggacaccgcgttccagtacatcgcgcgccgcggcggcctcgccgcggagtcgtcctacccgtaccgcggcgtggacggcgcgtgccgcgccgccgctgggcgcgcggcggcgtccatccgggggttccaggacgtgccgtcgaacgacgagggcgcgctcatggcggccgtggcgcgccagccggtgtccgtggccatcaacggcgccgggtacgtgttccggttctacgaccgcggcgtgctcggcggcgccgggtgcggcacggagctgaaccacgccgtgacggcggtcgggtacggcacggcgagcgacggcacgggctactggctgatgaagaactcgtggggcgcgtcgtggggcgagggcggctacgtcaggatccgccgcggcgtcggccgcgagggcgcctgcggcatcgcacagatggcctcctaccccgtctgattatataaacaaaacacacgccgatcaaccacgtcattaattgattcgatggatcagtttcaaaatataagtcattctaacattttctacattcatattaatgttaatgaatctaatatgaatatagaaaatacatgaatgacttacattatgaaacggaggaaatataaatattaattaagatgtgtatatatatgtgctctggtatgtatagcgacactgcaccgtgtcaacatgtattctgaaatctgaaccggccggcccgtgcaggaagtctgcaaaagttggacgcgcggggctgtacgtagctgtgtgtatattgtatagtgtatatactacttaccatgatgaagttgtacaaagtgaaatatgttaccatattaccgtacagtgtacacagtcttcactagtacttctttcttaggtctctcacagtgcgtctaggtggactgtgccttagtcccgccacgtaggtttttttccgccgtgtcgcttggacccgcgccttagctagggtgctcgtgaccaaactaggcggcgcgaaacctcgcctgttcgagggcgtgcacggaggaatcgacgcgagacacgtgcgctgtgggcgtcattccctcgccgtccggtgctctcgcgcgggattcccctggcgaaatcccctattcaccctcccaaaaatcccctcccgccacagatcggattggaagagaaaaggcaagaaattcttgaggattggaagagaagaacagatcggattcaacaagatgaaaaagaaaaagaaagcaaaatcatcatagcaaaatcatccaaaccaacagatctggacatgcaagaaaagaacggcggcggcgactcctgcttctgctcctcttcttcgtggcggcggcggctgccgcgctcgccgcggcggcctgtgtcgcgtggcttcgccgctcccctgggtccggcggcgctgctcgaggtccccctcggcaaggtcgccacggtggaggcgtgccccgctcgagcctttcccctcctccgccggccgctcgtccgctcccgccaccggctgcttgtccgctcctgccgccggccgtccgttggcgccacatcgtccactcccaccgctcccgagtccgcgcgggaggagaagcgagcggcgcggtcaacggcaaggcgcacggcggcggcgtccccggcgtccgccgcgagggaggagagcacgacgagggaggagaagggaggagaaggcgaggcgaaggggaggagaagccgagaaggcgatttgctgagggtgggggtaggtgaggaaaaataatttgtgtgcgctacccgtgtccttgcgtagggtgccgcccactgcgggcttcgtttcttttatctgtgtctctatccaactaagccacacatatatgggtacttgcactgtggggtgggtgttttggactaactttttaggctaggggtacgggccccatagcttgcactgtgagaggccttactacaccgcgatgcgcgatcttgttctggctggcagcttttttgcctctggtgctctacatgataatggttgaaagcgatagcatttctttcggagactattctcactcaattgaaaattaactatatctatcaatatatttatcaattcatctgtcagtattgacaacaatctgaccatttcttttgacgtcgtgttgttattgacaccgaacatttgaattgataaatatagtttcttctatatagataaatttgtttatatatctttatctaataaaaaatacataagaatttcggtttaaccgtcgccgatgatggccgtctagcgagcttccctagcattctgaggctgtgttcgtcatttgttgttcccagccagaacagtccgtacgaaaaatggagcgacatattagcgcatgatcaattaagtattagctttttttttcaaaaatatattaatttgattttttaaacaactttcgtataaaaactttttgaaaaaaacgcacagtttaaccgtttgaaaaacggacgtgcggaaaacgagggagatgggttgggaaaagtgggtgccgaacacaccctgaggctgtgttcggatgtacgtattaccaacccagtgcacacggaaaacagagcggtccattactgcgtgattaattaagtatttgctattttttttaaaaaaaatggatcaatatgatttttaagcaactttcatatagaattttttttaaaaaaaatagatcaatatgatttttaagcaactttcatatagattttttttaaaaaaaattacaccgtttaacagtataaaaagcgtgcacgcggaatacgggggagatgcagcctgagtccgtcctgattctaggagacggtatcccgtccttcccgtttcacgtgcaccagctgcgagggggaacgcccgctgcgcgcgggcaaaatcgctcgcttgcggccttctggtccatcattcgtactagccccacacagaccacagcggcggcacgctgcacgcacgcaaaatttccaccggaaaagcccataaaatccaggaaaacgtggtggttttgccaacctcccgcccctcgtccaaaaaaaaggcccggaaataaaagcggattggaatctggtggctccgggtccgtgcggtgcgggtgcggctcgctcgacttggcgtcgttggagtccacctgacctcctgtcctccaccgcccgcttcccctcgcctcggtcgtctcggcttcgtctactcgtctcgtctcgagtccccgactcggaaagtccaaagccccaatctttccgttcctccccctcctcctcccggatcggaacaggagagcgggagctccgattcggtagcttcccccgtcgattctccccgccgtaagcgcgatccccccatttccacctcttttatttctttccgttcttgctcgatccggttcttggaaactagggttcttgggggttgggattgggattggggttggtttctttgcatttcggggggggggggggggggggtcccattgaccgaatcgaggtttgttcgcaggatttttgccctagccctggctgacgccgctgctgctgggctggggggcgccgccaatcgttcgcgatgtcgtgggggcgattccaccgcgcgccgttcccgtcggggatcccggcgatgacgaggtgctccaggcaccagccccccgcgccgcccaccgtggtggtgatcgatgaagacgacgacgacctaggcgacggcccctccgatgaggaggtcttcataatcgatggtgatgcggcgaaaggccgcgcgtcttctgggtgcaagactaagagagggaacagctcgtgtagtaatgtgattaacttagatgatgatgatgaggaggaggaggagggtggtggtggtgatagggcaggacccagctctgccggtgctgccgctggttctccagcagtgacgacgcccggccgtgtctccccgagaaacagatatggactggattatgtttctgacagttatgagagtgattcgtctgaaggacactccgacggagatgatggctcggattgtgagattcttgatgacgcctctgggtcagctcgcaaacagtgggagaaggctgcttcgaggaaaagcatgcctcaaggtttccggaagagtacatccacatcaagtgccgagtcaagtacacagccagatgaaagtgaggagaatgatgcagaatgcgatataaatgagtacatcaggaagtattttagtgaagatgtattgaagaaaggtggaccaatcagtacaagcggtgcaaatgctaaaccttcagttccagatgcccatgattgttcaaagggcaatgcttccaatgcaaatgaagctgaagactgcaatgccacctccagaattgatcctgacccagcttgtaatgacgaagcaactcattcccaaaatggttctgtgcctgaaaaaactgcagaaagaagtcaatctccacacatagatgaaacctttgaacctgaacaatgtacagactacagctttgtctctgccaacagggtttttcctgcatgctcctcagcaaattggaaggatcaaagtcctacatttgtcagtactcctgaaaagctggatgaaaagttatctgatggcacatatgcacggaaggatgaaacactaatagatgctcacaataaaagtaccacaaagaacaaagagatgtgtcctgaaccagataatggttctctcgatggtcgactaacagaagatccacctctttctagcagatgcgactgctcaaagcaatccgagaaaaaatcggcacatttagatgcaaactgttgtgcatctgctgcttcctccaataagaatccttctgcaaatgtcatattgggaggttgcatgccacctcagaaggatttagttgatggtccagaaaaatcaggccaacctgccgtggctcaggttgctgcagacattcaggatggtctaatcggtgcacgtgaaaagcacaaagaatccgatgagtacaaacgggcacaggaggaggagtgggcatccagacagcgtcaactgcgaatacaggtacgatttgtgccgcttttagtttaattgttctaaagttatacaagaaggatgtgaactgcatgaatattagaatgtaaataagttcagtgttaatctcaatgagcattatgctattgcactatattgttggaatgtttagttttgaggacattgcggcatgatagtgtaatcacaaaacaaataaataaatggatagcaggctgagggaagcaagtagcacctacatgcaattcatgatgtttccttttaaaaattattgcaggctgaggaggcacagaggttgcgaaaaagaaaaaaggctgaagcaatgcgattacttgacatggagaagagacaaaaacaaagattagaagaagtccgtgaatcacagcgaaaggtatcttgttataacctctagcgtattagcaaacacttgcatgattctctattgtccgcctatgtgttttcaagagcatttggttgcttcaatctttatgtgctattgtttaatatttagattgttcctttattttgttgaatcagaatgaagcggatatacaactaaaagaaaaataccgaggggtggtgagattggagctcgaaagtatggaaagaagatacattgatatggcttctatattgcgtgcattaggcattgctgctgaaggtggtgaggtatattattcatattcaacctatctcttccttgtagtagtaaagttattaattgctgctgtttttcttcttgttatatcttatctgtctctccagtacaatataaaatgctagtatcccttgtcccttgcatattgctgttaaactcaataccttataacagtaagcttcatgaacagttgtatgttgtccatttcatgatatccatctcattcacggaccaaccactaattgatctctaataaaaagatgaggaattgccatacattttcatgctaaattgcaatctggaaccacttaacctcttctgaaacactatgatggactgaaattttactccctatgttgaatttttaggcacctctagatttcatcttgttgattgaaacgcacacacaataaactatgcaaaatttgtatacaccatttctggctatcaacttccatgctttacattcacatccatgcaattcagttgcaaacaacactatttcgcatggagagaactatatttaatgcagattattgcgttattactacaagtagtttggtttttaccttcctttgatagtctctgcttagttcaaagccgggtaacaaattttaatagagggagtgataattatacttgatttactaacggataaacattgtgaagcaacatttcttaggaaaattggcaaacattatgaaatggaagtagttatgttttatgtaccatatgaaaccaacttacgaatctgttacttcgagtgaattaacttattacttgttattgttgtggcatatgcatagatagatatatgcacttggaaattgtatttcaattttctatggagaaatcccaaattcgtttgtttatttatagaagagatagcttctcatgacaaattttggaagatttgccaattattgcctctggcaatctaggcgagatcaattaccaccttatgccatgttctgatataagttcataaaatgatacccataaatgtaaataaggaattattgatctcttcccgctgacaattgtttaatatgaaacttttttcaggttaaagctgcttacaagcaagctcttttgaaattccatccggacagagtatcaagaagtgatatgtatcaacaggtcaaagcagaggagacattcaagttcatttcacgcctgaaagagaagatgcttcgagtttaatactagcatatccctgttcagttaaatacaacctctgaccaatatctttatgttaaagttgtggctagattaatttattcataggctgagttctcatcagccggcacatagttccacagttctgaatgccattcttagaagactaatgcttagcattcgttatcctctcttgagaatttttagtggtaggggagtcagcagtgacagtgagcttgggcgccttggtatatttcttggtttttgtaatgggtaaaatgtttgtataggagtgacggcagaagatcattatatacaagatgatctcccattatttaactgagaatgtcacgccttattttctttgtaaacagtcgaacgatttatgcctatcaacttgttcgcatacaatttattcgttatgcagtatgcgctcaatcagctctgccggtgatcggacagattcagctccaatcagcaagataacggagacttattgtctacaaagtttatttatcttacagtaatcacactatgcacaatgctgaaatttcgctatttaagtcacacatgacaccaatggagatggttggaaacgggaaaatttgttcatgctactcgcatatattacatgggtaaatactggtgggaggaagacggtgctggacgaagccaaaatatacacattgcagcttgctactaatgctgaatttagggctaaaatgctttcctcgtctcgcaaccgcaagatgacaatagtactagtagtaaaccagagcagcaggcgaccggaccgggtcaggttgcaacttgtgattactggtatggatctgaagcctccttagccgttgatgtggctcagcatccatggtggcagcccaatgcgaacatgctgtggctgccctgctgctacatcctctatcctttcgccagctgctgcagggtagttactgtggaacgaataagcacacctcttagctacatcaccaaccaaaatgacaagaaaaagcccgctggcgttttgggggaaaaggggcagatttggcgtgttttcagacaaaaaaaagcgtaaaattctgaggtgcctaaaaaaggtttgatagttattggtttatacaaccttgttagaactttcagttgtttggtggttggtgccaaaatatgcccctattaagttgttggtatttttaatagtattttagctaatgtttgatttgctattaaaatatagtgataacatatataagttgacaaaaaaatgtagcacttccaatatttgtctaggttttagtatcgtcaatattttgatatggtagtgaactaaacgagccatttaattttgttttctaataaagctggatctaatgatctttagtccaaaaggttattcgtctgtgctacataaggacgaaactaacttcaggctgctagttacttacctgatattagttgttggaagggcttccctcatcatgaaggaggatgatgaggaacttgtttgaggttgtgtctggtcccattgcacttgttgcttctggactttctgcttctccaccagctgtaggaaggagcaagggttctgtcaatttaacttgattgatgttaaacaaaccaagatcagctgaagcatggaaactagggggcatcaaggctagcagcctacttctttctgtaggaccttattctcctcctgcagtgacttttcctgcagcaagaatccggcgtgcatgttagaaaatgaaagtgtggcagcacttgcagttgcaagcatggcgggaacttaaaataagagtatgaaacataacacgcgatggtatcaactggtggccggccaaagatttctcgagttttgacaaggttatttctagcaagtcccagtactcaattaaaggtctaacatggttgacatcattaccttccgttgaagctcgttaatggactcgagcattagttggctctgcacataaaggagatttgtaattgtcagctcgtaaaacatacaggacatctatatttagctgtataaaaaccatataaattttgcacatattgttgatatcagccttgaataattctcatcacaaaaaccacctttctggatctgatatgtttcaacgaattttccagctgctgctccagctgctgcagctctttgagattcaaagattcaagatcctctcccatgaggtgcctgcaggatttaaggcgaacaattttatgtcaacagtgtatagtacataatgtcataatggcaccagttgtgagtagtttccaattacttttgacatttctgtattgtctcaaccttagccttcagtttcctatattcgtggcaccagttgccctatacaagcaagcatagaagatttacattaataaatttgagtaaataggaagtatcacaatactattcatacattagctgatatttgaaaaattgccaggaagaactgattgtgcaaatgattgtgccctttggagtaccttgaatttctatattaacaagtgtaactttaatcgattttggcactgcatatagctaaaactgtggacacctagaactgcaagatacctccgtggagaattgcttaggtacagtgtatattgaataaatggatttacttcagtgtgcttgcagtaaaatatgattaactttgtcccccactccacacttaccttttcttctcgacactcatcaaactaaatttactggtggatgtacagtgacctccacaattctaagcacagaatcactaatattacaagtttagaaattgaatgtgctgaagagtatacaatagtgccatccaaaatctatatagagaaaagctctaagcagatagtgcatgttaggaaagggaactataatgtatgtttccttgacaattcatcagcgtgataactatattatctactatctccaaagtagcaaacatttctaggaatgataacagggttacagtctgcctagctagttcagctttttgtaatatcttgattagaaaattctcagtctcactctttatggtatggaaatatgacttaccactgtctgcataataactacattagttcagtcaacaatgttcatacacagcaacttcttacaaaaaatattgcaaacgaagaatatgcatgtctacatgggggatgctaattggcgagcgcaagtcagttacggaactggcgcgcgcgccagctggcggtcccacgcgatttttttcctttttttttgtgtttcctttttttccatctttttcgtttttttctttttttcgctattctttcgtgttttttctgatttttttaattgttaggatacgtgttttcaaaaatatttgagctgaaaattttcaaatcttaacttgaaagtttttcaatctgaacttgaaagtttttaaatctaggcttgaaagttttcaaatctcgagttgaaagttttcaaatctgggtcgaaagttttcaaatctaaacttgaaagttttcaaatgtggacttgaaaattttcaatcgcgagttgaaagtttttgtcaaatctaaacttgaaagttttcaaatccggtctacatgtatctagccataaaagaacttctgattttggagtacaccattagtccatcaaccccaactaaagagtaaagattattcgtaacaaatagacgaatggatctttttaatagcataattgactatagtaagtcccagctaaatgaaaacaaggattatttaaggttccaaacttctgatgagccacgccaaaagttctggaaaatgtttattttgttttatttgatgaaaaatatgttttgtgatattctctggcacacaaaattccataatgagtgttgatgtagtcatgcatccaaaatttttttttatagtttttcattaggcaataactatgattttgttccagtaaaatccacaaaaggtatattgaatcatagtgtaaaaaatgtttgaataagagggaactggcaaagctgtatacgtgtaaacaaacatggaagataaatttgatctaatttgtgaacaaaatttcacttatgaaatgtaacaataccacaatttttaatgatctgacctgagagagagagcctaattaattgcaccaatataaagaacagttcagtttgagttttcaagatttcagacagcaaataggttcaattgggctgggatgccaaaaggtcaggacgctatgtaataaaaaatggatataatctaatttagaataaatctacatatttgataagtacattgaagtaagagattactgttcaaagagatgtaaagcaatatttattaaaagttgatctacataacaatggaaaattgccataaaaaatgatgcctaattgatttatccaacttgaggagagctaaaatgttggatgtacccgtcttgaatgagtcaaccgaaacaggtgtagtgaaaagttcaaaaaataaacaagatattgagatatgagaaacaacagaattagagctctttatttttacctgagtgtcagattcagctgaaataaggaccttttctgcataggagtagcgctcataacgttcaaggattttgtccatactgtgaaaaatgaggaatatacgtttcatcatttgaaataattgtaataataactaagcagtatatatattcttccatctcaacaacaaatgcacatatggctgtaccttttcatatacaggtcagatacatacactgtatttatgattctggtctgttttttcttgaagtccatttttttaagaaaggataggaatttaacaggaaacctactttagtttccaggtttaaaataaaacgaaggaagaacaagaaagttgcacaggcgcgcacacacacttcaaaatctacttgagtgcaaccccttatgttttaacatggagttgttttagaaactgcgtatgcagtattgtcaaaacgaaaaggtgtatcactgtaacatcctaactgaaggatgcccatttctttgaatgtcttaataggtaagttagtgactatcactatgatgagaatatatatatataagtaatacaaaactagatattgttatatatttatgtgttgaagtaacttacatattgtgtgggaatataatatcaatacgatttcacttgccatacatgtactaaccaaaatcataggactagcagcatctaacaaaggccctcaactactaataatctctagttcaaaacatgaataggtttctcaaatgtcacagtggatattatgacatgtaaatgcgtaacccataataaaatgccatttgttttattcaaattcttttttgcaattatgtaaaaaaaagtcatgcttaaactacctttgatgcttaaaacacatcacaacaaaataaatgacaattacgtattttttaataagacgaacggtcaaacatatgtataaaagtcaacggtgttatacattcaaaatttaaatgggggtacttcgtagtggtgtaaataacaacacctacattttgcagtttattcttataagaacttatgtaagatataatacagaatagatttgccaatctacttctaacacaagagttggattaacacaccacccccccacacacagaaccctaaaaaaacaataaattgttgtatttatgcagttcatgaaaacggttttttgggcaaagctaacaataaacattttcatatatcagaatgatcagcttttggtggtagcactgatatggttcaagttctgaaacattattaagtcttactccatccgtttcatattacaagtcgttttgactttttcccaagtcaagcatctttacatttgaccaatttatagaaaaaaaatagcaacatcaacaataccaaattagtttcgttaaatttaatattgaacatatttgataaaatgtttattttgtgttagaaatatttttatttttttctataaatttagtcgaacttaaaatagtttgactaggaaataaattcaaagtaacttataatatgaaatgaattataaatggagggagtagcttcattgtttgctaaagtatttccatgttcttgaggcactttgaacaagttcactttataaccaaaggatatatactttctacggcatactaaaatgtcaacctttcaaaagggtctgtataaccttttggggaaagataatatgcatatatatagaaggtatacttctggggcaaagtcaaggtaaacatgtaatacaagcatacatgtcaagaaaagcttaagcaactgaactgtatctcattttcgttaagaaaaagaaatgaaacaggatagcaagtataactatctatagaaagaattaaggggaaatacaacaccctagactcttaagcaaacataactttgttgaaagagaacatatttgcttcttattcctagacagggtctaatcaatgataatcaagtaagatcacatgtgatattgggttgtctacattaactaaatgaatactctgccgcgttgctgcgggaaattaagttgcataatatgtacaaataagatgaaatatgaatattaaaactaaaacaaattgatacttatgagtttaaggcctaaaaatgattgagattacttggtgtaatgagagaagaaagaagagaaaatttgaaccatatatctattatccaatggctagaaataattggggtaatgtagtctaataagaggagagaaatatcattaactacacttagtggagatgaactatataagtatataggataacttgaaattaatcaacctatggaaaattaacaaaattattacaaaaatgaagtgtcaagagaattaatacagtattaatgcttaaaagatattgtgaataatgcaatccaaactgaaaatttatcattagtcccggatatatacagacgttgctacagttcagtcaacagcaggaatcaactcaatactgtataaccaaatagctgaacaggtatattatgcggttatgagtttgtatgtcctacgcgagttggaccagtaggcctccgagcaagttagaccaattaatgcccgcaaatatatatccattttattattttgggctaacttataagagaatatttgtatttttctgaatcaagtagactggaagtctggaaccctaatagcgtgtgagacagtgagagccagagttaactcattgccgactcatctatatacggctagatgcaatactacaagagtcttgttgtgaaaacagcatgcaagtcgctgcgagctctattaatcaaagcagagttctgaacttcgtgcattggattaagatggaggaaaccaactttacaattctactgcttatagttaaaaagaattaaaatatctcccgagtcacttcaaatatgactactgtttgtctgtgtagacgttcatcgtccaaagagcagtaggagagtattttactacatttgaagtacggagagttttctaaattggcacccaaacaaatatgaaagaactagtgtcttgctactcctaaacgacaagcatttataaatattacccatcgtaccaatggagtaggctcaatattcttattggcgcagtaggtaactacttgcttagctttaacaagaaagccagtcgatctattgccttgtgatgaattgtaagtggttgcatttgccgctacgtatgccagcttaaggcatgctaattaaagtaacatcttaattaaagttcgaagaggatttgtcatgtttcccaactaggttcatgaaagcatctgtttaaagctaaatcttggaaaagtcttaagaaggattaattagcataactacagtaccctgcaggaacctaatggagttgatttccaaataagacgtttaatgacgtacgagaaacgaaaaaaaaatcagattaatccatcggctcgtgtactcccaccccaaacttgataccttgaaatccaaacactgttacctcacgtgaagctctactcctatgtcttaactcactgatcaatggttagagtgagaaggatttcaaaatatgtgatactaatgactcttatctagagatgtggttgctagcattatggggatgcccaacacactacccttattggattaaatcagcgaggagttaattaagttaattagtcgttcattcatagaattagaatagagtataagctgataatcactgatcatatggggagtctgattagtagatataaggatgcccacaaaactgaagaaaatttataacagccagatcaaactctattcgtatgtagtgaggaaaaaggagagataagaaaatttttaacttaaaaaatatataagaactggaattaaccatcaaactctaagatttgcatgttgacttaacaaagcttgcataacaatgcattaatagtaaatcattgtcgaaaacatcaagaaggataaatatccttcagatgatatggtatactggaagcatccaacgttttgcttcttagttctaaatttctaatgtctgtttcttcaggaaccatatgcacatcccaagaagaacctgacagaaaaggtagaacccagcaactaaagcgctaactaggatgaacctttagcttataagttcttttttttcctgttaactcctctctacctcttactaagtcttaacatcttaacagacctccgatgtaatgttgtaacctttgtacctcccctctgaactaagaaaatcgaatgagttaagtgggaaactctcccccaaggtgacttttcgataaaaaagaagcagcatgaaaccagtctgtaatcaggctagctagaagcatggatgtttcttcagaaaccatgtacatctcaaaaagaaccttataggaaaggtagaacccagcaactaatgaaccattagattgaactaatgacagccgggaattaagaagtaaagattaaaggccagccctagcttataagtttgttctagtaaaatcttttcgttctgaaaagcatggcatgcatcagcaaagagtccaagaaagctagaggcagacgaaccagcgaaaagggttccaacaagtcaccagcagcttaagatatgaactcctccatctcccgatgcatcccgtttcatcttctcccttaatatgcttagttgcctcaagagaaagagatggccagggagagagaaagaagatctaaacgagcccagaattaatatggggaatagtgaagaaagaagaggcacacacaacacaagcagcaagttcagtagaattttagatgaacacaagccaagaccattttaatccccaaataatcccaggtccatcaaatctacgtactagagttcctagctaatcacccctctcccctttgggtgcaaagctagcttgtcgccaagcaagcagcacccatcggcagggccaaaaaaaaattccccaaatagcgcagcagcaacgccctctccagcgaaagcggagcataaaattaccctcgtacgggcactgtagctacagtgcacagatgcaacgcatctcacctcacgccgtcagctcaaagcctgaaatagcaaaacacgctgcctcctccatcgccggcaagcaatcaacaatcgcagcagaaattcaaacagattattggggataaccccgaaacacacgcaacaaaattaattcgagcaatcaggacagatcgaattaatcacacacagaattcaaaggcaatcgatcgatacgaacagaacggaaacgggaacacatcatgtagcgcaaggattgctcgattaagcgaaaagaactgaaagcttagagacaagcgatgaggatgaaatttaatcaagcacacgtacgtacgtacgtaccatgagtcggtggcgtactcgtagagcttgcccttggtggagaagatgatgagcgcgacctcggcgtcgcagagcacggagatctcattcgccttcttgagcagccccgacctgcgcttggagaaggtcacctgccggttgatcttgttctcgatccgcttcagctgcaccttgccccgccccatcttcctcctgttcttcctcctcctcctcctcctcctcctcctccctccctccctctctctctctctctacctccaaccaaaattaaccctacccacctcgctatcagcgacgaccactagccctatagccacacctatccccacacggcaactactggtggtggtggctgctggctatccgcctatcccctagccccggcccccatcacgtggacacggcgagacggcggcggaatgcgtcgcgcgcgatgggggggaccgatcgatcgatggatggatcgatcgagtgggggagacgacgacgacgaggaggaggaggaggaggaaatggggggattttaaagggagcgcgcgccggatcgtcggaggaggaggaggcggtttggcgataccggggtggtttcgatcgcctccgctgtcgaacggccattgggcgaggcggcgccggcccgggccccgcctcccggcgacgcgtgcgtgcgtcgtactctcgtgggcttttctgggccgatccttttttgggccgtctcgtctggccaggcggtgggggtgggccatggcttttcctgcccaattaggccgcggcagcaatgcgtcgtgatgggacgggatggctcctggcttggcttggcttgggtcggccgcaaaacagtgcctgcgtcgtctcgtctcccgtcggccccggcgagggggtgtgcccatcaatggcgtcgcctgtcgctcccagagtggatgattgcctgattggcagttggcacccctgcagctctgctttgggttgaatgcagcaaaggcattcgttctctttctgctgcttttgacctttgtggatgaatgcatttcctccgtattaaagcctgtttagtagatcttcatctcttaaaatttaactttaggagttaaagtttaaagtgaagttgtgtagcggtctgaactcaactccacctctctagtttattttgtgataacgctctagccaactatatttctattttaggtgtagaaactatttggttggactccagctatagaatgagtggagctatagctagagccatactaaactggtccttaaatagacttcattttcgatcgctttaactttgttctttcttacctataattaatctgtaactcaaaattattcctaggttatcatttgacgataatttattttcgtattaatgagtgttcatttgatttttcttctctcaccattagtttgttagctttgttctaaaaatgtagtcttcgtagaacggagaaagtattttgaacaggaagcagggacctactcatgcagtaggatgattgattgccctccctatgcacagtaggaattttaacattggcttgtctggttctcaggggctatgcaaaacttgagctacattattaaatattttggatcagatctaacatcacatcgttttggatgggacttaaatacggacttcactgtgcattcttggatacactagctagaatgttatttcattctcttataaaattactgatttaattgtacgattggatctatctgtctctttgtaaggatgcaggcgatgctatcttacataagagcccatattctaagttaattttcatcaacaagtatataataaaaatggatgaaaaaaaagtacaattaggtttactgggcctcaaagcctgcaagcatgtcgcgttggcatccctattttctaacatttatgtaatgattctattttcccaactaccatatattctaccttaaaacttgacttcttgacgtatcatagcagcatctctttaagatatggtgtatgattgataatgttagattccccatgggcagaactaggtgaggacaaaaagctcagctcagcttgtaagccaaattagctgagcccgagcctccatcatagctcttttccgaaacgagccagagctgcagaaccgtcaataagttataatgtatttggttgaaagggatgagatagtcatgtggggacaaatctattttcagggtgttcggttcgataacaggtgggacagaataatccttgaaatggaatatttttctagatccaggtcaactttatatgaaaaaaattaacggactcgaattgagatgcgggccacaccctcacattccttataaaaaaaataagagcattatatcccttatgccaaagacatagatggggctatcccatctcagaaaataaggatggacctaacatatcccacttcatccccaaataaacacacttctatagttgtacatcaacttgcaattgccaatgcatttggtagtttcatgatttatatgtgcaatacctgtacatagtggacccaagggaacagagaatcatgggaaatgactataggggatgaaccaagggaatatataggacacattaaagtgttgctaaatactagagataccccgagaaattcccctctgaaatagggaacaaatggaatttaattttggatgaggggattgaatccaagataagctaagagaacaggaactgtgttgtcacactcacatgttatgcttggggaatttgctgtgacaaggggaaaaaaatgaaaatgtaagcaaaataccaagtatatatcttattaactgaagctcaaccatagtctccaccccccacacctcaaatcatctctctggtccctgttcgattttgctcatgttagcatggaaaacacgctgagacattagtatccgattaatgaagcattactaccatgaacttgaaaatggatttatgtggtttttaagaaactcctatagaattcttttttcaaaaaagtgcaccatttatcaattcgataagtgggctcacgatacaagagagtagctcaccccatcaattcaaaatgaggccaaaacccctaaccgctccgtcacttcctcaacctcactaatgacaatgcacagtgcccgctggaaggccacttcatggtaaacccgcctctaaccgggcaatcacaagattaaaaaaataatatttatatgatctaaattattattattaataatagaaaaataatcttgttttgtttcaaaggagggattttccttttttttcatttaccttgagcgaagctggaccaaattgggatctaatatttttttgtccgttgactttgagcccttctttctcccctccctcctccccgcacaaattttcataatctctccttcattatatatgacaagccatcccaacaactttgcctagccactaaatctaaccatcttgattagctgaccacactaccaagggatccctccttagagtggccctattaaagagaataataataaaaaaaacaccgtacatgatgtataatgcttggtcatacctcaaagagactggtgattgtgtgaagttagagctatagcattgacacagagcgagatgtatgacaatgatgatatacgcgtaggggaaattaattagaatcgcctgatcacgagcgagaagttcctatattatatgatgatgatgtcatgccattgtcagcgtgtgaagagccttgttgtgctttgaacttgctagttatatggccgtgtggtctacagttgttaggtaggtagttaatttgttggtacgtatgattgttttagcccgattttctcttcattttgagactaatcattcggtgttgggggtggtggtataacagttctctccttaaaacgagtcacttttttttaaaaaaaatataacgatgaaaaattaccgtgattgtagcatgcagatacacgatattggagaacaatgtgcgccgtgtttacttccaaagttattcttcaaaacttcaactttttcatcgcatcaaaactttcctacatacataaactttcaacttttctgtcacatcatttcaatttcaattaaatttctaattttagtgtgaactaaacacaaccgtgggactctatcctatgtgtattttacctctaccattaatgctttatgccgaccacgaccgtcaaatagctgatgaacgcacaacatgcaatcctgcaaaagattacatactttacagtcattggatagtaaccaccatatcagcgccccttgtggatgacgacgacaactttcattctcatgtcgtgtcattgccaaaagatatggaagaaacttatctttacatgcatagtgtctgcacaatgggtgagatgcaaacatgtaattatctagggcaatagagattaattagagaattcatattactgaaaagcgacaaaacacatgttgacagaagggataacccactagataacaatattctttctggcgcctttctagcaaacattcatcgtggcacaactgctcaactgcttaacctgctgttaaatgtttctagaaaatttagatttcttcagaaaaataaatcgtacggaaaattgctatattaactcatgcacatttcattttagcatataagtacaatagctactcttactgactaaatgtaatgtttatttcttttggaacatgggtgctcgtacttatgactaattagtctttcattagtatagacgacgtacatgttgacagcgagacgtttgtgcactccgttaattttaagatataccgacccaatctttttaaatgtgctcacatgattagggtgtgcgtgtgtgtatttataaaggtgagcacgcacgcgttgtaaacgcttgtgtttgtaccagcatatgcacttctgagcacacctccctaactgatattgatacttttttgaaacctaaactgatattgatactctctccggtaaaaaaagtactgatattttgatatgcatacagtcaacaagtttaaattttaaccatcaatatcgctttgaatattttgattttgattagattagtctttgaaaataatttcaaaatattataattttactatattttttatagattttattctagtaattaccaacaaaacaagtgtcttgatgtgttaccacacttcaatatccagaacacacttagagcacgtataataaaatgttataagggggctataagagttaccacaccagatttatgatgtgttggagaagagaatggaggagacagaagagaagtgtgcttctgtagcaagctgtaatatgagctccaaaaatctttaagagaataaggtgtgcaaaatacttcctccatttcacaatgtaagtcattctagcatttcccacattcataatgatgttatattgatgttaatgacatcaatatgaatgtgtgaaatgctaaaatgacttacattatgaaacggagggagtacgtattaatagtgctatatgtataactatagttaaatattgtatgggtaagatattagattagttataaatgatatggtaagagcaatgtgatccataagcaaaccatatatatatttatgtggaagagaaaaataagaaaaaagtgaaaagtattggctctcatgcaagagttagctctacacatgcttaaaaaaagtatatattaaactcatagtaagagaaagagagagaagaaaaaaatatagtaaggccggtctactatatatattaaactttatatatagctaacctattatatatatatgttagctaaacaatgatcgctaattaatagtaaggccggtctactattaaacttagttacgttggctctactattagggagcagttaactgtttataaggcaaaaaagacaataaattaactctcatcggtactgtacataataacgttaggcggagagcataaatgcaaacaacgcacaccctgtgcaaatattcgcaaggatggatcagatgcagatccgcagtgaaggagaaaaagacgggtatatatatgtatgaagttctaaaaaaaaaaaaagtgtacgaggcaggaagctgccggcgtcgcctcatcactcatcagattccacctgcaaccaaaaaaaatctgtggactgtggagcatggagatcgaccacaattaaattcgtcaataattcctgcccaaagctagaaaaacaacaagccaatatcaggagaagcatattcctaagtgagattacaacaagagagcagttaggccacacatccctctccacatagtactccatccgtcccgtaataagtttatttttggctcattatatttatcccaaaattaattttatttttagtgatcattgcatcgaagtttatgaaagtacaaaataattatactgagagtatataaagtgagaaataattgcattgagatttgataaaatatgggtgtttcggtctttttgttttgtatcgatatgtgcgagatgaataagacaggggtaggccatagcttcgtgctacgcaacatagtagattaatttggagatgaagcttgggaggaggccacgggcagacaaagtcgttgtcctatccaaatgtacgaccatctctgtctaatacatcttcgcttccgtccataaatataaggatttttattcttaagtaaatgaaaatgtttttgtaaacaatggttatttttaaaattttgaattgcttgtattaacttcccaagcatctcattggctaaaaatatatagatgttagtgttttagaattatattgtgatacaaattttaaatcataaaaatgcttatattttgaaacatagggagtagtactctagtgccccacctggctccacgcggcccctctcttattcattttcttttcttttggtggtgatagtgcgtgtggcatttttatattttagccggtcggtggatggacctcgaccgtgccactaacaatgtccactagtttcataccttgcacgtgagtgttgtctagtcatcatgactatacgcatctctttacctaccgatcatgcttcatttagaatattatgtacagctacctttattgatggggtgaaattatgttgtctcttatacgaatattacgcacttttttaaaaaagtttttttttttggcctaaggtagctacatatgataaatggagtgcgatatttctaaaagtaaggtctataactgttgagcactacaacatcgtggatatatcgacttgatatcacaaacatgatgtaaacgcaaaaaggatggttgtcccgcttttgttttcacggtaccatatcacgcaccttactcgcagtgacagtactcacaaactgttcatacaagacaaaactatacatagtagtagtacattacactgagaaaagtttggcaagcacttaattagcaacaaattgaagaggaaggagagaggaacttctgaagcaacatatagaatccatacatatggccaaactcagctgatacttgaccctgattaactgaagctgaaacggtagctagctagctagctaggccatccactcaggaggataaccgcccggtggcggcgccggcggctggttcacgtccacggcatgaagcctgcaaaaattagcaagtgcatatttgccatcagtccaacatgattcatatatagacaaccatcactttgccattattaggacaaatcttgataatccgtggaaaactaacttgtttggtgcaaaagcggaattaatgatttttttcccctctaaatgaaagctccatttgtcaaaaagagtgtagaaatctccctttttctaacaaaagtttagcaaggatgaagacagtgcagttcacgcacccgagggcctggaagaagtgctctggttggggaggctcactggaaaacacgccgccgccgccgccatggccattgctgcagtttccgttccatggaggctgtgggggagctgcctctacgtcgatctcgtcaagctgaaacaggaaaggatcaaacaaccaaattaaccaagagaagagcaacgttgtcactgccgatcactacagagaatgatcatgatcaagaaacatgtgcgttctccaaatagcatgatgtcaaattgatgcagagaggtgaaggctgagaagccgatgcatgcattttatactgctgccatgccaccagccggggggacctaccgacctatatatacttggcctacttgtgcatcatcggcttttcaatcacgagcccacaaatctacttcagaggagatcgagcaaaattcttgggagtggtccaagaagcgagtcatgcggtccctaactacaaatgcagagggagctttttctatatggtttctaggtagcatttgagtaaatggaaatctcgtaccttccttttcaggaccctgtttgcatcttgtagcatttgttcctgaagaaaagttcaatattggagcaattagataaaaacaaaccgaatttgcactgaaagaggtacaagtattcactgtagtgtagtatatcatttggcggcattgaagaagatatttcagtgttacctttctctttaggtcgcagagttcatcaagtagtacctgagtctgcaaaatatgtatgaaatcatgcacagaagagtattagaagtcacctagcttggagcagctttttgaatcgtagagaataatatatatcccttaattttttaatgaaaaaaaggaa

SEQ ID NO: 43299 - DNA, 1551 bp, Oryza sativa
  unsure (1)..(1551): unsure at all n locations
ggttgagttttttttttttaagaacggagggagtatcagtgtggcaaaatgcagttacttttttttaaacgttacagttacttgttattcacaactcctagtcagaaaatcccacttttaatttaatccaacctttgtaaattattctaattaagcttaagcaacacaacaactaagggttaagcctcgtagaacattgatcttttatcacatggatgttgggtaagccaacaaatacaaatccacatcacatattaccacatttgtatagcttcagatatagtgcatagtaagcaaaccataatatatgtaacaaagaagctagcgcaacgttacggatgaaatctgaaaattttaatcggtaagtatactacatatttatacttgaacgagtttccttgctatgttaatttacctttcttgatctgatttgcttcaaggttctgactacttgactctcaagctgctcaagttcatttgtagccagtggagctaaatcctcacctagaaggttcctgcaacattatcaccagttaaaatattttgcaaaacaaagggagcaatggagtagagccagtgttctttagactaaaatattagacccaacaaaattgaagaacacatgtacatatgagtatgaacataaagaatctattacctttgtgattgttgcagaatctcaacatgtgccttcaagttcacatattcctgatagttgttctacattataaagaaaagcgaattgaaaacaagctaaaattttaaatttagttattcttgtcatacacagcacaaaagcggcactaatgatttactgaaagtgtactgataatatacatttgtaatagtgacagcgtttgacctatattaatctacaaacagttgatctatatatatattgtattgtattattaagatagcttaaatggaagctaccacatttgctctggaggctaaaacctatattaatcggagaaaagggaaaaaaaatgtttggaccattagatcgtggggtctagctcattatagtttagattgatgaatatatctgcatataaaatgcaattgtagctatagaaaaaaaaggtagaaattgtatatgaaatccaattctattttttttaaaaaaaatatattaggtagaaaatacaattgtatcaatcgaatagagttaaagtattgcatatcaaatctaattctacttttgaaatctagcaccatgcaatttgcatgagacaatcgcctagttatattaagtataggccaagttatatttgcagtacgtataataaacaaattaaagatgtgaacatggtaattaaaactaaaatggtccctgtagagagatgcgtagagtttatgatgaatgccaataattgacggagtaactacgaagagatactatatatactctatctagtgcacccagatccccatggatatgttcaataaacatttatcacatttacatcatgtatgcgttgcccatttagctagnnnnnnnnnnnnnnnnnnnnnnnnnnnnnnnnnnnnnnnnnnnnnnnnnnnnnn

SEQ ID NO: 43300 - DNA, 994 bp, Oryza sativa
gcaggtcgactctagaggatcccctgcctacctttatgctcatctgattatagattcttttttgcttctcaagttgttagtcctaggcctacaaggccacaagggccatctaaccaaagaggctgcgtttgattggctccagggatgatcacctgccactgatgagtaacaaatcttcgatggaacctgggtatgttctgtcagttcaggggcagtttcagtagttcccatgctgcattccaacaaagatatccatgcatacataccccaaatactactatcaaaacaaaccccacatggtaataccaccaattctcccgcggtccacacaatgcaacgcaacaccaaaaggacaaaactccagttccgcagcgttgccaaactccggaaaaaataaaggcccatgagccgaaacaccggcacgcacgtgaacccgaaacggaacgcagccgatgcggcaaggcccacgcgacgctagctgcagcgacaaagcggtggtggcgcaccgctgccggtggcacgtccgcatcggacgccgacgtgcgtgcgcgccccaagccgcgggatctcgcggtctcgtgctcacctcaccgatcgagccgtgccgaggcgcacgcgaccgcgacgccaccacgtcgcccgtctcgcctcgccgtcgtctcgtccagatcgcctcggcgcgcgttgccgtctcgcggtctcgcggggcgcgggtgattcgtgcgtaccagcagctatcggccgcgtcttttcgcaccgatctggctacacggctggggcgggatggactacgacgtgtgcgaaaaagcgagctgttgcattatctaatctgtgattttccatcaccacacggtgacaaatggaggcaagggagcaaagcaaagctggtggcgacagtgagatgtccccgagtgcaacgtaaataaagcaaagcaaagcaaagcagtcgtggtgcagacgaaacgatcattccatcaaaggcccagactgaaca

SEQ ID NO: 43301 - DNA, 44911 bp, Oryza sativa
tgatctaattaacaaagcagccctagtctgtgccaagccactaattgtacatcctttttcactgaggatgaaggataaaaataaaacaatattctagtgtgttataacccaataagacaccattttttcctagcaatatttaaaaattattaatatgagaaacgtgtatctatggatgatgcatgtcacatatgacaaattaacagttcaccaacggtgaaactttgtgtgatcatcacatggtagctagtgaacacatatactacaaaaacaaggtactgtggcacttgataaagaaccaataacggcatagcattattatacagaaatctcttattcaaatacagtaatctgtctctatggatgataccccttataacaacaaattaacagtgttaaccaagggttgaaacctgtgtgatcatcatacggtagctagcgcgaatgcatattcctacaaaaatatggtacatatatatatgatacttgacaaagaaccaacaagaaacagacaaaaaaactggacccttatggcaatttagtgattgattggaaaaactaaatgtgcaataattcagtaatagaaactactaggtcatttgatttccctttgtaacgtatatattaattgtaagaatgtagcatacattcatatggggaaaaaggccaaaacatattagcatccccatacaaactataactcactagcatgtatattaacatggtcagtgtattctttaatatgcaatttttgctaatgtgagttccacatttcatgcaaactgccccaaatttgaagattatcctgtatgggtcaattacacgttaatataataatatactataaattagcaattctacctcacagagtgtctatatatatggacggtgcatttgcctacagtgaattgttttatagagctgaaagtagttgtacagttgatcttttccaacgtagctataaggtaacagtattttggtactgtcagatatacaaagtcagagcttgtacgttaaagtagttcttgcaagttccaagccgtagatgaattaacacatgacgatgttggtgagtttaactagtgtgttgtgttcatgagatatttattgcagcaagtttataattaacacacaaaagtatccttgataatatataagtaaacgacaaattttgatcaaaagcggcattcttcagcaaattttgctcatcaacagctagtactaaaagtggcattcttccaagtaaattatttaaactccatcaagttaaatcctccaaattttaggctaattcagattctagcatttgtacacgccatgatatttacatcaaatgaaacccctttcttaatttttcttgcctgctatgacacacatacatatatacacacacggtatatatacgcatatatgtacatgtctggatctcctgccgaggacaacctcgtcttctttgccttgttcttttgtagccttttttacatgaacagtagcttcgcccaatagaacagaaagaaaggaacaggcgtagaaaaaacaacacgtacgaaatcatggcccctcccataagttcatgcacggacgacgacggatacagtacacgcgcgagaaaattcagatcggtcgtgatttcttgcagattgtgcgcgcaaagatggagcaaattgcggtttggggagtgcaggttaagcaagttgagagaatttgattaggggaagaggaggaagctgagatgagtgagaggggcagtgggtttacttggatgaggaggagaactggtagaggcggccggcgtgggagaagaggacgagggcgacctcggcgtcgcagaggatggagagctcgtaggccttcttgagcaggccgttccgccgcttggcgaacgtcacctgccggctgatcttgttctcgatccgctgaagcaccaccttgcctcgccccatctcgatctcccgctcgagatctctcttcagtcttcccttcctctctctctctctagatcgatctctagcagaccagcaaatcaacacaaacctctgaagaattttcttcagcaaagcttagctgctagctcttctcatccatgcagcatctgcatgatggatggatcgatcagtgcatgaaatcaattccgattccttgctctctctcgctagctctctctcctactgtcacacacgcacaccggccggcctgcagctgatctgctcaagctgtggcttaattaggagtagcttttttctctctatgccctacttaatctctcctctcaagagagagagatagagagaggcctggcccagcttgcagcgccctgtggatggtggtggtggtggtggtggtggtggccgatctacagcttaattggccgagagagactgagcgcgaaagaaaggcaacgagagcgagaggccgggtcgtcgacgaagagaagaatcttttctttcgtggggtagagaggcagattgaatttggatctcatctcatattctcgtctcgtctcgtctctcaccctaggtcacgtagtagtagtacgttacgtttccatcgccccaggtatagcaaaaattaataccgccgcgagcgctcgcacaatcgcaattcgcaagcttgtaacagcgacgttaacagcgaggcgagggaagcgaccgggccggcgggggcgtcgaacccgaggttgtgtacgtatcacacggtgcggcccgggcagcagcgcgcacagaggcggaatcgcgacgtgtcgagcggacgctggtgccgggtgcttttatgcccacaggctaagcggagactagctataagctaagctagccagcggctgtagcgagcaacgcccaagctctcgttgacgcaacaggtaaggtggctgtacgtaggagagtacaggatggctgcctctcttcccccggcccgccggtccagccgcttccccgtcctcgcctcgacgctgccgccgtgtttcctacgtacccgacgcgtacgcacgccggggcgccgggccacacggcgaggccggtagctgggggagcgatacgctagctaggcagccatggccggacgcgtgcgtgtcgccggctggcagggggggcgttcttccggccggtcacagtgcacgtcgcgtcgaccgggacggggggcatgtcgagccatcaggtcggcggcgtcgcctcacgtgacgggtgggggggatggcagaggacagagaggaggaggaggagaggagggggatcgatgagcgcatgagctcatctgcacagtgagcggaacaactactacgcccagcacagtagctgtagcctagcactgtcactcctacagtgtggctgccgcgctgggcccaccacgtaaccctcggtctcgctctcgatcggggggtgtactgtagctgcaatcaaagtagttgccacaacttgaagagcgtacagtacttgctaaaacctaaaattaattaaaccggttagttttaatttggcaaatttgctacagtatatctaaatcaaaacgtggattttccgagaacactataaaaatatggtaatttgctgaagaacataaacatcgattattttattgttttcatcctatttgatagaaaaatattttaggaggcccctatcccgcatatgtgaacgaaggagtatgtctcagttcgaactgatcatatccccgcctctcaatctttgtgctctctcactcaaacccctattagcaggcagcgaggcgatgacatgagtggcgaggaagaagaggagggcaaaataaacatttcatatgcctcatctcttctcaattaagtggattttacattttaaaggccgtgatgttctccagcaaattatcacgttttttagtgccctaagacaaaagctacatttttaacggtgtccaccagcaaagatcatgttttttagatgttttgtagaaaatttttccttttactttacatttctcatattgaagttgaggttaagtagaaatttcataggtgttcattttgaaagttgataaaaccccatatcgtcaccgcccaactctttcttttaaacgcaataatttcattggatattctagttggagaatgggggaaattccaaaattctaaaggacaagctatttgacccacatgaatttgtgtgtgtgtgtgtgtgagtaatattccaaagccttgagtatgttgggccctatttagattccaacttttttcttcaaactttcaacttttccatcacatcgtttcaatttcttcaaacttccaattttgatgtggaactaaacacagccttggtacttttgtacagacatatgttcacgccatgacaataggttaaagctcgaggactatttctctttgaaattttaaatttcctttccaacgctagctagctacaacctctagatataggctctaatttgaaaatgccctaattcttgatgtgtattgagtatatgatatggagttaattaatttgcaatattaatttgcacaaacaatggttacatatattgagcatggtcacaccgtgatatatgctgctccatcttgttcggtatactcatttacacacacacgtgagctccattttaagttttaacacataattggcggatatagcacggggtaaaattacaatgagtgcatggtgaaatgcataggaaattaaatagagcataagaatgcacgtgcaaagagaaattctacggtcattaagaaaatacttactggtaaaatactagataacaagttttatactagaaaatatgatacgataaaggatggtaaaattatggctcgcaaaatatagcacgaaaaaagaaactgaactagctggtgcagtaggtgtccccatgcattaatgtactcccttgatagttgataaagaagtactccaagcactcaaatgtagcctgttgcgatgtctgagaaagtaagaatatatagagaggtagtagtacgtgagaaagacatggccggcccatgtccgtttcaattgctatgttttgatttgttcttggattctctttattttgtgtaccagtcccatgcatgtcctctaagatgcactaaaagttgcgaagaagcaatcccaaccatatcttctcatcagtgtcatttattaaactgtacttatcaagtacaatgttaggtaattacgaataaacctgcatggtcctaaactaattccatctcatatgcatgtgatatgttcagagctttagataaccgataatgtcactagctaagcgtgttacaccggtccactgatccactcatgctgatatataagttcaatcacccaactgtgtgttacacagtggacaagacaagtgaccaccgagagtgacgatatattcaggctcacatatggcaaaagtgtaaagtgggaggcaatgtcggcaccacataaaggccagccatatatgcatatatgaactcgtgacagaaagtaggacaagatcgatggaaaagggaggaggcgagaccaggttgggtatatagcaaagcggaacaaggccatatctatgcacacacacgcatgtgacacgcccctaggtacaggctgtgttgttacagtctaggcaaagtcgagtaccacgttacatgcaggaaaaaggagcaaaaaaaaaaaaaggccgggtcgtagtagagctgtagccccctgttgctagctggcccggccgcggcggcacgatcgccatgtagggagcggcatgtcgggcctctcgcggagtcgcggtttggcgcgtcgggtgcgtggcgatccgtccgtccaggccgcgcgcggagcggggtcacgcggcctccgctgttacgacgcgcgaaatttctctgcgcgttcgcggccgtgcgccgcaggcggccgggtgggtggggagccgtgtgcagcgggcgcgggtgggggcgtggccgcgtgggcgtccgtgctgggagcttgcgtcgcgctgcgctgcgctgcgcggtctgcgggttccgtggagccgtaccgtgcgcacggccgcacggcgcgtcgcggggctcgaaacgtggcgccggtggcaggagcgcgcatcggaatcggcgagttgcctcccagctccgtgcagctgcggtgctggcactcaccaagtggacgccggccacatcgcgtgcgtcgtcacccctccaggatctgaagtggcagaggcattgaggagtacagtaggagtacttcagctgggcatgtattccctctctccgtaaaaaaaaacaacatcttagtacaacgcgacacattataatactctctttgtctaattttaaatgcagttatggtttttcgcgtccaactttaaccgttcgttttgtttcaaaattttttttaaaaaattaaaaacataagtcacgagtaaagtattatttatgtcttatcatctcataacaacaaaaatactaattataaaaaattttcaaataagatggacgatcaaagttggacgttaaaacttatggttgcacttaaaatgggagtacaatgaatctaaacataaagcatgtccaaaattattgtagaatgtgatacatcataatactgaaagaaatttgaaaatatactttattttttcatattttgcatttatatacctggctgcgattaatttacaaaaatatacccaatccgctgaacggatgcgcgggagcggaacccgagccggtcgcgcggaaccgagatgcgcgaccgagccggtcccacacaactggcctgcgggatcgagtcggtaccgcggcgccgatgcgcgggagcgatggagcccatggtaggacgagtgaacgcggcggtgccgcagaatggcagcgcgggaccgacgctgtcgcgcggttccaacgcgcggaaccgaataggtcgcgtgatctttgagatgtgttcttcccctaatttttctaactcatccgcgcgcacgcttttcaaactcctaaacggtgtattttttataaaaagtttctatacgaaagttgtttaaaaaaatcatattaatccatttttgaaaaaaaataactaatacttaattaattatatattaatagcctgctccgttttccgtgcagaggagatcggatccaattcgggaaaccgagatgggggcggcatgtgggagcgccggtcccgcacatccggcatgcgggagcgttgccgcgctcaccacgcccgcgggaccagcgtggtaccgcatccccggcctgcgggaccggctgctcgtcctcactcccgcgcaaccgttctgcggattgggtatattcttgcaaattagtcacagccaggtatataaatgcaatatatgaaaaaataaagtatattttcaaatttctttctcataatactaggttatatttttttgacacagaggaagtagggggctaggggctaacctgcctagtgcatcctctgtctaaaaaaaagataaaccctaactataaacctaaacgcgtgtatgtctagatttacaagttagaattgaatatttttttaactaagggagtatgagtcattcttgccacattttttctttagtctcattggcacgggtcaacataggaaaaatcttgccacaaaatatatctatgaactaaacaagcatcttaaacttgtctaactaaggctgagttcggcacttaactttctaacacactcctctcattttcctcgcgcacgtgtttttttttaaaaaagttctttacgaaagttgctttaaaatcgcattgatccttaaaggctaatactccgcttcgttttctgtgcgggaggtggagtcttggtgtgccaaccttaagcaagttgtgagtgccaaccaaacaatgttgtaaactaagaagtatcataatctaaaaaatgctaagttttctatcttgtagttcattttttgattctatagctactgttagtaaaatctagataaaaatattaactgtttgagagaattgaagattctggagaagttgcagttactatcagctctccaaacaagatcgttaattgaccgttagtagatttagcgctcctttttgggaacatttagacgctagatttgttgcgttcaggaaattacaatgttgtaaaaatgcatatttcgagagctcgaacgttattagtagtataacaattaaggctaacaacatactacagtattaaaaagctcggcgaaccacctgttttagtttccagcgttcataacattgtcggaataaatctccagtcaatacacaatcagtaaaaacacacattcgcgcgcgcacacaagaactatatatctaatcgatctttgttcaagatgatggaaatccaatcatctcaagcgagctaatcatatgcatgagccgtatgagtatgacacaccatccgtggagaagaactgggaattgatattatcccatctccacacaaggcatgtcactagattattgtgcgatcaacaagcaaaacgttggttcaccggcaaacctgagctgaggcacgattcgttccagcacgacccaggacggcagaggtcgaggcgccgccatagctgatcaggactcggtcgacggtcctgatttccgccttcttcgggggaagtcgattggaattactaggtgtgttgggctggacatttgggcgtacatatgggccagcaaatgggtggctccgtggctgggcttctgtttcgtcgcgtcggtcgttgggccgtaacattttcggatggttttgtgcaacgcggggatcggatattcggaggaggccatgcggcgccagcaaatgcgacgattgctacgtcgtcgtcgacggcggcggcgtgcgtgcgtgcgtgcttccctgcgggacgtcgtagtgcgtggcgctacgtacgactgcacgatccctccctagtcctgggctctaaaacgtggcacggtggctggcaggagcgcgcgtcagaattgcctccagctcgacaaagcgatccggagaggcgtgggtactgactactgagtaggagagtgatttttgtgaactagtgatccgactcccacagcagggctgctgttttccttttcttttccattttttcgcgaggaagggttgatgttagatcaggcgcagattaacagatttagctagttctcccaataggacatgtttagttttttttttctttttccccaataggacatgtttagttttttttttctttttcttttatggattctagtatatgccgaggttaaaatgcaattagtttcatatatatgtttggatgatagtatatacttagttcacaatgccatgcctaattatgtgtcaggctaattatgtgttatagagaccatgagacttgactcgaggatcaacttggaaatcctgaacgttgatagcaaactggaggggcacagcaccaacgcttgtttagcacaatcccacgaaagatgatcaacacgtaggtgaaggtaagatgatctgggcctctggggccatccctggcaccaaaatcgaatcgatgtcctcgtctccataggatgtagaaactataacttcttaagtattctcacagtaaaagagggagcattgattcaagactcaattacagagcaagacaatcaaagctaagcaataaactttaacagttcgtctacgacagaaatgcaattcatcaaactattgctgcctcttcaacagattagcagcagcttcctacacaaccaaattatagcccatgtagtccatgaattgctgttctgtagattatttactacagagtgctgacagctgaatgaatccattccaaattatagcccatgtattccatgacttgctgctttgcatattatttactacagagtaccgacagctgaatgaatccattccattggccactgaatgaataactagattaaccattgatattttagacaaagtctgacattttcaagtggaaatatggtactaatgttatggtaacaaaataatatgctagaaaatctgatcaaatatatcaatgactagtatgctagaaaatacatgttgcgttgcctagcattattaacaccaccatcactggtgcaataacttatcataaataaaccccttcttccaacaaacttaccaagcaacggctgaagtaagtaaccatatttcacacaaatctttgttgtttgaagaaaatcttgaaaccaaacctttgccacttgatagaacatttccagtatcagcatccacaaattatacactttgtgaaactagatgtttctgtgaggttccaaaaaacaagaggtagatctgactgagctaaattaaagagaaatatatctgtggcttagctaagattatatagccttgatccaaacaataagaaaaatatctatacacaaggattgataacaagtttaaaacctgagctccacagatagaatatattgcattgtaatcttaagatataagagccacacagatactgataaacctaagctactctatgtaagttcattgactatctagaactaatcatgtgtgatattgcaggtcctaagagagtaagatagatgcctctttaaaccgttcgtgtttgctcgcacatattttatacatatatcatgtaagtaaactagtgctcctgcctctaaatgtaattaagtggcttcagcagctattctgcaggtattggtgtaagaaaattccagcattgcaatacatgtccgaacaaaggaaaatgattaattaaccattagacaatacacctcctgctcagctgcttgatgcagcaggtgtctgtgcacggctacttcgcttgctgcttggcgaagcaactagctgcggcagcatagcatccaagcaccaatctatcatgaatgcacccacagcacacagaagcactgtcgaatcaatcatacaaacatccacagatattatgcactatccaatggatctatctatgttcaagaatcaagatgattgataatgcaattatacaaatcaaccaaaatcatgaggcagatacgagtatcacaccatctgcagaggaagcacatcaaactgaaaacgctataagattgagcatgagccttctcggagggaggcatgtgagttctagcgaaagcgttaaaatgaaataaccaaataaattcatgctccttcagtgcatcaagattaagcaatcaatgagcaagcacatactggtaacgataaacattagtagtactaaagagacatgcaggctgtagcaaaacaaacccagcttgtgaacataaaacatgtcattcagaatctgatctcctaatcagcagcctggcgaaataaaaataaaagaagtctagctggctcccacaccacacgaattacttctctgatctctatttctgcatgctcttccactcgctccattgctggccaacaaaagaagaagacaactcagatgaattgtacacactgctaatgccataacatgcttgctacagttgtaagcaagacaattgagtaattgtagtagcacaacattgagcactaaaatgaagatgacaaagcagcaatatcagcatgtatgaattgcaaatattcaaacaaattaagcttgtgtgtatgagacaaaacggattacctgagcacacaaccctaggaattcacttgggcaaattagcatcagtatatagtcctcattcaacttcctcttgcctttgccacaaccaggaacctgaacatgacggtcaaggtatctgaagaactcagagccaaacaaacgctgcggaacaatcatatctgggggaaaagaaagagggctggactcgagcctcatgcttctcatgtcgaagcggcacatgtggtgcaccgcaggttccccacattcgctgattggccccaacagtgaactggacagcgtgaagtagagggcattgtcttcatcttcctccttcctcaggaaagggtagactggctgagtctccggcaatccattcttcttgaagtcctccagctcccacagacttcccaggctgagctccacatccttagtccatccccaagaggccgtgtccagcgtccacactgtcatggtcttttcatccaccggcatagaatcttcgaaggagatggagacgaacttgatcgagctcccagaggtgcaacccatggtccggtatatctccgccggcgcagtatccggcatgtccagggcgtcacactcgcacccatggggcagctcgatgaagctgaagttgacgtggtagctgtcgaagaggtcgctgcagcggcagcacaggacgcccttcgtgaggtcagcccagaaagcatggcttgtggacgtgaacttgacgtggtggcggaactccgatggcgtcttcccctccgggaagacgggctccttcaagtgccacggctcaatggagggacccggggtgtcacgcagcagcagaggcggtttctccgacgatggcggcggcggccacaggcagagcacatcacggtggtagtagttgcatccttgttcttctttctggtactccaaattccgcgcgaagagtacaagggtgtactcgtcgccgtagcgcacagggagagggtcgcacgggtaataggcctggcaatagggatgagcagatacatggggtatcatggagagcgaccggagagtggcatcgtagataaggtagtaattgtcacgagcgaaggagtaagacacggcgaggatgatgaggttcttgtccgcgatctcgacgtagccggtgacacacgaggcgtgtacgatcccgtgaagatccatcttcaggcagccagtttgttccgtgagctcctcctctatgatggagcggatgaccccgtcgtttgcagtgatggccaactctgattgatccaggcccgcgtcgccgtcggcgaggcgcacatatagcttcagacactccgccatcaattggccatacttcttcccggctccgtagttcttgttcgtaaaatcgacgaccttccacccttttgctgttggaccgatgcaaaatctgtagtccgacacgtttggatccagcaggacccaggaaggccatggcgatgacggaggcggagaccgagacgccgccatcgccgaggattgcggtagaggaaggaggggggaggggaaggaaggggaaggaggcggagattagatgtgtgcacggtgagatttgatgggggaatacttgagagaaactccctctcttaataaaattggtcgatccggaaaaaaaaaagggactagctacagttatagtgccatattttttaccaaaatatagtcggcatgtgtttatattgtaagtctctaaattatatatataattttagtgtatttataatgtaagtcttaaaattacatatgtaggtcttaaaattacatatgtcaatcccaaaattatatatgtaagtggtgtgcaagtggggtgtaactaccgtgtaaatttatataaatatataatttacaacaacaaccaaagtttaaaaaacataacagtatgcatctatggcagagtgtcagaaccaatcaccgacatgaaaaaaaaagtaaagcctgtgtgctgatgccccgtgagcacgaatcttcataccaatactaaggctcaaaattcgactgcgtttatgggaaaaatctgtcgccataattatagccaatctgaaaaaaaaaacttgagagagatggtgcgattttgcacggtgatacgatcatacgagtagtagaaagaaaagagggctgagtcgttagatttgggttgtcacggatgtccgattagcggacggtggatgtgtgctgtaaataaagaaacacataaacaaaagcggaaaatctatttcgagagcgctctcggtttagctctatagcacgaagcatctcacagccgtctgatcgtgcacgtcgtcatggcgtccatccacgtggatgtctttttcctcttcaaataaagttctctcaaattatttatccgatctacaatccaattacaccattgtgttcgttacaattaaatcttcacaataagatcttacatgattatattacgatgaaaaaatatttatatttgtaaattacttttattatatataaaaaagttacttttagatttgactaaattatttcttagacatataaatgtaaattcaataaagtctaaaagtaatttgcatatattataaaagtaacttaaaacaaaacggaagtaactttgtcacgacattaaaagtaaattatgtcaggattatggataccacatacctaatagtagtcgactacatctcagcaggacccaccacataccatatcttatacggaaacaaccttcggatataggaggagttacgcataaggaaggatgactagagttctacatggaaacgacaaggactactcggattgtatccatattggtttccctagttctacttggataaggggacacctatgggtataaatacaaggcctcctaggaggagaggggaaacagataatcgacacacccaccacaatctacagaacaacagaagccacaacatacaagccaacataggccaagacaagacgccggcagatatcgacttcagggataagcacggttagtcccctatggtgtctctggatactgtcaggagagacgaaagcgctatctctgatctcgccgggcacggattcgaggaggaagactaccctcttgtcgactacgagtcagaacttcagaccgccatgtcgacaacagttagataggctaccccacatattatactggtgtgattatggtgaataaagagcaacaccggctccggccaacaggatgtagggttattacctgacaattcaggggcccgaacctgtataaaaatcctcgtccccatctcttttacctcagtctcgcatatatcctagcaccaacgatcccccatactatgcaaataacagaatcgcgatatcaaacgtcaacaaatttgttgtaaggataaaaaatatgactttatctagaaattaaatttaatcaacacacgtaagtttaacaaattttgaaagtaacttcaatgttaattggaagtaacttttgcatggttcagaagtaactctttataaatatgtttaatcaccgattgcttttttcctttcatttttgtttttcatgtagaatgagaaaagaagataaaacctttaatggattgcagataacattgatggaataactaatgagaattaaccatgtataagaagtaatagttacttcctgataacattgaagttaattttctaacatgtaataaattacttttaaattaataaaatgtttgaatattgttgtgaccttagggcacaaacagagttgggggtaaacgggaaagtgtaaattcccgtttaccctgagagtgagcccaaaagtagatgtcaggatgtatataagatatttttttctctatttcattgtgtctttgctacaggactctggtcggccttttatagtgttcgaccatgaccacaaatatttacatctttgccatcatgggcttacatgaagttaccatattacccctagtgatccatatgccctaggggtataatagtactttgctggtggtccctaggtgacatctggtgccagctggttagagtagttgaagtggtccccatagttatttttctcgaatgagtcaattgctcgataagacttttccttcttttcttgttatttcagctgtcttggtcgcacccgagaactcgaatatactttcccattatcttggcgccttgtcactccataggaacctgctcggatacaactattaagaaaaataatgtcaggtggatgatgttggctcgaatacatctgtctacttgacattaactcgaatttacttttcctcataacgctgtttcctttgggtaacaacatgtcctaaaagaacttttctataaagaggagaacttcattcgagtttttatattttaggggaaactctctgagtattttatctttaagtagactttttgggcgaaatgtgtttttggccaaacttggggggcaaagtttaccccttgctacaacaaatatattcaatatgaatctcgttttgtcacatattttggtgtggagtacaatgatgtaaatagatcttaaaaataatacgtgatttaaaatatataatttattaaagagattaaaaaaagatacatactattgcattttttaagttaaaaggagacactagatggagtacaaaccagctaccactagctgtgtacaaaccagctaccactagctgtgtagtcacgtccacaatgaaaaaaggcatgcattaaagttactttcttttttataagttacttctataaattactattaggctttattgaatttactattatatgtctaaaaagtaatttataatttttcatcaaaatataatcatgtgagatcttgttataaagatttaattattacggacacaacagtgtaataagatgaatagtctaagagaaaattttatttaaagtatatatggatagagtctctcgtaataaatagagtggtagtttggttagtcaaaccagctccaaacaaaagcctcccttaatctgctacggagtacacggtagaccgagtagtcccgccgatacacaaagtgcaaaaccgctatattcggttcgcagccttattttgacaaattgaccctttacgaaaaattattttaagattggtctatgctaaaaactaattgaaaaatgagccgtcggctcagcgccattgagattggcactgatatataacgttttagcgccggtaacgttggcgctgagatcctagatgagctggtagcaaattcgaacgtggcagagggtcagcggcagaaccacgtaccggataagaaggaagcaacaatctgtaatatatgatgcaagtgtagcctagtggtgagagatgtgctggcatgcaagacttctcgggttagatcccctgcaatgcaaatttttttctttattttttttccttggtctgttctctttctgctttcgtgaactagcaaacagctgagagaataatcaatgtcacatttattttgttttaaaaagccaaccgagtgaatagaaaagaaggtaaaaaatcatttatttttttaaaagcatttatttatttattttttcttggtatatgttctctttctgccttcttgagagaataaaaaagatgagagaatttaaaaagccaactgagaataaaaataatagataaaaaatcatttgttttttaaaagcaaacaacagaggaaaaaaataaagaaaatgggttctgccttcttgagagaataaaaaagatgagagaatttaaaaagccaactgagagaataaaaataatagataaaaaatcatttgttttttaaaagcaaacaacagaggaaaaaaaataaagaaaatgggttctacatggtgacggcgggaatcgaacacaagaccatgcacacaccaggcaagcaaccaaaccattgcaccactatcacacttccaactatgatgcaaaaggaatattcttaatgtagtacgtggggtcagcgccaacagctttaacgctgaccctctgccacgtggaatttgctgacagcttagctaggattttagcgccaacgttgcaggcgctaagacgttatatatcagcgccaatctcaatggcgctgagccgacggcttatttttgcaattagtttttagcatggaccaatcttaaaataagttttcttaaagggtcaatttgtcaaaattacagatattcgcaatcagagacgcgcaagatcacgtatgtttccttttcccggcccgctgtggattccgatctctttccctttcgggctatccataaattggcatgggggcttgacccgttcggggagcatcgacaacgttttgggcttcggcctgtttcttttttgaataagttcatatgatatttcttaacttgtcgacgaatccgatttgcgtcattcaaccgaaaaaccagatacaacgtcaactgtcaaaaccggtgcaatataagtattgtcagggttacgggtcagacatatcctctaccccacgatatacgtcacatatcgacaaggcatatccacgtgtacacggataaatcctttagcacataaggaaactcttcgtaaagacaacagacaaggagagaccttctcggacaagaattgggttgcctacgtatcgtactaggtctggtatattcgagtcctactcggatagtgcccaacctacggtataaaagggaccccccggggagggcatagatgatcgaatctcagagccaacacaacctacatagcctacgaagtcggagtctgcaaggggccaagtcaacgagagctagtcgaatcgtctcgactacaatctcgccgaatccctcgagttccgtcttttcctgtgtaatccgtgttttccaccatataatcccatatcaactggattagggctattacctatcaaggggcctgaactagtataattcttgtcttttgattgctcgatgtcgtactacgtagatccttataccagcgtaccccaataccctctatatccggtctacgggtatcccccgtcgacaagtatcatggtggtttaaacagtggtgttagctgaagtggcgtctacgtggctaatttgaagggaatgaaggaggagccagcctggcgcggtgcgctcgtaaggaaggagatcggcttaggggaggagcagaaaaactaattttctcaaggacccacttttcattatgcgggcattgagatgttttgtgtaaaattccttaaaatatcgtaggacctatgagagtttagtttgttactgcctctgttttttaataaatggtaccgttggctttttaatacgtttgaccattcattttatccaaaaaatttacgcaattataatttgtctggtcgtgagttattttatcactcatagtactttaagcattatttatattctaaacatttgcataaaaattttgaatagacgaatgatcaaacatgtgcttaaaggtaaatgacgtcatctattaaaagcaaagggagtaccattttcatttctatccgatcatggtatatttggcattaacaatatttggttgtagtttatgcatttagttcgaaaacttattaaactttgatcgtgtttttaatattgcaagttttcaaaattactaaattaattttgatagggtagaatttgcattattatgtttggtttattaccctgttacatttaccattgctaaattttgttacggttcaaagtggccacgagctaacactactatagaaagtgttattggtgccgatcgggaaaccccattgaggtctgttttcctaacgggcaccattaaaacagcacagatgactcgagtaattggtgtcggtttcacaactagcatctttaaggcgcacgcgaggaaaaaaaaaacacacaaatcggctcgatgcattggcttgaacgaaaccaatgcatcaagttgctccccattgccccaaatcaaagtcaaatccccgaatcaaaattaaattgccaccaagatcgattgacatcagagaataaatatacccaacaacaaaaaataaatccacaaatccgacgccaccttggtgccaccactaacgaatccggtgcaagaggctggggagaggtcagccgctggctatcgagcttctccgccgccgcatgctccaccttctgcttcctcaccaccgcccgtcggtccatgtcacgttcagaaatttaacccaaatttccagactattttgtgtattaaatctctatctatgaatcagccagggtacacaaaacgataaattaatatacagatctaaacgtaaataaagcgtaaatacttacaaaagaggcacttcgtcctcacaccgaaaagaaagcagcagcagcggaaaaatagcgatcctaacggggcttcagctccactccacatgcaaaatttaactggggtctgagccttggtcctctaacttcgtcttcgactcagaagcactgcacttctgaaaaggaaaaaaatagcaagactgagtacaaccaccgtactcagcaagccacaccaccgatgcattcgtgcaacgggagacaaagggaggtttgtggctatttgcataaaggcagttgcaaagcatttgtagttttaaaaacagtaaaatagttggttaattaagacaatatttaatctccactggtcaacgctacaccacgttaaacaggcccaaccatcccacctgaactaaccagccaatttattaagggtgagactaatctcggtgaatctagtcgatcgcccataaccgcgggcacggctattcgaatagtttcaccttggccagaggtgcataactatatccacaagacacaatccactggcatgttacattgcccggccggacacgtcaccatgtcgagtgattgtgacaagacccttcgcataaccctcccctaaccatccacactatgctgaggtttcacctccaccccctacaccgggagtggacaacggacaccctggccgacccaactccatcacgcccaccctcgctaccagtgcctaggaaagagtcgagctatactacaagtcaagcagttatctattcccacttgtggtaaacgttgtaagtctttcaggtttcccgtgaaccggttcttaattgctatgggtgcgactaacaaaacaatgcacccacagcccaccattaagtcgcattttaattggatagttacgactaatgaaacatggtcggatgtctcgagcacgcagctcgtcgctttactcctacttctatattccaatataagctagttaccacgtagatttggatgtgttcagcaaacagacatttcaacttcctataacttaaaaactacatattttttacccacaaatatctttgtgagaaagcatgcgtgttatactgtaggtccatgctttcaggaatttcacatcatttttaggcctttctgaggatattatgtgtgatttgcaggtccagagatgcctcctgacaaattcatgtatgctcaaactaacgtttctgcatgtaggctgtagcggtttcagcagctatttctgcaggttcaatgtgaagaaaaattctagcgttcaaaatatagtcctaacaaaaagaaaaattgtagcattctgcagcgtgtgaaagaaagagagattgtttcgttttccgagcgcacactttccgaactactaaatggtgttttttttgcaaaaagtttctacaggaaaattgctttaaaaaatcatattaatctatttttaaagtttaaaataattaatattcaatcctatagttgatccccactaaggactattaatgctatttttctgcaatttggtgcctccacgtcatctcagttattttggatcgttggatgtcatttgtgaggcaagatatcagcgcttgtagcctccaacgctggcagctggcttacgggaactgtctatggccaccacgtaggctgcctgttcacttccccatcaactccacgctcctgcatgccgcattagtccggaaaggctaaggggcgatcgatcgctaccagctatcgccagcgatcgcccctaaaaccccctccctcaacttttctttttcggtaccgtattacttttctattttagtaattttatgcacctaaagtttatacaccttaaatttacacatataaaatttagagacctaaattttataagtcaaatgtttatatatccgattcaaatttaaatttgaattcacctcaaatttacacatataaagtttagagacctaaagtttataagtcaaaagtttatatatccgattcaaatttgaatttgaattcaaatattttttatagatagtatttatatacatctaaagtttatacacctaaagtctattgaccccaagtttataagtcaaaagtttatatactcgtttcaaatttgaatttgaattatatccaattcaaatttgaatttgaattcaaatatttttctttatatagtatttctatacatctaaagtttatacacctaaagtttatatatccaaagtttataagtcaaaattttacatacccgatttaaatttgaatttgaatttgtttttttctttcaaactaattttttgattttgttatcaaaaccaatctaaacacacacgtgcacaggaagaagaaactaactacaccaatctaaacagattaagccgttgcacatgagaatgtaaactgatcgtgcacggtgatcctacgcgatcacccgtgaattaggcggccccgcattagtcggacactcgggcctctggttcggctttttccacttcccccatcggcgtggaggttcctcaaaactactactcccttcatttcttttgttgtacgacgccgttgactttttaaccaacgtttgaccactcattttattcaaaaattttatgtaaatataaaaatacttatatacgccgttgactttttaaccaacgtttgaccactcattttattcaaaaattttatgtaaatataaaaatacttatatcatgcttaaagaacatttgatgataaatcaaatcacaataacataaattataaatatataaattttttaaataagacgaaaggtcaaacgtttgtataaaagtcaacggcgtcatatattaaaataccgagggagtatctgttagcctcccacagtcccaccgccattgaagacctccaacttcatgccatcaaggctttaatcctctactacacatgtaactgatgcatgttaggtttaaatagccttcactatattggggcttattccgctccatataaatagatgttatgtggggaatcggctatcagcggaagcgcgcgcagaagcagcgtgagtcggacgcagcgccgggattagcgtgaggccggcgtgcgtggataaagataagcttgcacttaattaggatttggctgttagagcaagtttaatagtatagtcaactaccagctctaatttatttatagccaatctagtagctcattcatacaatagttacatactacactattaatacctggtcccacctgtcatacacatactgcgtcttgaagtccgtgctacagctggctacaaatctgtagcccgctgcttttctctcttcttatttatctacttaaaatatgtttgcagctggcttatagcctgctattgtacctgctcttactaggatttggttgttatcttttagggcccctttgaatcgcagggtagaaaaaacggtggaatagaaaaaacacaggattctgataggaattgaagtgtaaaacagaggattgcaaaacacaggaaaaacacaggaatgatcgtttgattggagcgcaggaaaaacgtaggaatcggatgagagagatagactcaaaggaaattttccaagaggttggagctcttgctaaatttcctctaaaatccacatgcaatgtgccattccataagaacttcataggatttggaaagcttaatcctttgaatcaaagggccaaataggaaaatttcctataagtttttaaacctacgaaatttctatataaatcctttgattcaaagtggcccttagttttggagagttcgttacaattgtaagcctctaagatgaataaagcaagcaatcttcagtgtcattctcgatctgttacacaactccggcacggggcagcgaggttaacaacctcgccttcccgtcgaccccccttgtgttctcgtttgattctaatctgttcttagccacaacaatagccatcctataaggcatcgtttcgtcgtaggctcggagctccctagatgttcacagtccttccccttgctgtttaactgtttgccaccaataccccaacattatttgattggcactttgatattttccttttagcttaggcaaaggtctttccactaattttaatttcatctcttggttttggcaggtgtgatattcacatcttctgtagaataagtggatgggatttgttgatccagcatctacgaattaccgctagctggttgtgtaagttttgttgtatccctgtctttttaatcaggtaatcatctcatgttggtataatatactaccaattattgagctttgttcctgcagatttaattaggtattactttaatacaaaaatatttatcaatatggtcttacatgcccaacatcagatcgaaagctctgaagaattaaacctacatcctacaacgtcagctccaatgttcatcttgaaatcaaactgactagatttttccctcagggccgtgagtactttcagttttttttttctatagagttgcagtgaacacactcaaggagcactactccgtggaaagtactgttaaactactccgtggaaagtactgtcaatcatttaacagctatgatctgaagactttctttaatttgtactttttgttctctccactgcttgagccttgagaggtaattattgttttagcaggcaaatgcaaaaaaatccccctactagttaatactagttaataatacactaatggctcacctcgttttatacactaatggctcacctcgttttacgtatcttctgtttcgcgtatcttctcaatcatctctcggctgcttgggcaagcagcagcctatatgcccttcgtaaatatccacagaacactgccaattcatcatacatgctcccacagaagtgctatataatggatcaagatggttgggaattcaattgcatcaaattgaccgaaattatgacgcagataagagtataacactacaccatccacagagaagcactaggaattgatatatgtatcagcaagcatcaagcacgtcaaactgaaagcactatagaatgagcatgagccatccccaaagaaggtatgcgagtttttgcaaaagcagttcacccaagataaattcaaattacttcagtgcatacataaggttgtgagatcgacaagcaaaaacatactggtaccaataaacagaagtattaaagaacccagcttgtgaacatcgaatgatggaattcagagtccgatctccctaatcagcatttgatctccctaatttgcctggcaaaacaaatctagctggctcccggaccacaccatttgcttccgtgatatctctctctgcatgctttcatcaacttcctccaatgctgggcaagaaaacagtagacaagtcagatggatgacaatgctattgccatagcatatttgctacagtagcaaacaatacaatgggtaatagtagtaattcacaacatcagcatgtataaaatataagaaaacagtacacaagtcaggtgaatgacaatgctagtgccataacatgtttggtacagttgcaaacaagccaatgagtaataagtgtagtaattcacaacatcagcatgtataaaatgtgcaatcaaattaagatgttaccaatttcagcatgtatgaactggaaattcaaaagcagctgtgtgtataatcacaaaactgattacctgactccatctcgacccaggattgcactttgcccgcatccatcttcctattgtcaggaacaaggcgctgactatcaaggtgtctgaagaattcacagcccaacaaaccagaaggaacaatcttatctgggcgccaggaaagagggttggacacaagcttcttgcttgtcatgttgaatcggcagacgtggtgcaccgcagggtcctcccaccgcatgattggcctggacagtatgaagtaaaggtctccaccatcgccttcctccatgctcagcagggggtacactggctcggtctccggtaatccatccttcttgaagtcatccagttcccacagagttccgaagcgcagctcctcgcccttggtccactgcaaggtacccatgtccagtgtccactccgtcaccgtcttgtcgtcctccggcacagaatcatcgaaggagatggagacaaacttgatcaagtccccagtgctgcagcccatggttcggaacatctccgctggcccagtatcggagtcatcaagggcgtcagacttgcacccagggggcaactcaatgaagtcaaaatggacgaagaagctgtccaagaggtccttgatgcggcagcacaggacgcccttggtgagatcagcccagaaagcatggctactggatgtgaacttgacgtggtggcagaaggacgctggcgtctccttcgagaagcgcggtttcctggtgtgccacggttcaccggagggattcgggtacatcttctctcgcggcggcggtggcggcggtggcagcaacgttggaggcgacgacgactttggaggcgtccacaggtagagcaagtcaatgcaggtggatcgtccttctctcttgtagggatagttcttggcaaagaggactagggcgtactcatcaccgtaccgcacagggagagggttcgacggtaagtagatatcgcagcaccaattcgggatggggatcatggacatggatgcgtgaatggcatcatagaggaggtagtgcttgctagatgtgaagacgaaggacagggagaggaccatgaggttcttgtctgcgacctcgaccgcgggcagtgacacctgagatctcatcgatcttgtcgaactcgatggcgcgaatcgccagatccggcaccatgaggccggggatgaagattcggcggccttggaagctttcttcttcttgagttcttccgccacgatgttgcggatgatattcttgtcggcgcagatggccaaccgagagagagccgggtgctcctcggcgaggcgcacatagagcttcacgctctccgccaacaaggggccgtacctcccgcacccttggtacctcttcttcttcaagtcgatagacgcccacccttgttctgttggaccgatggagaacacgtagtcgggcacacctggatccagcaggacgcaccgagacgccggcgacgccatccctagggtttcggtggaaggggagaggaggagaaaaaggggaccggtaagattttgatgggagaagaagaagattttgattcggaagcggtggagccgaggcaaacccgatccgactatagtacgagcaaagaggaacgagcgttgaatcgttagatttgaggtgtcgcggatcgtgagattggtggacggttggatgtgttgcctaaacaaacacataaggcgacatccccctgaacttggtgcacggtagaccgcgtagcctatctgggaacgcgcgccatctattttttttctttttcttttttaatataaaaaagtgcccgtaacattttaacgggaagaaaattgaggaaaagtcgaaatatttacattctggaattaatggaaatacaaattttatcatctttatataacgctacatatgatatcataattgcacatatatacgatgttgaagaaaaaaaggcacataaaaattaaggtgaattctaggctgacctggcttggctatatgataggtctaacatcaccgtactatctgtcgaattgcaaacaccagcacgaacgattagaactgcatgtaatgttacatcgtagttgcatatcctctctaaaaactgatgacatcattgaatattgggaacatgttttcatcaagtcatttttattgaggccccgtttggtagggctccaaactccaactcctaacactaaacttcaacttcagtgagagctagctcctattagagttgtgccatgattatggatacaacacctaatagtagttgactaaactcggcaggacccaccatatacaatgtcttatacagaaacaaacctcgtatatagaaggagttccggataaggaaggataaataaagttctatatggaaacaacaaggactactcggattatatccatatttatctccctaatattatttggacaagggggcatctatgggtataaatacaagcccccctaagaggagaggggatagtcacaaagccacaagccaacacacgtcccccctaagacgacggttagatatattatcacaattattgtagatatattatcacaattattgtactttgtggtttctatatcaatcccatataaacaggatgtagggctattacctgtcagataaggggcctaaacatgtataaaaatcattgtctctgtctcttttacctcaatctcgtatataccctggaaccgacgatcccataccatacaaataccgtagtcgcggtaccacccgttgacaagttggaaactcgttaaaagtgttcggctaactttcagctctagatccgaaaaaaattgaaaaaataaagaaaccaagccaccttggccccagccgcgcatcgtctccaccgcgccgcgcatgctgcccgttgccatcccgccgcgctggccgtctttgtcccggccgcgcaccgcccgtcgttgtctgtcgtcgcccgtcgccaccccgaccgcgcgccgccggtcgtcgtcccgccgccccacccattgacgtcccgtcccgccgcgccggtcatcgtcgtcccgtcccgctgcggccgcccttcgtcgtcccgtcccgccgacactgaatcgggattaggaggaagatgtggaggagagagaacaggaggaaaggaagatgggggtatttgagtggcattttcacgtaaatacactaaaaagttactacctccgtcctaaaatatagcaatttgtagctctgaatctggacacgtgttttggggtagtaggtcttttggggtggagtggagctatggagcagcaaaaacccagctccaccccgtagttcattttctaggagtagctttgccaactccactcaaaaaatggaggatctggaccgtttggcacagctccggcttcaggtaagttaaagttgggagctagaactgtgccaaacgaagcctgaattgatcttattgaactctattttgatgagcggtgacaacagaaatttgaatgatgcacaattcttgtgatctgtgagggacatacacatgcataagtatcatcttaatccaaattgagaatgggatgagctcttataccttgattttccttttagggatttataaattacgtctagaatttataataaagttcaattaatttaccagtgaagtgaatgtgagaaataaaagttcccaaataaaatatggctgaatttagtttttattaaagtctccatgattaattacactatatgattatttttcagaatattcatagctcaattgacaagtttagtaatacaaatatctttttagcatttatctctatctctatattatatatatctctatctctactattataaaaattgaaggtgtttttgccgatactttggtacgtcatctgtatataagtcggtttttaagttcgttcgcttttagaaatacatatccgtgtttgattcgggttttaagttcgttagcttttgaaaatacaaaagaagttgtataaaaaatctctttaaaaaaacttgcatgcaaacttgagatgatcgaactcctaattgcaactcatgattttatggaaaaaaaatatccaagcgaattcccacaacgaattccaccttaactgaaccgtataataatagtaagattgaaataaccttcacccgttgcaacgcacgggtattttttctagtactattataaaaatttaatatgtttttgccggtactttagtataccatctgtgtttgagtcgatttttaaattttatagttgggtgcccgtgcgttgcaatggggaaaatgtgcatcatttgaaatatacaatctatgtcatatataaatatgcacaaatcaatgaggaatcgtttccttgatctgaacaaaacgaaattgtaacgaatctgattcatttgccaagttattatgctatatattaagaagtaaaacatgtagatcgttagattcagcaaagagaaatatggacatgtgcacccacgtcaattctatgcttctttatatgaacaacatggtttaatcacattccgtagcacacaaagaaaaatagtacgtatgcagatcaaaaggattgtgtgaaaaatgagaaaaggagaggctacagaacatgggtacttagaattaactgacgaagcatgaatttgcgatattttcaaaccatgccaaaatgttacgatgcatttcttcaatcaccaaatctgcatacagagctagaatgagcatctctgaacaaatataattttcatcaaggaaattcgagttcaacaatcagataattctaattacaaactaagagagacaacaaagaatgatttctatatcagtctatctttctggtcaatggtagcccgacacatactcgtctcaaacacgataaaatgcccaaacatagataaaataatgaaaacaaatccatttagttgttctcatgcccaaggtgcatgcaaagttttatatgggcatggtatcttaaataaagcttttaagggggttattgaccaaatgaaaggactactgaacattaaaagcttgcacgggttaaaagcttaaaaggaacctcaaataaagcttaaaaggacaacattaggtacctcaaatgatgtgtaccgtcagaacatttaaaacaaacttgcttgggttcaaaaccttaagctgcttttcatctggcaaaataactggaatattcataaatgaacagcaacaaactgaatttcacaatcttagaggacacaaataatgaaggcgtaaagtattcagttaaaaatatattgtgctgaaaggttgaagtattcttttttcagagcaatacatgcttaaaacatgacaattcaagagcaaatggcgtcctatttactttatatggtttaaacggtgatagtggccttaattaaagtatgcagaaatcatcggctctcaaaagtattactgattttgactgtaacttaatcctagttcctgcaccaatcagtcgtttcagtcatcccatagagaatgcatttggttctaatttaagcagttactgattcagtttgaatgagctgaacaatctactacagattctggtgcataaattatgtaagtgtgcacgtggaacccacgtcaataataagataaaacagagaataagcccataatattttcacgtctctaataagatgaaacagaaaataagctcctatataacaatttaatgattccatgcctctaatacgataaaacagataataagctcccatacaataatttagtgaccatacaatactttgtatagataatctttctgataggaagagcattgctacagaccaaaggatgaactgccccgaaagggcatagcatgagtacaacagacccattatatataacgttaaataacaaatacataaatgaccgtcttcccattttactgccaaatgatgccttcgaaggctcatagatgaaggaagggttatattggcctcagtcctcagaagtacttttccatgaacccgagttaaatataatagaggtgaccaacatcagttaaaagaaacacatgtagtagagagaataaactttatgcaatgtaaattatgaagtaatgctcacggaatcagtgtcagctaaaaaaatgtgtggttatgtattaatgtgatctaaattagagttcgtaagtactgcagcctattctctacaacgttaaatggatacggaaattgacggggcaaggcaaaccggcaaagtgttctctcgtactgcattccagataatcaaatgtgcagtggatagtttacagcgatatgcaataatattaacaaccttccttttctatactcattcagcttaattgaaggaaatgattctgccaagatgcattgatagcagtaagatgactgcattggtaaggaagataatatacaggtaaagaaactaaccgtgtgagcatagatgatgcaatttactccatgactgaatcagggattagtgtattttctgctcgcatattgactaaatttcattgagtggaggtcttctctcacatttatagaattcaggtgtggtttatcaccatgaattcccatcagcaattacgctgatcatcagaacttaacatgagacacttaccatgaggaagtatatatataatcaaatccaaaattttatgtctaatgtgagcacctagccagtaaaacaactaccaggatcatgaccaaacagagagacagtatgttaataccataggagaagtcgttgtagtgatgagtgtgcaccacatgtaaatgcagcatcacagatcaataaattgacagacacaacatagatcaacgatatttctatcgcatgttaaaaaattgatatcgcagaaattaatcaagtaaaaacaggacaaacagaagaaactggtcttattttcacagtaggaaagagtacccgggtgatgaaggaacctgacgtcctgaagaagagtgagcttgtgtccagtggcaagatttcacttcagatctacgccgtttgtgagataataatttaaataccatgggtaggtacaggatcaatactcttttttcgctggtagtactctcgcatcttttgaagcctagcttccttgtcgtcagcactaagagcagcataccgctccctagcactcttccgcataaattaaactcaattctcggcagctttgtatataagcgattggagttaaattagtgatgccgccaagtgtacctgcagaaacttgtacagaaatcatttcacaacatagcaacagtacgaagaagcgagacgaaaagggagaaaacagataatgtccacaaatcagatacacatggtagatataccttcaacaggaaagtgtttcttttacttaaaacgaaactgtctaagtgatactttcacatacattttgattacagctcgaacaaagcattacagtgctaaaatcactttgaaaagtgaattggtttctggacatttgctcaacaaatttatgaactttagttgatttgtaacttttctagatgggggatgtctagcaatcgaacgctatataagaaattttgtttaccttttgttgatgggaatgtccctcagtgatggaggggagacgggtgagtactgcatcacccgccgacagcatccagcgacgatcggaggactggcgggcagcttccggtgcggctgatggaggggagacgggtgagtactgcatcacccgccgacagcatccagcgacgatcagaggactggcgggcagcttccggtgcggcgcgaaagggaccgtggtggagatcgacggagaggagcggatccagttgcgagacgtggcgtaggcgacggactgtcggcgtggatgtgggctgcgcacgggggaagcggagtcgacgatggaggccgccgcgggatgagggtggtggtctagtgggaggccgggatgtggggggttgatgcagccggctgacaggatcttacaagattcaacactgatttaagcaggaaaaagggaaacaaatcacaagaacacaagaacacacgatagataggcaactttagtggaattatactccaatccaacaggattgagtccgccgccgccttcgcctccgagttgccagtctcaagacatgtctctgttcttcttagacttgagtacatatactactcctcctctctctcacgtgatacatcgccagctggacagagccaggctgttacaacgacaactgctttacgcaacccattgagagacttgataacgtgggttgggcttgataggccttgacgaccgacgcttggccaccaagtcttgttctcctcctccttgcttcgcgccatcgctctccactggagcttcagcttcttcctcttgctcttcagattcatcaggacggatctcctcttctgtatctttttgtaccgctaccttggcgttgcttggcgtgttcctgacaatccctaccccttgaaagcctgcttgtccccaagcaggaagtccaggaaaccttgtcttcaaatcttcaaggtcttcccaggttgcttgctctggtaatgtattagaccaatgaattagtacctgaggaatagtattattacctttcttagtgatgcgatggtccagtacagtcaaaggatgctgtatagaaggcatgtggggtggcagaaggggctgaacaggggccttgaatcccttggcggcgggtgatggagaggaggacgcggcgacggaccggacggcgtgaccggcgttgggggtagtgtctagggtttcggagtcggccacgaggagtcctccccgcgccagcggtggttcgacggaggcggtggcagcggcgaggcgagcagtggggtagggagctggtggagtacggcggggaggagcgaaggcggcggcggcacgggacggttaggggacggtaatggagccgtcggcgacgcggtggaggaggacggcgatggcggcggggaggatcgaaggcgacggcggcacgggatggttaggggatggcgatggagcggtggatgcggggatgcgggagcgatggagcggtggatgtgggagggatgaggcgaggagctgggtggggatcagtgcgccgttggatttagcgatccgacggttcacattctgcgtgtatgttagggttggagtgaccggcaccactatgaaattttaaaatagtagagaagagttatctctactaaaatttcgttgtctgttaaaaaagaaaaaaaaatccgactcaaaagaggtaaaaaatgaagaaaaaagtccgacaaaaaagcgattaaaaaaaagcttctaccgaaaaaaaatctcgactccgacttccgtaaaaaaaagaaaaaaaagtttcatcagtaaaaaaacaaaaaagaagtccgtttagtccgacttccataaaaaaaaggtctcctcagtaaataaacaaaaacgaagtccgtttggtttctttcgcacgggtattttttccgacttttttgcacgtgaaagagttttttttagcacgcacttaggctcttggttttttcgtccgtattttaatctgatcgtgcctcccgggcgctgttggtttttttcgtcaattttattgtccccggttttttctcccgtgcactttttgggttttctcatgttttttaatccgatctgttcgccgcacgcctcccgagttaaaccctgatgccgcgccgccgccatattgattgtgcgtttatcctccgatttgattgaaaaatcgattccccactcctccgtcattattttctccattattttccctttcgattcggttttaatttgtcggatttaatctccgtttaacggttgccgatgatgacaacaatcttccccggccgtttttatcccgagttttacgctctgattttggaaaaaacggaaggcgatcttccccggtggttccctcaaccaattttggatgatcgagaaagattcgacaagatttgattgggagatttgctccggcaaccatacggccacgagacctagcaaccgtacggacatgggactatcttcgagaggttgaagatggtagtagactgtgcgagttgcgcttacagctacctgtggctgagtcgaagggaagcaggcaaaacggagagaggtagcagactggcctagggctaaaatggaaggaacactatcggccctaaactcaggaaagattttcattaactttttcaattataatgtatgtagcgatcccaatattttaatatattgctcagctcttaatatatcagtgaaaaaacgcctttacccgttgcaacacacatacacttttctagttcaaataaaaatctaaataaacccctcctttctctctgggccatttttagcccacttctttccttagcccgcaacctagccggcccgcaagtgcgaatcaggattcagactcatcaagcgaccgcaagtctaataaccctccccctgttcctccctcactatggcctgggtcccaacgctacagtgtcatctcctacctccggtcggactcccgcatctgcccgactgtttgaagccacctcctccgtgaagtccgactatattgttggtgataatccaaaagtgattgagggtttcgattcttatcttctcctctttccgtttttctaagaattggatcaaaccacatcctatctgagttaggaatcaagtcagctaacactggatttttctggctcagaatccgttttcgcttaaacaaaaatcgcgatggacgaaaggtcagtgtttttttatttttttttccagctttgttcgccactttttttttcaagtacgaatcgaacgttttgtcttgcttttctttcgctttttttacggggtgatttttttcgcgtgaatttttcgcccatcgcataaatgaaagggacgcgcgctggggcgccacacgtcggattgcagagtttttagctgtgtgccattaagaaattgttgacagaaaacacgaggcctgggagatttgcttaactccactgcaggtccaaaacccgccttcggatgtgtgaccgtgccagttgatttgatcctacaatcaaccagaaacgaatacaaagaaacgcgattaaatccataaatgatagtcgatcagctaggtgccgatgacatatcatttattttaggccgatgtcatgtgtacatcgatcggcagtcgtgaataattaaggaagaactaaatctactcgatcggctgtagatattaacaatatataactcttatgtcgatatatacttaaatcaagtgattgtgatagatcggtcgctatgccgagacagtataaatcacttagatcgaaatataaattaacaacagaactatatacgtttatagcatagccgatcagatagatctagcgtgcattggctaataatctgataccactctatattaagatattaaagcaagtagaatatatcaaacagaagcataatatacttaaatgcaacaagatcttaacataaagggcagatttcacatgtcaatcaagcatataagataactatagttaaatcagttaagatcggctgaaaccccgatgctacactaatcggcaaccaagaagcaggctagagactgatattctaagcacgacttaatatatcaaactcaactgatgcagcattaagtatgaaaagaagaacaatatctagacaatcaagccgctggatgtttcatagagtggtagatatcttatacaatccaagctaacgtcgctatttaacctaatcggttgccttctactaacagatgttagccgattgtaggttagatgacgatattaccgaagattatacaagatatatgataacttgacgaattacataaacaagattaaagtatcataaagatggaagtactaatcctgagaacacaagccgccataacaagttttacctcttgttgatgattgaaaccgatgcagctcaacccgaaagcaagaactcgtcgaaataaaactaaagcaaaaagggtggcgatgcgccgaaattgtattgaacgtgtgtcttttttttacatagggctcagggtctatttatacccgagaattacaagatatgtccataccggacacgactattatctctaacaaactctaagataccataagtctttgcggcagacttttgcccaaacatatctctaaggaaattacataaaatatcctaattaatagatacaattgccttctcaggactctatccatgcgtggcaatcatcttgaagcatatcaactcaacccgatgatgtacaccgagtcgtattcttggaatcggctgtatcggctagccctgtctgactcgaactttgccgatcctgaccgtagccgattcggattgcagccgattcttgctctgtttccgcaacgatcttcgtcttcgattccgcttcgatctaatcttcttttccgatgctgatattatcaaatttggtcgttaacagaaatatagtgcctgcctttgtgccaccaaaaagttcgagccttcctatatgccatcgttgagaggccatgtttccttctatgccaccaagccaccgccaccgctcctcctcaccgagacgccgtcgtcgccgctcctcctcaacgaaccgccgccgcaccaagcagcgccggccggcccacggcaaccgatgtcatcactcatcaagcaagaacgcgcacggagcgacgccgccacgacatcatcttcctccccgtcgatctggaccacgccaagtcgagccgccgcgctaccatcgtcgtctcatcaccacgtctcatcaccacgaccaaacccctcaagaacccccaagattgatgcaccatggacggagaacggcatcatattctccaactccgtccgccggcgtcaaacttcgattccgcctcctccggtgagccattgtccaattctggttcattcacaggttagaaatggaacagattagtaatccagcaaacgaagaggccatcgttcattcgcaggctagaaatggaacatattagcaatcaaagaaacgaagaggcgagagcgaaaaggagctttactagggccattctcctcgctagagtcgaagagcagctggaggccgaggcagatgccgaggaaggggcagtccctacggatgtactcgcggagcgcgttggccatcccggagcgggtgaggacgtccatggcagagctgaaggcgccggaccctgggaagacgaggcggtcggcggcgaggatgtcctccgggctacgcacgtcacagatgctgaagccaaggtggcggatggcgttccgcacgctgcgcacgttgcccgcgccgtagtccagcagcgtcacggctgtcgcatcgaaccgacggcgaagcggaggaaaagcaaagcaaacgcggcggtgaggccatgggtgaagtgaaacgccttcgagctccggagttgaaacgccttcgtcgccggacgcgcgcacggcgagcatcgagggaccgcgaagctggctcctccgcttcggccgaccaacggagcaggggggcggcgtggatggaggtggcggtggccgtcgctccctgcggcggcggccttgtcgccggcctcgccgcgccaccccgcccctcctggtcgccccgccgcgccgtcgagcaccgcctcggctggccgcctggctgccttggcaccgcgccggtcgcctgcctcagcaccgcgcctgaccgcttgtccgcgcgcgccgcctgacctctgtctcaaacgacgcagagactgaaagggcaagatgcacatttttcctgcacgggcccacatgccagagctgttaaacggttaaaccttaacaaaatagcgacggaatggtgtgaagggcacgataaagttcaacgatgtcatgagagaggctcgaacttttttttttacacgaggctcaaactttttagtggtatagaggcaggcaccatctttaatggaacacaggtaaaaacctccggattgcaatagtgtgcggggcgaaaattttgcaaaaaagcccttcgcgtttctgtaattggatataggcctctcacatttgaggggaaaaagtagcgaatagggacttcgttgtgatatgtggaagatgaggggctttttcgcaaaaaaaaagcccactatcgcggacgagtctacagctcaggcgcccgattggtttgcagaaaaatcggtcagcgtccgatttacgtgcaaaactactttaaactgatttttctcttaaattacttatccaaatcatgatccgattgcaccattaaattcgttgcaattaaatcttcaaaacaaaaccacacatggatatattccgacgaatttttttagcttattatcgaattatttttaaatgttgcacgatgttccaccaggtatatcggaattgtttcactaagtagatcgaaaatgtttcactcgtttaaatcaggtgttgtttctccttatataaaaacaatgtttcagcaaatagcgaaagaatatttcagttcactgcaacatttgatccatacatagtgaaacattataagtacactaggtgaaatatttttcggtggaacaaaaaataaacaaaattcccttaatagggggtttccaaaatatgcgagtttttttttgcaatggagtatttcagttcactgcaatattagatctatagatagtgaaacattatgattacactaggtgaaatatttttggtggaataaaaaataaaccaaattcctttaatatagggttttcaaaatatgtgggtgatttgttgcaatgaagttgtatgtgtggataaatgacaggtgaggacagggatacgtgagggggcgaggggcgcacttgatgggagagggtggagcgaccgattttttttgagaaaatttgatccatagcacaggaaaaaacccggtaccaaaaaatagcacaacaaattttccacttcggccagaagcacagggcaccagttttcttgcgattcatagcactcccgtcacatttgccatccaaacatgtgagttgatatgaaaaaagactcatttgcccttcttccccacgcaagagggcaatggagctcagaccgacggctccctcacgctccccccgcgtcgcccacgcgcaggccacacggtgggcgaaccccgccgtcgccgtcgccgccgccccccactcccctccccccttcctcgccaccgccggagctcaccaccggcaaagccgatggcggcggcggggccttctcccggcgtcggtgagtggtggcagcgaggtatcccggctaggcggcggtagatccggcgccgccgtcgccggatctagcaaggccctccgactttggcggtggagggggccgctgagtcgcgaggcgacggtgactccagcgcgcgcgggcggcggagggcagtgctagggctgacacgttgaggcgtcggggccagctggggtctccaccgtcggctccggtggacggcgaggcacgtttgggccagccggggtctccaccgtcggcttctccgccagccaccgaatccccttcgtccacgctcccaacatcgccaccagctccgtctccgcccatcgggtcattggcctcggcatcacctctaacgacgacgacggcctcacgggtggctcgaccgcgtgcggctgcgaagcaaggcgacttggttgacggcggcggcggtggcggcgactgcttgcgaggtgcggcgaggcgacgacggcgatggctggagggtggttcgaccgtgcgcggttggtccatgcgatggctgcgaggcacagtgaggcgacaacggcggctccttgctcgaccgcgcatggcgtagctgctccgcacagggcctgacgcgacgagatgacatggtcgaagggtaaattagtccgaggatatttctttctactccaaactaacaccgttatcttaaaatataacggaagtgctatgtatcgaaggaaaattggtcctccgtgcttctggtcgaagtgaaaaatttgttgtgctattttttggtaattttttttcggtcccccgttgagcattctcgcactatcgcgaataggggcttcgttgtaattggatataggcccctctcccgcgccgcctccgcctccccctcgccccgtccccgtcgccgagcgccgccgccgccccctcaaaccctagccgccgccacccgttcgctctccctctgtcgcgccgccgcctccgcctccccctcgcgccgtcctcgtcgccgagtgccgccaccaccccctcgcgcctttgccacctcctccgctgccgccatcgccggtcactcttccacctgcacgcccgccggtccccaccccgacgacatcgacctccacgcccaccggccgcccaaccccgacgaactcgtctcctgcgtccctcaagcccgcaccggcggcgctcgcctcggtggcacagggggaggaggacgacgaagagaagacggaggtggatgacggcggtggcggcggcggctgcgcgcggacgccggatttggggtgcccctactactacgctccaccgaagacggtgacgacgacgccgccgccgcctcctcctgcggcgtcggcggttggagggtgggatttctttaacccgttttacggggcgcccctctgccgccatcgccgccgccgtgtccacctccgccgtcgtctcggagcgccgttgccgtcggcgaggcgagcagccatctccgccgctgcctccccctccccctcgtgcgccgctgccgtctcatcgccgtcttcgagcgcctccgcctcagggccggcccagcagtgcggccgcactaggccctcaaactcacaggtcccccacctagctccgtaagaatcgtaaagagcgatgccagagccgcttattccaaaacgcgatacgtctgagattgccgccgtgatgagtatgcgatgcgaggcatgtagcgattccatctgttttcgtttcttctaatggaaattgggagatgacttctttcctttcaaaaagaagagtagcgatcccatttatgccattgactgtcgactgtcgggctcgattctagcgccagccaccgtccccggccagccgctccacgagctgccctgaatcgggactgctagagtgcagctgtgcaagaaacgggctcactaccaatctgctcatctgcatatgacatagggggtaagcagcagcaatacagtgttgtcatcgttgccaattgcttctgttgttagtaactgacatctttggcttcatcagctctctatttcttgttcagaggttgagcttgcacgaagtggtgttcggcgtgtgttgtcgactaacttaccgtgcccatccatggtctaattaatcaggaatatttcatagctttgtaatttactgccatgttatggactcactaatatattgtttttttaattaccagccgtcctgatatcatgttattgagaaagtttgtatcgggtaaaagaaaatgataaatgagtttatagaataaagtaaggggccaatgtatgaaaaactgttggatgagattgatattgatatcatcaacaatagtttcacatatagaaatatttgaagaaatttttagataattcatgtaaatactaatttgtattcaggttgttttttgccagatgtggtctccatgcggtcggggtgaggtcttgaccaggctgacaggtggagaagcttggcgtgccttgatgagatcttcctcatgtccatcaccctaggccgcaagcggcgccattggcttctttgccaacacagggtctgctccgccaacgttgttgtgtgagttaccttcttcctctctgttttctttatcccttgtcaagcaaccaaaccctgacatgctgacgatatcatgcagcaattgtgtatttgagcatgttgattttgtgtgtgatgtgtaatctgcaagactgcaacagttgatcctatgttgatgacagtaatactatgggagggagggagaaggtaagctaatcaagagcgatcttgtttttttttgggcataatcaggagtgtcatcgaggtgaagcttggcaagctcaagtgcatcaatgatgattgcgcttatattcccaagctgcagctacgagcattggcccattgtcatggatcatcccagcagactgtgtgccaccaagtagtagatgattggctgctacatccagagacgcttgccaaggttgttggacagtgtttctcgcttcgaatctttcacctgattattgctttcagattcttaacatgatttcccaatatttaaatattgacctatctttgaaggtgccacaacgaggaataggccatgaagaagacataattttccccattttgtttgttggctctgtactctcaagaaactagcttccagagtatgatttttttttttgtttcaatattatgtacattgtcttttttttttgtttttttttttttttggggggggggggtgaattgtagtcaattaagacaaatagcaatatgatatgtattttatgagaaatcaatggtgcgttgcttgatctgggagaggcacatctctgttggtaatcaggcaaatccacatgttattctttacttttactgattcaagtagttaatggcttaatgccgacaatgtctcatagttacatcattcgatgatagattatcacatcacctgaaaatccaggctgaaatgactataaactaatttacagaaagtatcaaggattgacctatgtggtggttgcgtatgaacctgtgtgtgcttctattattgatcaacacacaaatgtatatttttccatgaagttacataagcatgtctagctatctttttcaatcgcaaatagtcataaacatcttgttttaaacaataatcagggttgtattatcgcgataggtgcatggaggcctgaggaagttgctcactactaatgtcagaatccacatgaatcatctatgcaggtatagttcattttattgaacaaatacattatttatgtgaaaaccatcttggtgtctagatgtacggttgtttacatgctcttgccataggtcctgtactgcttcgaactgcaaggaactggcagtacaacctgatcttaatggttttcttgtcagtggagcttcattgaaggtaaagaggaatacaaacatattagaataattgtgtagacacaattacctgcctgattcactgaataccgtcttctttcttggttgtgtaccctgaattcatttacattatcaactctagcacggtgatgttttgcctaagatcttcacccttctcacctcggcattgaaaaatgcctgaagaggaacatacctttttccgtttgactttaaagtatgctatgcaactattaatgcttttatttattgtataaaggaaacaccagtgtattggcttgccatatttagtcagtaaactcttgagatgagttatttagcaacattaggaatcatcaatcaatattggcatgaaagcaaccatcat

SEQ ID NO: 43302 - DNA, 2925 bp, Oryza sativa
  unsure (1)..(2925): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgttttcctctcctgttttaattctctccaactttagtcaagcgattggccatgatttttcctcgtttgctgttgtaacatcagtagaccgaaccgacgcttgcacaccttactgctcatcacagtttggttgtaccataatcccttttccacatggtaatccttttctaaatattataattaactcagtactgccctacaaaaaagtgatcaccaaaccatgttactacgctccaaactctcactggcgagtgtgcacaaaagttaaccgaaaccttcaataaaaagcaaattaattttgaagcaattacaacacatcacactctacattattcgcatactgtcaaatcgctggctataactagacgaagcttcatctcgtggtaaagctgctcgcctcgaaatccacaacatcatctccaactcctcctctcgatgatgattaggaacagaacagtccgggtaaacaaaaattatttacagcttaagacagtaattaattacctgagtatttttttactgacttactgtgactgtcgttgtgaggaaacacagatcgatagatcatagatctgaacttttgttccttccttcccagtgggagcccattcttggatgggaccaagaacaaccgtggcacgtgagaaagggagagagatctgcacggccagaacatcaaagtttattattctcactcacccaactcttcaagcagagaataaatcgcagagaatcacaatgattattaacttaacctatgccaaaggaaggtagcgagcgagtgatctatgcctgtccgtgtccctacatgtcacctcttttatgcagataaagtgaagattttcaataattctacgattaaggaccgtcaggttggtgatgccaggatactgcaactgcagcccatagcatctctgaagcctgaaatgagaagattgcagaattttgcaaatgcaactgattctctctgatcaattgaggagttcaaggtagcatgtaggccatcatatgatacaatgcatcatgtcaatccaatcaaatcatccagagtttcaggccagtgaatggccaagaaaagcgttctccagaattgagccaacagtcacctgcaccatcctgcagaaagccataataaaagcgaggaggaaggaacagagaaaaaacggctgtcatctttcagaccggagcatttgtccggtgtgttttcagaattcagacatgaattccggaggtcagaaagcaccagccccccatctgcttaattacttcgtccccaccgttccgatcttttaatttcatggagtcattagcacacttcccaagttgacatgctcgcttctccagccatgtgagctaaagcggtgtggagaagacaacctgacatgtgatctttcacatcttttttttgcaggtgttgttcttcggattaccgggtagtttgtccatgaactgtgttcagtgataaacttcttctggagttctggagattgtgaagtagttgatcctacattcggtgctcgagcaatagcaaattcgttccagctgaaaagtataaactcatgactactgatttctgaatattttgggtattcacctctgaactctgaagatattcagaacactagtgcttatcaggcctgaatttatagtgacaccactggcccatgatggcataaaaccatcatttggatcacactttgattaggccgtgcagccccaaccacaagtccaaaactgaccaagaaaactttgatgccgcatgcctaacaagtagagtgaaaggttttcctttttcttgactgatagaagagtcaaaagtttgtgagcaaaatccttctagtaacccaaatttcagtcagcggtgaacgcgtaattagagcatgagagggggacttaaatgaaccaagtgtccaagtgtgcaatttttaaggggaaaaattacggtagaattcagtaagtggcgatgacgaacggatgaaaaaaaaacatgagaataatatgacatcaataaactaaatatacatattttttcttaaagtttatcgctttaaaagttgtatattttttaacgataaactgtgctaaaattatggacagcaaagagcggtgagtgggagaggatgagcatcctgtccaccactcctaaaaaaccatttcggatcacgattttggcacggaatgccgacaaaatcggaaataagggttgaacagtccattctggtgttgtctgaatcgcgaaacagaaaattccgttcctaaaatcgaagagagacagcttcatcggacggccacggccccaccgccgccgcatcatccaccgtccgttcccgcggttaatcccccgccaaccaaaaagaggaaaaaaaaaagcgccaagccgaatcagctacagggctacagcttgagctaacgcgcgccactccacgctgtcgatgccgtgcatggccatggacgccgccgcggcagcgggcggcgagatgtcgcggcagaaggcgacggcgtcggctccgccgccgccggagctggacatggtggcgcgcgccgtgcagcggctggtggcgcggaacgacgcggtggaggcgctgagcggcggaggggaggcggcggcggggctaggagcaaggatggc

SEQ ID NO: 43303 - DNA, 55174 bp, Oryza sativa
cgcttgcctctccaccccctcgcctcttccgccgccgcctcgcctcgccgcgctcctgccatgccgccgccgtcttggagaagagagagagaatgagagatagaagagatagaagagagagataaactgacaggtggggcccacctattttttaataaataaattgctgactggaccgccagaccaaaaccaccgcggatttgggtcgaggggggtaattcgtccggtttacatagttcagggtgaaaaatgtccggttttgtggttagggggggtaattcagacgactgctatagttcggagggtaattcgtactttttccttatttttttttaatggagtagactttgcaaggcatggaaatgaccgagggttatccatccttttcttgatgctcaatttaatcctttggccatcaggtcagtaggtggttgccctacgtacgtattcttctgatactgacatgcgtatgatcaatacagcttaacgtcatttttcgcgtcagtaatcgatcattagtgctagtaccatgtgtcatcattcgattagtagttagttgcatttattcagcgattagttgcttcttagttagtacttacactgtgacagtaacctagtagttgggaaatcttcttaccacttttatgtacatacactcgttttatgcctgtcactataaaaaattaaaacattttgataagatatatcaactataaacatacaatttaaaattcgacctacatatagaaataaaaaaattataaatatgacaataaaaaattatgtactattagcagtttagatgtgttgtttttctctatttgtatgtcagaactagaattttaatttgaatgtttctagagtgaaatgttatatgttgatatttttttaaaaaaaagagagtgactttttagttgcatgagcgtagttccactcgagtgaggaaaaaaaaacagtttctgaattagtggagtatactgtatacttcagttctgttgggttaattaccattcgcgcgcgtgtgtgcagccaccacaacaacgcgttcttcgcgcgcgtcggcggcgtgagcaacgcggagatgaacaggctggagctggagctcctcgccgtgctggacttcgaggtcatgctcagccaccgcgtctacgagctctaccgcgagcacctcgagaaggaggcgcggagggacggcggcggcggcgacatgctcgccggcgcgtcggccgccgccgccgccaaggcggggagaatggcggccgtctcgccgtccaagctgctggaacgcgcggcggtgaacggcgccgcgcagcacgacgactggaggagcctgggtacggcggcggcggcggaggcggcgaacggcgtgcggcggcacaggtcgtcgtcgtcgtcgcggtattccttcgattgctagtatagccagcgttgccaaagagcgcgttctgtgtgtatatatcaggttatcaacgagagtttttgaggctgtaaaaaaattaaagacggattaattacctgccaaagtgccaattagcaaatgtttgccatacacgaacattactcgttgcctgttcagcaattcagcaatgaaaatgaaaatctggaacaatcgtcgagtcgttgtagagttggttgtttgatggaatttcttttcatgcattaaacaacctaataccggatataacatattctaatattatgaatcatgttgatttttttagaacacggagaaaatatacatgaacacaccaccatcttgtgtaaaacggaaaaagaaactgtttttttccgttctttttccgtgtgtcaatgtgtcgtaaaaacaccatctaataacctcgcagagaaaaaaaccacagtacttcaatagtttgtacagaaaacatgatggatcaggctaagtttgttgaaatcaaggtctcaaagggaaaaaataaagaggaaatcatgtaaagctcataccgaggagtacaaaattagaccaaccatagaagaaaaccaactcatcaaatggccagtttagttccccgccaaaaaaaaattttacacatgtcacatcgaatgtttggacacatgcatagagtattaaatataaataaaaaaacaactaattacacagattgcgtgtaaaatgcgagacgaaacttttaagactaattgcgccatgatttgacaatgtgatgctacaataaacattttctaatgatggattaattaggcttaataaattcgtcttgcggtttatatacggattctttaatttattttgttattagattacgtttaatactttaaatgtgtatccgtatatccgatgtgacacgttcaaattttacgcgtaactaacacacccaaagtcatagttcgagcagttggttggttcaaccatgaagactgtgactgggagtaaaacaaaaaaaaaactgaaagacctattaccaaaaataaagacactcttcaaggacctaactgcaaaataaccgtctcctaccacgccgcaagcaaaaacaacgagcttccctctcctccgccctcattccctccgacatgtcgcagcccgccccctcgtagaagagacggcacaatttacacttcgccccctccaaatcttctcctcctcctcctcctcctcctcgccgacgccgccgcgagcgggcgcgctagggtttcgggccgccgcggcgtcctcctcctcctcctcctcttgttctggtggtcagcgggggcgcgcgtccgatgtcgtcgggggcagcggcgtcggcggcgggggtggaggcgggggccgcggggggcgggaaggacgacgagctggctgatctggtgcggcgcctagtggacgccctcgcccgctactccgatcgcctcccgttcgacctcgatcgccaggtttgccgctcggatctgtgatcccccccgtgtcgcgcgtgtgttttgcggtgttttgataatctctaggttttcctcgctgtttagggatttgtggtggtccgtggtgtaaaggtggcgcgccttgcttgattgtttgtggggaaggctagtcttttttgtttggaactatattttatactgtggccattctactattgtttagttgttattacatacatatgagttcgaagcatcgatttggtaattcgttcttagcagctgtacaagctagaagctgtagtaaatttttaggcgtggattcgcagttcgctaatgatatgtctcccttttgggaaatgtggtcgtatttgggtcattgtgatagttgagattttgatgtatcctttaggttagtaataggctaatagtgctgcgagaaatagttactatgtagaagtgttggttggccagaaagatgcaaacttttatgatggcttgctttatgtgatatcatcgaatgatctacttacctctatagtcagttaatgaatcactaaataattcgttaatggcatgttgtcgttttgtaagttctcttgactgtagtgttttacaacgctatttccaagaactcggtagtaatacaacgtgcagatcctaggctagtaatggatgcaagcacaggcatacacatgcgaacatgacatgtgcatgcacggcgaggtaaaccgatttctatgctcagaaatctgcgctacaacgtcattaaaacgactttaggtatcaaatcacgtgaaagcacttaaaagtgccgtagcgctcgaaaatcgaccttctgggccctatgttgcaacttgcaacagcatgagcattcatattattccacaaaagattgtacttggtgtcaatttttaatcccttgtatcagtcgttgttgtggtttggatgagtgaattggtgccattttttgtgatttctcacacacaaagtccgttttattaattcttgctacaagaattattgaattacttcaatcttctattttagaaacttcgctcatttactacacttgccgcaattacaatcacacttatctttgcctggaaactgttgagagctcctcaagagcaacctcggaggccacgtagacgcgttgctccatcacctagcaacaccagcagtagatcacggccaggtgctttgacctcaacggatgcttgttcatcttcagcagattcaagagcacaggaagcaatcaaccagcttttccagccagtaaacgtattgcctgtttccttttctgaatactgaaatgatgtatctgcttttaggatccttggactgatagtttgcttatattcttctccagctgactcttgagcagcttgttaggcataaactgagcgaaggacgaagggtattttgcaagcaactgctttcacacctttttttttcacgaaatttaaagttttgttataccaatgcatgtttctttcccatgtgtgaattataatgtttaggttacatgccggttacttggtgtgattttggaggaaacaactccagaggagctccaggtgagcaaaagcgctgctgcaaaaaaaatttcctgttttttgttaacgaatttaatttagcggaattatacttttttttcagaaccatgtcacagtgagaccttctgtcctggaggttcttctagaaattgcaaaattctgtgatgtctatctgatggagcgcattcttgacgatgaaagcggagtaagtaataaggaccatgcattttttctgttgcatttatgttttacgctttacaagtatgctcaagacttgatatgtcaatatatactgatatcggcatatgcacgcggaataaacagtaatcaatttaccattgatatcggaataatacgatgaatgaacaactacctggtctgctattttatttcattatgttcaggggttctttttttttttaaaaaaagaaaagcagaagagtatttttggaatcatcactatagacacactgcctagtacggaatttgaatgagctattatagcttgacatcagcacaactgaataatgttgcaggaaaaggtgttatctgccctgagtgaagctggactttttacgaacagtggattgataaaggacaaggtaagccgcatgatgaggtcacttcagaaatataactgcttaatcgttttttttttcatttgggtatagccattggatgttcgcaatggaccttatgtaacatttcttcaaatggcaggttctcttctgtagtacagaaaatggccgcacctcttttgtgcggcaactggaacctgattggcacattgatactagtccagaaattgttcatcagctagctgtaagtcacaattttaacaatcaagtatcatacttatagaagcaggttttgagttgctatgctcccttgcagaggtttatcaaatatcaactacatatttctccacaacgagcagaaagagtagcatccaatgttttcagctctacaagcttggaacaattctttggaggccttgatcagagatgataatatgaggtagagcaggagagaatttattatttgacatgtgcatcggcgtgtttctcatgaaattgatagcagcacctgtatatcatcaccaaatttgacataaaacctgtatgctcaaccgaccggaagacatgacggactgaatatatgtactgcacaattctacacgccgttcctctaatttatactgtctatctctctgcaggtgagctccagcaaacaatggcatagcgagaactgagacgaacatcattgttcattttttttccttgaatgatggaactcgtttttcttgtaccatgtgtaaaagtcgtgtcatgttaaactggttctgcaactccccataagctatggaaagagatagcatctgtagcataatccatgtatcaattgtgttcctgtataaccgaaatacttaaaattgtcatccagttatttgttcggccattcatcccagaaatgtgttattttcacaaaaggaaaaatctcaactgaacagaaggaataaaaactttctgcagcatccaacattagcacagcaaaatccagcatccactcaaataagtacgtatcatatcattctttccgcatatcctatcctaacatttttggagttgtcaaaatctcaattgcatatcctagacaaaaaaaataaaataaatggagtcgtcaaaacttcaattgcatattccacaccaaaaaaataaatttcaggaacctccaaactgtggatcttgttcagttgggcttttcttcttggcacctagggcacgtacagatgaatccataatctgcaagctccgcctgcctctcctcgtaggagacatcctcatcgatgtaggatatggtaatctagaattttcacagttagtacttggcaaaacaacgttttcaatgttttcttttttcactggcagcacaagaaaaaaaatatttgagataagcgttaacagctcagtacctcatcgtccttcttgataggctccagagcaattatcactgcattaccatcagtatcctgcaacggtagttcaatggttttgtcggattgctgactggcaatttggtgtgaaaaatgagcgaatcaactggaagaaatatagattacctcatcccttttatatgctttagcatttggacaacatgaatgattcatacagctttgcaaaggaaagaatgccgtccctgccaacgagaaaattcacaagagaatgaacgaatactgctgggtaaatagaaaatgacattactgtggggggagataaacttgggaagaagctccacataccctcacaaggagctgcatagtcttcacctaaagcatctagaaatggccttgtaaccttttcagcttcctcctgggatatgttgcacttcagattaacaatgccacaagaaaagctaaggctaaccagtgaaaataccttctcatcatctggaagatcatcaatatgtatgaaatagtcttccactggagacggaacaaccaaaccactggaataaaagatggaaatatattgaggttattacatcaaatgcagtacagaacttatttctgttgatggaaagaaacaatgacagagtatgtaatgcacatatacaaatgaaaaataattagatttacttacagattgttcagctcaaacatgccaattaaatggccatacacgtcaagtgagaacactaggaaatgtcaaggtgaccgtttttttttacgtgagtcaatgaaacttgattacttgaatgtgaagggaagctacttatttatatatatgaactgatctagtatatgccaaaaaggatacagggtgcacactcagaatcaaaaatagcatccttgagaagctgcaatgactgcgaaacacagaagataatgatctgcccatcaatccattggtatgtgggacacttttcaatcaaaacaataaccacttcttgtgtgccatttttatattttaactgacgagctagtgaataaagcttcgtttcagagcacaatattgtgaatagaatacctatatagtttcaaaagaatgaaatatgtgacagcataattaccgtaagtgctagatccctaatttgctgcctaaatgtatcttcatcacaggaatcaacatcctcaggcaaagcaacagagtcccaccacctgcaacaagattttttttttttgggacatattagggtggaacaacaatgcaaacaactcaaaggatcttgtagagctagagcaaggtagtgaaagccacactgagctgaaaataacatcttgccaacaaatccaaaaaaagagaacaaaatatgcaaccatgcaacagagatcttattgactgttataaatgagaagagtggaaatatactagtaccattgaattattgatatacacttgatgaagaaactatcgattgtgcattaaaataacactgctggtagtgccatacgcgcagctactttatcagaggggatgaatagttgcatgcgaattcatgactttacctctttttgtagcccatcgaaagtggtttccatgcttccataagcaaagaaaagtttgattcatctgtgttattttgaaattcaggctgcgttttgagtttcttgtacctcagcagagtgaaagtgatagcctgacatgtaaaattgtatcgagctcatgcatcatgatcaggagatattaaattgactgcaattggtagcaataaggaaattgcaattgaatcttttgtttggggatgttcttgatatagctactaaaactcgtcttgtgcaatagtctgtcctggtgcattgataagtagattgctgacagccattagtgataacagtaccaactcaagtgtgatgcttgaatgctttttgtattagccatggacaatggcaaagttctagtatccccataaaacttttggagaatattagaatctgagatgagcacataacacgatgtttagtgcttagtacactaaacattaatctatatttctatcacataccttggcagcaacaagaaaaatatcattggaccctgaaaataaagattggtcagtagcagataacagactgacaacctcaatcacaatcatcactaatcaggaacaattgatctaggcatgctgcatttaatgaatagtgaacacaacataaattcgtaatgatggtatataatgatcactgcatactgcacttaccatttgcatgttctatgaatttctgaagagcagatctctgggatggttcagtcttagatccagtacacagcaaagagtgataagtttcccagtcggaatcagcacatgattggctaaacaaaaatgcagaatcaacaagttatgtttttaccccaagattacatttctatctaagacggcaagaacaagttacatgttctgataagataattaggttttaagttttaacacgaccgacaactataacctatgatggagaatgaattgatcaacaaaatatttatgcctcaaacaaaattcctaacatctttgggtgttgcagccaaaagaaagtgtgaactgtaaaatggttagtgactcaaacctgcagtagcgttcttcctcacatccacgacaaggaacaacttgaggcaaactaaaatggtctgtgaaaggcagtgacatgtcaccagtaataagtgatcctaagacctcttctggcaaagtactactgttttcctttgttgcaccagaagaactggcactcgatcccaaatcactctcatggcaatgcctcctattagtgcagtcactgcttgaaccaacgctttgccaatacaatcttcgtccaatctggaactctatagaaccaatgaagcgaaagcaataactgcacacagcgcaatcaatctgaaataaaacacaaaatggacaccacacttcagggaggagcagttcacacaaaaaatagaagggaacaaatacctaggatcacttcaaaagcagacgaaccttgttaagactgtgctgagcaccaaccaatatttgatccttcagaataaggtccccttctgcaaactccttgttcgcacaaacacctgcaagaaccaactggttaagtatcttggcttttacccgacaccaactttatacaagcactccaagtttgccggattgcattgcacaagatatataagtattcagtaaccagtacctttcccatgcttgctgctgaagttcactcttataccatcatgtttcctggactgtatgagcccattgtagtattcctgaaaacaaaagtagcatagctgtgtgtcagatgggagctacagatcgtcagcaatacatgaactaaagtaaccaaggaaggagaaaaaaagccataaaagatttactacaattttactggcttcaaggagacaattgtaactgcaacacagaaagaagccaagaacacaaaagattgtttctattctgtcgaattgatacctccatcgagctacattcactacacactaactgggatacccaaaaaagacaaacttaagattgtacttctgcaaataaaacattaaactacaccgttactgttgtaaactaaacaattcgcctctcatctcaccaatctaaaaaaaaccatccatgcggaccaaaaagaaatcctcctttctcagtaagataactgaaaccaatcatagtaagatatacccatcatagtatcacttccttataacgaaattcccgacaatgattacccaacctttctacagggaaaaacaataatcgcagcacaagcaattcccaagcagatagatttgagacccggaggatggatgggcaagggaaggaaaaagaaaacgtacctgcgcgggttggagaggaggggtggcgaggagctgggcgatttggggcgcgaactccctgtccaggtcacacgggcttgcgctgctcccacccatgccgccgccagcgcgagctgctgcctcttgcggctgcttcttccgccgccgctcgccgccgccgccgtggggtttggggggttttgttctcgagaccttgtctcgtacttgggggagaggtgtggatatgaacatacgtgttcgagctatgaaggcggaaacaagggaagtacgcctccttgttgaaaacggaaactgccatttttggttcaaattgacagccggtgtatgcataactgcacacacataaggaatatgtgaatgttacttgtaaactgcatacatatggtatatgtgaaattgcgattatcaactccagtcaactaacattgtcatcatatccctgatgcttatgcaagaattcccccaaaaagaatgctaaagcaattaaaccaccaccaagtacctaatccgtagtatagaatgtaattcatcctctagtactatgaatctgtatagaagtaggtaggatgtatcatattatattctatattgggttaagggagtatatgtactagcccagttccattccgagtttatgtgttcgtcaccatcaccatgtcaagtcaacatccagccttcaacctttgtaaccaagacgtgcatcgagattgcttgtgatgatcatttcaataatgcaacatacactgctaattactagtaatatttgtgagtgttagatacaccgaatacagcagaaaacaacttcctaggtccccaatgcacaatacataaacaatatacaaactttttcttttctttttgtttttttgagatggaacttaattatctaccacttgctgggtagctagtgagcgccagctcgatcgacaattctcattagatgcatagcagtatagcccatgtatatatatatctatgaatttagatatatcctatttctagatttatagttagaaattggattttttttttggagcgagtataatcgaattgctgaattgataccttgtcaactccttcgatccgatcaatcaaacctgccatagtcatagtgccgtgatcatatatgtatgaactcccccagatatgcgattaatccaactaactattgcctaaattacttgtatattagccatatcattggcataatgctgtcaacctcttagttagttggattgcaaattaaatgggacatggcacgagcaggtaactatacaaaattttcatcgtcatccacgatccaaccaccagctggtgcaaaaccagcagcttgatatataaattcaggcagtagctgcgccattgctggtattagctagcttctctgcagcctcttccattcctagctagcttgtgcaagagctcgcaacaatgtcgtcgtcgtcgtcgtcgttgaaggccttggtggcgttcatggccgtggccaccgtcgccgagctcgccgccggcagcaagacgtgggccatcaagtgggcctccggcgggaactacggcgactggtcgtccaagaacacggtcgccgtcggcgacagcgtcggtgagtgagcttctccattcctcctccgttcttggcatctggcaacaatggcgtctgagctgatcgatcggcgtgtgtaatgtggcgcagtgttcacgtacgggacgccgcacaccgtcgacgagctgtcggcggcggactacacggcgtgcagcttcgccgccccgctctcgtcggacgccggcggcagcaccaccgtcgtcttcgacaagcccgggacgaggtacttcgcctgttcgtccgggtcgcactgcagcatgggccagaaggtggccatcacggtctccaactcgacggcgccgccgtcgtcgtccaagggcggctcgtcgtcgtacggcgcggcggccggcggcggcgccgagctcgcctccaagctggtggtgggcctcgcagtcggcgccggcgccattcttgcgctctgaacatgaactcgatcgtctctgaattattggcagcatttccgtcgtttgagatctttgcgttgcggtgttcctatttgtgtaatgtgcagtggattcccttttgttatgatcttgttttttgtatgcatattttcttgaatgaatttagtagttatgcttgattacacaaaatcagaacttgtctaatgaaaattttacacagcatcgctagcacttcacaaatttgacttctacatattgtaaaaaaaatatcaaatttgaatttgcatgcttgtgcagtgaaatatcacatattaatccatcctgcaatgacagtttttttttacatttttttaataattatttaaataacatcgcaagaaacgaagggcatctccttaaagggcgaaaaagacttccccatcacaatcataggagtaacagtttgtactttgtaatgcattccatcagagaaccaacattaaaattagcatgccatatatatatacacacaaaaaaaggctgcttctgatgtaagacctcctaacatcccattccagcgacggcgaacataatctaattacaaaagctaactaaccctctctgtccaatgatcagagcaattcaaaagacatggcatcacccatggtgaggaacatcgggtgcataaattaatggtgctaaggctttgtcatcagctatagctgataggactatgtcagtcttgctacgacaaaattcaccagctagctccacaaaaggatcatgagctgccctcatattccgaatagatattggagatcatctatggtgagccgagttgcactgccgccaggtttgtcctcaccaaaagcagattggaccatctttctcttcttctcctggcaagagaacataaaagttgtgttgacaaaaatggagagtaaaaaagaaaacatgcacaagcatggtgacactgtctaaaatgaattgatcaccagtctagctccaaagcatgtccaattatttaacaacccttacaatcgagagaatcgaaaaaaaatgcatgaaattgcctacatgatttcagctactttgtaaaaaaggtaaacctcatattagtttcaagaaaaaaatacatgctaaccagtatacgcaagaatggaaaattttcattttgtagaaatgcatctttaactgatgaagttaaatatgttcagttcatatcctacatccagacgactaatgaagtgcataccatctaaaagaagaaaggctcatgcttttgaaatgaaaatgtaacagccaaaatgatacctgtagagctaaaatccgatcttccactgtgtctttgatagttaagcgggaaacggttacaggacgggtctgaccaattctgtgtgctctatcaactgcctggtcctcagcataagggttccaccatggatcaatcataatcacatggcaagcagctaccatgttgagaccaagatttccagccttaagtgacatgagcatcactctcacctgaagaatgaaatttagttatatttgttgaccatctacatgtaacatcaaaaaaaagaagatagagatgaagggcgtcagaaaagtacctctggatcagtgttgaattctctcactgctgcttctcttaagttgagagacattgcaccatcaagccttctgaattttatacggctgctatccagcgaaagctccagcaagtccagcaagccagtccactgggagaatactatcgccttagaaggggctacttcacttggacttgattccatagtatcactccaagttagagcaggtgtattcacgattgagttaagtatgtcagtggttgccctgatcttagaagatatgtaactgctttcacagattgatggagagccatctgcttctacagaactactagttgttgcaccagactccaatttatcagctatacaaaaccttaacactccaggtgaaaaaactgtttgagcgcttaatttcttcccacaagaaggggagggacagacattctcatcacttgttaagctcttatgcacacactgataacagaaaacatgaccacatgttgctacaacaacatcctcaggtgggtcctgcaaaacgcgcagaaatcaaattaccgtagttatcttagtatccatggagtaacaaacagttcagataaaattaaactactgattgtttaatcacacacacatgacagttcagataaaattaaaccactgattgtttaatcacacacacatgacaatcctgttctgatatccttattttgctttttcataaaagaaactattcgaagataatgtaatactatttttttgcatgtacagtatgtgattagattgcttacactgcatctggaacaaattgcatagtctccttccagctgtccaagcaaatttatcactgtttccttaggaagtttgtttgccacttctacagaaccagtatcaatcaaatctttttcctttcccttcaaaagaagaggatggtcacaagcctgccgaagtcgcagcagcaatacaagaatgtttgcaaaattttctcttatcgtcccagcagaagcatattcctgtagtatgaacatggagtataaacattttgcattgaaatttctgaactactgcaaatattttgaaaaagaaaagtaatcacactgaacatggtaaactattgactagcaaacctacttgtgcttacgaagataaatgtaaaaacttggcttctgttcattaaaagtaaaaccttcacaattgctgtgggcacaatacagctaagtgttcatcggataagacaagagtagaaaacaaaatgtatggagtattgatatggtgctattctaagaccttgcagcaacaactgagttaggaataaatcaaaaccgagcatatctaagttcaaataatgagtatctagagaacggacagtatctatctatgcaccataactgccgatcgctttttcatttaagatctaatagttgacatagtaatgcaatattttcgatagaaaaaaaaagaggcaaaattgaagtggccataccttgaacttttccctagaaccttcttcaagcatcatatagaaagttcgctcctcttttgagaagtctattttgctcagctgaatcgtttttggtggcaattttatgattggttctccatcgattagtgtttctgtatttgaacagtccaaaaaatagattaattagacaacatcagaaccagtgaaaacaaaaaaacagccatatgcactgaaactgaaagcacatcttacaaatttaagatatgcaaccaagtattgaagctgaaaacatcaactcaagcaacatataaataaacagaatgttacggggtactcaatatgattccacccaaaaagatagtactctttcaattatgtttcccaccttcacaaattccagattttcagatgtatttcatgacttccataaaatgctagagatccaagataagaggttgcatttttccaagtaaaagttgattttgccatgatatcgtattatcatatatattagctccagcacacacatatataatgaatgaatcaatatcaatatttttaaattttcatagttgtgagtaataccaacgattattgtcaggaattagtaagcatcagaggcaatgggatgtgggtttcatatagcagataactaaaaggtacaaagttgcagacacatatgcagtcatgattttctattttaccttttgtgcgccgcaacagaactatcttcaagacagcttggagtttcttatatccacgagttgcatctctagaaatttggtattttatcatagagcgaaaggaaccatacacagaatatggttcatacttcaagaaacggaaataactatacagatcatcaattgtattttgtataggagttcctgataaacaccatctccgttttgctctcagtccacaacaggctctagccacttgagtattgtgattctttattgtttgagcttcatcaagcacaactctgaaccatcgcactctggcaagtggtccaccatcaaggtcagcatctgaatttttgggtttctttttcttctttggttcgctgtctttctttcttttattgccaatagaaaatgctggacataacccatatgtttcgctgttcttttcctccatatcctcatcaaagttttgtttgggtacctcattggctacaatagtgtatgtggtgacaacaacatcatattttgtcaactcagttggatctttagtccttgaacctccatgataaaccaaaacagacaatttagaactttcagtaaccttggcagccaactcactagcccactgtctaagaacgctggctggacacaccactagtgttcccgcagttgatctattagcagacctcaaagttgacgaaggcgatggtctcactctagccttcttcttgggttcaactttgacagcatttaccattctatcaacagcagaccccggtagactagcccagggcttcagatctgcggcatcacttgctgcttctgatgatggaaacagtgttgaatcctgtagcatattcacagattcacccttcagttgcttcttgtccatgactatcactacttcatcatcctcatcaaggttagctacagatttcatgctgcccacatcagcagacatgaacttagactgctcaaccctctccttttgtataagggcaatagttgatattgtcttcccaagaccctgcgtcacataaagttatgtccctataagataggggatccagtaaaacaagtaacagttatcaaggtagaaaatagaactaacctgatcgtctgccaaaattccacctgaacaatgtgagctattctccctggaaaccatccaagctaatgctattctctttcaataatgaagaacatagcagtgaacaggatcagtagaataaatagaattatcacacaaccaagattttcaaaatataaactttacctggtgcttaaggagtgatactgacataacaccttcaggcaaattttcttccgttgtttcttgactgatttgctgcacaatatatttttttgttttaaaaaggtataatccacagtaagtacaataaaattgaatcaccacacaattatattctataccttcagggcttcatcatacaccaccctctcatcacggccaaaaagcctcttttctatatttaagtggctctgagtgccaaggccattgactccaaaattgttaacagaattgttgtatggcactgatggaggaaagatcctatgtgagtttagacctccatatgcagagacaccacctgcaagtttcaaacagagagaaaaaaattactaatatcgcattttatactagtaaaactatttttatgtgatcacccatcagaatatttgagggaattatggtacatgaacatcatcattatcagttttaacttttcagttgctattaataggtagcttccaacctgttgacattgcagatgtaggcatctcgattccataggcagaacttgtttgaaaaccattgtacttccaagtggattcttcctcgatcttcttgtcacctaaactcgaatgactgaacggaaatggttgatgcagaacctcatagacatcatctgacaggtttcaaaagggaaaaactttagttgtactaatcgcaagttacagcagtatacttttcaagttaatcaaggatagttctactcaccgtcatcatcatcaattgaaacaccctggccataactaacatatggcttgtagccacttgcaatagcaggtgaagggaacccaattccattatagtgcacagtgttaggcttcacagtggggtgtgtactttcaacattgttacctcctgttagagaaagtggacgagacttgtaactgctgctcatgaaggtatgtggaagagtcctgtattgccaagcactattctgacagtcagtgttgacaccgctgctgctttcaataatgtctgatctattctcagcaggtctatgagaggataaagcatgagtgttgtttaaccagttatcgtcatccagcccgactagtagttctgaactattattgccaaatgctgtgttgtgcaaaaccacctggttaacaccatcattgggatcgtcaaaatcaagattgtcttctgtatctgagtacgggctgaagtactcttcactgtctgaacacaagtcaataatatccatattgtgctagcaaacatgggcatcaactctctgttgtcagatatctgcgatgcttagcttcactaatccccaacaagcctggtcagaccacactatctccagcacactgcaaacaaattatcttgatgaacccacttgaatactatcttctgcaaaataatttgtgaattggaagtcagaagtctgaacaaatgatgcattcagtaatttgcagcagtaactgtggtttaattcttcaaggggcactgcaatagcccagataggaaatacaatttcaacttggtgcatacaagggttgcaaataacacctaaaaatatttttttaaaaaaaacacttttttacatcaagaacaatatttgcctaaaccaggcacagtgatgtgcaataaactgatacataaaactatttaaggaagtaaacactaatgcattcctaggctaagtgtattgatcaaaatgcagcaccctattcaaagaaaatcacaaatgaaagattaactattaatccaagggccaaaattttgaaagaaggaagaattgtcacaacatgaactgagtgtgccatcacgcaagcatcgccttcgacaaggaacggcaaagccaactccacaacaatcaaacaattcgactacaggaatgcacaaccctaatcaagcccacgatcgcttaaaacttccccccaaaaccgcccaatccaccaaaaccctacctaagcgaaatccgcccaaagccaccgccttctcctcctcaaaaatgatccgccgcaatcaaaatctcccgcaaatcgcaacaaccctctcacacctccccgaaacaaaacatctcacaaaagcattccatccatttgaaccaaaaccgctaataaccccaaagaaagaaaccagtcttgcaagagagagtagtaaagaagttacctcctccgaatcgtcgtcgtcggcggcgattatccgttggagggatcgaaggcggcggggagcacacgaatcaaatcaaatcaaaatcaaccaaatttctttttgaggggaactgcgtggagattttatctggttcgtgacggccgcgcggcggccgaatcggaaaaactctctctcgcaaagacgagtgggaaacctgggacttatcaaggcgtcgccggtttctccgggggcgcgctcgtgtgtggctgacgcgtggggcccacgtgccgggccccacgtgtcagtgggcgcgggcgagcgggaaagggtggaaatttcgattggttcgcggcttgaaatcgtcgtggaggtgccttgtgttggaaggaaacgggtcgtgtgtgttttaaattgtttttttctcaacgcaaagtatgatgcggtttcggaagaaattcctcggaaattcagatggccccacctgtcagtggctattgggcgttgcaacgggggctgtcaacccctgaaaaatcgactgatattttgaaaggaggaaacgaataagtaattgcaacggtaaaattatcttgttaccgttcaaagaaaaatctcttgttagcaatagcattcggactaaccatcattatcaacgcccatgatcttagttaattgggcattaacatcggacggtcctggtttactgatcgattttttgctgtgctgcaacttgcaactaagcagatataaacagccacgaggattattaaaaacaatataaaacaagagaggattagagtaataagcccttgtttagttctcaactttctcttgaaacttctagcttttccatcacatcaaaaattttctacactcataaactttcaatttttttcttcaatctttcaattttagtcaaacttctaattttgacgtggaaccaaacacaccctaatatacttattttgcacggactactacaggtcttcaaagatgagcactaagggtatgtttagtttttaaacaaaaattttcacgctgacacatcgaatgtttcgacacatgcatggagtattaaatatagacaaaaacaaaaaccaattacacagttcattaggaaaatgcgagatgaatcttttaagcctaattgcgccatgatttgacaatgtggtgctacagtaaacatttactattgactgattaattaggcttaataaatttgtctcgtaatttataatttattttgttattagactacgtttaatacttcaaatgtgtatttgtataaccgatgtgacatgcatggataaaattttttgccaactaaacaagccctaaacacatgaaccgaagaacacttggaatcaaaatcgttatttatatccaaccaaaatgatcatcaacggcacagaaggctagaccagcttaaaatgcagaaactcaaaactgtagaaataattcacagccatcatagtatttcaaattcagaagaagaaaaatacaacagaaaaaaaaaagaagaaaaaaaatatactccgaagcgacttgctttcacccatgggccggggcgaggcccactgcgaacgggctgggcggcccaaggtacggcatgctcgccgtcggcggcgcggccgacgaagcagaggcgacgccggggaacgcggccacggccggctccgtcagcgggacgccgggcggcgtgtcgccggcgccggaggtggccgggagagggtcgccgccgccgccgccgccgccgtaggccggctggagctggcagtcgggccaccggcagtccggctggaccttccgctcgccccacgtccggtgggccagcccgaagcccaggacgaggcccactacgatgagcgccgccgcgaggcacaggaagatcttggtcgccttccccacgtagcagcacattgcaaagctaagctcgtcgtcttcttcttcttcctcctctccggcgagctcgtccggccaccgctctctcacccacaattcacaaagagcatgcgatgcaacgccgcagccgcactcgcagcagagagcacgagaggggaagagaatgaggctggagagagagagcaatggcgagagggatccagctccaactccaactcgcctcgcgtttttggcggtggtgctggctgtcggctttgcactcgtgcgaggcttcacgtgaaggagagagagagatggagatatagagaggttcgttagtatcacgacctaatcatcatattattaaagtgaaatgatcaccatcggtgactgcatgtttctgaacattttaatctcttttgcagtcagtgcagctcactgttcagttagtcagtgttgtatatatgaacagcagaaaacatactacagtaaagttagaaattcagattatggcaagtctcgtttctgcagtttattccagtaagtcagctctgcatcgatctaactaactcaggtacaaacaatagttgctatcatatcacacctaaacttgtctgctgttagtgataggagatgcactactctgccgacacatctagtaaaaaggtagtaattgattgaaggtaattaactggagtctgggacaagatgataaatgaagtgtacaagttcagaataatgctacagtgggtcttcagagaattggatggtgcaggttatgtggtgagggtccatggtgttggtccaataattctcttacttttatttctcttttgcccttttttccccttagcttttaatactctcattttggatgattgaatagtggagcacaaagatgaaggaaggcctcaagacaaccagtggcatgtccatagttggtcacatgttgcactgggccaaagaccagcttgcattttttgttcattcctaggtgtggttaggtatgcagctttaggttagagccttttatgatgcaaattcttttgattgaaatgcagagcttttgctaagctaatcattaattagtagtaccctgcaacagcaagataacggtacaacctactaacatgatctgcagattttacaatgaataaatcagctgctcgtgacacttgcttacacctggggatgtgcactttctgcggtggctgcagagatcatggcaatttttatagctcatcgtcagagtacgctttggaactacaccatccatcatcatgtgaagtgaaaaggcaaagcactactaggcatgccagatactgtcaacaaatctttttagtctaaactctgaagtctgaaccacatatttttcaactggaaacacatgtaagtaaatttcatagagcatggtaaagccacagctgcagcctgcagaacaaactaccgcaaggcacaagcctatcagttcaaagggacaccattcagagtcacaggagcaaagctagaatgtacacatggacgcatttttccggacctgaccaagaagcacccacggtcacagagaagtttctgaagataaaggcaacatctatatatctattccaccactatatcaggaggagcagtaactccaaaggactcagcagaagcgtccaccatcttcttgacctcatctgggttggcaccaacaatcttgttcaccacctccttgtccttgatgagaaaaaatgtcggcatggccttcactccaagcttggacgaaacactctgcatgcacacggtatatgatatagcagcttggctcagtaaactaatttaatgagcatatatgcatagcagttttgtaacaaatggttatgccatgatattcagtagaaacaattgaacatcaaagatgaaagctccgaagtctaaggacattttctagacaactctatgtgaaattatcagtttaggcatccactttctctactttctattcctcaaaagacacttcgctttcagaattcagaacaactcagagaaaatacgaccatgggatgtattccaaaaatacatgcataaacaacacgtcatgagaccaaaaataggagaatggtttccttctttaaaaaaaaaacagagagaatggttacctggacatcatcaacatccacatagaggaacagtatctcagggtgtgtctgagctagctcctcaaacttgtagttcatggacagcgaagtcacacaccatgaagccccaaagtgggcaacaacctacacaaagtcgaggggtcaataaccaagttaacttctgagtgagtaaaaagaaatttctggtgcaactgcagcggataattatcatcaggaaaattttcaatttggaactcagtttgtcaattacagttacagtgaaagaaaaacgagaaagacccagaaagaacgaaaagaacatgattacagaaatcaggttgcatgaagcatccatccccacaaactattatacatatatcgttctaacaaaattataatctacaaacagcaattacaaaaatcgtgggccgaccaaaatatgacttgagaataaacaacatcaatattcatcatgagagacaaagcaggaaagatgtgggggaagcccggcgaaaaaaaaagaggtgggggaagaacaaggcaaggaagaaaaaacccacagggtggccttcgttgcttgcttgattgacgaacagatcccatgactcctccttctcaaccttcacaactttggaattgccaacccccttctgctgctggatctccatatggcctaagaagcaagaacagaaccctctccctttcactccgtgttcttggtctcctcctcctccttgctcctttccccaagaccccaacaagaagagaacaaaattatcacagactgtctacaggaaagagaagtggcaatcctcctgaagattagataagcatggggatttatattctaaagctggtgggtcctgccttattttggctggtagtttcttctggagtcagtatcctatgcagtacttcaaaagctatgagcttatatcaaccacataaaagatatgcccaacgggaataagggccgtgatgcagaaagggtagcaaattaatagagagcttatctcctagtggaaaaggaatgcttatcaggtgggtactagctctgaaatggtaacgtattctacatgagctggtcaatttattagcaatacaacaaattgtggatgttagaacatattggagatggtaaattacaaagcgatgtttttgtgttcctagctccttgaaatcggatatatcataaagtatcatcattttgcagagcgcacctactgcaatttccatatatttcttattgcaataatcgaataacaaagaacaataagtttgtattctcccgctctagagtaataagttttgcatgtggcaaccttgcaataacatccagtttaaagctaccaagtgaacaaattaggagatccatacggaagggaaaacgtagcttgttttacttaaggtagcacacatgtcacagaatcacctcaaaaacatggactgcctgaggttagaagattagtttgctgccattcctagaattcctgcaaagcaagtaataactgtgaattgtcattttctgcgttaactaaaagtagagacgagaccaagaaatttacaagtctggatgtgttcaaatttgatggacatcatagtaacttcatataaaatatctcttactcagaaaaataaataaaaaataaaaaatctcaagttcagtgttacggtttagttgaagactttgatactgaacagaaccatgagaaattaatccagtctctaggagagctttggcaagtttaatcgtttcaacaagatttggggtttaactgctctcacttatgaaaaaaaaaacagctttttgagagaggaaaccctctagaagttcccttgttccttcaagcaggccacgagtccagaatacttgaaaaagaaagataacatgatgatttgatatggtgcgagtttaataccaacaaccctatccattggtggtcctaattaaaaaaaaaaggtgatggcaaacagacatgccaaaatcaatcatacaaaaaaagaactaccaaaaagagatttatattccaatcccccattagcttgccaaccatggtgactgtagacggtagatacacaaaacctagaaagaaagggggaaaaaagcaccgatgaattgcaaaaccacacgcaatttctcacagcagtgaaacagaccactgatctacaaagattgaagcgtgcgagctgtgaatcaattggaagtacacgatgtagcatagcgtagcatagcatagcatagcgccattctactcaaaactactacacacgatttacttcgattcgagcatgtgggaagtggtaaaaggagatggaaactacagagggttttaacctgaacccgacaaccaaactccacgcacaccacgcacgcatacggaagaaggatccgaccactccgcgggctggggggcagcaaaaccggggattccggtagggaaggggagcgccgcagtcgcagatgagaagactggtggcggaacgccggaaaaagccgcgtccgaaggcctctgatcttcttgtgatgggctagctggcaatcgcatagtgggggcacctctctcattctcgcttttccttttttttttatttaagaaaatagatttactacttcctccgttctaaaatataatcatttttagaattcatagctaaaagttactgtattttgagacggatatagtcattgaacggattatgcaacggataggagcatatacttgcatataggaataaattaaatattttaaaaaataaatttaataatgacttcctctgtcctaacatggaggatacttccaaatgaatcctagtaatattttgagatagatgaagtagtttaaaataagtgatccggaagaaaatgatctgacacatatattaaatatcttaaaggtgctggattagctatcttaggcctcctccaacaaggatgagtcagctagctcataaatctccacatcagcttttgtatgatgtagaagagagagaagataaggagagagagtgcactatctcttcttcaagagctaagctcctaaacaaaatatgagaggggttgtggaacccaaagcattttgaacaatgtgctatgagacaacctattaaaaaggtaggctttttgctatctcttgtatgaggtggacaagcatgagctagtgcactagctcaaccattgaaggaggccttaaaggtgctagattagctgctctcctagcgatttggagaggcgcatccaatacggtgtggacacgttgtttcgttacagtggtcctgctaccatgggccagctgattgtttggcccagcgaccgacggccttttactggccatcgtggcatcggtggcgcggccttgcgtcgtcgtggtttggctgtatgctcagccatccgcgagccaccgctaccgtcttgacgcgtgcccattctccaacccatgtccggctaggattgagcgaaggctgtgtttctcgtccgctccgcttcagcgaatcggcaccgccgcgtgtcggccatcagcgagacagcgacacctccaaggctccaatgcccagcagcccctctctcatccatggtagtgctctgtcatggtgtacgggaatgacagggttggctgctccactaaaaatacgcgcggagacccccatgaggagcagatcgagggtacctgcatcgctcctttctttctttcattcgaagctggttctgttccttacttcttcctcttagttcctgttttttgtggagacggtactttccctagtcgcatcatcccgtatgctttgatctttttcagttgtgcttcgctctggatttcaccattgtgatgtcgatgttcttctgaccatgcctatgctcattgattttgatttttgttttctgccttctaggttgcgcggccaacccttaccgagacgtggttttactgctcgccgagccatccgcgttgcccccttccacttctcggcatccgctcgtcgtcgtcctctccgcatccgcatctcttcccaatttgtttgttcccctttatgttcttcactgtggctgcacgtacaacaagcttgaatagcatcacatactccccatcccgtcctcagcatcggcgtgccgcatggcatcgcagcgtcgccttcttcttcggcatcaaggtcgactcggtggctcactgctagcacagatggcgggcggggagtggatctttcaattcttcctcagcgacttgcccgacggtgttgctagctgacacaaccatttcctcaatggcagaaatcggcgtacggtctacctgtcctcctccggtacggtttcccttctcttatctctcatctagcataaattgaagataatgttctgaatttaggctaaatttatcagatgtttgtttgggaagttcgttcaaagattcagatagaacccagcacatttccgaatattggtgcctccagatttctctctctatttcttttttaaatgttgccttctgataattcgaactctgcgccaattcctcttatggaaagagagtcgatgtgatgtcatgaggcaaaacatgaactggtgagcttccctgaaacctgttgattccctggcaacattgatgttttattaggatgaattctcacattaatagcttccttccattagggctttcaatgttctaaacttttttttagagaaatcatgttctaaacttttgattggtgaaagaagttacaattactaaggagctctcatcctctcctgcgaatgagattctattcatttttctgttcctgtactttaagcatgtcagtatgccactacttcattgtccaaaactgagctccaaagaaaggtcaaagtggccagcttaggattaaaacaagtttagcagaatcttcttacacaaattatttggtgtttttcagcatacaggtaaacagacggctagacttcatgatacatgctaatgttgggaggggcaagccactatgctcagctcatggatcttcaggaacggagctgccagcatattactgacaaacaaatacaaggtaaataggcagaagagatccttcatgtgctttgctctccgatgttctccgtagagaaaagaaaagttaatcatttcaattatttatttttattcattaattatatgtaattagtaaattgttgtgttgtatatgtgttaccattttgacaaaaaaaagagcactccgattgatcattttctgaaccatacaggaaaaatactccatgcttttgtatgagctgttcttagtctcttatagaatgtgctgtggtcttaatctctgaaggctgagctgtgttagattggagcactccgatccaactcttttgcccaccaaatcaacttaccaatgcctgttagatagatctctctccccttgagcccaacggctcaagggggccttgaccgcgccctgatcgggggcgcccagcccaatggctggtgggcccccgtcacactgcgccatataaaagaggggtggaggccggcacggcacatggtacgagattcaccgccgccgccaactccaccctacaaaccctaatccgatcgagagggggcgcagccagtgacgggaagcgccaccgccgcgccagacctcatcgccgggacatctacgaccgtcactcccgcagccgtcatcgccgtcgacctcaccggcgccgcatccacgacaaccgagcgccaacgacgacgatggccggcacttcttcatcctccaacacctcaaccggtcggtctatctaaaccctctcccgttttcaatctctatagttcaaacatcaaacccaaatagaaccacccgactagatctaacctaggtgatcctagtgcaaagtttaacaatggtatcagagcaaccctagtgtttagatcgtttcggggaaagaaatccaaagaaagaaaagcacaagatccgcacggatcaaaagaaccaaaaaccctaaccctaattcttacctcgtcgccggccgtcgtcgacgccggcaacggagggggggaggggcaaagaggcgccgcctaggagccactcgacggccgcgcgcgcacctgcacgcgcgtgccggcgagggggcccgcggcggcgccgccatctccgtcgtcgccatctctctctcacacggtgggggttagagacggtggggggagcggagaagagaaaagaaaggagcgccggccatggcgcggcggcgcgagggccgccggcgtcggcgacgccgctcggcgcgaccgcgcccgcccgagagagagaaagagaggagaagctagggtttcggcggccggccggggcacgaggggttttgatccccgttttcggcgcccggccgtccgatcgcaaaccctaagatcggacgtccggcggcggccggaccgaaatcggcccaagtggggagcgcgcggcggcggctttcccggcccaggcccaggttgcggcctgggggaggggagggggcgctcgcccgcgcgcaaggtggccatgggccgaccggcaaaggccggaacaaagtccatataaggtccctccggggccgaaaatgaataaaagagaacagtagcaatttttccattttattttgtcaattttcatgcaaatttcaatagaattttgaatagatttttgcatgttttacctctgtttaaatttgaaccaacgggagaattttcacagagagagaattacagagatttagctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctactccttgatgggttgcattaaagatattccgaccctaaaaggagataactacgcagaatggaaaagaaaactcgaccttgcttttatcttgggagaggtggactgggtattgactaccccatgtcctatagaacctgctgaccttgtcagaggtgaaaatgagtcagatgctgactggcaaaagagacagagggacaatgctcctctcgtcatgtcgtatgacattgaacaaaagaaatggtccttagccaacaagaaatgtttggctgtggtaaagaatacgattgagcctaccatattgggctcgatcccagagtgtgacgctgtctcagagtaccttgaaagaataaagagtcagtttactggctcttcaaagacttatgctacacagctgatcaagcagcttgtgacagaaaggtacaatggaggtggtgttagagaccacatacttagaatgagcaacatggcttccaagttgaagccaatggatttgggcataacagatgactttctggtccatctggttatggcctcattgccaaagcagtttgacaattttattgtcaactacaacataagtccagagaaatggaactttgagaagctcattgctaattgtgtgcaagaggaggagagaatcaaagaatcaaatggtggttcaataaactatgttaaagataagaaaaagaaccacaagtctcccacctcaaaaggtaaacagtctcagcatctgcctcagcaacaacagttcgctgttgagaaagatcaatgtctccactgcaagaagacaggacactacaagaaagattgtcctgattttttgaaaatgatcatggcaaagaaaggtgagaacattattacatttgtaaatgaatctcattatgttggttactctagatccacatggtggattgattctggagcaactattcatgcttgtaattgtttaaaggcattccgttcgacgaggactacgcaaagaagagaaagcaccattagagttgccaatggagttgaagaaaaagttgaagctgttggagatcttcctctagagctcgcgaatggcttcatacttttacttcgagatgtcttttatgttccttctttgcaaagaaacttaataagtgtatcaaagttggattttgatggatatgattgccgctttggaagtggcaaatgtgaactatggcataataatgcatgtattggtcttgctgtgttgcgagacgagctttatttgttatctctttctgagaatgtgaatgttgtgtcctcgttgacaaaagaaaacaagaaaagaaagcgaactcccgatgtctcatcgaaattatggcactgtcgtttgggccatatttcgagggggagaattgagagactagttaagaatgaaattcttcctccattggagttctcagacttagaacaatgcatagaatgcattaaaggaaaatttgtaaagagcatcaaaaagggtgcaaaacgaagcgcaggaattttagagatcattcatacagatatttgtggtccatttcctgtgaaaagtgtggatggctatgactcgttcataacattcacagatgattactcccgctatggttatatttatccaattaaagagcgatcagaagcattggataaatttaagatattcaaagctgaagttgaaaatcagcatgatataaagattaaagtagtaagatctgaccgtgggggggagtactatggtcgacatacgccttatgggcaagtccctggaccttttgcaaggttcttgctagagaatggaatagtagcccagtattcaacaccgggcgaacctcaacagaatggggtagctgaaaggcgcaaccgtacccttatggatatggcgcgcagcatgatgagctactccacactaccactcggtttatggatggaggcgttaaaaaccgccattcatattctcaacagagttccaagcaaatcggtgcccaaaacaccgtatgagctatggacagggagagtaccctcgctaactcacctccgtgtgtgggggagtcctgcagaggccaaagtatttaacccaaatattgggaagttggaccccaaaacagtcagttgccattttattggctatcctgaaagatcaaaaggctatcgtttctactgtccaaacagttatacaaagtttgtagaaacgagacacgccgtcttcttggaagacgaaatgattagggggagctcggtagttcgagaaattgatcttgaggagaggcgggtgtctgtacccgctccgtcgactcaggaacctttcttctctctacctgctgatgttgtgcctgcaatgcctgtcattgaggtaccagcacctgttgttacccctcctgtggcaacaatgaatgagagtgaggaacctgttatacaggattcaacagaaatggttgccacaccagaggaggagctacaacaacctcaaatagataatgtgccagtacaggagactcatcaagagcctcaggtacaggatgtgccaaatgtgcaggcccctagaaggtctgaaagagtcagaagatcggctatccgtgatgactataaagtttataatatagaagagtcgcatatggaggatgatcccacctcatatgaagaggccatgagaagcgctcgctcatctgaatggttggaagccatgaaagatgaaatggaatcaatgaaactaaacgatgtttgggatttagaagaaattcctaaaggagccaaaacagtaggctgtaaatgggtctacaaaaccaaatatgactccagagggaatatagaaaagtttaaagcgcgacttgtggcaaaaggcttcacgcaacgagaagggattgattacaatgagacattttctccagtctcttgtaaagattccttcaggattataatggcactagtggcacattatgatttggaattacatcagatggatgtaaaaacggcatttctaaatggagatttggaggaaaaagtatacatggcgcaaccaaaaggttttgtcatgaaaggaaacgaaaatatgggatgtcgtctaaagagatccatttatggattaaagcaagcttcgagacagtggtacttgaagtttgatgggacaataaagaaatttgggtttcaagagaatgtcgaggacaactgtatttattcaaagtttaagaatgggagatttattttcctaattctgtatgtggatgacattctactggctagtagtgatgtcagtctactgcaggaaacaaagaaattcttgtcctcaaactttgacatgaaagacctcggtgaggcttcatatgttttgggcatagagattcaccgagatagaacaaagtatgcattgggactttctcaaaagacatatatagaaaaggtgttgaagaaattcaacatgtacagatgcagtgctacacctgctcctataatgaaaggcgaaaagtatggggcatcgcaatgtcccagaaatcagtatgagctcaatgaaatgaaaacaaagccatatgcgtcagctgtaggaagcctacagtacgcgcaagtgtgcacacgacctgacttggcatttgttaccgggttacttggcagatttcagagtaatccaggcctagagcactggaaattggtaaagaaagtcttgcgttatttgcaaggaacaaaaggcctcatgctgtcttacagaagatcagaatcactccagatagtggggtactcagattctgactttgcaaaagataatacaaagtcaacatcgggatacgtgtttaccctggcaggaggagctatttcatggaaaagctcaaaacagactatcactgcagggtctactatgtatgccgagtttatagcatgctatgaggcaacggggcaggtgaactggctaaagaagttcatacccggtttaaaggtggttgacagtattgagaaaccactaaagttatactgcgacaacgaacccgcagtaatgtacactcacaacaatcagtcaagtggtgctgccaaacacattgacataaagtactatgttgtgaaggacaaagtccgggatcaaacaatcagtctcgagcacattaaaacagaaaggatgctcgcggatccgctcacgaaaggcctaccacccaacgtgttcaaggaacatgtagccggcatgggtttaagggaagccttatgaatcctggactacagggcccaaaagtaaagtatctgtttctgaatagagatgtgtatagtggctgtcgaatccatcggcgattgaccgtgacgatgaaacatgctctatttacaaatctgtgatggaatagaaaaagctaaaagaaaaagtgagatcaagggggagaatgttagatagatctctctccccttgagcccaacggctcaagagggccttgaccgcgccctgatcgggggcgcccagcccaatggctggtgggcccccgtcacactgcgccatataaaagaggggtggaggccggcacggcacatggtacgagattcaccgccgccgccaactccaccctacaaaccctaatccgatcgagagggggcgcagccagtgacgggaagcgccaccgccgcgccagacctcatcgccgggacatctacgaccgtcactcccgcagccgtcatcgccgtcgacctcaccggcgccgcatccacgacaaccgagcgccaacgacgacgatggccggcacttcttcatcctccaacacctcaaccggtcggtctatctaaaccctctcccgttttcaatctctatagttcaaacatcaaacccaaatagaaccacccgactagatctaacctaggtgatcctagtgcaaagtttaacaatgccaagccaattgagtgcagcaaagcacaaacaatatggtctttatagcctgtgcagatatagctcttccattggtgtgttctgccaccacatcacttccaaagttgtttccaagctaaaaatcatgctgcagtggtggttcaatcccacacttgaataattggtgtttcctgcactgatgtagtagtgactgccttttctcacttgcataattgatgtacttcgctcacttttttatcttaacatatttcataatatcatatagattctcctcaaggactgcgacaagattgaagctcatgcttagcaggaaaaccattttttttttacggaaagcaggaaaaccatttgaaatacctatggaaatatccctacacatgtgttaaccatgatgatctttttcttttcgaaatactgtaaggcaggtatatccatcatctttgtcatctacaactgccttagctatacaaatattcaactctcaaagtagtttggtagctaattaatcagacaggtgatgtaaatgtatacatcgtccattgattcacagtggatactcagttgttgcatttaaatgtctcttttcaggaaccataagttcatttacatggctattttaagagtccactgctctgattagtaacataacactgactgaaatgaggatctgttcattaatttgagtttcttctactgactcagtaacatctctccatgtgctgacttaattctccaaactttgagttctactgacttagtaacatctctcaatatgctaagttaattctccaaactattaacttaggaatgatttaacttggcacatattttcttagtgttcaagaaatgattttagcagatgcttgccattgcacctggtgatctaagttgactgaattgctgaggcggatatgtttcttgaacagaaagttctcatagtgaagtgtcaagtctcttcttaaaactaatgaatctgaaatatgtagtcggtctttcataccatagttgataaatgcaatactattgtctcatctgactgggtttttggccagttctagagtttacagatattatcttaatactgcagtcctcgcaaacaaaactacgagaaatttaaccatgttccattttcagttagttgacataacgaactgcatcttgtgcccattgatattggatgagtcatactatgcttgccacccctgctatgtattgtgaaattattgtttaaattattaactatcaggaactgtttctggcgacttcagttattaaaaaaaaaactatacaggttaaataatgttcttagtaggtacacaaggaattgactgttgttgttaggtaatcctcttagacaaaccttgcaatcgtacatttctttctgtgcgttacagtcttacatgctacaataccgcgcagcgtagcgcgcgagctcactctagtaatctaaaaagagtatggcctagtccgttaaccatagtgcatcttgaaatcgattggaagaaggaaaaaaaaaaggcatagtccgttcatttctcattgtgatacagtgatactgattttacctcatttttattagcatgtttttcaaactactagacagtgcattttgtgcaactttcttatatagaagttgttttaaattattagataaattattttttaatatttgaagtaataaacctcaattaatcatgtacctgcagttaatcttcgtccaccgcaagttctgtggttctgtggaatatattccaagtttgcaactgaaaaacttcatgagcactgactgcatttgcactgcagttcagtggatgcatcgacggagaatgaatacgcattccatgacagaactaaaacgcagggaaatacagagttacaaatcatatggcacgaaccgatacacatttcgtggcataaccatcattttgatgcaggagccagcagcgaagttctgccgggcaaaagtagtacaccattttggaacccacggttgcatacaaagttactccagaaaatacattgcaatgcagttaatattgctcaaatcagctacaacagaaagaaaacacatgatgcatgcgtgttctcttctgctcacagcgcactagcgcagtgccactctccttcctactgtacaagttacaagaagcaagcggcctcatcagcttcagccaaatgatatccccaatgctgatcgattatcatcacatcatgatggccacagcaacttcagccatagctcagcctggaatcgaaggaccgggcttgtgtgtgccgtcttggtattccgatctcgcaagcatttacccttgaagcgaacctcagtgaacaaatcgtctccccaacggatgatgcctccggagaaatgttgacaaacatcagcgttttggaatcacctccaaggcaaggctgcaatagaaagttgatataagaaatatgtttcaaataaattcagggattgcaggtttttgtattaccatccatttgcacaagtcactcacctgcaaaaggtatgtaagttttgagttcctgaagggcacatgatcgtctcctttcgcaattgcaaagataacatcgctaagagctgacaagcttttattgattgcctgaaacataaagaaaacaaacagataagacaatgtgattatcaaataagaatattgtaaatttgtgatgaacacactcacctgagtttccttcaaacgatcacccgtggagccacttttagcaaggcgttcactgccagctaaatcaatcaagttaaggacaccttggacttgttgcccagtgttctgcattaagatcaaaagaaaattagtgacatacatttgctcaagtttcagtggttctgtttagttagcatgaaaatgaaaaaaaaaatattgtgaccagtttgtaaagtttcagcactgtgattaatattctaaaatatgggtgaagcgagtacctcatttgatccagatatcttcagtgtgaaaacaaaatggctccgggaagattgttcattcatttgggtcctacccacagacctggttcaatgtggtgaaaaaaaatttagactcactgttgatatgtagactaggtggctaacagacacatgtgaattcagataataagtgctagcttgtataaaaggtaaaccctcttatgtttctgctctctctaatatatttgagtgatagatgagagaatcatctagacatatccaaagcattgctatttcaaatataacattaaactgataatggtcaatacccttagagcaaacagttacaaggcacaagtgaatgattaaaaatgaataaagcgtatttacctgctttgggatgctttcgctagaagagaagttacgtcggcgctactaaaaacatcagcaacagtaaggtcagtgacggttgtgttcccttgtggatcatgctttatggtgtattgtttactggtagacagatcaaagttattagaccgaccaggtgctaacaaatcacgaattgtctcattgtatatttccaacattgatgcctgcacataggaaaaactctcagcaacactacatagaatgtacacttcagaatctgcattgcactatggatactaacctgcatactgtacttccatccttgagattcaagagactgacttgtcttaaaaatttgctccaaagaacgaggtatgatgcctttctgatcacgccctggtggacccatcattgtataagttttaccagaccctgtttgaccataagcaaatatgcaaacctgcatcatgcaaaaataacttaagcataccaaattgacaagtacttcaaaactgaaataaactagaaacatcagtcagagtttcaagataatggtgattatacaaatgcagaatgcaggtgatatatactagaaacatcaatgtaagatgttcacggcttttagcatgtatttgtgcttatgtggtggtgctgaagagataaaatttggggtgccaccatatcaattaaaacaactttcatttgttcttgaaataaaaaaaataaagttaggatatttgagttattagagacaggaacctcatgaacagattattcaccaatacttcattgttgtagtgaaatattcataccttgtacccatcaagtgcactttgaactagttgtgacatttccacaaacacatcttcttgtgaagcaccgtgatcgaaaactttgtcatatgagaaggaaaatctctgacctacatcaacacaaaacaataaaatgaagtctccgattaactttaccactgaaaacttagtgggggaaacatagtttctgtttagcttcaacaatgaatatgattttaccttggttcatcaaatcaataccacgcccggcagattcaactgatgttggatatgaaataagggcttcttctgcaccactagaatcgttgtcttgcaaaagtggtcggaccctacaaaacactctgatgtttcctttaagctcctgcaaatagaaaggctaatcagtaacaagtagcaatagcaagatgaaaaaatttcagtatttactcaaaaatttcttctgtcagtaaaatagagaaattgtttttagtaagaagtgctagtatgctgaaacaattaccaatattgtattgtgcagtttctttcgtagcttgtcagcttcaacaatttgaaattctgcggatgccaaacgttcttccagatcttttattatcaccttttgttcttcatatcctgtcatcgcctcaattgcagtaacatcagcaagctgcaaaagtaaacaattagatcaaatgtcatataatcatatctcacatgtaaatcagcactgacaaaatattatttctaaccttcagtttatttgttgcaactgcaagttgtttctgcaaagtttgaatctgttcttgttgcatactacatgtttcctgagcagaagcataatggtgagccaaatagttgcgcacagaaagtattgatttggttaatctgaaaccactaacctcaaaggctgacacttttacactcaagctttcacagtcttttgtagacttgcctgctagttccttgtaattagcaagctcagcactcaaggtatttacttgagaaacagactgatcacggtcttctctaatttggtgtagctcaattctaaggcaatccacttctttcataagttgttctttcattctaatggcctcttgttgagaagtctaacagaaatcaaaacaattaaatgtttaagtgaaacaagaactatactgcccaaaaaaattatcaattcacgaaaaaacacaactcaccctagaagaatccaaatggttcttcattgaattgtttaaatctttcagagaagccattgtttccatcatggcactcttctctttttgcagttttgagatgatgtccccactcttagaggcatcagcttgaagattactgttgtattgctgcaagctggtgttgtactcctgcagtcttttgttcgtgtcttggaccattttcagctagttcacaatttccatccatcagaaaggaacattatatatgactcaaattcatgtaagactaatagaacatttctgaacacgtacttgctcactaaaccgttttgcttcatggctgactctttccaggtccaccgacagcaagtcgagggacgcctcagccgattccctttgctgcctctccttctcgtaggactccacagcaagctgccagtttaaaggtcaacaagtgtaagccgtggctgaaaccaatcacacaggcacacagcaacagtacataactatgcagcttattatgcgatagatgagttctaaccatcctgtcggccttctccttgttgaagctttcctccaacgaatcgcactgccgcgtcaagttcaggtgtgcagctttcagctcttccagatcactgctaagctgggcctctggaagtacagtaccccaagaacataaatgaccagaataaactcagtcactacgatgagatggtactctgatgaccaaacagcacacatgaatgctcaaaacccaaaagagtaccatcttgttctcttggtgtgatcaaataaatacaaaaaaaagagaagtgcattcgaattcattacccaacttggcgtgctgggcattctctgcatccatcgtactacggagcttctcctgctcgaccaagtagccgtcctccaactcaatgtaccagcggatgcaagctctcagcttcttgatgtactcactcatctgctcagttctcccctgcacaggtccaaccaaattcaggaaacccgccccccaaaaattctcaaacagaacgaacgccaagaaatcccccaaaagaacccaccttgtagtcggtcttgctcttccccttcatcttctcggcgagcagccgctccacatcctccctcccggtgaactcgatcacaggcgccgccggcccagccccgccctcgccgccgtccaccgacgccgtgtcgctgttcgtgccaccgccattgttgattgccgagaggacattgcggcgcgggccaggcttgacccccatcccccgccgcgcgttgcccaagttctccttcttctgcaacaacaacaacaacaaccacaccccacaaatcgcaagaactaagctcccatgaatcaaccctcccccaaaataggcgatttctttccacaaaagagagaaaattaccgggtaagggctacggggcgtgagggaggaggccatgaactgggattagtggcaggattaggggttatagttagggttctctcctcctcagtggtggcggtgggtgggaggaggggagctttcttggggccggatggagtgagctcgaaggcacaagaatctctctctctcgtggcttacaagcgccgacaaagccgcgctttagatccgaaaaacctcgagaaaaaaactgcggagccgatgaaattggggaaggattcgaagtttttgaagccaccgagcggagattaccctcgatttttcatggatttctcgcctcgctcggatctgagcgagagatgtgtgggagaagagagagagagaggaaggagaagaagaggacgaggcggccgagctatttcgaaatattttgaacgctgacgcatcaggggtacccaccccacccctccgatttcgatttatttacacccaatgccactggtgttagtttaaagcccaagccggcggtgaccaggtctaagtggctggccggctcgggcagggtcattcgcgtaatatgattggttagtcaggggtattttcggtatttctgttgaacggtcaacttcgatgttgtgggcttcgagattcgcgtcgccttgggccttgctgataatgggccgggccgggccggggcatgttgcgacgttgctctcctcgttttctttgtccttttcgggaatcaacagcttagaggtgccacgtcttgttattaagcttttgacagctttttcttcctgaaatctcaacgaatagttaagctagcttgtcagtcacctcgcgcactggaacctgagaatgatcggacaatcgacgcgatgctaattagaaatttgctgtttgttagtattagtaaattggtgtctcgtctcgtcaagttgcgagattaggtcttaattgccttgtgccttaccggtttaggttgcgttcggtagagcgtattcaaatcttatttgtcttacgcaatacgagaagatcattagtttataattaattaaatacttaattattatagtttctttaaaagactattttaaaaatatatatagagaagttttttacaaacagtataaaaagcgtgtcatcataagccaacagacagtaactgaaaagagcttaggctcccattggttcctctatatagaattaaccgctgtcaaaatttaaattttagagtttattttaatttttttcattgaacatatctctactattataaaaatttaagatgtttttatcggtattttggtacgtcatatgtgtatacgtcagtttttaagtttgtttgcttttaaaaatatgtatccgtatttgattcggtttttaaaatcgtccacttttggtaatacagaagaaatcatataagaaatttgttttaaaaaacttgcatgctaacttgagatgattagactcctaaatatagctcatgattttctaaaaatatataaagcgaactctcacagtgaatttcattttaactaaaacatataacaataataagattaaaatcgacttcacccgttgtaacgtacgggcatttttttctagtatatagaaaaatttaacctataaactattcttttctaacgcgccgtacgacgtattttcgacaattggcccacagacgagggccttaaagatggatttgtgaagggggtttggtgtaatgatgcttggcgtacgttgtcagctagccatttactatttctggtgctttattagttgggggaaaagagcatgaccgctgctgtcccctctcaaagctcctgagttttttcgccttaaaaccacgtttcgtccttgccaaacgtggtccactgaagtgccagtgctttgttgtttgagtaatcgagttataattggtacagtatctgcgagcttaatacagatgtcaccgctgttctggattgcaatcctgttttgattagggagtgtattgattaccttgtactcctacataatggcaccgatagtggcctagcgatgcccagtgatgcgttctcttgcagttcacgcaaaacgtgacaatggtatagtcgatgttagaccggtgtacctcttgccaagatgtatgtacagtagaacgccgtaccagactaccagtttctgctagctaagcgtacgtttctgattaatgatagattctagaaaaagaaaacaggtcccatatcgatcaagcgggctgatttaatactccctccttctcaaaatgtttccgttgacttttttaaatatgtttgtacatgactccatagaacgatgacgacgacgtctgtgctgcaaccagaaaaatacaagagaagaaacagaggaaaataatggccttcgttttctttttcagaaagcggctcgtagtactgtattttagtataatgtatgtacatgtcccagccgacactgctgcgtatacacggtagcggaagattgacggatcgatcggtcgcgggaaggtgacgcggcgcgcgcatgtaagctcgggcgtcgctagctgccgatcgatcggtcgccgtcgatcgccggagcgggggcagacacagggcgctgctgcgtgacggcgacccggggcatgatcgagtcactcgttcgctcgccaccaaacctggctttgtcacggacgggggcgtcggaaaggaccacgcgaccgtgggggaagagcagaatgaattatgtgcgcgcgcagggcgtgccgccgaaaacgaccgcgcagccgtcgcgcgtcgccgcttgccggtgccgcgcgtggcgggtgggtggggaggagacgctgcgtgatgtcgcgcttgcgccccccgtcgcacggttgaggtcgtgattttcgcgcgatctcacggagaagtcgtcgtgtcgtctcctacgtacgcgcgacgccggcgggggaagcgctggtccggtgggccggctagccgcgaacgattactagccaactgggcctcgtggttcgcgagaggaagaaggccttctttgtttaggcctatgagctggaaagtctaagctcttaaggtgtgtttagttgagctctggctttgaaaaaaatatctgtgggctgtagttttcttaaacgattttgctatatctcactcgaaaatttttttcttatctctcactcgattttctcattcaaatttacagtgcattttcttgtaagttacagtgtaatttatgaaacttacactgtaacttttgtaagttacactgtaatttttgaatcttcacatgtaaattttaaattttgtattggatttggtctttttcttgaggatatggtaatttaatgttcattatggtgtttcttaattgctttttgctttttattatatctatcggattttaatataaagattaaaaatctgtgtgatacgattataaaaatctttcgaaagatgtataggtactcccttcttaaaagtagctggggaatatgtacggtggcttttggaaaagctcatttggttcaatagctgtggcttttgaaataactagtcccgctgacagcgacccccacatgtcatacacacgttgaaataaaagaagagggagagatggatatggcaacggcggtgtcgtcggcctcagcggtggcagcggcgtctcggcgaggaggagcggtagcggcggttcagcgacgaagaggacgcacggtggtgaggagcggtggcgccaggaggatgaggcagtggtgacgccaccgctgtcggccacctcaccaccttcgtctcccacctccatggccgacgagcgaaggggcggcggcgtcgggaggaggaggcgtcggtcggggaagggcgggagcggcgctggcgtcgcgttgaccggcgtctgttgaggaagggcgggggcggcatcgatcagggaaggacgggagctgcgccggcgtcgggttgggcgtcgtcggttggggaagggcgggggctgcgccgacatcaggttgggcggcgtcggttggggaagggcgggggcggcgccgatggcggacacccaatgcgcccgatggccgacgctcgccccatgaagtcacgactcgcgagaaggaggagacgaggaaaagaatatcggaccgttttttcataatggcagaggtgggtaatttttccctcaaaagcacttggagcaaaagcacttatgcttttgggtcctttggttgactcttgacttttgcaaaaggaaaagcaggttgaaaagtccaaccaaacacacccctagtgtatatttatagttaactattgtataaattaactattagattgactatagattatttgaagcttatagtaggctcttaaccttatgagctggaaagtctaagcttaacaaatatgcagttctttcgtttgtactcatcatcaaaaattatgttgaagaagtttttttttcttacgctagatagagttatgaccctactattaaacttagtacttcaatccattagcctataaatcatataaactaaaaaggcgacttaaaaatccaagaaaaaattccctaaataaagaggctctaagtatatttttcttccctcatctcttgcttctaattgaattgtctccttcaatagtaaaattcggatataataagtttgatcacggttaatttaacacatcagtagaaaatcgattttcaaaccatcaaaggagtcgatttataccggtttttgaagttggagagtgcgatatacccggttttgcggttgattgatgcaatttgaccgaggtctttcaaattagacttattttctttgctagagggaggaaaaatgggccttactggtccaaatttagctagattaatgggccggacgtgtactgtaactggccagcccagtcactcgcatcgtcgactacctcttgccatcggttctcccgggaagttttgcggcggcctagggttttagcattctcacctcagcggcggcggcggcgggggacaccggattttccgctccgatgcctcgtcagcacgcgccggcgttcacgccggaggcggcgtcggcgtcggccaccggcggggccggggagcggcagagcctcccggcgctgcaggcgaagatgaagcgcgacccggaggggtacgaggaggagctccgccagctgcggcgccacttcgagtcatcggtgttcctcttccggcagcaggcggcactggcctccacgtcctcgtccggcggcggaggggaggtggccaaggagctcggcgacctcgcgctgttcctcgcccacgtcgcgcccttctacccggacgacctcgctgacttgcccgaccagattggtggcctgcttgacaccaacgcgcgcgcgctgccgtccgggctccgtgtgcacctcgtgcaggcgctgatactactggtgaatcggaaggtgacgcctgtttagttcatctgttcatttcacattaagttaaattttgttcaaatcgtgtggattggaacgggattatcgtatgactgtagagtaaattctcctcgtatacattgctttttgatgtttagattgttgatctggaggacacaatggagttatttatggagcttcaagttataggggaccgggctgtcaaaaaactagcattctcacatattgtacacagtatcaggagaatgaatcagacccacaagaatgaagccaggaatcgtaaactgcaaaacatccttttcacattcctacaggtttgtgacataccactataccacacttgcactgattagtattatcgggtttaacatagtggcaagaatacattcatgattctcttcctacctcgtttagttatgcatcttgcttcgctgtttcccagggcgaggaagagtcgagagcaaagagggcctttactattctatgtgatcttcaccgtcggagggtctggtttgatgaccgcacagcaaatgctatatgcaatgcttgtttccatggttcttctaggtacatactgccagcatctttgtgtttattaataggtgttgatctaaaatatatcttttacatgcagaattatgatagccgctatttcattccttcttgggtatgaaaacgttgagcaagaagatgatagtgatgcatccagcagtgaagatgaagctcaaaaccctcaaattattcttagtaaagaggatgtttacaaggttatttgaatttttaccattatttcgatttatagtgttttacatcttttttctgttacgtgccttctgatataatgtattttattgtcatattactttctcaggcaaatcacaagggcactgctgctactaagaaaaagaagaaagctaaattgcagcgtgtgattcgtagtatgaaaaggcaacaacgtaaatccactgaggacactggctccaattattattcaccactgacgtatttaaaggatcctcaggtgggaaatggtgtaatcccataattgttcagagtgttatcatttacatattgactgttatattgaagctttcgttttttggctgacagggttttgctgagaagctcttctctcggctccagaaatgcaatgagcggtttgaggttggccccattccttgttctgaagattccttgttctgtaaagatttaaaaagttatatataattgtcagaactatcattacttagtacttttagctttctgctgaagttttatacatgagtgtatatagttggaaccagcattcaagtaggagaattggaacccagatgtgcaatagtttattttttaaacacaatgtctgttgtgagttccatccgatggttaaacgaaaataaacgttaattcaaatttagagaatgttggttgggtgcttgcaggtaaggatgatgatgttaaaggttatagcgaggactattgggctgcatcacttggttttgttgaacttctatccatatcttcaaagatacgttcaggtatgttcttaacttggcatgtgttcttcttgtagcaaccttatggtagatataatgtttatctatactctatactaatataaaagatggtagtggtggtggacccacggactgtgagttgcgtatctcttagcccccacatgccatagatcccgtcgaaaggaaaatatgacaatagaatattatgaaaattttcatctttacgaaatgacagcaaaattagcataatgataatataatagacaattagaaaaaaaaaccgttgcacctcacgtgcattatactagttcatactagttttgataataagttttctacctttctgtgatgcagcctcatcaacgagatgtaacaactttacttgctgcagcagtacaggcttgccatgatatggttgaaacacttttgctcttctcctatatttcactacttatatcatttcttttgctttgtccaaattcagctaaattaatatgcttcaatttcaggtgcctcctgatgcagttgaaccactgtttaagcagatagtaaatcaatttgtgcatgatcgttctcgcccagaggtttgcataacactcatcacatatctaatatatttaagtattttccaactaacatggcatatttctaaccaatctcattttaggctattgctgttggcttgaatgttgtgcgagagatctgcatgagaatacctttggtacttaccttgctcaaatctgtactcttgctttctagtgctactgacctctgaccagacaccccttaaatttgtgtgatggattcattaaatttttatggtggtcatgttttgttgtacctaattcctgtgccctggacatgctctagtagaaattgtgatttcatttttttactagtcttaaatgactggttgcgtagtccaaactccaaaaggatgtgatagtcgattgctacaggttttaagcatataagtgtaacttaatgaagaattgaaaaggtataaacatggttttaccaggccacatttagtcttgtgtagcctgacacgttagtcacttatgcatgagaagttgagaacacacatgcaggtttgtatactacattaccacctgaggtactgtgcgggttgtaagatatttaggaagatattcttggtctatttattttattcatctagcaggcctctgttaatccttctgttatacctgcagttgatgaatgaagatctactccaggaccttgttttatacaaaaagtcccatgaaaaagctgtttccattgccgctcgttctctaattactttattccgggaggtcagttcttatccttttgcatattctgtgatttctttttgttcacttcagctaaaccttcttttggtttgggttcagatctgtccttctctgctagtcaagaaagatcgtgggcgtcctgctgatccgaaggctcgaccaaaagcattcggcgaagcaactatcgcttctgatgtgcctggagctgagttgctagatgaagatttttcatcagaaggggaaggctcagacgatgagtctgatgcttttgattctaatgatgagaaagagttgcaatctgctcgtggtactaaacaaaatttggatggttcgtctgaagcaaacaagcttgacacagatgaaggtatgaaagaggaagatcaactatctggggatgaagatgatacagaggaactagatgaggatcaagacatctctgacaatgatagtgaagaaaatgatgatgagctagaattggactctgatatggatgaggagaatgatgtatctgaatctgatgatgatgaggaactcagtgagaaattggatgattctgatgaaggctctgatcaggatgatgacagtgaccaggatgataagtcaaaaaacagcagtcgcaaggcaaataagagaaagttgagtgattatatagggcaacttaatgctgcagatgcaagccttcgagctctgaagaagttggcaggagccaagaaggctgaagcttcgtgcgatgaagctggtaaaatcttatctgatgaagattttaagcgtattaaggagctaaaggtatgggagttttttccagctgtagttcatgctgtggagctttcttttgggaaagaaagtgaagttgtgtatatctgacattgttatgagtttcaggcaaaaaaagaagcaaaactggctctggcacaacatggactcggcaagggccatgacacaaaatcagtaacctttaaaatgccttcttctgatcagcttagtctgaaacgggttgacccatccaagcttgaggtgcattttctctcttcccctcccgcattgcactcgtgccagcgcgctcatgcacacacatccacactttgcttatatgaacatcttcctttatgtaggctcacataaagagaaagcttacgaaagaggagagattagaaatggtgaaggctggaagagaggatagaggaaaataccaagcaagaacagctgtgaaacagaaaaaggtattcgtttatatgatcctcctttttggtgcttattttgacctatgttggctatatggcacaaccttgtgaaatctgatcatgaattgttctttcgtagttgcttttattccttctctacttatatgcttctcattgcgttttagaccggtggcttgagcaataggcagaaacaacacaagaagaaaatgcccctcgctgcaagcagagcgaaggcagcgcgttctcgacaggagaagaaaaaactgcaaaagcgctcgggaaagcaattcagaggacggaaggcgtggaaatgagggattttttgtacttgcgtttgccaattcttgtggtctactggccaaaattttgactccttcagttaatgattttcgtatacaaatatggtttcacaaaccgtgtatcatcgatttttcaagtgctggtgtattcttttgtgagtggagagaatgaagccggtatatcatcgctcacagtggttgctctatgaatttggacagtactcgtatccagaaggttcagcatcacgtgtcctcctggcccagtgtctatacgttgcagtgactccagcgagagccacaattacgatatgataaatgctgtctctgtttctgctttgatgagactgtttcgattaggccagcaacctcacctctcctatataggctgtgtttatttcagcgtaaattttggattttggttaaaattagagatgatgtggctgaaaagttatgtgtatgacaggttgacgtgatgaaaaagaattgaagtttagatccaaactttggatctatacacacagacggattcagatcatgcgcagttatagctattactgcaacttatattctgtgctacagtatttatgctacagtacgatgaatagtgcacctcgctgatctggaccgttccatctacatccgttgatgaaaactggtaccgcctaaattgcagtcccagtagcgactgcagctgatccggattcaacacggacatagtacaccctcttgttgcttcgatgagactggtccttagcacaatcatcaaaccactaccattatatcagtgcttggtgttctattgggttaaggaattctcgatcgttctctgctagtaggaaatcgagccgactgaccagcgatgtcggcggttgagaggaagacggcgtgcgtcaccggcggcaacgggtacatcgcttcggcgctcatcaagatgctgctgcagaagggatgtgctgtcaacacgacagtcagaaaccccggtgagattcttcttcttcagttcataatttcgtgcatactcgtgcatagatttgcagtagcatcagtggttttaacctcgtttttcttttctttttttttttaaaaaggaatttggttttagcctctgaaactgctgctacacattgcaattttgagtcgcagaaaacatggagaagaactcccacttcaaggacttgcacgcacttggtcccctggcggtcttccgcgccgacttggaggaggaaggcagcttcgacgaggcggtcgccggctgtgattacgccttcctcgtcgctgctccggtgaacctcaagtcagagaaccctcaggtattacatagccgtctacaacaatttgattaagtttatagaaaatttaataatatttataacatcaaattagtttcattaaaaataactttgaatgtatttagatggtatgtttgttatatgtgagaaatgttctgtattttttttatgaacttatcataataaaacataattagaaaagagttaaatcatcttatagtataaaacggaggaaggggaaacatattttaagattatctttatggatttagctagatggtggttgccactcctcaagtctcttatggttgccaggccattaatgatactaagtattcctccataaaaatgtctctttgcacttcactcttcattgttggcttatgcttacatttacaagctaacatttaaaatttagaacttaattttaagtttgatctttttctcatcatagtttatttttatttactaataagcgatttaaataagcgaaacaatgctactttctgttgcgatgacacagacacatacacagaatcacatacacgcactccttctgtctcatagaaaccaatcagtactagatgtgacatatcctaatactatgaatctgaatatatctctatccagattcgttatactaaatgtatcataatcagttatagattttttttttgtacgaagggagtagttttgttttttacttggtcagcctgatggtaatgacagaaagaactggtggaagccggtgtacgaggcactctgaacgtgatgaggtcgtgcgtgagagccggcacggtgaggcgcgtggtcctcacatcgtcggcggccgccgtctccggcaggccgctgcaaggcgacggccatgtcctcgacgagtcgtcatggtccgacgtcgactacctcagctcaccagccaacaagacatctcccggaaaggtacacacaaaattacagattttatttaacacaggtcagtcaatcagaggctcagagcccattaaatcggccacatgagaacagctccgtgtgctgatgcaatcagcgtttacaatttcggttcgaaatttccggcaagcatttacttcatccaaatatttcatattttttttaatttagaaaaaaatatttaaattcggtcaagatttgtttaaatttcaaacttttttgggtccctgatagatttgtgcatatcgaaaatattaagacatggatgcaatgcaggcgtactcgctttcgaaggttctttcagagaaggaagcgagcagggtcgcggaggagaacggcatcagcctggtgaccgtttgcccggtggtcaccgttggcccggcgccggcagcggaggccaaaccgtgcgtcgccgccgtcctctccttgctctccggtgataactaatcgaatcaagaaccggccggtccatggcaaatgcggcaacgaaaagcaattcctgtgaaatttatttgttcatctcttgattttctttcaggcgaccaggagatgatcagcaccgtgaagctcatggagaaggccaccggcgggctaatgctggtccacgtcgacgacctctgccgcgccgagatattcctcgccgagaagccgccgccggcggcggcggcggcggcggcggagaggtacatctgctgcggcctcagcgccaccatgctgcagctcgcccgcttcctggcggccaaatacccggagtacaatgtcgacgtcgccgcgtaagatcgagctgatctcactgagtaataattccccatgcgtctccatgatcttatcgagagctctgacgatggtgaactttcatgcagcctcggcgacctcccggagaagccgaggatccgcctctcgtcggagaagctcgccggagaagggttcgagttcaagaacaggacgctggacgagatgtacgatgatgccttcttggagtacggtagagccctcgggattctgccatactgataacgatgttgttcccctcgtatatcatctgtttctctggtggtgattgttagactttgctctaggatcacctaggttagatctagtcgggtggttctatttgggtttgatgaacgacattgtagatgaaagggagagggtttagataccgaccggttgaggagttcgtggaggaagaggcgccggacatcgtcgttgtcgtcgcggcttgacgtggatgcggcgccggtgaggtcgacggtgatgacggctgcggcagtggtggtcgtagacgtcccggcgatgaggcgtggcgcggcggtggcgtttcccgtcactggctgcgccccctctcgatcggattagggttttgtggggtggagt

SEQ ID NO: 43304 - DNA, 823 bp, Oryza sativa
tcctcctctgccgccgccgccgcctcgcctcgcatactccgccgcaccccgccgccgctagccgcctcatcccccgccgctcgcctccaccgccgccgccgctccctgtcgcccgcctgcctccgtgtgcgtgagtgagaagagagtgagagaagagggagataagagagagaggggaatagttggataggagtatgacaagtgggttccatatttttttaataaataaaatactgactggactaccagcgtatgccacatagaccaaaaccaccgcggattaggtcgaggggggtaattcgtctgatttacatagttcggggtgaagaatatccagttttatggttcagggaggtaattcagacgaccgctatagttcggggggtgattcgtactttttccaaaaaataaataataattaccgatcgattaattcattcttatttaattgtggtattggttggtctcaatctacccattgactgttcatgcagtagtgactgcagatctgtggttatgtttccaactgttcatgataagaacaaacacagttgctgggattaatacacagacaaagtggccacaatctttgtgtttgttcttcatgtatcctaacaaaactgaggttcttttacatggttcaattatgtgtaagattttacttgcgaacgagtaaattagaggttaattaagaagagatgatttatgcttacaagtcgtcgagaaccttggaggcgacgaggaagccagccaagaagaagccgttgaccgttccggaagcccccgccgccgccgggccgccgttgcccccccatgtcacgta

SEQ ID NO: 43305 - DNA, 11481 bp, Oryza sativa
  unsure (1)..(11481): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggagaagaagtcttaggtggagtcctggcttataccccagttgagcgcctgtgaagatggagccgtaggcccgctagtccgctgctgtttatttttgtttgtcaggcctgaagtgcctttgtaataatgtaaatattatcgatataataaagatgtgtcttttataccatgtttgtgtggtgtaccccggcttttcctgggacggggattaatacactggcgttcgggaaaaggcaattttcccggtcgcgacacagactacccggggcggtccgtcttctttctcccttttgcaatggcagggctggttccgctattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttctttaccgtgcagtcggtgtcgccgccatcggtagtcggtggctgctacttccagccacgggggccggcgctgaaccgctacatcccctgcgccctccgcaagaagtgggacgactggaagagcgattggttctacactcccctcgccgacgaagcgcgcctccgacttccgagccagcccccggcgcaggcctccagttggcgggcgccggtagatctgggggatggctatgacgctgtcctcgaccgcctggcgggcctgcgatcccaggggctcacaggggccatggtgtatggcgactacctccgtcgtcggattgcgccgctccagcggcgcgctcggggcgcctgggagtacaccgggtccgaagactacatgaggacccaccagggagtgagatgggactgggctcctgaggacttcaagatattggtccaacgggtgctgaatctcaactccgtggaggcggccctcattccccaaggaatcctccccctctgcagcgatccagaccgcgcctccatcttgaccattatgacggcagtcggggcctcagaggagggagctccaaagggccacgacggcgcaggcgggagccgcaagggggatcaatctaccccaggagggggtcgtgcttctgggccccgcgtcaggggctcggggagcaaccgccctatcgacgaccgggggaagaggaagctgggacgaacacctcccccatctcctccccgagggggcggggcagtgcgtgccagcagcaggcgcccggagggggccgcgccaacatcacagcccgagggggagcgcaagaagaaacggctccgcaagatgggggagacagaaccatctcggggaaacctcatctcccctccaaagtggtcgttcaaccgaccccctcgcaggttcatctctcactcatcgtggctgtatccattctcttcaacgcgagttttcactcacccgtctttgttcgtcttctggtcttttcttctgttttagcgagatcccgtcgcgtccctcccgtcattccaagtctggccaatctgaggccgaggatccggcggccgcagaggcacggaggcgagaatctgaccggcgagaggccgcagatcgcctacgggaagctgaagaggccgcccgggaggccgcccgggctcgccaggctgaggataccgctcgggaggaggccgcccgagcccaccaggccgaggaagccgctcgggagaaagccggatttcgccaggacgaggcaatggtttcttccgaggcagctcgcgacgaggtcgcgggcgcatcgcttgggcccactccctcgggcgacgctcaggcgacaacttccggggcagctggcgacgaggctgcgggcgcgtcgcctgggcccactccttcgggcgacgcccaggaccaaacaggtccggggaacatccccgagtccggcacgtccattggcgggccgagccgcgcgacatcttctccaaggcagctcttccccacgccttccgtcgccccgctgagcgcagagccccttctgcaggccttagccgccgcaaacaccgcggtgttggatgggttaagtgcccaggtggaggccctgcaggcggagcgtgcggagctcgacgccgcatgggcgcgtgtcgaggaggggcggcgatcggtggaggccatggtggaagcgggccgcaaggcacaccgccggcacgtctcagatcttgaagcccgtaagacggcgctggcggagatcgctcaagaggtggaggaggagcggggggctgccctcatcgccaccaccgtgatgaacgaggcgcaggacaccctccgccttcaatacgggagctgggaggcggagctaaagaaaaagctcgacgccgcccagggggtccttgatgccgccgctgcccgagagcagcgagcaacggagaccgaaacggcgctccggcggcgtgaagaggcccttgaggcgcgtgccatggcgctggaagagcgcgcctgcgtcgtggagaaggacctggcggaccgcgaggccgccgtcgccatccgggaggcaacgctggcggcgcacgagtctgcctgcgccgaagaggagtctgcactccgcctccgcgaggacgcgcttaccgagcgggagcgagctctcgaagaggccgaggccgcggcgcaacggttgacggacagcctgtccctccgtgaggcagcgctggcggagcaggcacgccgcaatctagaatgtgtccgcgccgagagggccgcactggaccagcgggccgctgacctcgaggcgcgggagaaggagctggactcgagggcacgcagcggcggggcggctgcgggcgaaagtgacttagccacccgcctcgcagctaccgaactcaccatcgccgacatgcagcgcgcgctagactcatccgccggggaagccgaggccctccgcttggcgggcgagatagggcccggcatgctttgggatgcagtctcccatctggatcgcgccggtcggcaggcgggcctctggaaaggccagacaatgaagtactccaccaaccagggaggcctcgctcagcacctctcgaagatggccggggctctccagcagctccccgaggagctcgagaagaccgtcaagtcatcctcgagggacctcgcccaaggagcggtggagctcgtcctggcgagctaccaggccagggaccccaacttctctccgtggatggcgctggatgagttccctcctgggactgaagacagcgcgcgcgcgcaggtccgggatgccgccgaccacatcgtccacagcttcgagggctcggcccctcggctcgcgttcgcccccaactccgacgaggagggcgacgccagcggtgcagacgacagtgacgacgaggccggcgacccgggcgcatcggattgagcccccaggcccccgctaatctctagttttttctttttctttcttctaaggccttcaggcctcttttttgtatagatcaacttaatctgcaatcaaaaatgatgaaaatttttgtgttaattttactttgctatacaaatgagatgaggatgatctgtgccgtggtccttttgtgtcttagcttgatttaaggactcgtgcccaagtcccagtcctcgaaaggcgcgggtcggggctagtgcctggggagatccacatgtcgaggctggccaggccgggaacgtggtgaccgagggttatgggtgacccgattgtgggtttttgccgattcccccccccggagttcaccacgccccagggcacggctcggttctgggccccgtttggcgattttagctgaccgaaccgagcccccgagggcaaggttgagcacgagtgatcttatttcaagtcaaaattcttcaaaaaggaaaaaacggcacagatacagcccttaggaaattgaaactgcttttattgaaatactgaaataagagaaaagagaatgtgcatgtgtggtagcccccggccaaccatgcacacccgagggggggggtacggggttggcccgagcccgaaacctgacacccgacccccccctcaggggtagaagcgacgaaggtgctcgatgttccatgggttaggcaactcagtgccgtcgcccatggccagccgtatggagcccggccgggggacgccgatcactcgatacggaccctcccacattggtgagagcttgctcaatctagcacgcgtttggacgcggcgtaagacgaggtcgtcgacgcagagtgatcgggcccggacgtggcgctgatggtagcgccgcaggctctgctggtagcgtgcggctcggagggccgcacgccgccttcgttcttccaagtagtcgaggtcatctctacaaagctgatcttgatcagcctcgcagtacatggtggcccgaggagacctcagggtgagctcggatgggagaaccgcttctgcgccgtagacgaggaagaaaggcgtttccccggttgctcggcttggtgtggttcggttcgcctagagcaccgctggcaactcctcgatccatgaatcgccgtgtttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagtccccagacagcaaatggccacgaaagtggtatggtctgcagggcctgggccggctgatggatttgcttggcgtggaattgacacgctctacatcggtggaccaggtcgaccgcatcattgagagctgtcggccaatagaaaccttggcgaaaagctttaccaaccaaggtgcgcgaggcggagtgtgctccgcattcgccttcatggatatcggcaagaagcacaacgccttgttcccgaggagtgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagctgggagcactcccctcgggtcccgaggcctggactccgacgggcctcgggggccggttaggcgcatccgtctcccctaaggggtcgggtcgcgccgacggctgggcaagcctttcttcaaaggcgcccggtggggtctgggctcgcgaggacgcgagccgtgagagctcgtcggccatcatgttatcccgtctgggaacgtgccgaagctcaatcccgtcaaaatggcgctccatacgccgtacttggcgcacgtaggcgtccatctgcgagtcagagcaccggtactccttacagacttggttaacgaccagctgggaatcgcctaacaccaggaggcggcggatccccagtccagctgccactctgagtccggcaaggagtccctcgtactctgccatattattggtcgctcgaaagtcgaggcggaccaagtatttgaggacgtctccactcggagaggtcaacgtgacccccgcaccggcgccctgaagagacagggagccgtcgaactgcatcacccagtgggcggtgtgaggcagctgcgagggacccgagccggtttcggggaccgagacgagctcgggagccggggtccattctgccacaaagtcggcgagggcctggctcttgatagcgtggcgtggttcaaagtgcaaatcaaactcagaaagttcgattgcccatttcaccacccgtccagtaccctctcgattatgcaagatttgaccgagggggtaagacgtaaccacagtgacccgatgcgcctggaaataatggcgcagtttcctcgaggccatcagaacagcgtaaagcattttctgggcctgagggtatcgggtcttggcatcccggagggcctcactaacaaagtagacgggccgctgcacctttcggtggggccgatccttttcgctaggggccgcatccctggggcgctcttcacccgagcggcctcgcggggcgcactcgtcttctgtgccgacgacctcggggtcggaggacgacgggggcggccttcccacagtggcttcggggccgtcctgggggtcgggggcccctggcgtcgtcggacaagcgggcagagggccatctccggtcgtcgggagccttgggccaccgttctgctcgggggcctctcctccctgctctctcccgggccaaatcggcacagggttagcctcggggtcagagggcgataggtgcggccttcccgcagtggcctcggggccttcctgggggtcgggggctcctagcaccgtctgacaagcgggcagagggccatctccggtcgtcgggggccttgggccaccgttcggctcgggggcctctcctccctgctctctcccgggccaagtcggcacaaggtgggggtgcgcggaatgaggattgtcctcatcgcgttccacgaccaacgccgcactaaccacttgcggggtcgccgctaagtagagtagcaagggttcatttggctctggggcgaccagaactgggggagagctgagatacaccttcaactgagtgagggcacgttcagcctcctccgtccaagtaaacggcccggagcgtttgaggagcttaaataagggtaacgccttctctcccagcctcgatatgaaccgacttagggcgaccatgcaaccggtgacgcattgcacatccctaagcttgctgggggggcgcatccgctctatagctcgtatcttctcggggttggcctcgatgcctcgggcagagaccaagaacccgagaagcttgcccgtaggtacaccgaacacgcacttatcggggttcagttttatgcgggcggagcggaggctctcaaaagtttccgctagatctgaaagtaacgtttcctggttgcgcgtctttacaaccaagtcatcgacataagcctcaacattacgtcctaattggctacccaaagaaattcgagtagtacgttgaaaagtaggacctgcattctttaacccgaagggcattgtcgtataacaataagttcctatgggggtaatgaacgcagttttttcctcatcctccctagccatgcgaatttgatgataaccagagtatgcatctagaaaacacaaaaggtcgcaccccgctgtggagtcgacaatctgatctatgcgaggcagggggtaaggatccttaggacatgccttgttaaggtcggtgtagtcgatgcacattcgaagcttgccgttcgccttgggaacgaccaccgggttcgccagccactccggatggatgacctcgcggatgaatccggcctccagaagtcacgccacctcctcgcggatgaaggcttgacgttccggggcctggcgccgcactttctgccggaccggccttgcgcccggccgtacggcgagacggtgctcaatcacctccctggggaccccgggcatatccgccggtctccatgcgaagacgtcagcgtttgcccgcaggaaagagacgagcgcgtcttcctatttgccatccaagagaccaccgatccgtgtggtcttggacgggccgtcgcccaggacaacctccttgactgggacctcatcgcacgtgactatccgctgcctcggggcggcgggggcggatgtgccaagcctctcgtcgccaccctcgggcttggacacgacggcgaggcggtccgcgcgctgctccatacaagcgagcgcgactttgaggtcgccatggacagagatggggccatcggggcccggcatcttcatctggaggtaggcgtagtggaccgccgccatgaacttcaccaacgcgggcctccccaggaccgcgttgtagggcagactgaggtccgccacatcgaagttcactcgctccgtgcggaaattggcgggtccaccgaaggtgaccgggaggtcgatatgacctagcggccaagtgtgccccggcgtcacaccgatgattggctgggacggccggagcatcatccccggggccttgatggcatcaaaggctgcgggggaaaggatgttgagggctgctcctccatcaatgaggacacgccccaacttcacgttgcaaacggtgggagaaaccaccatcgcaatctgccctccccgggcaacgcacggtgggtggtcggtctggtcgaaagttagggcaacctccgaccaccgcgcccggcgcgtcgcctcatgagtaggggccgcggccagaagctctcgcttcatggccttgaggctccggcgagaaatgtgagcacacgctcctccatcgacagtggcaatggtggccccaggctcttggaaacctaggtcatcatcgccgtcgtcgatgtcctcggcgggggccttcttcttggcctcacttcgccgattgccggaaggaaccgccggggacttgccctctcggcgctcctgcctcctctcttcctcccacttcctcgtccgctcagccaaacttttgactgcacggcagtccgcgaggtcgtgaagggaagtgttgtggacggtgcaccacttgccggctgggcgctccctgctgggagcgccggcctttttctttttgtcgctcgctggcctccccttttgggtggcccgcgaagcgccctcgacggcgaggacatgaccctcgtcgtcggaatggactgacctcttcttcctcctcctgtcacgccgccctgtctgagcggcggatccgggggcggccgaagctgccactccggaaccggaggggttccaggtccatgcctcctccttacgagccactcggtccgcgagctgaaaaagctccgcggtagtctggggctctttggaggcgatcttttcgagcatgcggttgtgccgcacgccccccctgaacgcgtagattaccgcgtgtgcagggatgcatggtatggtattgcggacttgacagaaccgctgaatgtacgatcgaagtgactcatcgtcccttcgctgtactgcgtgcaagtccgcttcctcaccggggcgcggatatgtgccttggaagttcatggtgaactgttggcacaaatcctcccaagagtggacagatgcaggtggcaagttcattagccaaccccgcgcctgccccttcagggccatgggaaagaaattcgccatgaccctgtcgtcacccccggcggcctcaatcccggtcgtgtagacctggagaaactcggcggggttgatgctgccgtcatatttttcggcgatggtgggccggaaccttgggggccaacggacattccgaagactcgccacaaaggctctacagccgacaccaccaaccgggggcacggagggctgattcccacgtccgtgtcgaggtgacactctggacgaggaagcgccctccgttgcgtgggcagcacttcggtcattacgccggcgctcgatgctggtgcgggcgtcctgctccccacgcagatcttcccgggtcgaaggagtcgacgaaggagtgacggccgaacggcgaacagcggctgccgctcgtcgtgccctccgtcttgacgacgcggagccggtggtagcagcaccagaggccttggtggcggaggaccgcccaccagcatctaggcgctgccgcgccgtcatgaccaatttggccacgtcgtccagccatcgttgggctggagactccgggtcagggacgacaggcgggtggcgtaagagcgcgcccgtagcttggagcgcgccctggggcgtgctgccgtcgccgtagacgaggaggcgacgctccccatctcgccgttcttttccatcgcccgcgatcggtgaagtcgcggatctttcgaccctctcgagcgcctccccccgcttaggactttggcgtggagggggcggtggagtacgagctcgacggcgtgggttcggctccccgtcgtcgccactcacactcggagagaggtcgtgcgcctttgcttgctcagccatgaggctgaacaggaaaagcttggtgcacacgaaagagcgcaagagctcagaagatcactcgcagagtcccctacctggcgcgccagatgacggagcgtggggctcctcaccgggagaccgcgctggcccccctttgccggttcggccggggaccctgggtgagactctaagctcccaatctgtatgtggaaggttcgcgagaccggaagcacagaagacaccggcgatgtatacaggttcgggccgctgagaagcgtaataccctactcctgtgttttggtggatctgtgtatgaagcagctacaaagtgtgagccaacctctcccttgttctaggttccgaatctggaaaaaatcaatccaagaaaaagctcccccttctctcagtggtcaaggtcctccttttatatcttaaggggataccacatgcaccatttccctcttttttctgtggggatttcccccaccttctcagaaatagacggagatttgcatggttgccgttcgagtcaccttctgatggaacggcccgcacctacctccactttcgccgggagcaggcgcgacgtagaatcatggctgtctgctggcgacatgaccggtgtcagaatggtcacaaatcggtcattcttgtccaccacgcgtcagcttagctatctgcacgttggctctccttcacactacattttgcctgtaatggttaggatgaagcctggcatatatctgatcagggctaacgtgccatctctgggaggtaacacgctagctccagctggggacgagcgcctagaagccctcgacctgacgggatggggcgaggcgtgcgtcagaccgcctgccgccacctaacccgcgatctgaccggtctgtgactggtcacagaccggataaacgagtgcactgcactgcgctacatgcggtgtgacacgctcagccaaaccgcaattaatgtggttag

SEQ ID NO: 43306 - DNA, 10906 bp, Oryza sativa
ctaacccatacacgcggagcgaaaacccacgaggggtcggggcgcctcggccctcggggccgaggggggtgcagcccgaccccatcggggggactaagaggagggcgaacacatcaccctcgggcccgacgtcccccgagggtgccaggccacgtgggcgattgtgtctgcctcaaacctctagtcatgatactcccgatcccatgtcaccgacaacctgatttaagtatacatcgacataagaattatatatcgttaatatctacagccgatcaagtagatttagtttttccttactcattcacgattgccgatcgatacacagatgacatcggctcggatataaatgatatgtcatcggcatctggccgatcggctatcatttatagatttaaccacggttcttttgtctttatttcttgttgattgcaggatcaaatcaactgacacgctcacacatccgaaggcgagttttggacctgcactggagttaagtagatctcccaggcctcgtgttttctgtcaacagccaccccttctccccaccgaccaccgccctcctccacgctgtccgtcggccgttgcgcctggagggaggagaagagagaggagagagatacaatgaagagagggagatggggagagaggtggaagaagaggattgtgagaatgacatgtggggctcacgtgggccccaccggtcttaattatttttttctaactaacatgtaggctaacagtttttattattttccaaattaaattgccacgtaaatgccacgacaatgccacgttatccaaaaacctaattaaattagccacgtaggtgccacgtcagcgaaaaatgagaacaatgttggtgatggatcttgtttgcactggttttgtaagttgagggacccatcatacctagtttttccagtacaaggacgaaaatcagattcaaattaagggactttaaatgaacttattctaaatttgctatgggccaccttgtttacgggttagagagcccataacaataatggttaattggatccagccatgcatcgagcctttttatagatcgcaagtggtctcaaaggtgtggtttttaaaatgggattggtgctggagcactcattggtgccgcatccctagtgtcggttgagaaaaccgataccttaagaggtttttcacatgttctgtggtagtgaaagggtccgtatcataaagagattaccataccgtaacacacaacaatgacttatttcacaagacaagaggactaacaatttcacaagagaatttttatgtccaaaactccaaattgacggagcaaccatcaattcagtgcggtagaatccccagggccttgccgtactcgacgaggtcgccgaatatctcgtccagatccgtccacttgaactcgaacccttccctcgtcagcttctccgacgaatagcacactctcggcttctcagggaacccttcgaaactacgagcaaacaaagattatcgctggctcatcaggttctctcaagaaatgcatgtgtcgatcgatcagtcacttgaaagttgaaactgaaagtgccagttcgtgtatatgtaccagtcggtttggacgttgtactgagggtattttgctgccgcgaaacgtgcgagcgccatcacggtggtgctgaggctgctgcagatgtacctccccgacgccgactccttctccgcgaggaatatctcggcgcggcagacgtcgtccacgtgaaccaccggaatggagccggtggccgccaggcctttcagggtttttagctgcgcctcatcacctgaaaaagaaacaacgtcaatcgtaacacataatggaagtacatactctcttaattctaaaataaacaaatcaaatataaaatgtgatatatcttgaatctgaacaaataaaagagtagcttcttaaatttgacgtatgtttctcaggctctcaccagacagcaaggagagcgtagttgggatgcttgttgtggtcaacggcgtcggcgccgcgcccaaggtgaacaccgggagcacggtgatgaggctgatgtcgttctcctccgcgaatttgcacgccgccttctccaaaagcaccttcgagacaccatacgcctgcaaaacgcaaacgcaaaaacaatggggtgtgctagcatcagccagccgtcattttcatcagcccggtaaaaaatgtatatgaatgatttgatggaggaccaaaaaagaaaggagtagaatgtgacccaagatggtggcttctctctcgtcaggtagtcgacgtcggaccaggacgactcgtccaggacatggccgacgccgccttgcagcggacggagggcgacggcggccgccgacgatgtcagaatcacgcgcttcaccgtgccggctctcaggcacgatctcatcacgttcagggttccttggacgccggcttcaatcatctctttctgccatcaaacgttggcaggaaacccagcttaatttgtcatcgtagaagttaagagcaaattaatttcagtactagagactaaagagcatgcttatcatcagatgacacaagacaactgtcaactgtgacgtcgattagagaaaaccggattaattagctaagctagctgttcacctcaggattctctgactggagattcaccggagcggcgacgaggaaggcgtaatcgcagccgttgacggcttcatcgaagctgccatcttcgtcaaggtcggcacggaagaccttcaaggtgcctagtgcctccaaccccttgagatgggaattcttcctcatgtcatctgaatacacaagagtaggatcgtcagatgtgaaactgaactctgaaaattcgtagcgttgtcttgagaattgagatcataaagatttgcatccatcgtttccagcatatgtcactatatcagttggaacatataaagattttctatatggtgcagatagaagaactttttctattgttcatgacgacagttcagcaaataaactacctctgaccaaaagatttttgaatctgaatgggagaaagactgtggccctgtttagatttcatttttcttctttaaactttcaactttttcgtcacatcgaactttcctacatacataaatttctaactttttcattacatcgttctaatttcattgaacttctaattttggcatgaaactaatcacagcctgtaactgaaatcatgaacaacaaaaaagggggaagaatctcaccagggtttctgactgtcgtgttgacagcatatcccttctgaagcagcatcttgatgagcgccgaagcgatatacccgttcccgccggtcacgcacgccgtcttcatcccaaccgctgacatcgccgtgccgccggctacttcgtcccctccaggctccactacgtcctcctgagagaaatagcttactggaatgaagacggcggttgtaagagtacaagagtacagtcactgtcactgacgttcatctgataggatatgcttgtcagttgtcaccaataagaaatctttgttatttagatgcaaaggtatgtttgtattcagggagtaaactttattccatgtcacattggatatttggatgctaatttagagtattaaacatagaataattacaagactaattgcataaatgagagttaattcacgagacattttttaagcctaatcaattcataattagcacatgtttactatagcatcacatagactaatcatggattaattaggctcaatagattcatctcacgaattagtccagggttatgtaatgagttttgtcattagtctacgtttaatctatctattaatctaaagccagtggttatgccagcttttgattgggccacgtggcgcccctagcttatcaaataaatcatgaattttgtctaaggaaaaaaatacagaagatcaagcaaaatagaaaactacagtgttatgtgataattctaaaagcaagtagtaccttagcagtttcttttaagaaaaagttgtaccttaacaacacagcatccagaacatctagctgttcccacccggtaaaaaaaaaaatcagcttccagaagcttctaactgtacatcacttcgcaataaacatagagactttctagaaccactcaaatataaatcataatttaagataagtctagttaaagtatctagatccatagacttatacatctagattatagtcctttgcaacaacatcactcctagaggcattcaaatatccgatagaagaaaactcagaattattaaaaaaaaaaagggaaatccaataaaaaatatgagcaacagggtcctcagctatcgtatcaccgtgtagcaccaagtcaattgaccatttcaattcctccttttttcagtttccagttaccatcgtatcttatgaaccaagtgtacttcctccactaatataaaatattcccaatctttttcttagagagataagtatggagtgaaaaaactataatgccatttattaaataaaatatagttgaaaaatgacagaatggttagaagtaagacatgaagaaaattaaatcaagaggtgagtgatacgacacgcagtgctcaatttggcaggaccttccagcttttctgtagctaaagctcaacaaagttttttctgctctataaaaaagagagtggagcagactatagtgacctagaaaaatgaggggtggagtgaacacaaagaccgtcaataggccactacttaacttcaaattctacttctagcatttaggagttggatccttccacctaatatttgtggacatcaagagtattatggattattgagagcaagctttgtaagtttacgattttctgtaacttttttttattacaatcactcctttttttaaaaaaatattaatcttctaatatttttttcagagaaccttctattatttaactccacctactttctactttcttaatactttatagtatttaattatatcaaaaatttgttagaaactcaacatctataattaatcgtccaccagaaacatagagaacacacaatcccaaattaacattacaggagattatgctcagaacgatatgcaagagaatacaatatttaatggaacatagaagttgaacgaaatgctaaaaatatcttacaaaattttcatgtttcaaacacacgctaaacaatgtatcgggctataaagaaagtgtgccaaccggcacactaatgttctggtacttctaattagtgtccaaacatccgatgtgacatggcttaaagttttagtccctgatccaaacatttcaaattattttaggacgaggatgcaacactatgtgcggggttggaccatctatggaaagaaggatggaccatttacggaactgtccttacagaactgttcagttgatatgaaagtgggtggttgtttggttgatatctgattgaggagtactcctttcgtctcataaaaaatcaaccaagtatcgaatgtgacacatgctagttgttgacgagtactacaaataaaaaccaaatctatgaccggatgtatagatggccatccgggcggcacggcccaggcacggtcgtgtttaatgaaatatatttaatgtagtgtttaatgaaataaattttgtgttgtaaatgttgctaattttttctataaacttagtcaaaccttttactgaaaatgtttgacaaaaaaagttcaaaatgatttataatatgaaatggatgtagtattaactactataaatatgccaaatggttttattagattttttaaagaaacttaaaaacatgtccataatatacatcttttaacagtttatgaagcggctaaaaaaacaagtggcatccctaacagaccaacgaacggagccttaggtccctcaaaatggacatcccctaatttcttacgtatcaaccaaatgattcttgttaaatttttttataaaaaatatataaatgacatgcaagaacgaaggatatgctctaagggtattaaacttcattgccattatccactgtgtattaggctcatcttaaaacactgtactatttttttttctttaaaaacactgatcacttatttcgcaagcgcatactccagttcggtcctcgtgacagctaggttgaaggtagagcagcatcagctattcgttcaatgtggtagaattcccagggccctgccgtactctacaaggtcatcgagtatgtcgcccatattcgtgtacttgaactcgaacccttccctgatcagcttctccgacgaacagcagactctcggtttctcaggcatcccgtcgaagctgcaaagatacagagacgatcactcgctcgtcagatcgaacacaacaatatttatctattttggatttccaagttggtcaacaattcgatcgtaccggtcggttttgacgttgtactgcgggtaccttccggccatgaaacgggcaagcgccaagacggtggtgttgaagctgcagcagatgtacctcgccgacgactctgccgacgacaatgacgatgactccttctcggcgaggaatatctcggcgcggcagaggtcgtcgacgtgaacgatcgacacggagccggtgacccactgcaggggcttcaggacttcgagatgcgtctcatcacctgagaagtagtagtaaaaaaacagcagccaacttaaactgtgtaacacgcgttgcaaagagtgttgagacttggggtctgtttggagttttaagattacaatctggaaaaattgtgtttcccagcttcattttttggattttacaattatatcttcttataatctaaatcaaaagctgaactgtttagagcaacttctaattctagaatatactgcagcagctagaagctccccccaaacaggccctttgtgggagctagcttgttgatttgattgctgttgctggtgcttctagctcaccggatagcaaggagaggatgccggggacgctcgtcctcgccaccggcgccggcgctgcgcccaaggtgaacaccgggaacacggtgacgaggctcatgttgttctcctccgcgaacttgcatgcggccttctccaaaagcaccttggacacactgtacgcctgcaaacgcaaatgccattgccaattgggtgcaagcttattttcgttggtaaatttaaagaacttttcggtccaatatactgagtattttaagaatttttatcaaattaaaaatggtattttagtaattttcattctagtttgcaacagcgcagtgtctcatggtggtgaaaataatgcctatctctactccctctgtccttaaataactcaacctcttatgacacatcctactattctagtaaaacgaatctagacactctaggatgttacgagatttttttttaacggagggagtatttcgctataagttgtgagtttacataattaccctcatccaatagtatggaaagacaattttaccccctttaattttatactataatatattaaagcacaaggaaatattcataaaaatctttgaattgtttgtactggcagcacatactagtagtagcatatattagtatatattgtacggtaaaagttttcttgaatttatggataagatggagatgtgaaaatgtcaagagagaggaacgtcacccaggctggcggcttctctgttctcaggtagtcgacgtcagaccaggactcctcgtccagcacatacccgtcgccttgcagcggccttctggagatcgctgcgtccgacgatgttatgatcacgcgcttcaccgtccctactttcgcgcacgatctcatcgcgttgagcgttccattgacggcggcttcaaccagatctttctgccaccaccatcaacatcgcaaaaaaaaaaaaaaaaaaaggaaatcaagattagtagagcacatcagttacagagtatcagagtcaatagtgatgttaattagctgttcacctcaggattctctgaattgaagttcatcggagcggcgacgaggaaggcgtagtcgcagccggcgatggcatcgtcgaagcttccttcttcgtccatgtcggcgcggaagaccttcaaggggccaagtgcctgcaagtccttgaggtgggagttcttcgccatgtcatctgaatacaaaccgcagcaattagtggaatcttcagagatgaaactgaaactctgaaaattcacaccatcgtattgataaagtcgcatcatattttgatccatcatatgtcacgatatatatatgtaactatcggttggaagttggaaaaggataagatttgacaacttctccctttcgaaagatatgatattgtccacatgtgcggctaagcctgccatttgctaatgagtggttaagcgaaaacactcgctaattagctcatatggtactagcaggccgaggatatgatcatatgaatggaagaaacactgcaaaaaaagtaaaaaacacgaactagagagtgaaaaaaggaggagaatcttaccggggtttctgaccgtcgtgttgacagcatatcccttctccaacagcatcttgatgagcgcagaagcgatgtacccgttgccgccggtgacgcacgccgtcttcctctcgaccgccgacatcgtcgtcgtcgatcggtcgctacaacaacccaccagcccagatgagacgaagaggacgaggaatttatgtttgttgctgtactttgggaagagttcaatttgtctagtgaggtggtctggcgtgcttatcagtaagattttttttaagtactaccgaaaagaaacatgctgacatcatgcactatatccagaatatcaccttattgtaaaataaaaccggtgcggtgcgagttgggtggttgattgagacatgtatagagaattagctaagagttattttaaaaactactaatttttaagaaaaaaatagccatccaataaaatagtctcaagttgtttagatccaagggttattttaagagctatttaatctttaatgcactttctcatggagagagataaagagaaaagacattttttagtgggccccacctgaaatagccctaattagtattcttaagggggatagtttttttggatgtgttattttcaaatagccctgaaatagctcacctatttataacttttagattatttgcagctatttgaaagaggactgaaaagtaacccatgaatctaaacaggtcctgagtcggagcgtcgattacgcacgtcagctgggttaaagtgtcaatatggagtggacaacaagatcgtcatatcacgctctcagcaatggtatgcgtagctggtagagtcaaaggagcatgcgtgcgtctggaccgatggattcatggccgtccatcggcatccaactgacgttaatacggccgtgcgtcatacacgttgtccataagccgatcgagagatgggacggacggtaggtacagtgctactgcaatcgcgccgtgtcgtgtgactatccctgtgcaccgtgttcattggggctgatgccgagcaggcaggggcagcccatcgcgcgcgctagaaagctagcaggccgaggtgggccgcgagcccgcgagggaggagaaaattgcatatgtactactcattaaaaactggcttcgctataatatcattctcaagatgggatttgcccaaacgccactcataatatatgggtattcgctgaaatgccacttcaggttttcttccatttcgaaaatatttttcatcaatttcaatttttctcagactattatgcccctgagactctttcttctcctcggttcaatctagcgagcgtgagaaggtgagaagagaatcggcagcgacaccggcgccgcccaccaccactgcgccaccgctacctcagctccagccgccgcgccgaggtcctccccagctgtgccgctcgtcctagtccgcgcaattgtgccgcctcctcggtgacatacaccatgagtccatgacatacaacctcaattcatgagttcatatatataacttgcaagcggtttaattttcatttaatttcgcatcaagcagagctgccgacttgtttaattttgtatgagcaagttcgttcgctttggttaacccaaacgaactttaaaaagaagttgcaaaatgtttttcgaacatacaagaagatactactagaatagaagtcgctttgtgcttgaaaattatacacagttgttgatttcagaatgtaaaatcggcacatcattgacacaaaatgtgaacaaaaatatttaccaggcaccagaggaaattacacaggaggcaaaaaaaccactatgaattcagagaagagaagaaaaaaaaatgaaagctaagctcaggggtcctcagtgatgcacgagaggtgcggctgccacggcgaggcatggctcccggtgctcatgcgccgccggtgttggtggtggtgttgcttctgcaccctcatcatccttgtcgtctccggcgacgcgctgcactggctgcccaaccaatcggcgacggcggcgttgccctccgacttgctgcggacgtggtgcccgtggccggcggcgccgccggtgctcgtccttctcttggcgtcggggacggaggcggccgggatgaggaagtagatctcgccgcactccagcttcgactccggcgacacgatgtgtatccggcccatcgccccctgctgcgacgagcactgccggctaagcacgtggttggggtgcgccgccagcacctcaccggcggacacagcacggccgtacgcgtcgatgcggccggctcggtgcctagggtttcgctgaggataggcggcggctggggaggagactcaccggggagaggcggcggcgcagctgtggcgggcgggaccggtgaggcacgccgcgccggcgatgcagtggtggtgggc

SEQ ID NO: 43307 - DNA, 26368 bp, Oryza sativa
cagcgaatacccacgtgttaagagtggcgtttgggcgaatcctatcttgagaatggcattatagcgaagccagtttttacgagtggtacatatgcaattttctcgcgagggaggggatcgggaatgggcgaccatgcgccgagagcctgggagtgaacgggaaggaaagcttacgcggcgccctcatgcgcttttttttggctatttttttgcgaattttttattttagaaattgaatctttcatcttcaatttcatttggaagttttgaatttgagttgaaagttttaaattttgaaatgaaagtttcaattctgagttgaaattttcaaatatagatttattttttttcaaatcatggttaaaagttatcgaatttgatttgaaagttttaaatcttgagttaaaagttaaaaatccttatttgaaaatttttaaatctgacttgaaattttaaatattaatgcgaaaattttcaaatcttcacatgcaagcttttaaatctgagttaaaagtttttaacaagaaaggaaattggataaagtgttgcactacgtactttgctagcgcatatacactaaataaggaacccccgaggctgcatagcacgtttctttttgggcaaagtggatggccactatccggataagctcttttgggctgagtttggatgtggtgctagaaatttaggatttttcacaaatgctaaatgagactaaattattagtgtcaggttaattgaatactttctccattttcatagtattgttgttttgaattttttttctattctacctttttaaatttaatcaagtttataaaaaatatagcaatattttaaaacaaaacaaacacattattaaaatatctttaatgtagtatttaatgaaattaattttttttacatgttgctagtttttttttataaacttagtcaaaccctttacttaaaaggtttaactagatgatttataatatgaaacggagggagtattaattactataaatatgacaaatggttttattagattttttttaaagaagctttaaaacttttcataatatacatcatttaacagtttgggaagcggctaaaaaaacaagtggcatccctaacagaccaaatgaacggagccttggtccctcaaaatggacatctccttatttcttacgtatcatccaaatgaatcttgttaatttttttaaaaatatatataactatttaaatgacatgcaagaccaaaggataccctataaggtattaattttttttgccattatctactgtgtattaggctcatcttaaaacactgtatttttttttctttgagatgtttaaaggcacagaccacttatttcacaagcgcatatatagtttggtcctcgtgacatctaccccctctatcccataaaaaccatcctaaaccatcctagtactgaatgtgacatatcttagtattacaaatctggatatacacctgtccagattcgttgtactagaatatgtcacatccagtcttagtttcgtttttttggacgaaaggatatgtcacatccagtcttagtttcgtttttttgacgaagggagtaggttgaaagtagagcagcatgagctgttcgttcaatgtggtagaattcccagggccctgccttactccacaaggtcatcaagtatgtcgcccaaattcgtgtacttgaactcgaacggtcgaacccttccctgatcagcttctccgacgaacagcagactctcggtttctcaggcatcccgtcgaagctgcaaagataacagagatcatcactcgctcgtcagatcgaacacagcatgcatgtatatctatgttggatttcgaagttggccaacaattcgatcgtaccggtcggttttgacgttgtactgcgggtaccttccggccatgaaacgggcaagcgccaagacggtggtgttgaagctgcagcagatgtacctcgccgacgactctgccgacgacaatgacgatgactccttctcggcgaggaatatctcggcgcggcagaggtcgtcgacgtgaacgatcgacacgtagccggtgaacgattgcaggggcttcaggacttcgagatgcgtctcatcacctgagaagtaataaacagaagccaacttaggtgtgtttatattcagagacgcggtaaagttttggcgtgtaacatcggatattatatagggtgtcgtaagagttgttggggcattaataaaaaactaattacagcatcgctaataaaccgcgagatgaatttattaagcctaattaatttatcattagcgaatgtttactgtaataccagattcgtctcacaaattagtcgtaatcttgtaattagttattttctagcctatatttaatattttatatagctgttcaaatattcgatgtgacggggtgtaaatttttaaggtgggatctaagaaccacctgcaagtgttgagactttggtgggagctagcttgttgatttgatcgctggtgctggtgcttctaactcaccggatagcagggagaggatgccggggacgctcgtcctcgccaccggcgccggcgctgcgcccaaggtgaacaccgggaatacggtgacgaggctcatgttgttctcctccgcgaacttgcatgctgccttctccaaaagcaccttggagacacagtacgcctgcaaacgcaaacgccattttcaaccatacaatatttatttttggtaaacttataaaaaaagtctatgtttagtttattgctaaatttagtcaatatataagaaatcctgccaaaattttgataatattagcatcttgccaaaattttaacattgccaaaacttggtaaggtttatttttgttacaatctaaacaggccctaaatttagagaacttttctatacaatatactgagtattttaagaatttttattaaattaacaatggtattttaataattttcatccattgtgctagtttgcagcggcgcggcacctcatggtggtgaaaataatgcctatctctactccctccgtcctaaaaaaaacacaacctcgtactctctccgtattttaatttatgacgcggttgactttttgactaacatttgaccattcatcttattaaaaaaatgtatttatcatttattttattgtgacttgatttatcatctaatgttctttaagcatgacatagatatttttgtatttgcacaaaaattttgaataaaacgaatggttaaacgttgataaaaaagttaacggcgtcacacattaaaatactgagggagtgctagaatgtgacatatggttttttagacggtgggagtatttcactataaattatgagtttacagaattaccctccaccaatagtataaaaagacaattttatcccctttaattttatactatattatattgaagcaggaggaaaaaataatatttttttcgattatttgtactgtcagtataatactgtaaaagttttcttaaatttatggataagatggagatgtgaaaatgtcaagagaggaacgtcacccaggctagcggcttctccgttctcaggtagtcaacgtcagaccaggattcctcgtccagcacatgcccgtcgccttgcagcggccttctggagatcgctgcgtccgacgatgttatgatcacgcgcttcaccgtccccgccttcgcgcacgatctcatcgcgttgagcgttccattgacggcggcttcaaccaaatctttctgccaccatcaacgtcggaaaaaaaaacgaaatggagagcagtagagcacatcaaagttggatgaacatggattggaaacggacgaaaactagctatctcgtagtcagtagggatcttaattagtggtgccaagtactaccttgtaaaaaaaaataaattcctatatacaatcttagatagacacatgttttcaggtttgtaggtaatattagttttttttttttttaagacgaagggtgtaagcttttcacctcaggattctctgaattgaagttcatcggagcagcgacgaggaaggcgtagtcgcagccggcgacggcatcgtccaagctgccttcttcgccgatgtcagcacggaacaccttcaaggggtcaagtgcctgcaagtccttgagatgggagttcttcgccatgtcatctgaatacaaatcgcagcaattagtagaatctttgagaggtgaaactgaactctgaaaattcacaccatctttttgagatcatataaagtctcataataattcgatccatcatatgtcacgatatgtatatatgtaactatcagttggaagttggaaaaggataagattttgtcctcatgtgcggctaagcctgccatttgctaattggttaagcgaaaacactcgctaaaaagctcatatggtactagctggcctatgatttcacacctgaactgaatggaagaaacactgcaaaaaacatgaacttagagagtgaaaaaatgaggaggagaacctcaccggggtttctgaccgtcgtcttgacagcatatcccttctccaacagcatatcttgatgagcgcagatgcgatgtagccgttgccgccggtgacgcacgccgtcttcctctcaaccgccgacatcgtcgtcgtcggtcgctacaacctctccagcccagatgacgaagaggacgatgaatttatttttgttgctgttctttggaaagagttcaatttgtgtagtgagccagtgaggtggtctggcgtgcttatcagtaagtattcctaaaagaaacattctgacgagcactatatccagaatatcacctttattataaaataaaaccggtgcggtgcgagttgggtggttgattgaagtgtcaatatggagtggacaaatagatcgtcatatcacgctgctctcagcaatggtaagcatagctggtagagtactacacaatactacggtggtgtttgaatattgaagatgaagatggagattaaggggctgtttggttcagatactaacattgactaggtttaccatgctttcttaaccaaacttgccaaagatgaggccatcaaaatccaagccacactctagccaacaaaatgaaaccatgccacactttttagagacacttacatgtgggacctagattacaaaagaggaatcttgccacacttgtggaagccaaccaaacaatcatctaacatggtcaaacttgtctaaccttaagtatggcaaagtgtagtaacttatggccatcaactaaacagcccctaagtttttatgcaaaacaatatgctattaacgtatgattgattgagttttaattcttacaaacttgaaaaatagattaatatgatattttagtgcaacttttatataaaaagtttttgtacgaaacacatcatttatcatttaacagtttgaaaagcgtgtcacgaaaatcttaatatttatctaagtcttgtggaagaaaagaactggacctgagtcatgcattcgtgcgtctggactgacatgtagattcatggccgaccatcgacttacaactgacgttaatccgggcgtgcgtcatacgcattgtccgtaagccgatcgagagaggggacggtaggtaaagtacaatcgcgccgtgtgtcgtgtcgtgcaccgtgttaattgggggaaaaagtacacccaaggtccctcaacttgtcagcgagataaaaaaacatacttaaaccataaaaccatatatatatatagtcccttaactaaacaaaaccgatcacccgagatccttcggtggttttgaccccgatttcggtctatgtggcggctgagtcagcatgggaccaacgtgggtcccatatatcaggatgccatgtcagccggtcctcggttcctcctctctgttgagcgcgagcgcgaggcttgcaggcgagcagatggttgaggactctgcgagctcggaccggtgcacgacgcggaaggggtccgggtgaccggcgagggcgcggtcgacggctgcaacgcccacggcctcggcggcggagaggaggagatcggcgaccagcgccgccgccgccgcgcttcctccacgcgctagccaccaccgcctccacggggacctcgccgtgggcggcggccatcgtcgacctcgccgcccctagggccctccacgccggcgcacaaggggcttgccgcggaggatgagcggcgtggagctccagacgcgccgccagcgggaggcgagcgcggcggtgcgagtcgcgcccttgaagggaggcgggcgacgaggaggtcgtcggggagcgcgctgacgcggtcctcgccgtcgtatccctcggcggcggaaagcatggcgccgttgtcggaggcgggatggccggggaaccaccggaggcggacttggacgtggcgctgtcgtcgtcgtcgtcctcggcgtcggggaagaaggtgggcgcggcggcggcggaggctagggggttgccgcggctagtgtggatggaaagctgaacattgcttcttcagctccaatatattgtaattcacgagcctttttattttgatggttgcttcttcagttcgaaagatgtctctgtttttattcttgttcaagccattggcaagtctgaagaacctagactgaattctatactgtagtacagttctaccatcgtcagtacagtataaagaagcaatcttttgaatccttttcaagtaggagtatagtatgagattattatagcctgtcaacttgctgtttgtaactagccaatgctaatcttttcagctcgattatgatatatatcacgtcgtcagatttgtgcaaaattggtatagagacattctgaccgggttatggtcgatgacactgtccatcatctgagagtttgcaagtctctgaactctgaacattgcccagaatctcttacaggaatctttttgttggtcttctcatacagtatatatcattggccccttgcaagcagaggacaaattctctttgcattcgtatgcattttaattctgcgaaacctgtagcttgtcctgtgtataaacaacgagaatatcatctgtttatcattccaatttccaagtatcaacttctacctcgaccaggagtaatacagattctgaagtttataaacacatctctgcctgaacaagatggacacctactgttttcagttcaccatttgatctttaccagataaacctgaagttcaaaccgtgcagcactgcagccatgtttcccaagatagaatgacgcgtacacaagcttccagcgtgtcgagggcgaggtcgacggcggcgccgcaccgcgtgtgccagcaaccccaggcgccgcaccccgggagcggcccgctattgggagccgccaccgacgcctgcctgctgtacagaaactgcagcacgagcacgagcaccagcaccttgtaccgcaccagccgcggcaaccccctagcctccgccgccgcgcccaccttcttcctcgacgccgaggacgacgacgacgacagtgccacgacctcctcctcctcggcaccggcgccgcccacctctgccgcgtgccccacgcagcaccaccctccccggtggcgccgccgcgccactatgttcgttgccggccggcttccaacaggagaaaagagtgagagagagagagagagaggaggaagggaggatgctgacggcggcgttgcctccgccggcgcgacgccggctgccggaccttctcctctcccctccccccggcggcctcctcccccacagcgccgcccgtcgccggctgagaaaagtgagagagagaaagggagaagaggggaaataagagggaagagatgaggtggcgtgggttccacgtgggtcccatgctgactcatccgctataaaccgccgaggaatctcgtatgatcggttttgtatagttaaggaatcccgcatatctggttttgcggttcgaggatgattttgtatctcgctgacaagttgagggaccttcggtgcactttttccgaattttttttatttttaattttttttattaaaagttttacaaaaataatttttcattttgaaaattgacagaagtggtcgcctaccgccctctgggagggcgatttttaaaaatcgccatcccagagggcggcgaaaatgacgtggcagacggccgttcgctctcgggcgacggccgtcaacgaaatttgcatgcggcccccttgccgccctccgctagggcgattttgtactgtgcggggggccgcctgcaaatgggcggcgagggggcatggaattttgcaggcggcccccttgctgccctgggggagggcgattttatactgtgctatatttttttttataaatatcaatagttatcaaatctttttatattgaaaactatacaagattaaaatctccaagactggtaaaatacaattttattattttttagggcatagttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattatgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtacgcgctactggatctgacactaccatgaagcgccgaaagtgcgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaactcgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtaccgaagatcccggctgcaaatcctgctggacaaggactatcagtttcatacaggtatttaatagtattaataaaaagtaaagtaccgtgtgggcgagggatcgacgctccgtgagaggaagagctggcgaacgcgcccgaagaggtggcgaacgcccctgcggagctcgcggaagtgccggtcgtgcctgcgaacgcgctcgaaggcagacgaggtcctgcgatgaggaaacgtgcagttaaaacatggtgacatattcgtgcaaaagctgaaacaaaaatgaactaatatctgggctgaactgtaccgtgcgaaaccggtgctgtaggtcgcactgctccgaagctaggggcgctcgaaggcaaacgaggtcctgcgaggatggaacatcaagttacgacggggtgatgttttcgtacaaaaacagaaacaaaacttaagaaacctctgggctgagcagtaccgtgcgaaacaggtgccgtaggtcgaggtcctgctccgacggtaggcacgcgaggccgtggttgcaccggaccagctggaggtacgacgtccatggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaagtaatacaaattcgacgtacccccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacatgtgaagagaggtacattatatggctcgatgatcgcttaattatcataaaaatttagaaatgaacaatccgaactcacgagtggtcggcaaggaggacggtcggctgcacgttgcccggaaacacctgcctaagtccgaactgtctcatcacatgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggcaggagacggtcaaactcgaacacgaagtccgggtaacctcgtctcacctggacgtgagcgtaacgacgctgcaataaacatgatcggaattagacatgttatgtgaagaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgtggcacgtcctgtggctgagcatccgcgatgaaccgtgcgtagtggaccagccggaagtccacagcgtgcccgtgggtgctagtgaacatcacccacccgaacaacaacaacaggtacgcctcaagggagcgtcggaccgagtaatcatcagcgtcagggtgcagaaggtccgcctacaattaagaatgaaatgttagtacaaaacactctgttgatcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacacagtccacgggaccaactggtgctcccgccagcggtagcccgagcaggtacgacacgtcctgcagtgtcggagccatctccccacagggaaggtggaacgtgtgcgtctcaggtctccagcggtctaccagagcggcaaggagtgaccggtctgcatcccaccgcttcgctgggtcacggtcgtccgccgccgcctcaacaagcctacaaagtggtggaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaacagattgatcagaaacatataaataattagttcaacataagtaataaatgttcataagcgaattactaacacattcctgcacaagagtacaaacaaacaaaagtgtcaccatacggaatatttctgattacaacaataactgcagttacacgatatgagtacttagtccgaatactcatcacgataacattatgatacaacaccgaatagttcgcaatactactagtacaacaatagtcggaggtactcattacaacaacattcaattgaaattacacgatagaaatatttagtccgaacactcattacagcacaacagcattttatttcctaaatcgatagcattgttacaccatggaatcgcctgctgcgcgacgacgccttggccttgcgcgcctgcttgttgttccttcaccaggtggtcgcctaccctcacttgcctgtccagatggactagcatctgcgccgcttggaacttctgcattctttgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtacacctctgctaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccaataccagctttcagtgttctcactctctacaaatgcaaaagccataggtagaacctggttgttcccatcacacccaattgctgtcaatatctgacctcggtatttacctgtcataaaagttccatctatgcatagaacaagtcgacaatgcacaaaagcattgatgcaagcacccaacgagaaaaaggctctttgcagcacactctttgttcgatcatcaactgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcactttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctaaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatatactcaaacataacatattagtacaaatgtaaaagatgtatgggagcatacctgtgatgaagtgagcgaaccagcagggcttcgccgctccccttctgctgccctcccctctctctctttcgttttttttggatttttagtgaatataatgaaatttcagagaggagggactgggctttataggggggaggcaaaaatcgccctcccccagggcggcaagggggccgcctgcaaaattccatgccccctcgccgcccatttgcaggcggccccccgcacagtacaaaatcgccctagcggagggcggcaagggggccgcctacaaatttcgttgacggccgtcgcccgagagcgaacggccgtctgccacgtcatttttgccgccctctgggatggcgatttttaaaaatcgccctcccagagggcggtaggcgactacttccgtcaattttcaaaatgaaaaattatttttgtaaaacttttaataaaaaaattaaaaataaaaaaaaatccactttttcctaattggggctgatgccgagcaggcaggggcagcccatcgcgcgcgctagaaagctagcaggccgcggtgggccgcgagcccgcgagggaggggatcgggaatgcgcgaccacgcgccgggagtgagcgggaggtcgcatgcgcgatccgttgactgatttctctgcactaatttccaccgttcgccttgtcccacgtagggatggcaatcgggcgcgacgggcacgggtagtgcctacctatacccatgcccgtgagattatttgtgctcgtgggtatacccattactacatgacgggtaaggatggttacctatgcccattgcccgcgggcgtgcccgtttacccgccacaacaaaagcagtggaacaaaaagtctacaagctactaagttcgaatcgaacttaaaacatcaaatattctccacctcggtgtcgtgtctctcctctggcggcgatagagtaagaggagagaaataataagggaaataaaagggaaaccgaagaaatcaaagaactgggcttatgtattctagtggattttgctcctagcctacatataagttagatttcgtgggtaaacgggcaaagcgggcatgggtagtgattacccatacccatgcccatttactcatcgggcatagcttttgacccaataagatacccatgggtataaaatggagaacaaacccaaccctaatagggtttttacccgcgggtaaacgggcaaacgggcacaattgccatccctagtcccacgttgacgaccggcggaggttgatgccaaggatattgtcgttgccggcttgccgcgcatccatcgccccggtgcctggttacgtgcccgtcgcgctcaaaaatctcgtccacgcactgcacaaaagatcaggccggccaccgtgcccaggtgaaacacgaggtggccagtacgtgacagagccaggcagcgtgtgacgtctgtggtttttgcatgctcgcattgcccgcatccgcatgccgtcgtgtagcgtgagcaattgaccgatcgatttgtggccttggccttctcaacctgctcggctgcacctgacagcagcagcagtgtcgcagcaggtagaaacgctgttcagagagttttttttttttcaacgcgtgccagaccacaacattcccattacggattcacatggatccatagtaaagagggcccacatgttagtgactcaaagtcatgtggcttagtccgtgtttagattttttttttttgctaaaaaggtcacatcgaatgtttggacacgtgcatggagtattatttgtggaaaaaaaccaattacacagtttgcatgtaaattatgagacgaattttttgagtctaattacgccatgatttaacaatgtgatgctacagtaaatatttactaatgatggacacattaggcttaataaattcgtctcgcagtttatatgtggaatctgtaatttgttttgttattagtctacgtttaatacttcaaatgtatatccgtatactaaaaaaaatttggccaagaaactaaacacaaccttttttttggaggagaaagttttaccgggtttacgggaaaccgggaaagtacgttggtattgcaaaaactattagaggatttcagctaatcctttccggagaattagacagcttaccccctaagaggatctcaaattctcaatcctcctcttacatgaacagaacgaagtacagccaaaccgccaaatgtattggaacttggtactagtactactagcaatgtagcaatagaatgctagacacaatagtatttttgaaagcaacacacgtttggtcgtaatcgccaaagcagtggaattacgccgcccatcatcaccatcagttggggatcaaccccagggccttgccgtacgcgacgaggtcgtcgtacatctcgtccaggttcttgtacttgaactcgaacccttcgccgatgagcttcgccgacgagagcgagatggtcggcttctcggggtgatgctcttcgatgctgcgtacatagcaacgcatgatcagattcagataaccaaatgcacgaatgcataaagcttaatttcttaattaccaatcgcatctgacgttgtactgggggtacttggccgccaggaagccggcgatctcggtgaccgtggtgttgaggctgccgcagatgtacctccccgacgccgactcctcctcggcgacgaagatctcggcgcggcacacgtcctcgatgtggaccatcggcatcgaccacccggacgccttctcgatgcccttgaggatgttcatcatctcctcgtcgcctgaaaaaaaaaattcacagatcatcgatgcagcgacccaaaaacgttcagaagtcgagttcttggattgcttcttgtttcattcattcggtgatcgctagatagttcctcaccggttatcaacgagaggcaggccgggacgctggtatcgaccctcaccgccggcgatgctccgacggcgacgaccgggcagagggtcaccaggctgagaccgttctcctccgcgaacttggtcgcctccttctccgaaagaaccttggagatcgagtacgcctgcagtgcatgcagcaacaatggcgccgaactcatgttctacgagacattgctgtggttcagtgacatggaacagctcgtgtgtatatatgtgtacctgcgtcggcgacagcttctccatggatctgaggtactcgatgtcggaccaggacgactcgtcgaggacatggccggcgccttccagcggccgcaggctggagacggcggccgtcgacgacgtcaggatcacgcgcttcaccgtgccggctctcgcgcacgacctcatcacgttcagtgtgccctcgacgccgccttggactatctctttctgccatggccaagttcagaattcagtaactaactaactgactacagatactaatcgagcttgcaggttgcagcagtggtcacctcgagatcgtcggacttgtggctcttgtcgtacaccggagcggcgacgaggaaggcgtagtggcagccggcgacggcctcgtcgaagctgccttcatcctccaagttggcgcgaaagaccttcagggggccgagtttttccatgtccttgaaatgggagaccttctccgggttatctgaaattcagagttacaaaagcagtttcagaggccaaaccaaaattgtactgacacaatcaatcccaaaactgaacgtgcaaatactcctctgaaacaaattatgaactgatgacatgttcttcgattttcagttaaaactgaacactggaaaaacatgtaacaagaaagaaagggagtagaatctcactgggatctctgacgcttgtctgaacagcgtatcctttctccaggagcatcttgacgagcaatgaagcaacgtacccgttgccgccggtgacgcacaccgtcttcctctcaacctccgacgacatcgtctctctctctctctccggtcagttaatacctctcctgtgacagagaaggtgacttgggtttactcccaggtagaatccgagcagcacactgatgatgaggtttcttttgctgattgcgctgttgtggcacttgccaggacaaatcccggagagcaggaacataatacatttgacttagccaacactattttacaagcgacgacgccagtcgccagacagagaggcagaacaagaaatgcttttcgtgatgcatgcaccatacctgctcttctgattgattttccttccttagataatgacctgcactgatcgattatgtcgatcgatgaacatctcacgcttcacatttttaatgcggtcgatcgtgttttcaaaaggtaaagcttttgctccaagaaaaaaggatcatcttatcttcccagatgacgtgtgtacaggttcattcttagaattgaacttttttttttaggatagaggtagtacatctgacgctgaagcctgtgacgatttaacatcgttgaaaatgataggatccgtttctttctctatgcaaacaaaagcgagagaggaacagcacacgcgccattgaaaagtaacccaacgctgcatgcctgcgaattggacttctcgtttgtgtgtgtgattaatcataccaaaaagtaattcctgcgatgcccgcaaagttgagctgagagagctagcataaaaaaaaaagctagcaagttagttcatgttattagtactccctatgtttacaccattgactttttagcacatacttgatcattcatcttattcaaagaaatttgtgaaatatgtaaaactatatttatacatgaaagtatatttaacaatgaattaaatgatagaaaaaaaataataattacatattttttttgaataagacgaatgatcaaacatgtttaaaaaaatcaaacggcgtcaaatatttagaaaaggaggaagaagttgtcttcgcatctctgtaataactttcccacactaaggttgtgtttagttcacatcaaaattagaagtttggttgaaattgaaatgatgtgatggaaaaattagaagtttgtgtgtgtagaaaagttttgatgtgatggaaaagttgaaagtttgaagaattattttggaactaaacacggcctaacacgacctgatcttcagatgctgaactggggaccttgaaagaccttgtgaggcttcgttgttccaccagaatattttctttgctacttaatgaaatgacagatctcttgcttgtttcaaaaaagaaaatcatagagccacaattaggttgtgttctttagtgagggttgtgaatcctttcctcccgacacataaaacggagtgacggattagcgcatgattaattaaatactatttaactgaaaaacttgaaaaatgaattgatatggttttttaaaacaacttttctatacttttatcttgtaaaaaacatattgtttaatcgtttggtaattgtgcatgtgaaaattgaggggtagaaattgagaaaatgttgaaaggagcacaattttattgaacagtttgacgtgtcaataggcacgtttttcataaaagcggatgggaacaaattcactgctgttttacacatacttatttttgcaagagccgtttggttgcgaagctgggtagtaacagcattgtcgtcggcgtcagtagtgcagaatcccgagtgccatgccgtactccacgaaggcatcatcgtacatctcatccaccgtcttgtacatgaactcgaacccttcactggtcagcttctccgacgagaggaggatcgtcggcttctcagggaggccgccgccgagtctgcatgttccgccgccaccgtcggagtcagctcgcagtggacacgcataatctttgagaccagttcatgattttgtcttacgcatcgatgtcaacgttgtggtgcgggtatttggcggccagggaacgggcgatctgccgcatggtggtgttgagggcgcagcagatgtacctccccgacggcgacggcgacgctttctcggcgaggaatatctcggcgcggcagaggtcgtcgacgtgaaccagcttcagcccgccggagtactggtcaatcattctcagggtgttgatctcctcgttgcctgaaatcgaatcggacacgtgagtccgaaccagatactccctccataccatgaaaactctcgttatactaaattatattacattctaatactaggttgggtttttggaagaaggagtttattctagcacacttaggtcgtgtttgctactgagggttctcaatcttctctctcgtttttctcgcgcatgcttttcaaattgctaaacaatatgtttttgcagcaactttctatatgaaagttgcttaaaaaaattaaattaatctatttttttaaaaaagttaactaatacttaattaatcatgtgttaatgaactgttccgttttccgtgcggagggaaagagtttccatccatgatctccaaacaatactgccggtgcttacgtactcaccggacagcaaggagaggacgttggcgacgctctcgttggccaccggcgccggcgacgcgccgacggtggcgaccgggcacaccgccactaagctgatgccgttctcctccgccagcttgctcgcttccttctccgagagaaccttggcgatcgcgtaagcctgcagcgcaaacaccaccgctgtgctctcacgcaagcgactgtactatcaactctgactgaacatgtaaaattttgtaagtttgtgtgtacctgagcaggagatatcccgttggttgatctgaggtagtcgaggtcggaccaggacgactcgtccaggacatggctgctgccgttgccgtctccttgcagcggctggccggagacggcggccgccgacgatgtgaggatcacgcgcttaaccgtgccggctttcacgcacgacctcagaacgttcagagtgccttggacgccggcttccaacagttctttctgccattaccaaataatactctagatcgttatttcagctggttattatggagaggatttactagacaaaccaagtaaattaatcgtgacgatacaagtaaaagtactctcccgtttcaaaataaaacaacatagtattggattggacacgtacataataaagttgtttattattattattattattattattattattattattattattattattattattattattattatttcagagacaagatttttatgggaggaaatattattccttccgtcctataataaattcagttttagacttttctatttatcccaaaataaatttatttttaaagtaatcattacatcatgtgaaagtatgataagcctctcccatttatcccaaaataaatttatttttaactaatcattacattagagttcttgaaaatatgatagtatatatgtattgagaataaataaaaatagaaataattatattgggatttaataaagtgagtatattataggcttgtaggtaaatattggtttgtgtgagataggtaaaaaacaaacttattttggaggaaggaatagtaattaatgtgacataattgatatctaatcaacagtggcctggcagcgatcagagacttgacaagtggcaattactacctaggacaagtggacaacatcgagtggcacttggccccacaatggcactgagtttggtgggagatgtgctacgtgtctgcatgcatttacctcaggattctgagacttgaggttcatcggagcggcgacgaggaaggcgtaatcgcagccggcaactgcctcgtcgaaactgccttcctcttccaagtcggcgcggaagatcttcaaggggcctagtgcttgcaactccttgaaatgagagttcttctccatatcatctggaactcaaaatcacaatgcgctgcagtttcagaggccaaaccaatggtgttcttgtgaattcccgaaatagttttcttcggtcatatcaacttgaaacaaatcaaacatcagcatttatcttctaccaaacagaacaccgcaaaatcttctatgcacacagcatgctgttactgcccggatctatcgtcaccgcatacacacaaaatcaatgaactgaagacgatctacagaccattgttggggtgagaagtaagaagaatctcaccggggtttctgactgtcgtcttgacagcgtatcccttctgcagcagcatcttgatgagcgccgaagcgatatacccgctgccgccggtcacgcacgccgtcttcctctcaaccgccgacatcgccgcggttagttggctacttcgcctctcctagtagacgaagaaagagtgagaattgcttcacgcaccaaataggagcagctaggaccccaagcactgagcagagcgtactgaggttgcttttggtcggggtcattgttggtgttgtcatgtctcgtggtcatagatcatcatattgggaggtacaactactttgagaaaagagtactccctccataaaaaaaaagacaaacaaaccctgatttccgtgcctaacatttgaccgtccatcttatttgaaaaaattataaaaaaaagtaaaaagacaacttacgcataaaatattaatcatattttatcatctaacaacaataaaaatacgaattataaaaaaatttcatataagacggacagtcaaagttgaacacggaaatccagggtttgccttttttttggatagagggagtatgtgtattagaatatatcacatcatatactaagtgcatttatattatgcattaagtgtatttatattgggaccaaaggagtaggaatatatacatagcatgctcaatgcttacaccctctgtcctataaaaaaacaatttagcactggatgtgacatatctataactataatctggagatacctttgttcatgtttagattcgtatacatccattactagatttatttttttcggaacggagggagaacgtgtcttgtgtgggtctttgattagtagcaaacgtaggtaccctgatttatcctagactgagatcctttgatttaaatcaagtgattttaggatcactaacatgtggatacatactctattcgttccaaaatataaatatttttaaacttcgacacagttttcgagatgctattttgatcaataatatatatatatataatgttttaaataaaaaagagttgcatattatgatagtttgtttaatgataaatttagtaacatcaattttacatgattgatcttttttctactaatagttaaagttaaaaaaaataacttgacactattctaaaaatgtttatattttggaagtaagaaggatctatatgttggtgactcaaagtactccagtagaaaaaggaggtcgagagtattcgttcaacgtgtctttttttttaaaaaaaaaatccgggaacagcaattaagccatctaaccaacatcgttgctcctctccccacccaccctatagacttaggggctgcttgaataggaggcacttatatttctgtgaaatcagtctctcccattcaaatagggcattatgttctaacgaagccatttggttctgatcaaggttttgaatatcagttttaaagagcacctaaaaatcagtttaaaaaattattgtatgaagtagtatatatgcatctcatacaattaatttttgaacttgaaactgttctcgctgttgctgctaccggtggtaatgtacgctaagatttgcatcttttcgttgtgatcactgttagatagatctctctccccttgagcccaacggctcaagggggccttgaccgcgccctgatcgggggcgcccagcccaatggctggtgggcccccgtcacactgcgccatataaaagaggggtggaggccggcacggcacatggtacgagattcaccgccgccgccaactccaccccacaaaaccctaatccgatcgagagggggcgcagccagtgacgggaaacgccaccgccgcgccacgcctcatcgccgggacgtctacgaccaccactgccgcagccgtcatcaccgtcgacctcaccggcgccgcatccacgtcaagccgcgacgacaacgacgatgtccggcgcctcttcctccacgaactcctcaaccggtcggtatctaaaccctctccctttcatctacaatgtcgttcatcaaacccaaatagaaccacccgactagatctaacctaggtgatcctagagcaaagtttaacaatggtatcagagcaaccctagtgtttagatcgtttcggggaaagaaatccaaagaaagaaaagcacaagatccgcacggatcaaaagaaccaaaaaccctaaccctaattcttacctcgtcgccggccgtcgttgacgccggcaacggagggggggaggggcaaagaggcgccgcctaggagccactcgacggccgcgcgcgcacctgcacgcgcgtgccggcgagggggcccgcggcggcgccgccatctccgtcgtcgccatctctctctcacacggtgggggttagagacggtggggggagcggagaagagaaaagaaaggagcgccggccatggcgcggcggcgcgaaggtcgccggcgatggcgacgccgtccacgcggtcgcgtgagagagagaagagaagagaagctagggttttcggcggccggccgggagaggggggtttttgatcctccgatctcggcgcccggccgtccgatcgaaaccctagctgatcggacggccggcggcggccggaccgaaatcggcccaagtggggagcgcgcggcggcggctttcccggcccaggcccaggttgcggcctgggggaggggagggggcgcttgcccgcgcgcaaagtggccataggccgaccggcaaaggccggaaaagttcaatttaggtccctcggggccgaaaatgaataaaagagaacagtagcaatttttccattttattttgtcgatttttcatgcaaatttcaatagaattttgaatagatttttgcatgttttacctctgtttaaatttgaaccaacgggagaattttcacagagagagaatta

SEQ ID NO: 43308 - DNA, 17893 bp, Oryza sativa
  unsure (1)..(17893): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagccatgaatccattttatgcatatctggatttggatcctgcagaacaaacatataggatgagtagtatctgatgtaaatataatactcgagaaaaattcaagcagtttataaatacgtatttcttctcttgttaattttgatttccccgagcagatgactcattacgtttaaacactctgcccgactagtcatagccacctagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgtttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcaacgaaggtgagccaacggtgaggacgtagacatccaacaacggcggcataataggccagccgtgtaggcggaggcaccactcggcggcgacggaggcaggccggcggtgaagtcgtagacgcccaacagcggcggcataataggccagccgtgtaggcggaggcaccagtcggcggcgacggaggcaggccggcggtgaagtcgtagacgcccatgaacggtggtgtgaccaaccaaccgtataggcgaggacaccagtcggcggcgacggaggcaggccggcgatgaagtcgtagacgcccaacagcggtggcataataggccagccgtgtaggcggaggcaccactcggcggcgacggaggcaagccggcggtgaagtcgtagacgcccatgaacggtggtgtgaccaaccaaccgtataggcggggacaccagtcggcggcgacggaggcaggccggtggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaaatagcaagaaattaatctgagattagaaatcaatctaatatatattgataacaaattgaaacgaaaaactcaagtcgagcagtgaggctggatcatgagtgatagccggcgacgtgccatgcaacatgtataagccccggcaactaacagctaactcgatgttctttcggcatgatgccatcatcggaggtagccggcggagcccatcaaccatcatacatgcaaacaggaatcgaatcctggcggcctgtgccactcctgcaacacgtccatctgcaaggaaaggaagagaggagcactcggacacggcaagggcacccaagtaggcgacgatgatggccgtgtttcgatctcatccagtatatgaaattcgtcaaaatatcaggaaatcaaacaatgattaaaaattaatctaatagagattaaattggaacggtagacccgattgaagatttagatttgagccatcgaaattgatgagattgatctcggggtttcttctgaagttgattccatcgcacttttcgacaggtaattcgacgcaccccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtttggggatttgaatctgccgggtgtgtattgatctgacgatcaggttgtctcctgcccctagaggggctccctgccctccttatataggttggggggcagggttacaagatagaaaccttaaccaatacggtatcggtttcctaaatctactttacaatcttatcaaaccaggactttaggccgttccataatattcagggaaacgtaatacccaagtcatgatctgttacatatttcatatatatataagttatcccctataactagtcggataaccataccgtgtgggtatggggtacccataatctccacacataggaacttatgaagattttggcaaacgtttggaacagattattctgcgaattattgtcgcagtgaagaaaaaagtttactactgtaggctgagagagatggatctgcttctaaccaccatcagtgagaattaatgtgggacacagaagaagtgactggatgtctggatcaaaggagtttttgcctttgtgactttgatctgcttgtgggctctaaattatgttacatgactctccgtagttaaatgatcttattttctttctttctttcttatttcagttttgtctactgtaatttctcttacgcaattttcgcttacgattgtaaaattatagtcacgagaaagtagttttgacataaatttgacaatatcaattttatggcaaaacataaatattacttcctccgtttcacaatgactttcacaatgtaagtcattctagcattttctatattaatattgatgttaatgaatctagatattctatattctatattcatattgatgttaatgtgggaaatgctaggatgatttacattgtgaaacggagggagtactatgtgcgttgtaaaatataataatttctggttatatatttggacaagggtttatctaaattatggtactatattttaaaacgaatatagtattaaataaatcattaactaaaatgtaaaattaaacggtcagaatacgcataatattttgagcggggagagtatagaatatagagtcactcaatttaactacaagtgtactctttatccaatttgacagtaacatagatataactcataaataacaaataaatgagtgaaatgctaaatggcattcgatagattaattattgggccaaaatcttacagattcatgctctggtattagctttttctccgggtccgccggctccaatgacaccgacaaaggtggtggagttagggatgtaggatcccgggttgggttagagattgggggaggtgggggcgaggaaagagcgggagagagccaatccagttccaacaatgcacttctcgaaccgagaaagtcaagcttagatggatagccatgggtggcggtgggcagtggatatgggcgagcgatgagccacaagcggctgcgttgaagccgtaaggatggaggagggaggtgatccagcgttggtagcagggacaaagcaagcttgtggttagaaggctagacagcgagaggaaggggatcgagcgaatgagcaatcccatagtggctgggagtgaggagggaggggtgatatggtttagattgtgttacacgaatcttacaataatcatacggtccaaaactcgcatgttttctgagggggttttatgtcaaatgcttgatggacagtccaaataaaaataaggaatattaaataaccatcctaaatgtcacccaaaatttgagattttccttgtaaagaagttttgttgccaatatcccccctcccacccctcctaattcatggtttgatattccttcccaaattaccgatgttcgcgtgttgagtgtcatgagtagggatgaaaacgatacgaaaatggacgaaaaccacctttattgtttttgttttcatattttttttggaatcaaaaacctcgaatacgaaaacgaaatcaaatattgtcgaaaccgaaaacggaccggcaatgatacagtaacgaaaatttatcgaaatacaaaaacccctcaaactaagttttaaactatgtcaaatccaattctcaagtctcaaatttcaacattacatctcaaaacacaattatgtcaagttcaattctcaagtttgaattgggtgtattgggttgggctaaattgagtgacttaggaattacgatgctgaattgggttgggctggggaggaattatagactatggtaagggccttcataattctggaaattccgagaaaatttctggaaaatttccgaccgattccgagttccgacggaaactgcccttatggtattcgattctatttctaagaaaatatttccgaattcgattccgtttccgaaaaattccgaccgacagattccgtttacatccctagtcatgagtgggaatgccatgaccgtattacgtaggcccggtgatatcaaataaaggtgaattaattaggagggagtatttacatccaatcattttatagggtggaatctcaaccttacagcgatatttacgatggtattttacaattttcccataaattaatgtaaattgcacatatgcacccacttgcatgcctaatcatgcggaagggaaaactaaaattaaacgtccacgtttttcccagtgtggtactctcttcgtccaaaagtcaagacctattttgtttttttgttttttttttcaaaagtctaagactcatttataggactaaactaaaatgattggaatccaagaagctatcttaatccttgttagttacatgcatgtgtatagtttattaattttgtcacatgattaatgatttaattttgtcaaaagaaatactccatatggagggagcgagtactaataaccagtagcgcacacgaggaagctaattaacctgacgccaccacctctctttccctctctctcttccattcaccgacaatctaactaaaaatgaatccgatggccccgatgctgccggcgccggcgcccatggcggcggggccgacggagccggtggtggtggttggcccgcagtactgcgcgccgtacgtggtgccgctgacggtgaccaagaagtccatcagcctcaccgacggcgacttcaccgtcaccgacgccaacgacaacgtcgtcctcaacgtcaagggcaccctcttcagcgtccgccaccgccgcgtcctccacgacgccgtcggccaaccactcctctccatgcaagagaaggtaattaattaagtatttctttctttttttcttttgatttgtctagacctagtagacttgatcggggattcaggaggggaatccaagaaatcaagtactcgagggaatccaagaaatccaaggagtagtattttcaagtacaccaacagctagagagaggatttcgtcttgatctgatttcgtgttttttttaatatgttaatcacatggtcaacgcgtttcatggagattgattggatgagaaggtttttatattccttgaattttttcttcttccttttgagaatgatacaaaggtggtcaaattcgctgagaagagagagctcgtggaaattaggatcgaattaattagaatttcgtgtcttcgtaaaggcgcctggattatggatcgtttggcaatcgatgccgtcttggtgaactgaatctttctttctgcctaattaatcactgtcacaatttcaattggaacgttgactattttcgtgattcttgtgatcttgacctgttctttagatgttgaaatccacacaaggcattcaattcttgcacatttttagtattttacaaaagcaaacatttcagcaagttgagaatgatccccaattgaatatccacctaagaacagcaaaattttcagatacttagcatgcacaacagatgggaagtatacagaggggacagcgcacattcgtgcgataagctcttcaccgtgaagaagtcctcaatgctccagttgatgaagacggagatggatatcttcttggccgggaataccgcggagcaagtctgcgatttcaagatcaagggcagctactgtgacagatcatctgccttctaccttggcaaatcaaacacaatcatagctcaagtaagtttactgcctatgtctctcatcacattgtggaggttcagaacaaaactttaatagatttgttatgcatgtcctaatacctgcagatgaaccgtaagcacaccgctgcaagtgtggtgctggggagggacgtattcagcatcaccgtgttcccgcaagtcgactacgtgttcatcgcggctcttgttgcgattctggatgatgttcacagggacagaaaggagtgatgaactggaagcactctcatcccaagcacccttttaaatttcactttcatatctgtcaaattacctctgttctaggtattgctatctggttgaggatgtgtgtaaatttttctttgaattatgtttattttcgctggtgttccatgatttgtaattaccttcaagattgatcgatgttgtataactgcttacagcagtgaatgttttctgtttaaagatcaggttgcagagccaagtgttgctgatcaaaattcagttgaatataggccatttgcagcatggtttctgtaggtcaatcataattaaattgtgtagaggggaaaaacaggcatatggtggcgtttcattccaaaaatttaatctgatttggggttttataatgccaaatgatcttatttcagttatctaaataatgaaatgtgtttgaaagtgacatggatattattttccccaatcagctgccctgatcaggaaaaacatgagtattgaaaagtctgacttctactttgtctttttattttgtctttccaatcatcaacaaatggaaaagcttccgacttaagctttttctttctatcacctactcctttgtcccattttaattgcaaccatgagtttccgtgctcaactttgatcatccgtcttatttgaatttttttttataattagtatttttatttttataagattataaaacatgaataatactttatgtgtgacttgtgttctcaaatttttacaaaaaaatttaaataagacggacggtcaaaattgggcacggaaaattatggctgcacttatattgggacggagggagtaaaagttttgagtgatcttccggtactttctactgatagtattatattgtcagtagaaatgatatgatctattcgttattaaagataaattagtaatttattaatatattcattaggggtaactttgtcatttatatttttcttcccggctagataactttattttagtttatttttttagctttcaagataagccaacaagcaaatgatgagaaatcctatttttttagcttgaagtttcttgtttccctgtactatacattgattggtttgataatgtacaatgacaagaagttcctaagatatactagacacataaaagaagttcaaagaatatgcccaaatgaaagcaaaaataatcatgttcaaatctcagttctgtgtaaattatgcactcgatgtttcataaacttctttgcaaaacctgcaaactttttcttttgcccctgaaatccagactgggaactgcaaaccctgcatcaccctgaccactctagcttgcctaccacaatttctctctctctctctctctctctctctctctctctctgaaataaacagcttaatttctcctggttgtgcagataaaccgcaagtttagcgatctttcagacatgatattcgttgggagcaagttcagtgtgaccgtgttcccgcatgtcgactacgttttcgtcatggcacttgttgtcatcttggatgagatcgcgagggatatacgacgaggagcagtgatccagatcagcacgagccagagaccaggccgatcgacaaggtgaaaaagaggggaaaaaaaagaactctgaagatcaaaagcttccttgcaggtgatcctgctgtaattttatctgaacatgcatggaaattttgcatctaactaagttctgcattcagatgaaattagttagatatagtagttagatgcatgaaagaatgatcaccctgctcttgtgtgtcaatgggcacaccaaatgttgcattttgctaatcctttttctgaacaaccatgtgtggaaatcgatcgaagcttctttgaagctagagattgaccagaaattctaacctgcttgtactgattcttaatgaattcccaaacatattacttttgactctttgatcaacacaacaggggaaagtttcagatttcaacaagccaaatattcttaagatctcatcgatccatgtacatcaaggttcaagtttgtcctattaaaaaaagtttatggacttctatattattaaagtctctttttttcccctgtgagagagatccactacactatgataagaattgactgcaatagtatggttatataggggaagcatcttcagtaaatcatcgagctgttgttggcactcctaattaagtgacttcatctgttcaggtatgaaacaactcgaacaaaaaataatttatggagaactataaaaacaaatcacgattctatacatgatattatggagtatttgttatccatgtggttcccagataattaattaaaaccccacagattcacaaggatgcacatccagtcatggaagacatgcatgtcctgcaaaataaacaacctgaactcatcattataatgatacctgtcgcccatgcaagatctgaactctggaaagggatatatccaacctgaaactttaaatttccaccactaaatataacataggtgagcacaatgatggatatgattagatgtgaggagctatcagaggtgcacatttattatgccatccagaataacattgtgaaaagtactttggtcatttgtttcctctattttttttccaatttggcagagtaatgttattattttcaaaggtgcacattgtttgtatctgcagttgatgatattttctaacctgctagttcctaatctagcttaagacatacttcttcagaactccagtgtggatttctttaaaacaaatgaaaacaacttgtctttaacaaccatggttctgacatatatctgaaggaaaattccagccctggacttgatgtcatgttccacaataaaacaagtattaccaaaggtcatacataaacaatccacataaatgttgcaaatagtaggtggtgttagcaaaagttaagtgtctggacctatgcgtgtgcttatcaaattgtccttttcctttttgagaaaccaccataacgctagaattctctaaatgaagggaacatattccatggagaccattgtgtgggctctaaatttgatcgttttgttcaattaacaaatattttttccttaaaacaataaatattaatgtttttattgcacatatagggagctcttttagtctttaccaaccatggatagagatttagtaataaacattatgacgcttgatagattcttgatcttcttggtttttttttttattttttaaagttagttctcaacccatgttagaacctcttaatagttactccctccgtcccataaaaagccaacctagaattggatggaatgtttcctaatccaacgaatttggataggactagaaaacatcccatccaatactaggttggtttttttttggatagagagagtatggttgtgcatatcctggatccagagatcgggaatttgtatatgacattaaaaaatatgttcttagttaatgaactatctaaatacatgaaagacctgtttggcaggacttcagcactaactgcatcaagagctgtagctcaatcaaatagttcagcttcacctaaaaaaaatgaagtggattagaatgataaaaaaagaactagaggggtgtagcacggttcaggcccatccacagtttcactctaggagtcgaagctttagcaaataggaccgaaaagtccaaacgactcttatacagaaacaattattcatcccccaaattaacaaccaaacactgcatgaaatctaccagaaactcagaagaaggaaaagactaatccaacctagaaaatatgaaaaatttccagcacaaacaccacactatactcttgtgacagctacaaaagtacacttaattaattaatcaacaaccttgatttgatgaacagtaccaattcaatttgatcaccagtgaactttgcccgctccgaagcacggcacggcgcgccgcggcggcgatcgccggacgacgacgacgtcgtcgacggccacgccgccgtcctgcccgagccagcgccggcgatacgtcgtcttccccggcgacggcggcagccaccgctgtcgccgcctgaagctcgtcagccagctcatccatcctcccgacgacgcccaagaacacgacgacgacgacgtcgacagcctcctcctgcacttcttggccttcgacggcggcggcggctgatcggagttgcacgacgaccactggtacgagtacgacggcggcggcgagatcggcggcatggcgtagccgccgtcggcggcggacgccggcacgacggtgctcttgggcgtgccgggcttggactcccagacgaacggcacggtgccggcggcgccgaggctgtagtacacccggaacgacgacgccccgcccgcggcgccgcgatccgccgccgccgacgacgacgacatgatcctcgagctcatcagcaactgcggcttccctcctcctccttctcccttaccaccactcgagctcattaagacacagattaattcagagatatgatcactgagacaaatcaaaccaaaccagagacaaattttcaagccaattaattaaagagagagagatttgcaatttgcaaagggaaaagtgtatgcgtttgctaattagaaggtacactgctcaaaatgaatttgatggagctagctgtttgtgaaattgtgattgagtgagtgagagaggtgtatatatatgggagctttgattgagatggctttttttttctttgtcaatggtggcaattagctagctacctagctagtatctagcttgaggatgaagaatggtggagcacaaaggtagctagctagctactgatgatgtgtgttggcaattaagttttgagcttaagtgataatgaccatgatgatttaattaacagtacaatgatgtagtttaagtagtactagtactagtactagctatagtgtgtacaaactgcaaagttgtgtagtaaagaagaagatggtgtgcatgcaagtactagctaggtgctgtgttaggttgaagatcaggagaaaaaaggggatgagaatgagatagaaggatgtgttggcagccttgtggaggtagcttctcttgtgttcataaccgttttctacgatatatttaactagtgattatctgctcatctcttttatgaaaatcatgttaatacggagttagaacatactccctatactccctccagtttttaatatattgtaccactgactttttaagataagtacgttttatcattcattttattaaaaattatgtaattattatttattttgttataacttgatgtatcattaaagattttttaagcattacttatattgttttatgttaaaaattggataaggcgaatgattaaatgtttgtctaaacaatggtatatattaaaaatagaaatgagtatatatttaagcacaccacaaaaaaaaaagaaaggatctcatgactgaaatatatcttgtttaattaattaacttccttcatatttggttggaataaattgaaatataaatcatcttctaaaaatacctccaaagatctccctttttccagaaatgagagcaaagatccttgaagtagataaataatccctttgtttgctagtgttactctgagatcacatcaatatctctgaattaaaatactcagcgcgattaatttgataattgcctccatgattgtgtcatctaacctagctacagaaaaggctgcaaagtactctgcaacatgaaaagaaaaattaaatacaaggactacattcacaaacgtatatctaatcataatcctatatgcttaacaaactgcctaccggtgcgtgcgtatttaattacacatgtttgtttccccacgaagaaaagaatttatgtaccctgcaacacgatagatggatgagaaaaaaggcagacaccgaattgaactcgtaaccacttatcatttcatagatcagcatcttgcacacattcattggttcatgcagatgaaataccagtacaaaaatctaaggttgctttactttatgtttctttgttcttctttaagaccttttgcaaaagcaggtctctgctgcaacagtttgattatagggcatctgaattcagaagaataatgtttggttgcttcgcatatatgctggtcacatgatcatatctaggccttttaactcaccaattaaaactgttgaaagggtagcaattcagtgattctgagagaaattgcatggtgtatgattgacagtaagttattgcagtggttacagggtcatttccctgaactttcgagcaatcgaactgtgttgaaaagttcaaagaaatgtgttgttagaaaggcatgtgcagtgcatgcatagtgctgtcaataaaatttcttttcgaaacatatctatcagtaataaatttaccaatattgaaaattgattaaaatttatcaatcaaactgatacttataaaagtatgtcgacaatgacgataactgaaactactcttggcatcacatgaaacattctattgagctaatataatgcaagaactgttttttattttttgagaacgcgaaaaactttgcacttcaacatattagaatagtgcaagaactgttgttaaaggtttcaaattgaccaggtttcattagcttcatttaagaacaaaaaagagttcagctagtccaagtttatgactctgctttttcggatcagtccagcacaaaaatcaaagctataattaagctggtgcagtgtcatccatctcatctcccctgaaactttcagacagtcatcaggtcattgatttgttcataatgtctctgctaattaagcacacacgttagccacttttgtcagtacttatctgtagccttgtacgattagaatgtgacggtgaatgtacatctgacgatggaagtgaaggtacaatgtgaggacaagagaaagtgtatggatgtaattgacccagctcatgtgatttttagtcaaacaagcacaaagattttttgtcgtggattaggttaactaacttttagtacttagcttgcaagttactgtcttcctttggattaagacttagctaagcttgctgcagattctaggaacaatactccattcgagcgatgtgtatgacgagtgtttaatttcttcaaataattaattatgcagtacaattttgcaaactctagaaaatcaataaggcattgccgttccaaatgttacaagagttgtagaacaacaactttgttcggtcataaattaatggtatcacatatagtcgtatatatggcaccattaaattatcttttttttaatcacgggaggtaaaattatgatgattatcactggcatgctttctaagctctcaaacagaacgattttcaaaaggaacacttttaaaatcaaccttttaactttctaatatttaatttatttgtttatgcccttaaataattatcacaaactcagtttcatcgatcacccatcagctttaaacaaaatatgccattaaatttctttgaaatatattgcgacttatttaatcgtttcctctgtcttggttaaatgtttggaaacaaaagaacatctgaagaaaaagaggacctcacacacaaataaaccgacctgctatctaatcatctgcagcaatcatctaatcatgctgtcacttacaaatatgtgcatgcatgaataaatccccattgacgcttggaatcaacggttgttagggcgtccttgttgtggctgttcaggaagctaagctgctgcaggcagacgataaaaagcagtttgcaggtttgatagattgccgtcgtccagccatcgctgtaccgtaaaacacgtaggcgacggccgatgcgacgcgtgaaaatgcttcgtgctgaattattcagacgtgggatagtatctatctgtcattagctctgcatatatatgcagtgaattcagacatggatatgtctgcaattataggcttttttttccgactgcggcttataaaccgacacacacgatatccaagtgaaaacgacgaaaaaaaaagtaataatttggttttaggttcagaatggattacactgtaatattcatcgtccccgaattgctaaatatatttcagtaatatgtagatccaccagtggcggatccagaaaatcgatttgttggtgtcataacgtgtctatcggtgtcatagtatgctaattatacttatatcatggtgttataacatatggattagcagttttgttacaggttttactgaaagtcgtcggtgcctaacactgtagatccgcccctgagatccactgaaaattagtcagtttggcattgccaattaagtttgcaataactaaaaattatctttctgtctttcaactgccctacacttgttctttaatgtagtgcgtttatatacaattaacatgatactatacacaatagtgttatactcttagaattaataatcaaaatttctatttcagtttagataacatagatattccattatagtactctgtatgacatatttctgttccatacatcagtggacatcgttagaaggggatagcgatttgtcccacaaaagctcgagttttttactattcatcttccctatcttaaaaaggtcaatgatatgaaccatttttactatcttaaaaaaatatgaaaatctatagttttaccctgtatatgcatatgcagtgtgaatcttaaggtctggaatattacctaccaaatatttggtgcatgtgtgaattatttccaattaataatggttgtatttttgggggcagaaataagctacagaccagctatattttgatccatcgatttggtgtgtgagtcgtcggtgtctgtcgatcgaattagatccttgtccttattattgaacaagttaacatcgttttggtaggtgtgattaaattgattaatgcatgcacctcctggggtggcaactgtgtgctgctgtttgccatttctgttgtgggggaagaacaggttgccaccaaaccactcagttctcacactgtgggtcatgtactagaagagtacacgtgtgacactggaaagtgggcccagactattaggctaattaactttgatgtcatgggagtttggtttggtaatggtactggagtactatgaaattgttgctaaaaaatacatttatgtactgcacggtagatgtggagaaattgttgcgaataaatgtggttggctatagcatactccctccatactcgtaaaggaagtcgttttggacagcgacacggtctccaaaacacaactttgacttcttgtttctataaaaatatttattaaaaagtgatatatatgtatacttttatgaaaatatttttcaagacgaatctattcatataatttttacattttcaaactcaacaacttgagagttattcatgatttatattcccaaggtttgacttaaatattgtcataaacgactttctttacgagtacggatggagtatttgtgtcatcagagacttaggtttgcgttcgtttcgtttcaacttctcagtttttttccggattatttaccgaaatattgaaaaagattatatttgatttgctctatgcttcaaaaaatacattttttaaaaaaaaatcttctactgtattgtttattaatgtttagacgaacaaattatttgttaaacctatctatcaaaatatttaatgtatctctataatcaaagtatataatccacagtagcatgtggtatctagcaatctacataaaacgggaaagggagatgggtaggaatatggcccggtttgacaccaattgttttccataaacgtgatagttaacatcattatctacttctttcctcaaacaaattaattttggtaggtgtgatgaaatttcaggcaagatgctacatgtatgtgctggcattagtcatttgtaccggcttgaattctagaagtaatgcacttggaagaatatagattcatcttaatttagagatttggacactggttgggaagtcatcagacgcgagaaaccttatatcattctttgccaagtatgtgggcagttacgaaaagccctaaatcgtacacgtgtgatatgttggctagtccatttctggcttaaatgccatttggaaattgattaatcccttatgtttgtcatggtccctttttatatttaaatatttaaccatataaaaatagtgtattatgatattatattgttatacatagctttccatcgtttaccttttagattataagttgttgctagaatttgattattaatttagggttgacttttaggatttttatttttaagtattgtcttttagatcataaggacatacatatatataaattttacccgcatgttaatttttttcgttgctgatattatattaggccaaacgatggtggtctcaagatgggtcctacacgtggccaattaatttttttcacaatgtttatgaatccactagtaaataagaaacgctcaaaataactacatcaagaccaactaatgagagtgagctgggagacaacatatatattgaaacagttttaaattaatctacaatatttgagctagctcactcacaagtcacaagtcatcttagtattatgtttatggggccggatccacattatggttgcatggtgcacacgggacttgggccatgttttattaggctgaatccgggggatcctaatggccgatcgatcgcctggagacggggtagtgatcgatcccctcccccctccctcccaccacccctccacctggttttcttttttggcaccttattacttttctactttagtaaatttgtacacctcaagtttacacatctaaagtttagacaccaaaagtttataagtcaaaagtttatatatccgattcaaatttgaatttgaatttaaatatttttctatatatagtatttctatacatctaaagtttatacacctaaagtttatagacctaaagtttatatacctaaagtttataagtcaaaagtttacatacccgttttaaatttgaatttgaatatccaattcaaatttgaatttgaattcaaatattttatatatatagtatttctatacatctaaagtttatacacctaaaatttatagacccaaagtttataagtaaaaagtttacatatttgatttaaatttgaatttgaattcaaattttttatatatagtatttctatacataaatttttctaattttttattttttaaaaaagttttgtgtggtatactatagtaggaagagaagaaggggaggaggaaggggggagaggagggaggagtgtatcgtataggggag

SEQ ID NO: 43309 - DNA, 1928 bp, Oryza sativa
ctcatttttcacgcgctagcttttctgaattgctaaacgatatgtttttttaaaaaaaattatataagaaagttgttttaaaatattatattaatatatttttcaaatcttcttgaactaatatttaattaatcaggtacgaataagttgttttgttttacaagtttcgaggagtagtatttttctttttttttctttttttttgtgagaaggggcttggatgagtatgttgaggtacgcccgatatcacagctgctaaagtaattatatcttcttttttaatagatgacaccatttactttgttatcacatatttgactatttattttattaaaaaaatatgtaattataattaattattaattttgttgtgagtttttctacttataccttattgtcagggttatggataaggtataccttctatcctacgacttatggaatataccgataaggtatactttcacgtacacggatcgtctttatatatgtacgccgttaggaatccgtcctaagttatggaaaatatctctacgaattaagcgataagcgatttccaaagtcttacttggaggggatatgatttctgttatactgtatcagattatcagatcaaatattcttagatctttcttagggggtcaacatgatccacggtattaaagagacccccagggaggagtgtaaggcatcgaatttcaccgccaacacacccatcatagtttacgatgccggagtacgcggagccaagtcgccaggagatctcgtcaagctcatcgactacgatcccatcggtaccatctgtttcgtctacttcctttgtaatctgttctcatcatcatcaatcccatataaactggattaaggctattacctgacaaggggtctgagccagtataatctttatcttttgtctacttgatgtcatactacgtaaactctcgttccaacgtactctaatactcaactcatccggtccgcgagtatcactcgtcgacacttatacatttgcataaactttctaaattagacaaatagttaaacatgtgtttggaagttaacggtgttttttatcagaaaaaaaggagggtgcaatacgaataaaactttttgtcccacaagaaaacatttcgatcagggccgaaacctcgtaagcccaacttaacacggcccggcccatatatggacaagtgtcctgccccccgcatccgccaacggctctttcccctttcccccagacagattccaacggtcaaaatcaacgagagcggagcaaatcacaccacatcacatcacaccggcggaatggcggcggcggcggcggccaatggaaagaggaggccacgcaaggcggcggcagaggccgtggacgggcaggaggaagcctgccgcggaggaggaggggcggcggaggcggccaagggtaagaagaggccacgcaaggcggcggcggcggaggaaggcggccgcggcggaggaggaggagggaggttcttctgctgctacctgctccggtccctctgcccgcgccgcaagggctccacctacatcgggtacgacatccgacgcggctcctcgtctcgtctcgcgattccgccgccgcggttttcttccttcttcttcttcttgcgattgacgtgggattggatggctggcatggcaggttcacggtgaacccgcggcggcggatccggcagcacaacggcgagatccggtgcggcgcgtggcagaccaagcgcggccgcccatgggagatggtcctctgcatctacggcttccccaccaacgtcgccgccctccaggtaatccagccaaaatccgatccaatccaatcatttgtcttttgggggagatcaatcatggagataggtgtagctgttcttgttcttgttcttgtctttgccaatgttttcttgctcaaattaaaa

SEQ ID NO: 43310 - DNA, 10877 bp, Oryza sativa
aatcttatggtgtgatttcagttcgagtgggcgtggcggcacccgacggaatcgctggccgtgcgcaaggccgccgcgagcttcaagtcgctcggcggcgtcggcagcaaggtcaagctcgcctacaccatgctcaacctcccctcctgggagaagtaagttttccttactttgttcttcgcgatcatggctgtctctgaactgaatgcaaccaaactgtagctgaatgtttttttgttgttgttgttgctgaatattgtgtttgttcagtctgaacctgacggtgaacttcttctccaccaagaacaccaagttcgccgccggctgcccgccgctgccgggccacatgaagacggccgtctgctcgctggaggatctccagtactgcaccgatggtgtttcctctgaggaggataacaacgtcgacgagccgcctccgaagaagaatcatcaagaacctgatgatgcgcatgcgcctgcaagagacgaactttcagtttcagagcatggtttggttcaattgcctgaagaagaaattagaaatgcaggcaatgaatcggattacgacgatttcgctccgatcgattggagtgtgtttggagcagcagaagcaagaggattggacgaatcatcggaacatgatgagtggatgggacaagaagacaacccattgtttgaagcacaaccattggaacatgaaaccagaactgcagcctctgcagttagtgatgctgaatgttccactgatgagcttggttacatgtcatggagtggaattcatgagacgacaagggaatcggacggatcggcaacatcgcctcgatgttcgtcgggtttgtccagtgatgatgagggtggaagaatactagacggtgtgtcaggacagatttcgtctccatttccatatgttgggaggagttcatcgtcagatgagagtggccctgctcctctcttccttgagaaagatgtgataaacttggttaccccaattgctcgtcgtcttgggagaaaaggaggcggcgaaatggctaggattgttgatctgacaagctcaccaattgtcatcgagttgtaaacttatagtgtgttgataaataattatccacgatgtgtgcggaatgcctgaatcttgtaacaatagaaacagaaacactcattctgtcaaatcatggaataaaaaggtgaatgcgacgtcaatatacgatgcaaaaagattgagctatctgaaaatggttcccgtttgatttgaatgccatttgcttgaagggtaactaataatccaggaactggaccacacaaagaaacttgtaatcagtctgatatcatcctccgtttgactcctgcaacagtcttgattaatcactccagccatgatccatccaaccttcagtagaggtggtttttgttcatctgctaagcttaatgcacatttcatgaaaataatttatctagtgtagaattcagtttgagctagcttcagcgtatgtattcgttgtcataaatataagtgctattatcaattcagacttttttttaagtcaatcaggcataacttgaccacgcagttttttacattaacataaatccataattagacacataatacagttaatacttgattactgcatgtagagtatgtgaggctaaaggtcaatcagttggtagtcttggtgtaattttcacaaatgtaccttatcagttgaagtcgctgtccggctgatttggagccacctactttcacttcaaggatgctaagctgtgctgacagctgaatgccaatgggtaagtagggaggattgacggtaaggagaggcaaagactatctaatacttcatctattctaaaatataataataacctagtaccggattagatataatctcaaactacgaacctaagtatatcccatttagatttatagtaataggttatattaaatccaatattaggttgctatattttaggatggggaagtaatagttttttttttttttgccggaatgaccaaaggaggtcattcaatataattaagatagggagaaaaatgttacaaggaaagttttacatcgacggctggctgtcgaggaaggatgtgcaccagagcacgctccaaaccatgtgccaaccgaccaaacacacgctacagagagagaagctaagcatcgaaccgaccatcactatgctagaccgatcgccaccgggccaacaacaccaccatgacacgaagactcaaaaacgacgccttcacgagggtcgtaacgccgaaagacgccgtcatcatccgtccaaaaaactggactaggttttcacccagagctccttgccgcgggaggaggggtacctcaacaatgccctcaggagagttaccacacccgaaggtgtagtcacttttgtcccaaagaaattgggctaagctctcgctcggaacccctaccgccgtggtccgtcgcccaatccgaccgaggacacatggcttccgccacacccgaccgacgcccatccgccagccagcatccaatcctgccaacaacaagactgccaccacaccgcaccgacgccccgccgtcggtcgacttcatcaaaccaccatcgctgagagctggcccaggacccttccgttccaccacccgccggcctcttcgctagatctggccgaaggagaacactggactaggtggcattgcttcggcagcctgagcttcccccgctgacaagctggcccctcaatccagcctagaaactccccgcaaagaaggggaggagctctaggaagggtgagggtgccgaccggcaacgagaaagacgacccaccgctgccagctccctttgcactaccatctgggcctgcgccgacaccggaaacgcggccgccctggctccggcgcccgctttaaggtcaccgtgacggcttcccggctgccgaggcctagccgcgccaaagggctgcaccgaccgccgagcggccaggcagcacagcagcgcaccgcccccgggcagcaccaccgccagcaccatggggtgggccacaccgccggggcaggccacgcccccgagccgtcgccgtcaccgccgcttccaacctccgagccgcctccgccgccgcccggctcggccgcacgccgccgccactcacctccaagccggccgcacgccttgctgccgcgcaaacgccgccgagccgccacaagccgcgtcgcaccgctgctacgccagatctatgcgaggatggccggatccggcctaggggactccggatccgctgcttcccacaccaccctggcgtcacccatcgccggccacggcgcctagccactgccacgccaaggaggtatgccggcagccctctagcttgacgccggcaccagccagccaccacgaccgtcgcggtctcccctcctcgccaaactgcatccctcctcgccgcaggcgtcccgacctcgacgaggcgcgccagctccagctcacccccctcgcggccgccgtcgtccccagactggtcgtgggtgccgacctccgtggcctccatggagaaggggtgaggccccgcagccgccgtccttgcagccgcacggtttccggcggctgctctagcggtggtgaggcgggggaggaggaggtgtggtggggtggtgggggggggggggaagaatcgcctcccgtgtcgccccttgccttggagcgacgcgcagggaagtaatagttaagagtaaggagggagacacctagagctagtgggctagtggcgtgtggaagcattgtttggttccaagaatcaaactatccataatgagttattcatcgtggtcattgcgctattttgaattaggaatgctatacatcggtacaccatccgccatcgcgacgggatcggcgcgatacctacgaagatcccgtcgccgtgcgctcccctgcaaggcaccgcagtacgcatgcaccctcctccacacgggcgcagacatgcagaagccattgtgtgatgcgcggtggaaatactccatcacgtgtacgtcctttgtatggggcccatatgtacatgaatcaatctgattgctagtactattcaggtgcatgcataagaatactaaaatattgttacagtagcatagttactaaccgaccaggagagtcaaatacacacatttatattggtcgtgcgtgtagcatggcaacatactccctccatcccgaaaaaatgtctaagactggatatgacatattttagtacagtaaatctggacagtggtatctccagatttgtagtactataatgtgtcacatctaatactaggttagttttttatgggacggagagagtatgcaacaacattgagccatatgtattatgtttagggttacacaccaaagctaggagtcactcaaactctttacaatcgtctactagcaagacaaaagaaaacccggtggacagaaatcctggtcgtgatacaattgtttgaaacaccttcctgtgtgctactatgttcgccgaacgacgaacccatcttgcattacattatgtgattccgcaaagcaggaacagtagttttttttttagagcacactggttgtacaaaatgcaggaaagtgaaaaacgtagaaattaaatgcagcacattttaaattcctacatactacacctataagatatgcagattatacagatgcgagctgtgggatggaaatcctgccgattattggtcgagatccgtcggcgtaccatctgcaataagtcaaatttaaatataaaatcgcactacataggtagtagtacatttataatggagaaaaggagtaattaagaaaacaaaagaaaaaggtggcacacacagtcagtggcgaaaaaggaaaaatgattgaaaaaaaatggagttgtgcgcttgtcacctttagttcgaggctagcccaatcgatgtttggtgaaacagtaagattagatataataatgtatatattccacaagaatatatgcagtggtgaatccatattatgatgtcgggccggttgatcccatagcgttttcacaatcacctttgagaatcttttgttttattttccatataaatccattcaaatttgcataaatgatcccactgaaatattcagtaatgataattgatccaagatataaattttctagctccgccactgaagatatgaacttcctcttgcaaccgttttttattattaaataatttggattgaaacttttatctggttaccggttttccaaatggatcacatttttttttcttcaaaactctagatgcgagagtgtggcatctcaccactattagttcagtctgcattggcaaggaagtttctctaatccaaacagttttacattctaatgaaacaaccaaatggagactaatagagttcgataagaaaaggagggcgaatagacaaatatacacaaaaagtagtatatttaaccaatcgtctctacttattagcctcgaagccaagcatgcattctacccacaaagatgacgatcgtttcaaataaccacatgccatttttgaagaactttcaccatgatgtcattttggaaccacatgtcaatttgatccagttaaaactgctcatttgtgctaaaaatccctcggaggtgttttgttttgtacttcctccatattttaatgtataacgccggtgactttttgtccaatgtttgattattcgtcttattcaaaaaatttatgtaattatcatttattttattgtaatttgattcataatcaaatgttctttaagcatgacataaatattttcatatttacacaaaaattttaaataaaacgaatggtcaaacgttggtcgaaaagtcaacgacgtcatacattaaaatatggagggtactggctgacatgtggccatgtcacgaatggttgacgatgatgaacacataaaagaagaagggacatgtacgtcggtcaatagtgtaaaatcaaaggagttttttattactattctgtgatgaacaattgggcattggagattattggttttgttatttggaatttattcacgaagtggttttggagatgattggatttcacaggtgatcgcaggtttattatttcatgtgaccggtcagactgggctctggtagccggtcggaccggcggtgattgagtggtcggaccggccagcccacggtctgaccgaccgacactgtgtcggtttcggtttcgggttgtttatttggatatccgagtttatttcatgattatgacttttagatggatactatacgtatgtaatactattatttgctgctaatgagtcaagttggagatagcttggtctcggaatatggtttctttgtttgttccatgtgtaggtgactcgatgtctcgggagagtatttgcggtgatggaccgggagtcgacttggggataagacgacgtccgtggtggtcagagatcatgtgggatactaaggctagagttgatgcacgtggttgatggagattccatatggcatacgatggagttattgtgtgcatatgggatgcggagtcgaatttggaaggagtccaaatttggtacgattggttatgtaaagtttctttcttgtactagagggtttcctaaggtgtttaggactcctagtatgagtatggttcgtggctttaggctgcctacctcatgtataaatagagggggagcgtgaggcttcccggtatcgctttagagagcaattgagttgagttttgagttagggtttcgagtttagtcagaaatttttgtaaggagtgttgttggtgcactttgtaaacacagagagaatcaataaagtcgtcatccactttaagagttcttcgatttgtgtttaccggatttcggcggtttaaccggcgatctaccgatggtcagaccggcgggtacacggtggtcagaccggcagcggcgacaggcgcggcaggctgttcgaccaatcgatctacatcggtcagaccgacgttcatcaggtggtcagaccggtgcaactacttcagtcagaccgcgatccatcgatttcgaggataacttttatttccgctaaaagttttcggtttttgggtataccaaccattcacccccctctggttggcttagttcttgtgattcgatcctacaagtggtatcagagccttgttttcttctttagatttttatcgatatagagtttttgccatggctactcccgctaggttttcaactaagcctcatgttttcgatggaacagatttttctcattggtgtagtaggatgcaatcttacattatggctgaagattatgatatttggagaaaagtttctaatgcttatgtgattcctgaagctattaatactactgctgaaaaaactgcttttgaacaaaattgcaaagctcgtaacattcttttgagtggtatttctcgttcggattatgatcgtattgctcatcttcaaactgctcatgagatttgggttgctttgagtaattttcatcaaggaacaaataacattaaagagcttcgtcgagatcttttcaaaaaggagtatattaaatttgagatgaaacctgaagaagctttggatgactatctttctcggtttaataaaattttgagtgatcttagatctgttgattctttttatgatgctaattatccacaatctgagatttctcgtcacttttttaatggtctcgacatgtctatttgggagatgaaagttacatctattcaggagtctgttaacatgtctactttgactttggattcactttatacaaaattgaaaacacatgagatgaatgttctttctcgaaaagctaattctaagtctagtgcgttggtttcttcttcttcctctttggatgttgatgcttcttcatctaagtcctcttttcttgctgtttttaatgccacatccgatgatcaactcgaacaaatcgaggaggaggatttggctttggttgctaacagaattgctcgagctatgaataatgccaggaacaggaaaagaggtggtccaaatcgttgctttgaatgtggttcaattgatcatcttcgttcgcattgtcctaagcttgggagaggcaaaagagaagacaaagatagtgagaagaccaacaacaacaagcccaacaacaacaagtcgaagggttcttaccaagggaggaagatggagaatcttaggaaggcttttcaacaagtttgcgccgtcttcgagccactaagtgatatagatggtgaaagtggagatgatgataagggaaataacgtctccgatgtttgcttcatggcgcgtggtaaatctgatatagagtatgaagataatgaggtgagtgcttttgaggaagctattaatattttgagtgcaaaaaataagaagtgtgagaagatgtatagaaaacaggaatttatcattaaatctcttaaatttgaaattgataggttaaaatctcttattcctaatgatgatgattgtgaaaattgtgaggttttaatgaatgagatttcaaaaattagagatgttaatgctgcacatgatttgaaaaatagatcttctcttgcttgtagttttgttttgcatacacgcactttggatgagttgtttttaaccaaaaaattgttgcaaaaatatcaaattgcttttcatgctagtttgatgtttaacatgatttcggctaaaaagttaaaacaacctcatgatgttttggattgctcaacatgtaatttgaataagatgaaactaaaagatgctttaggtcgtgttgagtacatggaagatattgtgaaaaacaatgaagtgctttcttgccctaaatgtcgtaaaagcaaaggtgtcatggtagattgtgaaaattgtgctaatttggaaaaagagatttcttacttgaaaaattctttgctaagattttctgatggtaaaaagaacctcaacatgattttggatcaatcaaaggttagcacacataaccgtggtttaggttttaatccttatgctcataattctagacatcctcctgttgtgttaggtgctggtgctagaagtggtgagattttggttaaacctgatactaacaaaactgtgtttaaatctgctggtatcatgtctactatgagtgcatcttcttcaaaatccaatgttgtgcatggaaaatctcctgttgttgcttgtgttgctaaatcttctaatgctatcaatgtgtctaatcatcgtgaaaaatatacttgttctttttgtggcaaagatggacatattgttggtttttgtttcagattagctcgtaaacagaaaaaggagagagaaattgcttttgcaaaatcaaagtggcaaaaatcgggttttccctcgaggaaaccggtcaaaccgcagtgggtcccgcggtcagaccggctgaataccctcggtcagaccagccactgtacctcgatcagaccggcctcagaggaatttttctgaaaattctaaaattgattttgcacgtggatatatgcctattggatcttctggtcgtgtgtctcagtactggatttctaaatttttattatcatctaaccccagtactgagggttcgacttctgcttgtgtgtaggctttggtggcaaagaaggagaacgtgtggatcgtggattccggttgttcgcggcatatgaccggtgataaaaattggttctcctccctaaagaaggcatccaagactgaatcgattatctttggtgatgctgctacaagtgccgttctcgctacaggtttggttaaagtaaataaaaaatttgaattaaagaatgtagctttggttgaggacttaaaatacaatttgctttcagtttcacaaattgttgatgaaaattttgaggttcactttaagaaaactggaagtaaagtttttgattcttgtggtgattctgtgttgaatatttctcgctatggaagagtgtttaaagctgattttgaaaatcctgtttcacctgtgataacatgtttggttgctaagtttgataaacatgtgatgttttggcatcgtagacttggacatgttggttttgattatctcactaggttaagtggtttggatcttgttcgtggtttgcctaaacttaagaaagatcttgatttggtttgtacaccgtgtcgtaatgctaagatggtttctacttcacatgctcctattgtttctgtgatgacagatgcaccgggacagctattacatatggacactgttggtccagctagagtgcaatctgttggaggaaagtggtatgtgttggttattgttgacgatttttctcgatattcttgggttttctttatggcaactaaggacgaagcttttcaacactttcgtggtttgtttcttcgattggatcttgaatttcctggttctttgaaaagaattcgaagtgataatggtggtgaatttaaaaatgcttcttttgaacaattttgcaacgaaagaggtcttgaacatgaattttcttttcctcgtgttcctcaacaaaatggtgttgttgaaaggaaaaatcgtgttttggttgagatggctagaacgatgttggatgagtataaaactccaagaaaattttgggctgaggcgattaacattgcttgttatatttcaaatcgagttttcttgagatctaaacttagaaaaacttcttatgaacttcgatttggtcatcaacccaaagtttcacatttgcgtgtttttggttgtaagtgctttgtcttgaaatctggaaatttggataagtttgaggcacgttctaccgatggattgtttcttggttaccccgcacatactcgtggctatcgtgtacttattttggggactaacaaaatcgtggagacttgcgaggtttcttttgatgaggctagtccaggtactagacccgatatt

SEQ ID NO: 43311 - DNA, 25061 bp, Oryza sativa
aacaaattattggtaatataggtgagcggactacaaggtctaaggtaacgactcatgatgtttgtgcaaattctgcatttgttgcttcttttgaacctcaaggtacttttgtgcatcaaacgaagtatacgaaggatcttttgagacggttcaagatggagaattgcaagccaatttcaacaccaattggttctacagctgtgttggatcctgatgaagatggtgaaactgttgatcaaaaggagtatagaagtatgattggatctttattgtatctaactgcttctaggccagacatacaatttgctatgtgtttgtgtgcgcgctttcaagcttctcctcgtgcttgacatcgtcaagcggtcaagcgaataatgaggtatttgaatcatgcacttgagtttggaatttggtattctacttcatctactatatgcttaagtggatattctggtgctgattttggaggttgtagaattgatagaaaaagtactagtggaacatgtcattttcttggtacatcattgattgcatggtcttctaggaaacaatctagtgttgctcaatcaactgctgaatctgaatatgttgctgctgctagttgttgttcacagattctttggcttttatctactttgaaacattatggtcttacttttgagaaagtacctctcttttgtgataatactagtgctattaatattgctaagaatcctgttcaacactcacgcacaaagaacattgatattcgttttcactttttgagggatcatgttgagaagtgagatgttgagttgcagtttttggacaccaagttgcaaattgctgatattttcactaaacctttggattctaatcgctttacttttcttcgtggtgaattgggcataattcattcttttggcatggtttgagggggagtttgtacctcatggttttagcaagcaataatatgacaatgataaaaattgagaaaagagagcttttgtttatgcatatggtattttcttgtgcatgctagcaatactttgaaggtttatttgtctctagcatagcttgtatgtattctagtcttttcatgatatttagattttgcttttaagggagatgatgcatgacacttaaattctttacttgaattaagaaaatatgcaatgttgatgctagcatatggtttgatttataaatgctctatatatatgctttattgacttgttattccttaaatagctttaattgctcattgtgaaaaagagaataaaaatatgaaaaaaatgaatactgaatccttggaaacagtcttgacgacaaggacgtattcgatatgagcaaaataatgggtgccgaatccctggaaacagtcttgacgacagggacgtacccggaataaaagagaaaaatatgagaaaaaggctcaagaaaagaaaaagttgaaaaattctcttggttattttgtgctaaaggttatttgagaaagagtgataaatgcaatagatatatgtgtttcgtgtttattcttcaacctatgtgcttgttaagatgttgcattataaatcatttaaaatcatgaattctgattgttgattcaagcttaattgtaaaatctttggttcatggttatactttaatgcatgcttgttatgatatagatgggttcatcttctttttattgcaacacatgacatgatatgctatatgtatgctgagctcttgaacattaatgaacctaattcctatgcttgatgaaatcattgtcaaaagggggagaagtaatgtgaaaatttttggatttttggagaagcaaggaaaaatttttttgaagagttgttgagaagagcatgtttttggttcaattgggaatttctttcttttaaaaagggggagaagttttcttttggatttttgagcacgatgtgtacaattgtacgaagtgtgctttttaccacttttgtttttatttttccaaacaccaaaacatttttatgaatttgccaatgtgttcatcaagggggagattgtaaaatcaaagaagtttttgattactattatgtgatgaacaattgggcattggagattattggttttgttatttggaattttttcacgaagtggttttggagatgattggatttcacaggtgatcgcaggtttattatttcatgtgaccggtcagaccgggctctggtagccggtcggaccggcggtgattgagcggtcggaccggccagcccacggtctgaccggccgacacagtgtcagtttcggtttcgggttgtttatttggatatccgagtttatttcatgattatgacttttagatagatactatacgtatgtaatactattgtttgttgctaatgagtcaagttggagatagcttggtctcggaatatggtttctttgtttgttccatgtgtaggtgactcgatgtctcgggagagtatttgcggtgatggaccaggagtcggcttggggataagacgacgtccgtggcagtcagagatcatacgggatactaaggctagagttgatgcacgtggttgatggagattccatatggcatacgatggagttattgtgtgcgtatgggatgcggagtcgaatttggaaggagtccaaatttggtacgattggttatgtaaagtttctttcttatactagagggtttcctaaggtgtttaggactcctagtatgagtttggttcgtggctttaggctgcctacctcatgtataaatagagggggagcgtgaggcttcccggtatcgctttagagagcaattaagttgagtttttagttagggttttgagtttagtcgaaatttttgtaaggagagctgttggtgcactttctaaacacagagagaatcaataaagtcgtcatccactttaagagttcttcgatttgtgtttaccgggtttcggcggtctaaccggcgatctaccggcggttagactggcggcaagcggcggtcagaccggcgggtacacggcggtcagaccggcagcggcgacaggcgcggcaggcattctcagtggttcgactgatcgatctacatcggtcagaccgacgttcatcaggcggtcagaccggtgcaactacttcggtcaaaccgcgatccatcgatttcgagggtaacttttatttccgataaaaattttcggtttttgggtataccaaccattcaccccccctctggttggcttagttcttatgattcgatcctacaaatagccgtggcatatgaaggccacctccgtaactatttacacttcaggttacaatatccggtttcatactttgggaattaaagtagtggtttctttcctcatggacgtgacgtaatagtcatggttcacgggttagggtcatgttctagctagtacaataatgcaactaaactactcattgatgattgatgtttcttaaaataaaaaagaagaagagaaaagtagctttggtgatcattatattccatcgagcctaaccatctagccatttatgcctgcctttggaagctggtgctccataaagccaagggcaagaacaccttttgcaaaccaacaccctcaacacctcttgttcccttgcctatgacataactatggagattgtaacaggagcaataaacactctgctcctcaaatttgcgaagctgctggttggggagtacaagctgcagaagggcgtgaagaaggagatcgagtccctccaggaggagtacgttggtaagcttgggtgcggcactccacaaggtatccgaggtgcccgtcgatcagatcgacgagcaggttaagatttgggtgagagatgttagggagctgtcctacgacatcgaggattctatcgataccttcatggtgagtgccggtaaggatgggcaccccgttgccaagttgttcagcttcaaggggatgattgacaggactaacaacttattcaagaaggttgtggctcaccatcagattgcaagggagataaaggacatcaagaaacttcttgaggatgcgagtaagcgccgcgagaggtacaagattgatgatgctgtcattgcacgaagatcggagagtattgatcctcggctaggtgctatgtacaaaaaggagacggagctagtcggtctcgatgggccaaagaatgtgctagtgaagacactcatggaggaagatggaaaattgaggaaacaccgagatataatttcgattgttggatttggaggcctcggcaagacaacgattgccaacgcattgcttcatgagctcagagtaaagtttgattgccatttctttgcattggtgtccaacaaatctgatatcaggaatattctaaagagtatactccatcaacttgacaacaaagccaacatatttgaaggactagcagacttccaacttataaataaaattagagaaatcctgcagaataagaggtacatttatgtatataacttttcaattattcacattgatttatcatgaacatatttatttcatttttaagttgccaacatgaaacattcatttaaattttgtacactatttttacctatgcattttcaatttgctagcatacctaatgactgattacatgtcttagttactccaattgtttccttgacgttgaactgttagtgtaatatcatctcgacgaaccaaacataacaaatcatgtaagaggtaaaaaaatagattaaactagaccaaacctaataatacaattactcctaaacgatgaggaattaaccaatggaactttacaaaattctttcttagcgtactagaaagttttttaggtttattatcttgaaaaaaatggtgctaagcgaaaaaagaaaaagaaaatgaagacactaagaaaaagcaacaagacacttctggatgcttaaacttgttctttattgaattaagtaatttgttcacaaggtgtatccgcaacacccaaaaccgctcaaaatacactctcccccacccccctccccccccaaagaacaattcaacccagtttgaacagttgtttttgcaaagttaagtgattagaatccaaaacatttactttttaactaagcatgcacccacttagaaaaataaaaattagttcccacataaaaaacatattattaggatgccaacatgaaaaccaccattaccaggttgaaggggtattctaaccaattttaatagttaagggtataagttgtccagtatcgtagttgacattgatttcttaacttctagacttggcaaatagttaaggtgggttaaatacttaaatggacttcactctttataaaatttagcacccaccatgttaagataaatttagatatcgcctagtctcaaacttctactatgacctaatacatgaatattgtaggcagatttgaatttttttttttgtgaaagagatttaatggtttcatttacaagttacaaatcttagtaccatttgatatattgtactctctgtttcaggttataagatattttgactttactgcttcaagtttgactaagtttatagaaaaaaaatagtaatatatttgactcaagataaatttattataaaaatatattttattattaatttaataaaaactaatttggtaatgtaaatattactgtctataaacttagtcaaacttgaagcggtttgactttgatcaaagtcaaaacgtcttataacctgaaacggatagagtggtcaaatggtgaagtttgactcccggaggccagaactattgggggaatgttggaaacatccatcaactttacaataagatacaattcaaccctacttttgcaaaaaccattcgattttcaaccatggcagatggcaagaatttagagtgatttcaaagatgaagtgacctgctgatcctaagcaatgtcttaagcgaaaattataaagtggtttcaaagacattaattgtcaggctataaatgggctgtggctagaaacaactctccttttagaaggcaaagacaggtagtgtttaaactaactaaacccatttttagggtccaatttgacttaatttttttacctactaaattgatttaggatcggaaaactctaaattgtttttacacaaaagaataaaggacatgctctattcaaagcataaaaactccaaattagtaaatgtcttcaagcaaatttcacaaaaaattaagacgcacattggagtactaaaaaaactacataagttgggagcggagagtaattaagtttgagggactattgaacaaattaccacaagtttttttgggtgaaaaactttcaaatgtaactatagccattaattcgtcattagtaaatatttactgtagcaccatattgtcaaatcatggaacaattaggcttaaaagattcgtctcacaattttacacgcaatatgtgtaattagtttttgtttttgtctatatttaatacttcatacatgtgtccaaacattcgatgtgacagggtgaaaaaacttgccaacggatctaaacaggccctaaggaacacgatgcgcgcggctctccctcccctgtggtcctgtgcgcttttttttaatctttagtcccggttggtatgaacaatcgggactaaagtgctgatctttagtcccggttggactaaagattgttggcggcctagcaccatctgacaagaattgaaccgggacttaaaaatgatctttagtcccggttggtaaagatcataaagtgtcgttgggctttttaactgggactaaaaatgatttttagttccgattcctattaaaatcgggactaacgtggtttttccaccatccagcaaagatcagagaactccagtagtgtaagtattaaaaacgcacactacctccataaaacttgtacataagttttatagaaaacataatatagttacaatgtaattacactacaattatattagagttacatttgaaagtttttcacccaaaatgttacgacaattttttttatcaattctcaagtttaatgtggtcatatttttttaaaaaaaatagttgtaagcattatttttgggccaactatactttaggaagcatctttttctaaattttaggtgatctactaattctaaacaattcaaaaacatgcttgtcaatgtccatcagcagcatatcacctaaaacaactctaaattcattcaaaggataaaaagttaacggttatgataattcagggttcaatggtttttgttggttctgacgcttcgggttatttcttcgactttcatggaatttcaaggttgtaaaatatagattaagctttctatagtatcatatatttctgaatctaacagatacctttccatgggagctctttccatggagtcatttgacacaattactatctagctttactgacatgtgttttatacttcttacgactagattcttgtgtgtaattgatgatatatgggaagagtcagctgggatgttatcaagcttgctttgctagatggtgatcatggaagcaaaataatcacaaccacccgaaaaatggctgttgcagaacgtgtcggtggtgctgtttatgaactaaaacctctttcttatgacgactcctacaagttgctcagcaagagagtatttgacactgaagacaggttcgctccggaattgagtgaagtcaccagaagtattttaaataaatgtggtggtttaccattagctataattactatagcaagtttattagccagtaaaccgatgcaaattcaggaatgggagaaggtaaataattctataggctttggacttggaaataccttgatgtggacaacatgaggaaaatactgagtcttagttactatgacctacctccacatctgaagacttgcttattgtatctaagcaaatatcccgaggatgcgattatcgcgaaggatattttgatttggagttggatagcagagggttttattaccaacgagggagaacatgggagaagcttacaggagattggagaaaattacttcaatgagctcctgaataaaagccttatccaaccagtagatattggccgcatttgtgaaaacgatggtcaggtgcatgcttgtcaagtacatgacatggtgcttgagttcacaaatcagttatctgctgaagaaggatttgttgcagcaatgccattagatagtgaaaaagaaggtatactggtaccgtctgttcaaaagaaagttcgccgactatcttacaattacagagacaacgattcctttcttcatggaacatactataccaccaatacatatgccacagcagaagctagagagagcttgtccagagtgaggtcttttactgtcttcaacagtgtcaaatccataccacctctaatgatctttcgtgttcttcgtgtgttacgactggatgattgttcgaatctagaggacaatcatctcaatgatctcgcaaagttgcatcacctaaggttcctgcggctagggaatatcagtaaactccccgagtgtattgggaatctgcaggttctacagactttggacataagagatactcgctcagtgattcagttaccaccttcttttgtcagattacgacagttagtccggctgattgctcacaaagttagtctggcagatggtttgaccctagggaatatgacatctctacaagagctgacatgcgccggtctcactgaaaacttactgcaagaggtgtgtgatctaacaggccttaggattctgaatcttatgctttcttcagaagaggattgtgagatcttcagggatgcctttgccgacagcctaagtaggcacaaaagtttgcagaacctcacactagatccccaggcctttacggcctagatttcatgcaacaagttccttgctgtctccaaaggtttatgagcagtggcccattctataggggattccctcgatgggttaattcctcactctcctgcctcaccatcttatccatcaatctgaacaattatatggagcaggagtaccttgtgactctcgcagagcttccctctctacagtttctcaggatatttgcatctaatgtagtggaagtgatagatgttgaacgtaagaagagaaggctcattgttcacagaggcacatgtgcattccgttgtctacaagaatttcacttttactgtcatagaatgtgcctctcttttgaaccaagggctatgcaagagcttcaaaggatttgccttcagttttcggtgtgggagactattgatgtctacggtgaaattgattttggactggtgaacctcccttctctccggaatatttttgtggacttggatagatttgaaacctcaggagaggagattcaggaagctgaagccgctatcaggaaggcagctaatgatcatcacaatcatccatcccttgattttgtttctgtgtatgctgacttatctcgtcacgtgtatacagtagttaaaggaatattaagacaagattgatctgcatcaaatctacgtcattccttcccatacatgctttcagcatgtattgggttttgatttgattgttttactaaccatttttcttacccgcttcagatttgctatacttccattgattgacattgcctttcatgattataaaaacttgatgcactcctgacgccttgttctggaatatacatatgtctctctcgtttgtgtgcagagggtaagcaaatgtcattggtgatagaccagcctattctgttcctcaaatcaaacaaattagtgtaagacgaaatgattatgttctgttctggcatgacacatggttaggggcgtgcctctcaaacataggcaccgttacatttttgacatatgcaataaattcttaatagagaaaagaactgttgcagctttggtgtttgggagatttggcttcagaaggtctcatttcttggatcaaggattagcgttttcaacctccttgatctgttaagctggagagaactatcagctatttgatctgattgaaaattgttggccaaatcctgttgaggacagatgcaaaatgggctcttcggaaaagggctaagggctcttttcgaacgcaagaattttacatgatttttggaggatttagttcaaatcctataaaaaaatcatccatttcaaaagagggtggcacatgtttttatgcgcatgagaagcagggagaaggagagattctggaggagctaagataacaatgaaaatcaagatgtacatgtggcaagcctactgggacagaccctgcaatgcagctggagaataggatctggtaaggaggagatggagaaaatacaagtcacaattttcgtttgctcgcaaaactgcacaaacttatattgttttggggtgtgatttgtgcttttgatatacagctggtgggaccacatcctgttcttgtttccttctttttgtttgaatgatgcaatatttgcttccagtgaaagtgggatatccttgatccaaaagaaaagggccaagtgactaccaatacatagagtttttatgatattcgagagatatttgtacatcttagaaatgccaaaaatatttgcaatatctccaagaagcatattaatacaagagtggcttgtgtatttttaatatctccaatgagcatattctatttgttagggctttggctttttaacttatactggatgcaaccccgcatgttgctgggggatatctagttaagaatggcagttaaaaatgacaaactaactgtgctaaaagtattgaaaatatattgaaattgaataactaggaaattgatttcccatcaggaacagagcagttttgcaacatagaaaatacacagtgctaatgtgctacttgatttcactatcataaaaactagtactattctgataagcattgtagaacaaaacagaaatcatgctttgctctaaaaaaaattgaaagtatttaggtgcataccgttgagtcgttgacggatgagcacacgcatcaaaaactgatgagtgggggagacaaacatcacacagcagggctggtggatctccaatctgattgaattttacatagtaggaaaaaaacaggattaagataaatgaacaaggacataggatgatttagcatggaaaaggggatttgaaaaggacgaaacagcaaacctgtgtgcttcatggagtgactgaagctgaaaggcaggaatctgcagaagaagaagacgtaaaaaaacaccggcgtatccaagacagacggattccagtggcaggaggaggctcgttgttagaggtcggggagaagggtacctccgaccggagctgcgcatggacgagatgtggcggtcgccgtcgccgtcggcgagcttcgcgggagaggggagccgtcgtcccgtcccggtcgagcgaactgagtcgccgccggcgaggagctagcgtcgtcctgagccgcggttgggctgggcacggcgtacgggagaacattgatgggccgaggcggggagagtccagtcactcgggccagaaatataggcctgacgaattttttttcatttttaaatttttattttttaatatttacggactatccaaaatatttatagaaatggccccttccgcccaattggaggagggcaaggtgtgcgcattttgcactgaggtcccttgccactctctgcaagggctacaagggggcaaatgcaattttcaccccgccaaaaatgcatttttctagtttttttttcattttatccgtccctcacgttaccctgccgagggcggcagggtctacttctgtaaatattttcgccggtacaatatttctataaatattaaaaaataaaaatttaaaaatgaaaaaaattataggcttgactatccttcaattgttcttttttcctgacatggctcgttgacttagttttaacttactgagtcagtatatgggacccatgtgttaattactcttctctccctctctttcttctctctttctcatcttatgcttggtagttggcagtgtgaggtggccagcgagagtcccctcaaccccaccggccgcgaagagaggtagctcgaggaacctattgggaaatgatagaaaacgcagcaagccccaaggggaaaacggaaaacggcacccgcaggtgtcgccattgctgacccaaaggctaggcctttgcccattgttctactcacccacgctaaagagtgcatgctagattcagcaaaaccaccagctaatctccttcgacgtgcaaccaccgcgtcgcaggccgaccatcaaagaagaatctcaaccctcgtcgcgcttcaaatccatccacgtggttgggttggagaggaagaggatgatagagaagaatggatcccttctccctgcactagcctgtccagcgtagccatcttatggcggcaagccgccgccgcaagaggacatacgcctggaaggaagctcgccacaggtttcaacaccccctcatagcgcaaccatcgccgccgcctcgaccaagctgcccgtcgcctcgtcctctcaccacggcagcctccgtcctcctcaccgcagccatcacctcgccgaccgccgccgaccatcgggagcgtcaccaccgctatcaggcaccaccaccgcccccggccgctccaccttgtgtcgtgcagtcatctgccgtcatcggctgagccttgcgcacgagccaccgcggcttctacgctcgtcggcctcctttaccggccgtcgtccaccgccaaaagtcgctgcctccgcctcccgtcgtcgctgcttgagcggcttgcaccggtcagatccgcgcgcagaggtaccagatccacccacggggggaccggatctggccgcggtggcgtcggatacgacgcctccacgctgcgtcgtcaacctctgctctgtgcgccagcccgccttccacgtgcagagacgggggtgccaccgagatttggcctcacgcgccgtcatcccggctggccgctcggttctccagcggtggcgaggggagggagaggaggagagaggggaggcggcggcgctaggctttccccccagcggcccgcgcatgggcgacgcggggtcgagacacgtccatactatggcgcttaatatttttgtgttcatgataaatgggttcacatatattttttttaattccaatgccacataagcgtcacattaacaccacgtgaaacgaagaccatgtcaacactgccacataggggtcacgtcagcaaaaacaccctccaagacctcgagggagttaaattacacctgttttaatagttgggggttaagatatcggtatcgtggttcagggaaacaaatcagatccggtcactagttaagggagtaaaagtaaacttattcgtagtgaagcccagaagcgggagatcaaggcccatctaggcccgacacgagagagccatataaaccccaccattctcccacccgcctcttccccacctgccctcctcgcgaaaaccctaaccctcctcctcctccgccgccgccgctctcccaaggtggcggcgctgcccttcccccttgttcttcttccttgcatctgcttccctcccgttttgcttctaattgtatttctctttcgtttccgcagatccctcccgtcgtcgtcgctgtcggcccctcgggtctttctagcgcaggagacatggcgtaagtttccccccgcaccgaaatctcggcgcccccactcgcttcatagttgatatatttttttctgttggtctggctgctgatggatggcgcctgagaaatgggttgtgctcctagcggttttgcgggatcatgcccttgctgttcgtgttctgtttttttgttttggaattgtgagggtcgcggcttgttttgacgaattgattcaagaacccggcgagtcttcagcttgtctgtaatgttgtgcgattggaaagctgtcatgctcatgtggctcgtattttagcgaaagcgtgagctgccatggatgggattgaaatttatgctttaggaattctttagttatgcctgtaatatagttttgcaagcagatttctggttcatactcagaaaaagaccaaacttctggggacgaatctagacatgtgcttctccgtattcatttccagaagttgtatttttgggacggagggtgtacatggtaatattaagcagatagaacatacggccagatagaaagaaggcttaatgcttgctgaattagtttttgttcgttaagcgagttgttctggctgagtgggggcatattattagttctcctttctacatttgtcctcgaattgttttgttttgcttgaattcggaaaaacctagctttgtgcacgtcattgctaatacagtgggaaattgacttttgcttatgtttactaactattttgagaatgcagcaccatatattgtcaaattacttggaactcaattatctaaagagcatttccagtagaacaaaactaaaaggaaaacgtgttgctaccttgtttactaagattaagcatccatgcagggaagagactccagttgaggccccacctgccccggttcttggagagccgatggacctgatgactgctctgcagcttgtgatgaagaagtcaagcgctcatgatgggctcgtgaaggggctccgtgaggcggccaaggccattgagaagcatgccgctcagctttgcgtgcttgctgaggactgtgaccagcctgattatgtcaagttggtcaaggcactctgcgctgagcacaatgttcacctcgttaccgtgcctagtgctaaaactcttggcgagtgggcaggggtgagatacattactcttctattagctataccttgtcaattgttatactgtgttaatctgatgtctaggctgccggataagattttttgatttagccttctgctaatgactacagttttaccagctcagtgtaaaatgtgctatttaattttgtaatcctttatctaaattttaatttcattttgttgttgatatcgttctgcatctctcctttctgcatatcttctgatttaacaatatcacaacaaacgttgtttgcagctttgcaagattgattctgagggcaaggcgaggaaggtcgtaggctgctcctgcgtcgttgtcaaggtagataattgattacccaccatactacttcaaatatctttttgccatcttcggcatttggtaatgttggcttgttctttctcatttaccaggacttcggtgaagagtcagagggcctcaacatagtccaggactatgtcaagtcccactagatatagcgttcccgatatccagaacttgtgcttgacattgtgtactttcctttatattttgcttggttctgtggcttgctaggagataagaaaatttttgtggtgtgagccaaggggatatgagcaatttggacctctgaactttatgtttactgtgctggatcagctgtttatttatctgaaatcatcatgagctgaggatctgtttgccccttattttcagtttggttttattgttcggtgaggtctgcatggtatttgatattacagcaaggaaattttcaccaactgtgcataggtgtaccatgtttggacaactaagcaggactgcgtgatcacgctgagatgagagaatcttacgattttcatggaaacaagtacgtttgcaaagacgattttatttctccgaagacaatttgatacaccatgcgactaatttatcaaattgtctttggatttcgatcgtctagggcttacagtttttcctttttgagctcaaatgcgagctgccagccccattgaagtaatctcgaaattcatttgaattttgacacaaaccaaacggtttgcgtggagatctgaattgtttctggcttaaatgcgaaccgcaatgacatcaattttgaaatttatttgaaaattgtcacaaatcgaacggtttgtggacatccgaattttcggcaaaaaaaatcgagcgaatctgaatatgtgaaatactcccttcgtacttgtaaagaaagttgtttaggacaatatttaagtcaaaccttacaaatataaattataaattactttcaagttgttgtgtttaaaaatgtaaaaactatatgactagatttatcttgaaaagtactttcataaaagtatacacatattattttttaataaatatttttatagaaataagaagtaaaagttgtgttttgaataatgtctctgctgtccaaaactactcccttcgcgagtacggagggagtatcttccccttagcacgaatctcgatgaaatctagcgagagggaaaggcgggaacggataagatagcaaatctcccgagccgcgaaaacttcttctccgacgccgatccatggccgccgccgccgccgccaccttcctcccccacacgcccaccccgcgccgccgcctcgccgtcgctgtccactcaccgacccgccgccgtctctccctcgtgttctccggccctcccgacggcgccctgtcggtggcggcggcggaggagaaggccgacgccggtgaggaggcggcggcggcggtgtcggccccgcggggcggcggaggaggaggagggaaggagcggcgccgcgtggtgcggaaagcgtgggagaagctcgtccggtggtcccggtcctggcggcggcgcaaccggagcgacgtggtcgagacgacgcgcaaggtggtggtgctcggagggggctcgttcgggacggccatggcggcgcaggtggcggccaagaaggccgacctcgaggtctccatgctgctccgggacgacctcgtctgccgatccatcaaccacagccacatcaactggtgggtacagctccaatctctcattgccccccatttcttgattcatttgagaaataatatcatatcattctaattctggtgattagatttcttgctgaatctaactttcagcttcttcaatttgtctcagtaaatatttacgagaccacaggttaccagaaaatatcactgcaacaactagtgctagtgatgctttagcaggagcagatttctgcttccatgctgtcccagttcaggtattcagaacagttcattacaaatcattgttcagtgcaatgggggttcccttccctcttgtgactcttgaggtttctttttgtggcagttcagttcatcatttctcgagggtatttcaacacatgttgatccgaagttgccgttcatatcgcttagcaaagggcttgaacttaacacccttcggacaatgtctcaaatcatccctcaagcgctggggaatccccgccaaccgtttattgttctgtcaggaccttcttttgcaatcgaactgatgaacaaattgccaacaggtttagtaagatcatttcttgacaagtttaatcttctctatgtcatactccctctagcttgtttaggatgcaatgtcaattggcaccacttcatgttttttttttctgttttgcttgtgtttaataattgtgaggatgcccagctctggtactttctataaagaacatggaatgtttttatttgcaatgaaggaaggaacctcatagttattaaactttacatggcagctatggtggtggcatccaaggacaaaaagttggcagctgctgttcagcagctgttggcctcaccgaatttgaggataagcacatcaaagtaaatattactaaccattggccatatataaatgctgatcactatgtaaccgagaattcttttatgtatagaccaagaactgtttcttctcttctgtaaggatttaggaattcagacaagcaacatgggctatcacttagtttagtaaaaataatgtacattgaatttaactatgcattcatgagaaagaatacttgaatgtgacttgtgatgcttcagtgatgttacaggtgtagaaattgctggcgcacttaagaatgttcttgcaatagcagcaggtatagtagaaggcatgcatcttggaaataactgtatggcggcccttgttgctcaaggctgttcagaaatacgctggttagcaacaaaggtgtgagatacttttatcatcagaatgtaatctttgaaggatcaacttatgaagttcactgattccttctttttttttccaaacaatccgaagatgggagcaaagccaacaaccctttctggtttatctggctcaggtgacatcatgcttacatgttttgtcaatctttcacgaaatagaaatgtgggactgcgtcttggttctggtgaaaaacttgacgaaatcatgaattctatgaatcaggtctggagcattcctgctattgaatcaacttttggatgaatgttgccaccatacatagttttaatatattcatctcactgtataggttgctgaaggtgtatcaactgctggggctgtcatcgcattggctcagaagtaccatgtaaaaatgccagtcttgacagcagttgcacggataattgacaatgaactaaccccaaagaaggctgttatggagttaatgaatcttccacaggtcatacatttaacttcatgtttgattctgttcttcatgataaactactttatcctgcaaacatagccatcaaaatacttgcattttaatataacatagaaatgacttcacgtttaatatagttaagatctctttcagatccctctttgatttcgctggctggtaattaacatttggtcatcagttacaaagtaaatgtcaagcatgcatgttgtataaaccatgtgaagcgtatctcttgcaatgtcttcaagttttgctcaaggtcctttaatagttatatcccatcgataacattttcataatacaaaagaaattaacaccttttggcttttgtagaataggtatttgcatttgtgattacactttgtaagtaagtgtaaaaacacattttcaattatttatctccatcatactaatggttgatccagcagcctacaattaatctggatggaaattgatcttgcatgttttttattaaaaaaaatcaacaattacactagcagccagattctggactgctacttgcttttagcaaccgtgctccattatttcctcttgagtcataaacctgttagtatggaatgacaatttctgtaactttggtttacaggttgaggaagtataacagcaatctaatggaatgatttaactgactctgccggccgcctgctgcactcaaattaaactaataatatgctccaaaatgggcttctccgtgtttgattatctacatattcagaagatgttctcttctctctcttaatccacttgagctttcagatatgaaaatgttatttttacacgagaaaacgaaggcgtgtgtacgctcgtatgcacagatagagagaggatatagtttatagcaccagaaagaaataggacaaggtcgttgtccgaaagaagaccacagttttgtttctgatctttttagaatcatttgatctataaatatgattctttcttatttttcttctgtatcgaaaacatgcagtgaattttcttcaattttacaggtgcaatatcttagcgaaaacattttattcattcaacgaaaacttgctcatggagaactagaaaacattgaaattaatgaatgaggaaatcacgttatcattatctgatataggagtatttcttatgcattgtgtgttatgtgttgcatacaaaattacaacaacatttcatttatgttctttacataccaaatgttgcttataagagttatacttacaaaagtcacacctcatttttctaaacatctttcctattttctatcatgagctccaataaatttgcatggaacagtgccgaccatagtcttgcactcttgcccttccccgtatgagccttaccaggaaatgagccaagagcattgccttttttttttaattgtaatccaaaactacaaagaaacttcctcttgaaatttcattcatgttccttacttacaaaacactgctacagtaacaaaagacatacctcgaatttccccttttgtcaccaaatcttaagataccctgcaactttgctcaaatagagacaacaagcaacccaactgaacaatgaaacacaagcattgctaacacagagaaggaaaaaaaaagatgcagtgacacatggcaaagcagccaaaaagaaacgaagtgtgactaacaaaataccaaaaagaaaagaaaaggagagaaatctttctctttttacgaaagagaagaagaaaaaaaaaacctggaagcagagggctggcggcccgggcccacaccacctggataccgaaacgccctcgggacgatcccagccgtcggatcccgccttatccgcccacgtgtgcgtatcggattcacccaaccccctcctataaatatcccgcccccccctcctccaccccacctcttcctcctcctcgaggctcgagctgccaccgccattggagcgccacgccacgacacgcgccaccgccgcagaggagagagagagaaaatccggaggcaggcggcttggtgtgggttgatgggcgcggcgggggcgatggagagggagctcctggaggcgttcgaggcggcgaggaaggcggcggacgcggtcggggaggcggcggcggcggccggggccggggaaggggagtcgccggaggccgcgcgctgcgtcgacgcgctgcggaggctgcgcggggctcgcgtcaccaccgccgccctcgtctccactcaggtgagccacgccgcgccgcccccctgtttgttgttaaaacaccgagcgcgggggccgtaagtagactggggattgtagggaatctgctctggttgttgttccgacggtttgggagatctctcggcgaggtgtcttgccgaggaaggggaatgtgggttcctgggaagcgattttagggttgtttttgtggcttcagattcaaattgttcgtattcgcatggataggattttcgcgtgatagttttattgctgtatatgcgtgcggggtgggggttgttagatgtggaaaggttggggattatgaacattaggatgcttgttttaccctgcttgcaaatctaaggaatatttagaatattcagattggttgatttggtagctattgtacggacgcttcattgaggggtgttggttgggttagatttggataaggggttgcagcaatgctatactggtatactataatgataattgggatttccgtgatgtctaaacatcaagcatgggtctactatactggtatgctgcgcaggcgcaaactattcgtaggtactgattttgcctgaggtggtggtgtcccatgtggtatgggttgcttgtggacctattgttctgcttaggagaaaattgaagtatggtgatattgctcaatgttctaggagttgtttgcgcgggaactattgttgaacgtgagaattgtgtggtagtgtgcgacacgcgaacaaggttggacccaggcccttggcttgggccccgggacagaattttctccgtcttggcataaacttggcccatatccaaggtttgttctaagaggtggccccaccttgtagtacgtatatggcataatgggacgcttatgcagtataatcggtgcttatacgacttaagaggtacaagattggggaacccgctccttgtatgcggcctagtatacctttttctagaacattgctcaaattacaatagggcggcctgggccttggcccatttctgggtatgcccttacacgtgcagacgtacctcgtaacacaaatgcctcttttttggggggtttggccctgggggtatctcatgtccaagtcattcttttctattgaaaagtaaaatataaaaagtatcgatggcgaaaggataccattggatagttcgtagaaagatgtgggttgtctcctgattttgtcataaaataactttcttattgtccactaaaagatgagatgaaattttggattctttccatcgcttcatcaccagcaaacaaaagttcaacaaatttgaagctatgttactctaacagtagatgacagcagttgctgagcatttacttgttgactatcctgcgttcctgcttgctgacacataatctttaggattatttccatgtcttcataaccagtaaacaaaagttgattctgaagcactggtgctctagcggtagatgacgtccttgcaggacagcagttgcttagtgttaccggttgactacgctgcattattgcttgctcacacataatcttgcttaccatttttagcaagcacccagtgtttagcttatattgctctatttattaccatgtccagttatgtaagatatgtaattccacctattttccttcctgttttgctcagcatggctagcatgcaaatgttttccttcataatggtacggtgtttttcttcatgacagcatcatatcttcccagagggaccttgcgtttgatatctagttattaatgtggaaagctaaaaaacttgtacatatgcatgtggtgtttgggtaatacaactctctttatgtcatatactaagttactaatacttacacaatactcttgtttgctgatctgtaaaatcattccataagatacacttatggagtaccatttttcatgaactgaaataccttcagtaatttaaggtttttatagaatttcaaaagcgaattgaatttttaatcccaactcttagtgctgagctgttgctttccatgttctgaaaactgggtgtctaggcttttattttccttttgtaagcttatctttcattcgattgtttgcagctcgtccattaggagattgactcttccatacttactccaattttatcttttgttctgatatagatcggcagacgtattcgctatctcaccaagcatcctcactcaagcataaaagcaacagcttcagacctgttaggacactggaaaaaggttgtcattgaagaagacaagaaaaatggggcactgcagaatggaaaatcgagttctactgtggtaaaggttgagaaggtggagcctatgaaagttgaaaaggcatcaccaagggctactgtcaataataataatatggataccagagttgtgaaccacaaaggtggaaaggttgagaagttttctaatgctgagctgagaacccaatctatcaaggttgagaaagtacaaaaggtagttcacaaagtatcttctgttgagaagccgtctcctgtccaaggtggtcctccaagactgacatccgttgttaaatgtggtgatgctagtcgagacagaattcgggcgatacttggtgatgccttctccagagtttctgaagagactagaaaggatgacagggaggaagtgaggaacatcatagaagaagtaaaagcatgtgacccattcaggattgctgtgatggtagagtgtgccttgtttcagaagctggggaattttaatggacctaataagcaaaggtacagatcattgatgttcaatctgaaggatgatcacaacacagacttccggagaagggttcttctaggacaagtgcagcctgagagaattgctgacctaaccccgacagaaatggctagcgacaccaggaagcttgagaacaagaagatcgaggagaaggctctgttcgagtgcgagcgtggaggagcaccgaaggccaccactgatcagttcaagtgtggcaggtgcggccagcgcaagactacctactaccagctccagactcggagcgccgacgagccgatgacgacgttcgtgacctgcgtgaactgcaacaatcactggaagttctgctaagctaggcacatcctactgagaagtgttagtgtagttgaccctggagtttgacaggcaggttagtttcgggccctgcttatctgggcccgtttcatcttttttccccttaagttagcttgttccgaattcgatttgttctagtgccatttgactgcataatggccggccgttgggcttgcattgtcaggctactgctgttgtgcttatcagtcttgtttattgtaccattggatgcaataatgccataatggtcatgctcatgagctgaagttttcacctgtcgtgtaactgcagttgatcttaattcgtcgtgtggtgttgttcttccttcgtactgttctctcaaggtgatttatttttgcacgtactgtcataccgtgatgcctccttcccaaataagctcacgcaactatactgtcatagaagtgaaaatgcaatccaatctggcttttctcaactgtctatttcgcctcgtctccagagttgaatggcaagtggttacggttgaagaagaatcttccaatttgagaaagttgcactccactattccaggagctgcagtactttatctacaaggtggtcctcttttctttttttttttcttgtgtttttttttatatctgcaaggtggtggtattttcttcacctctttttattttttgagtttttacatctacaaggtgatgatattttcttcttatctctctcctcttttgaagtatttaggttgtgtttagattcacgggtgtaaagttttggcatgtcacactggatatacggatacatatttgaagtattaaacgtagtctaataacaaaaacaaattacagattccgtctgtaaaccgcgagacgaatttattaagcctaattaatccgtcattagcaaatgtttactgtagcaccacattgtcaaatcatggcgcagttaggcttaaaagattcgtctcgtaatttacacgcaatctgtgtaattagttattttttcatctatatttaatactccctgcatgtgtctaaacattcgatgtgacagggtataatttttttttgccaggggatctgtttgccttaagaaaagatggtgctcttttatagactcgtatttcccctgttgtttcttcttaagatctaatgaaatactaattctgtacaatgtgctttccactgtgaactaataactgcaactggagtattaattaggtactactcccttttgattttggtcaaagtcaatctatttcaagtttaactaagtttatagacaaatacagtaatactatcaaaatgaccgtgcttc

SEQ ID NO: 43312 - DNA, 40489 bp, Oryza sativa
  unsure (1)..(40489): unsure at all n locations
aaataaaaatgtaaataaaacccccaatttctctatgggccattttcagtccttatattgtctcagcccgtaaataaagtctaatttaccagctccaactcctcctctgattgcgcaaacttgcatgcctatttggaggcccaatagtccggcggcccgagcgggagaagccggagccgtccaatcgaatggatggtccagattgatcctaacctacataaatatctgcagccaaaccctaaccctaaccctagatttcatttccctcccccaactcgccccgatcacctttctctttcgaatcgaaaagcgacggcggcggcgactccctccgcgccatctgttgacgaaaaaatcgaacacaccggcctgggagatctgcttagctcttgtgcaggtccaaatcttgatgagatgcgggcgtaccagtcagtttgatcctgcaactaacaagatatgcaaatagtagatcaaaacagccgatcggctgacaagccgatggagtagttccagccgatagccgataatagccgatgccgataccagccgatagcgatagggtttaagcaatcggctatatgtccaatgtagataatgatataaaggcaatcggctgatgatgatgtaataaaataacaatataatccagtataaaccaatcggcaaataatgatatgataaataagcatcgatccgaaagttaaagcacacatcggctggaggtccgatgtcatgaaatccacaagattagataaacagtgaaatctatgttgcgatcggctaaatccaatatgtattcaatccttatgagccgatgcaatgcctagataactcatcggctgaaaccccgatgaaacccttattggcagtcaaaaagcaggctagagattatggttctaagcatgacttattagatcaaaattaactgatgcagcactaagtatgaaaagaaacacaatatctagacaatcaagccattgactaatttttcagggtggtagatgtctaggctaatctaatctagcaaggcgatttagccgataccggcataaaccctaaagcgagagacagccgatagagctaaattgagatgctaggactagattaacatagacatatgataaatagccaggcaaatatatcatccaaaccagagtaatccaagaggtcgaatgtactgatgcagccttgaacgacgccgacgtagatggtacaattgcctggaccgacgggacattggacttatcccttcgccggagatcgaagacgatgcagccccgcgtcaggtgccaagttccgccggaacgtaaaaacaaaagtagaagtaaaaagggtggcgatgcgccgaattgtattgatcatagcgatagattacatagaccccgggtgtacatatttatacccatgggttgatacaagtccttgtcggacaagaaagaaactttcctaaagataaaaggaaaagataaagtccttataggacactaaacacactttcctaaagataaaaggaaattaacaaactattcctaattaatagataacttgccatgccgcattctctttgaactcggtctcttctggataagcttcctttagtagatcaatttccttaaccgaatatagcaagaatccgacaactaacgacttgacaagtctcatcggctaatctcaggacttcgaagccgatgctgactctgagccgacgactactccgggcttaccaaatttcattgttaacaccatctccccttccttgccggcggccgctccccccgccctgtctcgcctccctcgtcccctcctcctctccctcgttggatatgacgacggttgtggcgggttggcggcggccgcggacggatccgagggtggtggcggcggctccctctagcctccttcccgcggcagatcggcggcggctccctctagcctccttcccgcggcagatcggcggcggctccctccgcccccgttcgccttcctcccgcagcagatccgccggcagtggcggcggccgctggcggatccggcaacggcggctccctccgcggcctctcttctcccttcggcggtggttgtagcgtcggcaacggccgcggatgaatccggcggcggtggcgaaggttgagggtggcggtggcaacggccgagggccgtggtggcgatggccgagggcggatcctgcggcttcttctttttgatgtatatttttgtgaagttttgtgatgtattttgtgatttggtgatgattgtgaatgatcttttggggcaaagagtggttgagttttggttgtgccgattttgggatatgtttcctatatccgattctgagagctattgggattcgggggctgcgaaggcgtcccgccgacggacgaaagcgccttcgtccgtcttgtaacaaatggaaaaatacgaatatttatattagttaagatttataggacaactctattctacacctcccccttaaaatagctattctacaacccctcctatcctacccaacaactccacccggcccacccgatcccgccctcatcctccctctctcgtcccgcccctccctcgtcctttcttccgcgcgccctcccctctctctctccctgcgcccccttttttttctctcgatcgagtctcccctcggacctctcggcaccctctccctctgatcgatctctctccctctcttttttttctctcccggcgccctctccctctctcttttttctctcactggcacgccctctctcttctctgattttttttctctcgcccgacggcctctctccctctaattttttttatctcacattggagagaaattttaaaattaaagtgacaaaaccaagacttatccatgacctcatggttcaaagaaattctctattaaccaattcaccctatgacatcttgtgattagagtttactgcttcaatttaatatatctctattcaaactttgtgagagcaaatcacttatattgttgtgaaacttataatctgttattatgttccagtagtaacattattgaaaaagtgcagtaacacgccacgttactgcaaaaatatgtaggttgctactgcaaaaatatataggttgttactgcagttttgacagtaacatcctatggaaattgtagtaacgcagaacatgcatgtagtagtaacggtacttctacaaactaccgaatgttgttactacgagtaagtaatcatattactacaatatagtcatcttattattgtgcaattcatgcgagacgaggacaccaaagaggtgggcgtggagggaagtgagcaacacaaaagatacaaagtagcaaactaaacacaagtggattatttgaaattctaatctttaaacaatcgtatctctcgcatcacatattatattgttgaacagtttccaccataatgcttttaaaaaaagagctttacaaaactagatccgttatcactatattttgataatgttataatattgttaatgcgagaaagtaaccctgttactgcatgatggttgtcttgttagtgcacaattcatgcgagacgaggacaacaaagaggtggacatggggggggggagtgagtgggcgggtttgatcgaggtctgactggtgggaggacgctttgaccgacctttgactggggtgggaggggggttttgggccctaggaagggtgggggaggtgggtttgcccatgggagggagaggggggtagaatagttattctaaggggggtgtagaatagatttgctaatatttataatactaaattagtttcatcaaatcaataattgaatatattttcataataaatttgtattgggttgaaaatgttactacttttttctacaaacttggtcaaacttaaagcagtttgactttgaccaaaatcaaaacgtcttataacttgaaacggagggagtagttttcttgttgttttcaccacaacagtagaacttcctccgtcccaaaatgtatacattttttaggttagcacggtattaagaaaatatgtgagaatgattgaagaaagtgtgtgattgattgaaaagagaaagtaagtgaaggagaaaacgttgtgattggttgagaagaggtaggtggagaaataacttcactttgggacaaggtattgtgctagaaataactatattttaggacaaaggtagtaaattattagtaatcaatcatatcaacaaaaatttatcctagaaagagatgggggaagggaggggagatggggaaaggagaataagcagttgtgtggttttcatgtggggcccacatgttttttatttttatttgatgccacgtccgcaccatgtcagctaaaaccgcttaccataatgctttaggactatatttgtaccggttttacaagttaagagacatgttatatctgatattacggtacctgaatcctgaagcgaacttattccaccaagtaacgtgcatggtttccaccacggccactccactttcggcccgattaaacccgtaacgttgaaccgaccgtgaaatcatgaacctgggctctcctctcacggcctgcacgccatgccgtgattaattggcctcaacgcgctttgattgtgtgtcaagtttggtgatgtctagtagcatatgtgtgtacccctaatatttggagaagacacattttcttcctactccttcaatttttaatcacatctagatccaatttttacactgttttgtaacggtacaacctttttggcactatcaaatttaatagagtagaattgatatttagttggtatcgaaataaacatcaatgtgctattaatgaagtcatcaaaattttgttggggaaaacctgaccttctgtccctggctggctagcacgaggaaggcagtgacatggaccatcagtgccatgcctctatcaccagccaacgcacgaggagcaagatgtgcgagacatggaggatcgggtagtactcaatgccttggccatcgacaagctcctgttctgaaagaaagacgctgcatggtcaccagaaatagaccaaggtctggaccgctccattaaaattttagcacaacactgaaatttcgaagtgcaccatagaccttccatcccgagcctcaggttgttgtcgaagtagccgcccgtgcctgtgtgtgtgttggcaggggcggagccaggtgtggggcagcttgggcccgggccccacacctggcagaaaaaatatcaaggaatttactaatttttctattaaaattcgttcaagaagtttatactctagtgattaagccctactcttgatataatcctggctccgcccctgtgtgttggggtgggggggggggaggtgcaccaactggcagtgctacaatgttcacttccatgacagaatggtgtgaatcgtggtccttatgcaggcagtaataatagatattccaaatccaattttgcattacacccttgtgtttaaaaaaaatccgatattcggtcatattgagaaggtatccaaagtcatccgtgacaccatttggggtctatagtgaatgccctaattagtgaaaaccctttaagaaaatgttactaaaaagagtacattataatcttaagcaagtatttgtcatgaaaatttaatgatcaaatctacaaagaatcaatccaaacattgtttttaatatatcaaaaatgaaataatgttgaagttggttgggttaatcgtctttaaaaccctgtcgtatgttaaccttagaattattataatggtgtggctaaggaataattaggcattaatcaataataatgctatgcgtgtgctttgcaacatgattgggaggaatacgaatgaatggttttatcaggttttgttttatatatttgtttttcattattttttgttgggtgaggtgtttttaacgtggtgggagtacgattgtgggaggggtggaggacgactccattttcatagtagtagagttatttttgcaaatccattttaatacgatccctcgttacgacatggcgaaccgagggctgatcataagtggagacgagacacaaaatttaacacgctacaatgactatggacagcatattgatatcacctgcagtcattaaggacggcaagttggtgaccatatgtgatgtcatccatccatctattaaacatggtgctcaaatcgatatttctatcctatgtaaattacatcccacttctcttgacacttggattcatattgtacatatctaagggcactcccaattgatagctataattgttactatggatattaatacccttgacacacaggattttagatgatatggaaagagaacagaaagtgtcttccatgcattggaggagaaaaaatgtcttcaacacattttccaaaaaaatatgtccaatagtgagaagtaagagaaaataaaaagaataagagaatatttattgttggcccacttatatatactatgtattgagaaagttatttctctagttttgtctatgtggcattgaagtttcaattatacactcgtatttgctaggactgcacagcaactgggtctatggaaatataccatttcatttagattctaccaagtttgtgcttatgctattaacaatgttcgagctacatttgcatttaagcttgatacaagttctacaacacacctacattacactttgacttgtttgtgtaagctatcttgcaccaacttctccctccaactcatttttgcacaagtagaaggttggaagctataacaatggggcgccgtgtaaatatataagatcagctcttcacaattaagccatatgtttactcgtccaattttcaagaaatacaatgtttaggtgggccaaaatattacctcatcaaccgtgaaaagaacttcaaatagagaaagatacatacctccttcaccgttatttcacaaaagaaaatgatagagatttcgggtgaccaaaataacatctatactaggcaggtacatcacttcatcagttcagtgaatttgtttagaaaattgttctcacttgtagatgtgggtgaaaacagattaattttgtaaaatacaaaacaatagtcgcctctttatagtgatgtaccaccataattcttgaagctaaatagcactatatactacaatgtataaatgtggttttgaaatttttaattgttttcaaagattcacctaagttacacgcaaatattaccaaattgcaagctcacaactgtcaccaaccataacacattaaaagcggcggtttccaactttaaacccataagcatatgcagatttcttagttgactgcatcacacttagttttctatgagtccgctacggtgttaatgttgggttgcatgcctcatatgcactactatctctccatttatatttatttgcgcatactaattttaatgatacggagtacacattcaatggaggagatggtctggacatccaccaagctaaaacaaaacttttatctccttaaaaaaactcaagtttttcagcattccaccgtgtttgtttctaaaaaccatataggtggatggcatacgccaatacacaaaccacaagaccatacacttgtaaaaccctcacaaaccttagtctgaactttattcacacccaggcataggcagcctcccggaaattatcatgatggtttcaccagactcaacgacaccgtgcacctccagcgacagctcctcgttcatggccaccccgttgagctcaaagtggtagtccccttcggccagcagcggcgtctctgggtcgccctcgaagttgtcattcagctgctcctacagggtggcgaccatgtccgctggcgacgcctccaacaagaaatccatgtgctgggagtgtgagccctccatcagtagcccgatcacaatcttattgttgttggcatccacgttggtattgcggttgctgccactgctgcttcctgtctccaccatcttcttgcaatcaacaattgtcacctccaccacgccggagtcgaactcgacgtaggcacctagaggccagtgatccatcatcaccatgaggctgccacacacgaagtcgttccacatgcactctggcaggggcatgtccactttttgcgcaccgtggatgcggagttttagggcagccacgctctcctcgcgacgggcgaacactgtgaccttccgtccccaactagccggagggaggtaggcggtgacatggaccgtgtcatgcatcctatcaccgccgctccacttggccagcccgtggatccagcagaacctcgccgccacctgccaatgggggagaagcaggacatgcgagccatcaaagatgggataatactcaatgtcgtggtcatcagcgagctccctattctagaataaaaggcgttgcatggtcaccgggatgccatagcaactctccaccttctgcttgatctcaacaaccttgtcaaagggctcgaccacgacggtcaggcggcaactacggctgactaccgtcggcaataccacgacgttcacatccatggtagtatgatgtgaattgtggaagaatacaacgagggagaggccgtatatgtagcaagttgttaatgtctaaacaggttcggtttggagcaagggcaataactatagatgcattaatagtttctaatgaaatatacatgcattaatagttccaaatgaaatatgcattaatagttttaaatgaaatatatacacacattaatcacacatattgcaaatccagttttgcattacaccccttgtgtttcataaacaacaaacgtccaggacattttggcattgcacctgaagtcttccgctacaccatttggtctcaagagaatatcttatttaatcaaaacttttcatgaaaatattattgaaaatctagtacattgatatatatgttaagggagtactcatatgaaaactcaatgatcgaatctacaaagattgaatccaaataattttttaatacattaaatattcgctaaagttttagaagttggtttggtcaatcatctttaaaatcacgccgtttgctaacttttgaattataacgatgtggctactttgggattaatcaaaattttagcaaatcctattttgcattacacccttttgttacaaataatatccaacgtttgggactttttcttgcaaggtacctaaagttatccgcgataccatttggtgtttatagggaaatatgctgcttagcaaaaccttttaagaaaatattacttgtaacctagtacaatattatgttaaggaagtactcgtcatgaaaaatttaatgatcaaatctacacaaattcaattgaacaggttttttaatgtattaaatagtagctaaagttgtagaagttctatcagtccatctttaaagccgtgtcataagctaactttagaatcattccagtgatgcggctacgcaatgcaatacttagacacaattcaatgggctacacagagtgtatggaaagtggattgagatccctagtgactgtacgatctcatccatctatctattgaacatgcatggtgcttagatagataactataatagtgtctgctatagtaaatctaaatttttttcatgtgtaaattctacctcaattctccttacacttggattcatattgtatggacctaagggccctccgaatgggtatctatggcaattaatattcttgagccgtaggattttatattatatgttgtgaagagttaaagaagaaaaaaagtgaggtagtgtcttgcgtgagaagtggtttaaacacaaaaactaagaaggtaatattgcattggaggagaaaaatgtcctcaacacattttcgaaacaaatatgaccaatagtgagaagttagagaaaataaaaggaatgagagaatatttattgttacccccatttatagatattatgtattgagaacattgtgaatttttagtgggacctagtgtgtggtggtaagtgctggtatttcttaacgacattactagaaatataattcccagctatggcgcagaaatactcctggtatattatggttacagagttcatccgcaaccgcacggatataccattgtagcatttcacccgagaatattccaacggtatcgtatttatttaatcccgtgggaagatcatggttgagagaacttgactaataatttatatattacttgtaataatcatagtctaaacaggggttaagataattcaagggtagagtgacaaacaagcaggaagctactcattctcacattaaaatatctaagctaagtggaaagaaaagagaaagagaatctattcctatacttctagtatatatagtatacatacatcctagttatatgatatactagctaataccctctatccgatgccctcctgatacttcgagaagccacccctgactgccgagttccttacgacagtccgtcatggccatacaaccggggctaaatacgaaggaatacgctcccaggaaattaacttaggactatatacacgcgcggaggaatacccatactgagctatcatcatcaacggcccacctctcatccacaacatataaccccaaataatgatatcccgtagtctagacaccacgcctaaactaccagatactactctaatatcatcgtcatgacatagagtaattgcataaacaaacactatacccgtaccaaagcatctcccagataagctagcagtataatcagtataacatgaacataatatagagttagctttcgtatactcagaaagtatttcaataccataaatgtataaagaagagtattctaaataaagtacaaagcttacaaaagagaagagaagagctactagagccatatccgaactcttccgaaggcttccggactctgatttctactctatttctattccaatagcttaagaatactaaactaacttgagagaatatgagagagctcttgcttgaggtgtatgagtgaagtgagaatgccaacttcttttatagcctcccaatgacggttgtgatggttggaatggtcggaaataccctccaaccgtcattgggggctaatccacaccgtccaggtgaagccctggatcggatggcgctgaggagggtgacttgtgaactttggcccaattcgtcgtgtcaattctgagttcttggcccattcacacatgttgatttatcgtttgatttgatgtcgattctccttcactttatacttattctctgcaaaaggttagtgaaccaaatactagtggaatattattattctaatatgtatatgcattgaaagcataaccagttctcctctcttttggtaatattgacggtcgaaactgaccgctaacgaccatcaacaaaaccccctaagattgaacctttgctcgtctcgagtgaaggacgaaaggaaacaaaaactttcaactctaaatttaaatttataagacaaattttgaaaactttcaactcagatttaaaactttcttcaaattgaaaaactttcaagtaatgatttgaaaactttcaactcaggtttgaaactttctgaaattgaaaaactttcaagtaatgatttgaaaactttctactcaaatatttttgaaaacaatagattaaaaaaaattggggaaaaaccacaaaaagagaaaataatgaaaacgatgaaacaaatagcaataaaaaaagaaaatgtggggagagctagcgccagttggcgcccgccatttctatgtgccaattaaaacgaggtgccaacaaatcgggcgcccgatttttttaaaaaaaatcgggtgctgtttcaccaagtatttcaaacatgtttcaccaaatagatcgaaaatgtttcagtattttaaaaagctgaaacacaaccaaatcacctcataaaacattttacaacaacgtatgaaacaacggtttctaaataaccagatgttgtttcaccctatataaaaacacgacaaattttgttacagaaaatcgcaattgtgtggttttagctcagagacactgcgaaagtgaagttttagagagaatatatcacataatcatggatatttgccgatggacaacgcgccgtttaaaggatacttgtcgtgctgacgtggcggacaggagaccattttttgacacggtcggatgcaaatacccctgcaccacgtcagcaaaaataggcctcccgtcaggccactccccaccacagccagctacctctttcccctctccgccgccgcaccaagccgttaccccgctcggccgctgctgccgcgcgcgagcaccacctgcgcaccactgccgctacgccaccacccgccgtcttcgtcttgctcggggccaccaccacgctgcgagcgccacccccgcgcgcggccaagccaccccgcacagcgcctccacctccgcctcctatgctcggcgctgccccgacacctcctcgctgtgccagccttttctccccatccactcgatgttcccgggccgccttcaggccgccgccgtcgcctcggcccgcgtcgtcgcgcacctgccgcatcccgctcagggcacggcggcacgcatgcgcgtggggagaaagggaaacgagagggagagagatgaggagagatcgagaggagaagaaatcaagagagaagaaaaataagaggagtgggacactgtcaagtgggccccacataaccttattatctctcctcatcccttccaatgcctcaacggcaactgggccccactgtggtaaatttctatttaatcctcctcttaaccaacacaaccgctttaacgtgggacccactactccctccttcatcaacacggcaaggcgtaggggtatttacgtctgactgtgtcaaaaaaggcctcccatccgccattagcacgacaagtatcctttagacggcatggtgtccatcgacaaatatccacgattatgggatgtcttcccccaaaactacactttcatcgtgtccctgagctaaaaccatataattacgatgtcctgtcgcaaaatttacctaaaaaaatatttcagcaaatagcaaaagaatgtttcaattattaaaaaaagtgaaacacggtcagataactagatgaaataatctggtttaacgtatgaaaaaacgatttgaaactattgcaacactacaacccacgtgtccactaagatgaaattattaaacaatatcaaaattcacagtaacatttgattcatacatagtcaaacatcgtgaatacactagctgaaacattgttggtagaacaaataataaaactgatatttctaatatggcgtttccgttatatccgaacggctgttgcaacggggcacgcgtcggcgcgtgatagggacatgtggtgggggcggcgcgcgcacgggaggcgtggtgtgggggcgccccgatatttttttggcgcgcatcgggcacccggcgctgaggattttcctaattagaagcgcccgacttctagttctaagcaaattctcaaaaaaaaaaaaaagttctaacaaaaaaaaaaagtaatattactacaagtatattactgtaaataaagaaattgtaaagtcggttcgtgtcctgcctcagaagcaaatccggtaaaaatcgccgctcccctccaaaccaaaccagaaaccccatttcaaaccaaaaccctcctcggcgacgagctcgaagcggcaatggcggacggcggcggctacgacctcctcaccgcgctccccgacgacgtcctccgcctcctcctcgcccgcctcccctccaccgccgaggccgcgcggaccagcgtcctctcccgccgctggcgcagcctctggaccaacctcccgcagctgcggttcgcggacgtcaccgacctcgcccgcgtcgccgccgtcctccgccaccactccgccccggtcctcctcctgcgcatcgagagcagcgaccccgccccggagaagatcgccgccgtcctcgacctggtcgcgccccgcctccaaggcaagctccacttcgacatcatcacgccggggaaccaaaattcggcggcgggggcggcggggatcggggccgcgattcggatcccgtgcttcgagaaggccacggaggtcaccatccgcttactacgcggcatcggcatccggctgccaccaccatccggcgtcttcgcgaggctcaccgcgctgagcttgagccactgcaggttggacgaccagagccagcgcgatctcggaggcgccgtctcgtcggaggggtgcccgtcgctacgagagctccgtatccgcgatgccgatgtggtgtccaatctagccatccgctcggagtctctccgccttgttcagctgtctcgactggaagggattcgtcagctcaccatttctgctcctgcgcttacagaactagatttgtacgcttgcttattgtgggggatgccaatggttgacatctttgctccagcgctggggacacttcgttgggttgattttttccgttcgagttcagtccgattcagagcaatgccaaacgtccatacacttgctgtctttgtcatggtgtatggatacgtttcacactctctgccactcctgcagtattttacggaagcccgcgatgttcgtctctctctcgtctacagctctgtgagtgcaccttctccctgttgttgcattacattgtgatgaagctaatgtactgataatatttttctagttcataaccatttactagtatcttagcataggcacatgccgatttaaaagataagagtaagatatcatttgtgggactcctaatcagatgcgaaataggagtatgcaacttggagagatctaatgagtccatatggcatgtagatttggagataaatgacagtattagcccaattttaattccttagggcttgttaggttaatccccatgtggaaggcattgtaggggattaatttcacatctcaataggtgtggaattaatcccttccaattccccttcaatccctttggaggagggattaactgaacaaggccttgaagtgtttacattgttttgctcaagccataaagttggaggcctatggaggttcttcctctgtagcattatatttttctctgatacatttttcaatatcatcacttccttaatccttgtgcaaagtcaaaatacacatattaagtaattatattatgtgaatttctgttaattttcagatcagcagtaacgataagctcttggtggaagcagtgaaagatgagctccctgccattgaaatcctatttctgcggttattaacagaaggacatacttttggaccttgagtattccatttgcttaggatgtctcccagtacaagggagctgaagctgcagttagaagatcacactgaggtaatatatagcttttcaatgtaattaaataccttggtttctggggaagtggtataagtatttgcaatctaatacacctcagcttgatccttttactatgagttgtagtacttgatgtgtcagtcccagtaccgatatttccctccatggtttatctattaacactacaagtgtttcccttcttcaggctacagcctacaatctacaagtttgattcaactgttaccaatgctgctttggttttctatgataaaatagaaatgattggaatgtagctgcaaatgttgttcagttgctggtgattgttatgggtatattgtggatgtagtaagattcatgtcgatgagacttccaacaaaccacaccaaatgatcaaatgaaattccgacaaaaaatgtcgtaatcgtagtcaaagtatctgaactacattttccaatttttctttttctttctccctttctatacaaattacatctggaagtgattagatctgaaagacatattgctcttatacgaataaaaggtttgcatgagaatgatcatatccattttcctatgttgttcctgacttcccttttatctgtatccttccgtagtattcttaatatcgatttcttacatgctcttcatttcagggtagaaaagttccttgctcatctggctgcatttgttacaagccccgtgactgggaaaccatgaatttgagcttggtgtttctccagaaagttgaaatcaacaacttgagtggagcagagtgtcaaatatattttgtcaaacgactgttgagatggacgccagtgctcaagacgattactctaagttttgatccttcagtaacagttagcgaggagctgtctaaggagctacttagcttctctaccccagagatttgcatggaaatttacttgcaccgcgatggagctagggtgaagtatagtgcagcaaactagacctagagatgattaactcacgatgaaatggagcacagtaatcaccgaaaccaggcaatttcaggccttcctttcagatcaactagagtcaaagatgttcgtctgtcatgatagaggattgtcgtatacttgggtattgttgactgcacgcactaacaacttgggccccaacgtgtgtttacattctctgaggaacgtttccaacatgcatttggaagttttcttgctgctggtgaaaattgtcagattggaattttgttccatttaaatgggaatgctgtgttttccttgcaggagtatatgatttgttcaatttgctccaggcacccaggtcagtgttcaattctgccgtgggagggttatcacagttcagtgtaagatatctcaaaaaaaaaaaaagaagagaagttcacagtgtaagagcacgtccacctcgttttttttagcacagttgatgtcaattccatataagcacaccctcaatatagcatgatgtcataaattcgttatagatgcgtttgcatttgttatcagatactccatccgttttacaatgtaagtcattctagcatttcccacattcatattgatgttaatgaatctagatatcatcatcgtctgcgtatcatcatgctgatgtgagatgtgcaaccgaaataggagtagatgagtttgagatgtgcacgcttgttgtaagggcgtgtgcattagtacgaaatctgtacgggtgagccacccacatctaagcaaactactgtggaattatgtatatatttccacttatgaggaatctaccacctatgaaaatacaaattttataggtggatgtttgagatggctgtttgtagaaatgtctctttccagcggtaagttaccgggaaaaagaaatagatggtgtcgcaatctattgtgtccttatgcctcaatgttatcgaagttaagtgatgcataaattagatgagctatatgttacctaaaaatttaccaataatcggccattctcacaactaggatatatttaggatttattgaagattcgtgcaacttctataatcttaattggagaatgattgccatcggacgatcgggcggggaggggggggcagaaatcgggcgctcccctgcctctatgcacgcgcgcgctctctccctagcccaccacgtgtccactcacacaactctattacaacaaattacccacatattttggaaaccttctattaaagggaatttggtttattttttgttccataaaaaatgtttcatctagtgcactcacaatgtttcactatgtatagatctaatattgcaactatgtatagatttaatattgcagtgaactgaaatattctattgcaataaatcacccaaatattttggaaaccctctattaaaggaatttgtttcattttttgttccaccaaaaaatgtttcaccctttgtatttataatgtttcactatgtatggatctaatgttgcagtgaactgaaacattcttttactatttgttgaaacattgtttttatataaggtgaaacaacacccgattttaacgattgaaacattctcgatctacttagtgaaacaattccgatatacctggtggaatatcgtgcaacatttttaaaaaaatcaataataagctaaaaaatttcgttggaatatatccttgtgtggtcttgttttgaagatttaattgcaacaaatttaatggtgcaatcggatcatgatttagataaataatttaagagaaaaattaatttaaagtggttttacacatataggtggcgctgacgtcatgctgatgtcagcacccgatttttggagatttgggtcgggcgaccgatccctagtcacctccatcttaattacgtctcttttctcacctctcaaattcacaccttgcaaaccactactcccttcgtccaaaaaaaaggcaacctagtactaggatgtgacacaacgaatctagacataaagtatgtccagattcattgtattaggatgtgtcacgtcgtagtacgagattaagttttttttaggacagggggagtacacaactatgatccctatgcttgcgtgccactacatgcagggggatcctaatgggcgatcgatcctcccccctccctccctccacttggtttccttttttggcaccgcattacttttctattttagtaaatttatgcatctaaagtttatacatctcaagtttacacatataaagtttagagactcaaagtttataagtaaaaagtttatatatccgattcaaatttaaatttgaattcaaatttttttatatatatagtatttctatacatctaaagtttatacacctaaagtttatacacccaaagtttataagtcaaaagtttacatacccgtttcaaatttgaatttgaattatatctgattcaaatttgaatttgaattcaaatattttctatatatagtatttttatgcatctaaagtttatacacctaaagtttatagacctaaagtttataaggcaaaagtttacatacccgattcaaatttgaatttgaattcaaaaattttctatatatagtatttctatacatctaaagtttatacacctaaagtttatagacccaaagtttataagccaaaggtttacatagcctattcaaatttgaatttgaattcaaattttttatatatagtatttttatacataaatttttctaactttatgttttttttaaaaaaaattgtgtgtagtactgtagtaggggaggagtgtatgtagtattatagtggagaggatgtctgggtgatagatgggtgggcgggggagngatcacccgcccattagcatttccgctgcatgtgcccctgtcttctcactagccttggtgagggccaccaacgacacccttctcacgtattccctcccttttcttcacctcccctatctaccaactcgcaacagctccaccaaaaatgtcattgttgtcttgtcgatatttggcgtgattaccccacccgtctaacctcctctatatctccagcggtgtgagccaccaaatcaaccagcgccatcctcaccctcacctcctaaccacatggcctcccttgcccttgccaccgatccttgcctacccaatcaggctcctctgcatggagaaagaaaattcaaagaatcttagagtacatgtgcattaaacaagtttttgccattggatcttcatcaaaagacaaaacgatatgctagagtgaccttgaatagtacttcctccatttacttttgatagtcatatttccaaatctgaaaaaattatttttgataggcatatttcaatccaacaacctatcatcttaatgactttctcggatttaatgcatgactctccattcttccacacatgattggctgcatgggcattgagaaatgtaaatattaatgaatcgcttgtttacgaggaatgactagtagcatatttaaatggatgataaataggattagttatccttggtctatgtaccaagatgaaatatgactatcaaaagtagatgagggagtaatagattaacaatactttgcaaaacagtaaaatttggcaatgtgtaaatagtactccctccatctacttttgatagtcatatttcgtcttggcacacagaccaacgataagtgattctacttatcatccatttaaacatgctactagttattcctcgtaaacaagcgattcattatatcattaatattaaatttctcgatgcccatgtagccaatcttgtgtggaagaatggagagtcatgcattaaatccaagaaagccattaaaataataaattgttggattgaaatatgcctattaaaaataaatttttcagatttggaaatatgactatcaaaaatagatggagggagtattttgttactgtcctaccacatttcattgtaacagcaaactcagctcacaggtgacacagagaggcatttaatgtagcagcaaactaatatatactattgacacaatgagcctatctgtattacagcgaaggatgcacatcctacccacctccttggtcatcctactaaatcctatcccacgcaaaaaaaaaaatcaatctgatctcgcaaaaacatgttagtgttcaaatgaaaaataaatctcccggcattatatggtttatagttgtgtcactatatggtaagccatgcaatctcttttcgttcgaagcatggactgatctagtgtgggtgttggagggactcgactcaagtccccctatcccgttggatcgctattgataaaaggagaaagagaagggaaaagagggagaggaagagaaggggacagaaggagaaagaaagagatgagttccactctaatatttttcctccggtttggaggtggtctcaataagaccctgtttagttccaaaaacttttcgtaaaaacatcacattgaatctttacacatgtatagagcattaaatatagataaaaagaaaaactaattgtacagttaggaggggaaatcacgagacgaatcttttgagcctaattagtctatgattagccataagtgctacagtaacccacatgtgctaatgacggcttaattaggctcaaataattcgtctcgtggtttccaatcgagttatgaaattatttttccattcgtgtccgaaaaccccttccaacatccggttaaacgtccaatgtgacatcaaaaaattttcatttcaccaactaaacaggccataaggaaacacggaaagagtgattatgagtcattgttacgaagaatctagcattgccagtgattacgagtccttgtaattcttttccctcaggacatttaatccaattgtgtttattaattgagtgagatttggggtattcagtcgactggcaactcttcaacctcaaaatcatattcggtggaaaaaaaatatccaaccaaaccagaaatcccatttccaaaaccctcgtcgacgtcgcctcggggagcgccaacgccgacgccgtcgccgcggccgcgccaagagccaccgccccaactccggcgaagatggatgcgaaggtggacgagatgagcaaggcgtaccaggagctcgtcgcggcagcgcaggccatcctggaggcgcggcggcagccgggcggagagaacacggcggccatggacgcagcgcgcgaggcgttcgagcagcgccggaagctcttcgccgtcgcctgcgacgacgccgacgcgctcgtccagtcggctcgccagagtatcgtctccgaccccgggcgcttcgtcgacgtggtgaccacccccgacgaggattcggtgcgctctccgacgaggtcctccgcggaatcctcctcgtcgagcggattcggtgcgctccccgacgaggtgctccgccacatcctcctccgcctcccctccgccgccgccgccgcgcggaccagcctcatctcccgccgctggcgaaacctctggtccaccctcctcccgaagctgcggttccccggcgtcactgacctcgcccgcgtcggcgccgccctccgcctccgcgtcgccccggtccgcctcctgcgcatcgagagcagcgaccgcgccccggataagatcgtcgccgtcctccacttggccgcgcccctcctcgagggcaagctctgcttcgacgtcatcacgccggcggcagcggcagcgggggcggccgggaccgggggcgcgattcagatcccgtgcttcgagaaggccacggagatcaccatccgcttgcgcggccgcctcggcatccagctgccaccatccggcgtcttcgcgaggctcaccgcgctgagcttgagccactgcaggttcgacgaccagggccagcgcgatctcggggacgccgtctcgtcggaggggtgcccgtcgctacgagagctccgtatccgcgatgccgatgtggtgtccaatctagccatccgctcggagtctctccgccttgttcagctgtctcgactggaagggattcgtcagctcaccatttctgctcctgcgcttacagaactagatttgtacgcttgcttattgtgggggatgccaatggttgacatctttgctccagcactggagacacttcattgggttgattttttcagttcgagttcagtccgatttgttgagaagcccaacgtccatagactctccgtctatggcatggtgtatggacgtcgaaatactccaggctctctgcaactcgtgcagcattttacagaagcccgcgatgttcatctatctcttgtctatccctctgtgagtgcaccttctccctcttgttgcattacattattattatgatgaagctaatgtacttacaatgtttttgtagctcataaccatttactagtatcttagcataggctcatgcccatttaaaagataaaagtaagataatatttatgggactcctaatcagatgcgaaatatgtaactaggggagatccaaagagtccctatggcatgtagatttggacgtaagtgattatgtaatgcagaggcacattattaaagcaattttccttaggggttgttaggtacttaggttaatccccatgaggaaagcattggagcggattaattccacatctcaatagttggaattaatcccccccaattccccttcaatccctttggaagagggattaaccgaacaaggccttgaagtgtttacattgttttgtccaagccataaagttggaggcttctggaagtttttcctctgtagcattatatttttctgtgatacatttctcaatgtcatcacttccttaatccttgtgtaaagtcaaaatgcacatattaagtaattatattttgtgaatttctgttaattttcagatcatggatatgtcctgtgagctcctggtgcaagcagtgaaaaagctccctgccgttgaaatcctatctctgcggttattaacaataggacatacctttggaccttgtgtttaccatttgcttaagatgtctactggtataagggagctgaagctgaagttagaagatcacattgcggtaatgtatacctcttcaatgtaatcaaataccatggtctctgtgaaagtggtagaagtatttgcaatttaatgcacctcagcttgatctttttactatgagtggtactgtggtagcacttgatgtgtcagtcccagtaccgatctgtccctccatggtttatctattaaaactacaagtctttcccctcttcatactacgatctaaaagtttgatccaagtgttgccatgctgctttggttttcaatgataaaatagaaatgattggaatgtcgctgcaaatgttcagttgctggtgattgatatgggtatgttgtggtcgtagtagattcatgtcaatgagacttccaacgaaccatgccaaatgatcaattgaaattccgacaaaaaatattgtaattgtagtcaaagtgtctgctacattttccaattttcttttctttccccctttctccacacatcacatctggaggtgattagatctaaaagatattgctcttatatgaataaaagcttttaatgagaatgatcattttcatttccctatattttcctgacttccttttatctgtgtcctttcgtaatattcttaaaatcaatttcttacatgcttttcatttcaggatggagaagttccttgctcatctggctgcgtttgttacgagccccaggcctggaaaaagaataatatcagcttgaattttctccagaaagttgaaatcaacaatttgagtggagcagagcgtcaaatatattttgtcaaacgactgttgagatggacgatgccagagctcaagacgattactctaagttttgatcctttggttactgtcagcgagaaggtgtctaggaagctacttagcttctctaccccagggatttgcatggaaatttacttgcaccgcaatggaactagggtaaagtatagtgcagcgaactagacctagaggtgattaactgacgatgaaatggagcacagtaatcactgaaaccaggcaaattcgggccttcctttcagatcaactagggttaaggatgtccgtctgtcatgatacaggattgtcgtatacttggttatggttgattgcacgactcacaacttgcgccttaatgtgtgtttacatgctctgaggaaagttttcatcctgctggtgaaaattgtctgatcgaaagtttgttccatttaaatgtgaatgctgcctgaccgaaaggttcaaatatctagtttccaatctctaattttctctcatagcaaggtaagtattgcttgtgctgtatctgtgttttctttgcagaagcatatgacttgttcattctgctccaggcactagctagttcactgttcaatactgctgtcggaggattatatcagttatcatagtgtgaagagctcgtccacctgggttttgaacacagtcgatgtctgattgttccaactccatatatgcatacaccatcaatatagcatactgtcatatcgatgtgtttgtgtttgttatcagataacttccatgtactcatcatctatatgacactattatgtgtttcagtttgaagatagacgtgaatgatgtgatgacaagggccatcatctttgttttcacatcatgccgttgtcggcttgtggtttcagcctggtgacccgccttcaattctcctatacgctgaatttattgttaacttgttacagagttccttcttggttgtcccatgctttttatacaacctttgttccaaaatatagcaacctaggatgggataggttctgtccggatttgttgtaatgtagtgtcgcatgcatctggttcaggttcaggtgatattatggaatggatagagtatgtgagtttgattatgcatttttgtgcagtagactgtgggagagtcatcgccgtcttcatcgccacagatggatctcctccagtgttctgtctgctgctttccttctcgacgatgttcacccatcagagcaccaacatggtgatatatacagtgttgttcgagatcgattaagatgtagacgaagttaggcgcgaaaagtgaaaaaggcattagagtatgattaatctatctatctattatctatctatcttctatctatctattatatactaaaagtccattaatctatctataaacgctcctaagccgtcatgtggcgctcctacaagcactcctaagttgccacgtggcattttataatctcaccgtcgattttcatttaaattagtggacccgttattttagaccgttcgatcagatctatttaaaatttaaatatttatgcttcccgtctataaacagaatccgtttacttaaaaaagaatacgcatatcgaaaagcgtacatggaaaaaagtatacctttacgtactgttcatttttgggaaaaagaacaacacgtacgtatcatttaccggaataacataccatggaaaagacgtttacccaactgttcatttgaaaaacaggacgtacgtacggtaaaaaatgaaaaatatatgtacatgctagaactgtcgtggaaaaatagacgatcattttaaaggattttctatactaacaaaattaaatttattagtccacaaatatggtcacatggcacttctacgaacacttttatacttttataccgtcatatggtactatgtaatcttaccatcgattttcatttaaattgatagacccattatgaaccataggtgatgaaaacaaactagacgctaaagtatagatctttatcaaaacataaacaatgatacaatactctgaaaattctcacggtcatatatatatatttttcaatgatcaaagtattgtatttatactgtataaaaatttaaaaatttaagtagtactgattaacactataaataaattgtgtctacacaaaaacgtcaaaaattctatttttatgaaaagaattattttttatcgcatccatattctctttctttcctgaaaggcatcgtgcagttaacataagtataggagagatatacacatggttgagttgaggcagaccaactagaggccaccgttgataatagtactcaacttcctacttactaatgaaatcatctttgagggtgctgatagtgaaataggagttatatgatccacgctggctttgagaggcatgagtacgccgctatgaaatccatgtttgaaggcaacagaaaaataaatccttggtagctctagcggggatattcatgtctaatttttaacagtattatctttttaacgtagtatttttagaatattcatttatatatttagaaataagagttttgacataaatatttaggtatgtatgtagtggagattaacgttttacgtactaacaatgcattaattatgtattaggcttattttggtgatacagttgtaattccattattaaaaagacatctagcaccaatgataattagtaattttgacaataggtaattttacgtgtaatctaaaaaaagtgatttttatttgaatataagaaacattcttatcgtttattaaagtctacggtctatttcacgacatataatattttagttataatgcgaaatctataatttcttatatgcatatagtgatatacgacttaattctattaacattatttctatcaacaataaataaggtgtccgcgcatatgcgcgggcttcctttctagttatatactaaaagttcattaaacttcctataaacgctcctaaaccaccaagtggcaccctataaacactctcaagtcaccaagtggcaccttaataaatgagagaaatctgaccatctatttttacttaaattggtggacctattattctggatggttagatctattttgtaaataaaaaaaaaaaaggaaccaacaggcggaacaaacgggggagccctaatgggcgatcagtcgcgctccatgcgccccgcgcgatcagttctgacccctctagtctcttctctctactactagtgcggcgggacagcgtgtcgcttggagcgcccgcgttttccttttttttcggtttgtcttgaagcgtccgcgttttccgtttcttttttgtctttttcagtttcttttttttatggttttttctgtgtttttcttccgtaccttccgttctgtttttttctttccatatctttttctgtttttaatacttatgtatgcaaactttatatacgtacaaaatataaattttatatacatgtatttttaggtttttatatgtacgtataccaattttgtatacatgtatataaagtttgtatacacacatataaagtttgtatatgtgtattattttaggtttttatacctacgtataccaattttgtatacgcgtatataaagtttatatacacatttacaaaatttatatacatgtatttttttatatttttatacgtaggtacaaatacaaactttgtatacgcgtatacaaaccttgcatcccgtacgtacacatatataaactttgtatacatgtatgcaaagtttgtatacgtgtatacaaagtttgcatacgcttatacaaactttgtatatgtacatattaaaaaccgagagaaaaaacacaaataaaaatgaaaatacaaaacttagtatacgtacgaatataaactttgcatgcgtacatctttaaaagaaccgaaaaaaagaagagaaaaaaaaagaaaaaaaaaccaaacagaaagataaccggaaaaaaaaagaaaagaaaccgaacaaaaccgaaaaaaaccaaaagagaacgaaaaaagggaagagaaacggaaaaaaaaaaatcccgcgtgggtgccgtccgctgccccctccgcgcgcgacacgtgtccagtcgcgcgggggagggcgcgcgtgactggtcgcccattagctttttcggaacaaacatacgagcgtacgtatgtactgtgtctgtacgtacttcctttatgttgttactttgctattttctatttgatgagaaactaaaattaaaattacttttacaggaaaaaaaatcacaaaagacatactattagatctagcagttctccctcctaggtctagcagttctccctccgtcgctttaaagattctacgaaggcttctaaatcactacatgatgctattaaattagtgaaagtactaaaaatcttaaaaaatataaagaaattgatcattggtttgtacttaaattaatggattagattttttaatagaaaaatcccaaacctctctccctccttgattttttttaaaaaagactattatatattaaaagttcattaaacatcctacacatactactaagccgctaagtggcaccatacaaacgctcctaggtttctaagtggcactctaatccgaccatcgaattttatttaaatcggtggatccattattttattttagaaggttagatttttttttaaaaaaaagcacacatccgaaacctccccatcacgtacgtatcaacgagctatattcatgaggaattaaaatcaaaattatttttacattaaaaaaccatcattaaaaaatacctccacctattaggtctagcaactctcgctctgtcactctaaacattctatgaatgtttctaagctgtaacgtggtgctattaaattaaagagaaaatcttaaaaaaaacaaaggattaggttattgatttgttagtttttcaataagaaaaaacccaaacctctcaacctccttccccaccgccgtgtgatgttaaaatccattaaacatcttataagctgctatatgatgttcttaaattagagaaaaatcttagaaattttggaaaaaaaaaatccaaccatcggatttgacataaatcgatggacacattattttaggtcattagatccttttttaaagaacaccctaaacctcctttcctccctccgtctttgcggcatatggtattaaaaagtctattacacatcttataaatactcttaagatgttacatcgttctcttaaattagagaaaatcctgatacaataaaacaaaaaaacatccgattatcagtttcgacataaacatcggacgcattattttaggtttttagattaatcatttagaaaaacattccaaacctccctccctccctgctcgtgtatagcgtgccctattcttttatctctgttttttatctccttaacaattaaaattgaaattatctatatgggaaaaaaacacaaatggacctccatctattacttatatcccgttaagcatctaacgactttctaccaacttaattaatttcttaacatgcatatgagggctacatacctatacaaattgaccttgatacttttaaaatgatctttttaggagataaataaatatttttaagaaagatgatcatagcgtctgaattacacatatgatctatgaagtcactaatcatagcatgtattcatctagcaatatatagacaacatgttaaaaataaaggtttggttggttgaacatcataccgataagcatgtgggttgcacctaggaatcttaacagtggaacaaccttgcagtggccttagcaataaaacaagtaagttccatataggaattaaagaccatgtccattttttttattttttttttgttaaacttgctacagtacatagtacattgtaaagtcttgacatagaacaatctagaaacatttatttgttatgtgacagtccactttagtgatgatttgctaaatacactatgaccattacttcaagatttcaagagaaaatttagaacgtatgcctttaccccctgccaggttatatgcacttatatttttgtcccaaattgtaaatatcaaatcatttcaaggatgattcatagaatgaaaatatccaaaataaaaaaaataaaaatggacatgaaataaattgaaaattgaacaaatgttgttggatttaaaacccatacttattaaaaaaattcaaacattttacaagcactgttagaatgaaaatatacataaaattttaaaataaaataaaaatgatattattggattgcttttggggttgtaagatattcttctggcgagttaagataccctaaattttctcataggaaccacatctattgtttcgacaaaatattttatcatcaattcaactatgatctcaagtaattttattttagaatttatttgttgcaaggataactataaaataaccggcgttcaaagcacaaaaaataagtttaattttagtttagaacataatacaagatattttaataaaaaaccacccgcacaaaaatatttataataaaatttcactcgcattatataagaaggtgctcgcgcatgtgcgtgggctaactttctagttgaattttaattattacaaacttcaaaatatatttctctgatattttaaagggttaattggatcatgctatcgtaaatttacctatctatctatctatcaatgatatactaaaagtccattaaacgtcctataaacgctctcaagccaccacgtgtatctttacaaacgctcctaagttatcacgtggcgttttaataaatttttggaatatctaataattcctaaaaaggaaaactttaaatacggtggatccacttttaacccgtatcatgtacgtgcacccgtgcatgtatgtacgccatatatccttccctcctcctatcatactatattatatactccctccgtttcaagtttcaaattttaagacgttttcactttcgtcaaagtcaaactatttcaggtatgactcagtttaaagataaatatagtactctctctatcccaaaatatacatatttttttactccgatatggtccccgagatactactttgaccaacaatatctataaaagtaaaatattttaaataaaaaatgttgcatattatgatagtttgtttagtgaaaaatctaataacatcaattttatatgattgatattttttttattttttgctattaatagtcaaagttaaaaatgtttgacttgccattattgaaaaaatgcttatattttggtatggagggagtaatatttataatactaaattagtttcatcaaatcaataattgaatatattttgtctcgggttgaaaatgttactactttttccataaagtttatcaaaattaaagcagtttgactttgaccaaagtcaaaacgtcttataacctgaaacggagggagtagaaaatacataacacatcattagattatttaccacaaaatttataattcaagacccaaactaaatatatttagtaagtaaaagaaataaaacacatttatagggaaaatcatatatatatatatatatatatatatatatatatatatatatatatatatatatatatatatatatattattaaattaatttaattaaataataattaataattaattaatttttttaaacgaatttctattttaacccaaacacataaatattttaagagaacaatatgcaataataaatagttttaattagaaaatagatatttaataagtacattactttgggtcactactattatgtttgtaaatatatagataacttaagttggtgaaaccattggatttatcagcttcaacgccacctccagaaatcgacctgagcgatcgatcattcaagaaatagattagacacaataatccttatattagtagttccaaatttgatttttggggttgggtagtgacagctcacgtcgatcagctgtgtcacgtcagaatttcagatatatgtgtagtggaatgtttctgtttaattattagtatttgtttttactgtgatgcgattttgtatctccaaattattttcacaggccacggcgatcacaatccgcttcgcctgccttactatctggctgcctcccttcggtgtcttcgcgaagctatctgtgctgtgcttgacgacagccaatgtgatcttggtgacatcgtctcttcggaaaactggagaaaaaaaaatcactatagcaacgcgttacaaaacttccctaggagtagctaaacatccagggaaagcgactacatatgcagccctctgatgacaaaactcccctagaagcaatcttcgaaatgtcatcttccacttaatgaaatgaagcacatgtctctttgcgttttcgaaaaaaaaatagttttgaatagaatcatgcatgaggaaaaaaagtaatgttatatgtaagtttagaaatgaggtgtgtgccaaacaaaatagcgactaaaatacaacaagtagcttttaatttcactaattcagaagcattacaacaataacaagtactccctccgtttcataatgtaagtcattttagtatttttcatattcatattgatgactatctacattcattaacatcaatatgaatatggaaaatgttagaatgacttacattgtgaaacggaggaagtatatctaaactcataacaaatgagtggaatgcatgagaaccaggagccaacttgcctagctcctcttacaaaaagctcatttttaaatcacagacatatttatacataaagaaaacatacatatgcaagcaaaatatgataagagctatttgatcttacctcctaatagaaaaatcagtagactagtactacatagcacgttttgaagactcacatttgactcgatcaaaagcgtggatataaattttcatcgtaaacatgcatacgcgcacgtgaggctttcatcggacggcttccgcaggtgtcgcgccataagacaaaatcaaaatcgctctcaacttagattttccgttaagaaaaagacatgtatcatataccaaggaaatcttatacacaaatcttatacacggaatagagtgatctccggactccggttagaactgcctcacggtaccagtacactatttagtaatattttttttaattggattcatgccattataaatttgtatgtttggaaaaatactattactatttacaaaattggaatcataccattacaatttaacatctcttcgagatgtgccattgcttacccattcaccatactttctaaatttttctgaccaaattatcctttaaggcccctttgaatcacaggaatgaaaaaacggaggaatagaaaaaatataggattgtaaaaacagaggattgcaaaacacaggaaaaacatgggaatgaccgtttgattgagccgcaggaaaaacacaagaatttgaggagagggaaagactcaaagaattcttatcatgaggtagaacctcatgttaaatttcctctaaaatttacatgggaaaacgcatttcataggaatttcataagattccataggattcattcctttgattcaaagggctatataaaaaaaattcctatagaaataaaatcctttaaaattcctatgaatttctttggaatcaaagggccttatcttcttcctccttcccgtttctctcttttctctcttcctccatcccgccgccgcgcacgatgcaaccgaagcaagcagctgtgcgtgcgccgaagctgctcgtcatccccggccaccgcgtgcgcggaatctatgcagctacgcgcctcctgccagagccgctcgtcgtccccggccgccgcgtgcgcctactatggtccttgcgtgtagttctcttctcgttccttttttcgtgcagcctgccctacacgcttaaaaggtggcacatgattataggctctgtgaaagaacacgaattactagtagtggtttgcaatcatgtttggtagtgcgcatttttgaatctgcctaattcagctctttagttttttttagataactaagtgaactaatttcttggagaaactgaaaagttggaagaaagaaggttgatccatggctcgtcgtccctggctgccgaagccgtgtagctgctcgtcttccccggccgccgcgtgcgccgaagccgtgcagctacccggctcctgccggagccactggtcctccctagcagccgaagccgtgcaatcgctcgtcgtcccctgccgctgcgtgcaccgaagctgtacgtgcagctgcgcgcctcccaccggtgctgctcatcgtccctggccgaaagatgaagagagaaaagggaacaaagaagggaataaaggaagaagatgagggcaatttggtcagaaaaatttagaaatatcagtgaaagggtaagcagtggtacatctcgaagacatgttaaattgtaaggaaaacgcttcgtatcgagtgtccgggagcgaataaaatattggacgaaaaacgtttggtgggacccgccattgactcaacccattcttcgtcacccacgtcaatcttatcctctcacagacattccctcatctctcccctctatctctatatgctctctctctcccctctctttcactacagcggagatggcgcgatgagctccatctcgtcgtcaacagcgacgagctccatctcgacggcgcgacgagttccagctcgtccttgacggcggcgacgagctccatctcatcctcgacggcgcgaagtgctccatcccgaatacgcgacgagctctatcttggttcctcgaggacatggccctcgacatagtcacatagatgctgaagaagaggttcctgccctggcgagccttgaccacctcgccgaggtggtcgccgttccaagcatgcggaggcgacgcgatagcgatggcaatggcgacggcgctagacatggccaccgtcgaggacctgatgcgaatgcaactggtcttagccaagtttgtccatctcgtgccgttgctcgtctaggggtggttggagttgaagaagaagacagatgtgggtttagcttatgttgcactttgttgtattaaggtgtttcattttattttgattcgaattcaatgttacatatgttgattcttcatgttgcaatcgatatgtttcgattgcatttggttgaaacactttcgtcaaagcgatgaaacatttttcttctcatttgatgaaacatctaaaaatgcgtgaaatttttttagtaatgtttgagctttttttttattttttgttgcactttattatattaaggtgtttcattccattttaatttgatgttgcttaaattgatttcatggtgtggcaatccgtattgttgaatatttcatttggttgaaacaattttgctcaagtgctgaaacatttttctctagcagcgaaacatctggaacattttcattgaaacaatttttactgagggatgaaacatgtgaaacatttctcaatagtacggtgcaacaccgtccgatgatttgcatcagatcggatgtccgatccttagcagcctctaaattgtaatgacatgtgtcagggttacggataaggtataccctctatccttggatgtacgttgactcggagattaactgacccgcggtatataagggacccctgggcaggacctaagacatcgaatatcaccgctaacacatccaccatagcctacggagtcggagcctgcaggagtcaagtcgccgggagatctagtcggaccaactcgactacggtctcgtcggtatcatcgagttttgctatacactttgtaatctgtggttttcatcatataatcctataccaactggattagagctattacataccaaggagcctgaactagtacaatgcttgtcttttgcttgcttaatgtcgtattacgtagatcctcgtaccaacggatcctaataccctctatatccggtctacgggtatccaccgtcgacaacatgcttccaattttataaataataatgacatttttctaaacatgtaaatttataatggcatgatccaatgaacatttttttttccgaattaaacagagagaggatggggaaaaaagacaattagggagtcacaccaaattggaaaaccgcattcctaaaaccctacccgacgaaattgcaatggcggacggcggcggcggggccggcgacctcctgagcgcgctccccgacgacgtcctccacctcatcctcctccgcctccgctccgccgccgccgcggcgcgcaccagcgtcctcgcccgccgctggcgcagcctctggaccaccctcccggagctacggttccccgccgtcaccgacctcgcccgcgtcaccgccgcgctcctctcccacgacgccccgctcctccaccgtctcgagctctgcagccacgaccccgccccgcacgaggtcgccgccgtcctccacttggccgcgcgcagcttagcaggcaagctcctcctcgacatcgtgatgaggaagaagagaaatccggtggcggcggcggcggccgggattggggccgcgtttcacatcccctgcttccggaaggccacggagatcagcatccgcttcgcctaccttaccatccggctgcctcccttcggtgtcttcgcgaagctgtccgtgctgcgcttgacccgcttccggcttgacgacagccagtgtgatcatctcggcgacatcgtctcctccgagcggtgcccgtcgctgcaagcgctcactctctgcaattctcaaggcttgtcaaatcagccatccgctccaagactctcctcaccgttggcctctttgagctggaagaactgcagcagctcacgatttctgctcccatgcttagaacactgcatctggtccattgcttagacaagagggcggtaagagccgctgacatctctgctgcggcgttggagaaacttgggtggattggtctgtgcgattggaactcggtccacttcaatgtgatacaacacctcaagagactcgacaccttgaacctttcggtgtatggaccgccgaatcttgtcgattcttgatacccgggctctatgtcactcctccagcatttcaaagcagtctcaaatgtcgacctctatctcatttatccatctgtgagtacaccttctctcttgttgctgaactacattatcgaaacgttgaacgaaatgtcgtaatactctctttgtagttccccagcagccactgctagtatgccggcataggcacacaacattttaaaagaggattttgaaattgttgatataacccatggtccagatatcatttgtccgagtccgtgttttagtatatgtttcacattagcatctaaataagtgtcctaatcaaacgtgaatatataagttgggaggacatgtatgcactctggtatgtgtatttgcacatgattggttagataatggagaaattgagggcattcctggatcaatttccctttaaaagtgttcccattggatttctcaagccatacatatggaactttctggatgttctttatctgaagctgtatatacctcgtacatttctcaatctcctcacctccttagtcctgtgcaatgtcaaaatacacatattaattaagggatggaatggtgtacttactacaataactatattaatgaatctacaacttctgaccattgatcaagatcttcagtttccatttggtcctgttttacacattgttatgtaagacattgtatgaatctctgttaatttgcagagcatggttgactgtgagttcttgatggaggacatgaatactctccctgccattgagatcttatctctgaggtcaataacagcaggccatgcctttggaccttgtgtattccaattgcttaggacgtctactggtgtaagagagttgcacctggacttggatcatcaccttaaggtaatgcatacttattcaatgtgattaaatactttggttgctgtcaaaagtgatagaagtatttcttcttttacgcactcagcttgttcctctaactgtacacagtggtacttgatgtgtcggtctcgatactgatatgcccctccatggtgtatctattacaactaatggtctttccatattcagagtttcagactatagtgcctttgattttcctgtcagatcaactccttgcatccgattgttacatatggcacatgggatgtgaaaaattgcaatggtgatgagtgcatctctctctcatccttgtacccaccaaagagagtagtgctgctttggatttctgtgatatatgattgaaatatagctgccgatgttacttacttactggtgattgatatggatttgttagccatatattcaggttggtgacttagaagcaaaccacgccatacgataaattgaaatcttaacagtaaatattgtaattgtggtcggtgtatctgtgtaatgttttttacttcttttttgtatttctccctttctctacatgtcacagtcacttctctggaggggatagatttaaatcatatgccactcaatattatgaaaccaatgttttcagggagaagtttcttgctcatctggctgcatctgttacaagccgtcggactgggagagtatggatatctgcttgaattttctccagaaagttgaaatcaacaatttgagtggagcagagtatgaaatatgttttgtgaagcgactgttgacatgggcgccagtgctcaagatgattacagtaatgtttggtccttcagtaactgtcagcgaggaggtgtgccaggagctgcttagcttctctaggaggtgtagtccagggatttgcatggaaatttacttgcacggcaacagagccaaggttatgtatagagcagtgaacctgaagagacctagagatgattaactgacaatgaaatggcgacctggagcctagtatattcagtcaaaggagcactgtaattgggcaattttcaagcccgcctctgagatcaatctgttgtaaggatgtttgtctctcgtgatatagggattaattatgtatttgagcatggttcaatgcactctcaacttgtttccgaaatcatttttgtgtgcaggttttcaatctgctgtgaaaaatgtccgaccgaaatttgtctgactgaaaggttctatattatatattacagttttcgatctctacttatctgccgtagaatggtaagtacagcttatgtggtaataatatctgtgtttcgtttcagaagcaagcatatggatttgttcattctgttcctccatgtacccacgtgtgacaggtctgtaggacggttggcgattgttcaatattgctgtcgcaattgggtcatcgtttgtgaacaccgttgacatcttgttgtcccaactccatctatgtactcatcaccgttgacatcaccatttgccgtaaccatttgctttatttcccactgggacgtgcttatgtgtttttttccttattatagcttctaatactccctccgtttcatattataagattttctagcatagattcattaacatctatataaatatgggcaatgctagaaagtcttataatatgaaatggagaaagttagttataatcatgtgttttttcttattatagcttccaatagttataatcttgtaatttttttctactattttaatatacaagctagcactgtcttatgtgttcgcttaaagaaaaatataggtgatatgccaatgaatgagaggtgcattttgcatgagttgagccaaactcggagtggcaacatgccgccaaccgaacaagccgttgccggttgatgacttgattctaatggtcttggttaactggctggatgttgacgtggccatatgagtttttttaaaaaaaatgtttgaatagttgcatcgtttgaggatacaaaaggaattaattaaatattataaagttaaaaattgatttaaaataattttcttataaattcatatatagacttttttttgcaaaaaaccagccgtaccgtttagagtaagaaagcatgcgcatttcttcgaacatcccatcataaaataacacaacctatgtgtgaatacgcaactctggaatataaatcacatcatatcttcctatatagttggtatccactaaggcgtatttactcctataaagtaagaaatgcaagaagccacatcatcaacaattttaagtcatcagatcacattagtacaaagttaacaaccattggatcaagaagctacttattcattcaattcaatcatttattagttatccaatcacctccctttgctccacctcatagtcacagatagcattgttatcatatatacctatacaaatcatccccactaatag

SEQ ID NO: 43313 - DNA, 6501 bp, Oryza sativa
  unsure (1)..(6501): unsure at all n locations
atttgcttactgggccaaaaagaacagatagcccaagcccaacacagcaatgagttcttcactgttaatccgcacaccgcagcatttgcatcacctcctcccacggcgctgcatctttccctctcccacgctgcgcaacgcgcgaggtcgccccccccctcagctgcatcgcctcccctgtccccagcgctgcaccggagcctgcaacgcccatctctccccctcccgcgtcaagccgagcgcgcctaccaccagctgctttgcagcctgtttgcctccttggcgtgttaggactaaggaggaacggaaccgtcgacgcccatgaagagcagacttcatggctatcaaaactcccgcagctttcaaaccacctcccagcttttaactgtcgaccaccgcatggactcctgcagctgcatggaagccaatcatccggttcgcctcctttgccccaaactgttccccctcccccccctcccagtcttccaagaagaaaatcaagatctttaattcagccggctatatattggtcgactacggttgcttggatggagatggataccatgagcatttgtgttcttgcttcctcgcttgagtatgatcaagactgataagcgctcaggctgtttactccccaaacagctgaaccgagtgaatcaattctgaggtaaatttctccgagcaaggttttcccctgtttgatgaaatgcttatttacacacatcatatatttcaagtagacaggtagcactagaatcacgattcacttttgagtttccatctttttgatcttgagcaaaaaacctttgaaatgggcaacgatggagccgcagaaccacattaaggtgtttgtttcactgtcatgttctttgtatgcaatatgcacatctctatatgcttcatagttatttgacacatagatgctccgcatcaacgcggcggggtatgatctagtaccatgttttccaagtacaactcaaattattgtttaagatgtgtgttttgttttattatgcatgattagatagcatataattattacgtattgttacctaaatcaattttcagaaaaagcttgaatgaagcagagagatgcaaattgtctaaccacaacgatacccatattgcgcatgaaaataatattcatatattataacaagagtaaattgcataggcggtccttgaatttgtaagcaggtttcatctaggtccacgaacttataaattgtgtatcgaggtccctaaacttgatttattgtatcattccggtccaaagtctcatttgcccatggtcttgcctacgtggcatgacatgtagacaatgacatggcacattattattattattattattattattattattattattattattattattattattattattattattattattattattattattattattattattattattattattattatttctttttttctctcttcttcctctttcatttatgtcttcttcggcctcttcgacgcgggggagctcgaggtgactctagtggaggaagaagataaaagaataggaggaaaaagaaaaggggaaaggaaaaaaatgccacgtggcatgccacgtacacaagaccacggtcaaacgacactttggaccggaatgatacaataaaccaagtttagagacctcgatgtgcgctttgcaagttcgtggacctaaatgaaacctcataacaagtttaaggaccgctagtgcattttactcttataacaatatacaacgaatacagaatgacgcttggaaaaataaaatatgaattgtattgtagtaacataaggtatatataaagccacattatcatatattttgtagagatagagttgcatctaaccatttaaaactacgattttgtttgacgataaaactacataacccgtggcaagacgcggggtgccaactagttaataagatgattgggtcatgttgattttgtttcacgatagattttagggctggtttgcatgaactaaataattgttacaccgaagtgttttacatgttgttacacttactaaaaacaccccactgcacattcttacactacatgatgtaatctatactttctatatagtggtacccactaacaattattataagctaaagctcaacatgcaagcatgccacatcatcacccactactaattactattctaactcatttaaaatcccatgcaagcatgccacatcttcactagcaataactattctagcctattttaaattccatgcaagcatgacacaccatctacaatattagtatattatagagatcaacaggtatgtgtcaaatcatcttcctcacattattttctcaacatttctactttcatcattttgacaatatttaatatatactcatccatgaattccgcagcaaagcgcagggtatcacctagtttgctctatacttgtactccgatatacttttataaatgtgtttttattggatatttgagtcaaaaattttgactcctgagtagaaggtttgagatatttgagttgaaagttggactcttggcttgaaagtctaggagatttgggttgaaattttgattcatgaatggaaagtttaggagattttgggttgaaagttttaatttcatgatttgaaagtttcttttttttcatgatttgaataggaggcatttttcacataaaacatataacaatgctagtaactttcacatttttaattagtggtaatatatgaaagactgaaagagtactcatgcaccatcaattttgtcttcttttctatcttggtaggttaaacttctctatatcattagtcaaactaaacttattatcactagcatatttgagagcacgaaaggacatttagaataaaattccttagtctaaaaataaatttccaccgtcttaccgagaagtttttatcccttcaataccgatatctatccaccaccgctacttgcgagaaattgattcagacctacgatgtaatacggagtgctaacgtgtattctcttaagcacaacaggtatcgttgaggcccaaacatcaatacataaccttagagcgacgtattagcaaaataacaataatttgtgtgtaaaattatggtacacacatacatacatacatacatatatacatatatatatatacatatatatatatatatatatatgtatatatatacatacatacatatatacatagggctccatggtgcccaggcaccattgatatctaccgtaggattaggtactgatcgagctgatcttggcatggagttttgattaacgggttcacccgttaagtataatcggtttggaaagtgacaacatttgcatgcatgcaaaatatttcggaagatcaattgtgtgtatttaatacctttccaggcatgcttttcgggtgaaaattgatttctatacatttgtcaacagaaatcatgggtctgcggtttatatgataataatggtatgagttggtatggaaatataatccgaaaatctccaatctaagtatatgcagatctggaagctaagtatatgagaaaacggaaaggaggtatttagtacttggaaataggaagctatgtaatagctatgcatggaatgtaataggtacacattaattgtgtatatggtaatataaatagaaatatgtgcaagtccaactatattcaaataaggaatctaagtatatataaattttgtatctaagtatatgctacggtatattgccatattttgaataaaaaacttgcccatatgtcgccgagtttgctttgcgactccgtgatcttttttccatatacctatctaaactgtttataaatcaaacataacttttaagtacaaaattttaaatctcgtgatagaaatatactgttaagttcagttattttttccgtatgtacctagctaaattggtgagtacaaagttttaaattgcatgaaagaaattaacttgtaccgtgttaagttcagttatatttttccatatgtacagtatgcagaaaaatatatatggaaattaacttgtacaacgggaatatcgctcgcgaattaacttggcatctaataaagataaaatcacatgcctggttacgctggcacgggaatatacgctagaattggttgattaattttttatatgtgtaagtatagtttacgggaaaaataaccaaattaattacacaccatactcccttgcctgcgtacgggagacataaatatgtacttatattcacatcatatataatacctatgttcatgcacatccacaactcatacgtctgcacttgtttgtacacgaatgcatgagttataccaattaagtactgccttttcatacattaaaaacccaacgtacgtacacgcctgacagatacacatataccgcgtaccggtcgtgcacgtacatataccatgtgtgataagcaccggtcgagattgctcatgacatgtaatgaagatatttaaaaaatctgttttaatatatctggttattttcttcaaaaaaaaatccagttatgttaggttgggaatatgcatagtttttgttttgaataaaatggtacatacacacttgcaaaaatcacgaccacaagtcatacctacatgccttttcttataataaaaacagaatattcacacctgccacgtacgtacacaaataccgcgtacccagcgtacacacatataacacatatatatatgtcctgtaaactaaataattatatttaaaactgattgatcactctagaaaatggtcagtaaccaatatttattttttggaaaatacacaatgttcagtcgtgacattagtgcatacttaacttttggaaagaatagccaaagtacatattggccgagaacacacaaccatgaaaaagaaaaccaggtgacatatgcaccatcttagaatttgatacaattaaccttacacgtcaggtatgggcacaaattaaaaaatataaatttgtatgggagtacctatacatctttcgaaagatttttatgatcgtatcacacagatttttaatctttggattaaaatccgatagatataataaaaagcaaaaagcaattaagaaacaccataatggacactaaattaccatatcctcaagaaaaagaccaaatccaatacaaaatttaaaatttacatgcaaaaattcaaaaattacagtgtaacttacaaaagttatagtgtaagttttataaattacactgtaacttacaagaaaatgcactgtaaatttgagtgagaaaatcgagtgagagataagaaaaaatctttcgagtgagatatagcaaaatcgaatttgtatctatgtcaaagcattattactcatgtagtctgactgaaaagcaacaattaattcgaataattcttgcatcatgcaacagaagttatttcatacaatagaggtttaaaaaagtatcttgcttcattccgaaacagcactgttgtattgcttcataagttgttggacgacatctgggagtgtagccgcattagtcttcattgccattatatccatcacatgcctgctctgatattgtcaatggatacctaagattcataaaataagtaattttgttagtagaataacaagttggcgcgagaaggtaaaattgtacttgaaaccaaattgaaagagcccaacatgtaatatgtaattaaaaataattaccggattaagtcctcccacacaccagaattcattcgagttcttcgtatacatcagagttgtgtatatatccgttaggcaccaaaaaaacgtaaaggtatattctaagtaaattcaattcaagtgtgtattaatttatacccgggtataaattaatacacacttgaattgaatttatttagaatatacatcggaggaacatttttgcaattgttcacttgtcaaaattaaacaattttgctcttgggtaccagctggcgattcaacatgggtttggttagtaaaatactgtggaaaaaaaagggaaaatcatatacatacgcacgggagtactgcatgtcaacttaaactatacgaacgataaattctgggatctagacttttcacatacctacggttagtgccaaacctcacggatgacgggcagcgatggcgaggaggcacgccgcacgcggacgtcctgcgctgtaacgaaggttgcggaggtctgtctgccaacaagaacctcatggacgaacgccgtccgtgtaacgaaactcatggacaaccagcggcagcgacgaagaagcttgtggccgtccggcttcgttacggcgtggtgacgagaatgtcgtcggnnnnnnnnnnnnnnnnnnnnnnccagcagcaacgacgaaagagctcgcggacaatggtgtaccagtgtggccaagaaaaccgtgaacatgaaaaatggaatactatcactgggcatatgtatctgcatagaaaatggaaggataataatagcaattagcgggcatgaattaatatt

SEQ ID NO: 43314 - DNA, 23331 bp, Oryza sativa
aaaccgtactattaagaggggttccaggtgatgctctgagatatgtcaagtgctcttagtgtgaaccaagtgtcaagtttccctaggagtcatttttgcaaatactccatctgtccaaaagtgcaagtccagaacttcctgtcttccaggtccaaaagttccggtcttgtgaaaaagtttttcctaagtgtagtccggaagttcctgtcttccaggtccggaacttcctgtctagtttccagttcaaaattgtgagtaacggctagatgacgtcacctagccgttatacatatacagctcgtttccagctcattctttggctattccacttttacttttcgaacctagagttgttgctagcctctcccaagtgttttttttttgccttctccactcaatctagagcctaattcttgtgagaaagagagattgagagggagagaagaagatttggagatgtgtgaagactaggatcttgggtgagcacttggaatatctcgtgggctgcatctcggttcttattactcttggagatgatctcctagacagttaggtgtcgcccgtgagaatccgttgcatattgtggatgtcccgggtaagtttgtgaaggatctcctctcctccgaaagggaacgagttaagttaatgaagttcttgtgctaagattctagaggttttccaagtagagtaacctatacttgtggcagatttctagaagtaggttgagttggatcttggtggtcactcaattctagaaatttgcctaggagtgtttagggttgaaggctatggatttcctctagggtttttgcacaaatgaggcaaggggttaatcgagacccagctctttggagctcctcaacagagagtaggatcgcaagatccgaatttcgggaaaaaatcgcccttgtctatttctgtgatgtttctgtggatgattctgtgatctatcctctacttagaatacctgtgctctttcttgtgaagattggcttagtctcctgtttcgaaatttgaatttcatctctgttctgttacccggaagttcctgtcctagaacattggaagttccgggcctggaaggccggaagttccggagttccttaccaggaagttccgggtctgtttaaattttaccgctgcgatttgtttttaagttttcagggacagcctattcaccccccctctaggctcatcagcgcgttcaacgtgcagtaacaacactaaaatatagttcaaatatagtcacgacggatctacttttgacaagtactttttttctagcatcatagtgcaaatgatttcaaaaaataatgcatattttgcgagatattgctcttcaaaggttagcattttgaagtttaatcctccatatgtagtaacactatagcattactattactaccatttgttccgtgttactacgagagtgcagtaactactacaacttttacagtaacagtgtgttactgcaattgcttggtaatgttaccacaataacgtaataacaaccaataaattttacatagagaaaaaaatagttttctttatgatgaggaggacatgtgagagacgaggggtggtcagtgtttgctcgaatcgggaatattaggagtgtaattggaggccaagaaccgccaccaattttgctcaaactagtcaaagtgaatccatgatgactaatctcgttcaaactcctaagcggatgcaacattcatattgtgaaaattgtgcagtaacgttagtgcccgtgtacattaacaatatatgtgttttgcagtaaccgatcgttttactgcaattccatgatgatgttactaagaaattgtaacggaattgatttgcttctttcatggaggtagaaataatctaccttgttttttgtttgaatagcttactaaacaatatatgatagcatattagaatgaaaatgatactatacaaattgtccaatcttggtcaaaccctcaagcggatgctacatttatctagttagaattgtgtagtaatatagtgctaaatagcagtaataacttgtgttttgtgtattaaccgagcatgttactttaattccgtgatgatggttactacgaaattgtaccatgtatcttacacgtgctaaaattaatttactatatgtttttgtttgaacaatgtattgaatggtacggatgagggaggagagtgcagataaggcgggtgaggagagatgcgtgacatggcagagaaaggatgtgttttcacatgataggataaagcctcacgtgctaactgtatacttgttactgcacaaaagtataagtgttactgcatgataggtgtatgttaccacttccaactagctatgttactgcacgataattgtagttttactatgtcatttttacgagatgaagatcgaataggtgggccattggtaaagtctgtaggtggctttgagcgaggtctgattgatgtatgagtgttttgaacaattttatacatttggtaaaaccatgttactgcatgtatatgcccttgttactgtaaattatacattctgttactgcatgtggagggctaaagttcaaaatattctttgaaaagcaatatcttataagatatatattatttttgaaaaccgtttccaccatgatgctatagtgttactgcatatggagggtttccacactatgttactatgaaacttataatcgttacagtaacgacatgatgtgattacagtaacacaaaacagttagtagtaacacttttgatatagtattactgcttgtggagagttaagtttttaaaacatatctttgaagggtaatatctctcacatcatatactacttttaaaaaccgtttgcaccatgatgttcgaaaaaaagtgcttatcaaaagtagatccatcatgactatattatgactaaattttaattttgttactgcaagtaaaacacggtgttactgcacgatgaacaagacattactacgtcgttccgagacgagagctaagaagagagggggtggtgggaaaagtcaccggtgggtttgaccgacgtggggaacctttgaccagcctttaactgaggtgggaggtgggttttggacccttggggggagaggaggtgggttggagggaggggggtatagaacaactattttataccttgggtgtagaatagttttttctatatatatatatatatatatatatatatatatatatagttagcgatttaaaaatcaatacttgaaaaataaacattgataaaaaacttcaaatcaacttcaaaattaaaatttaaaatttaaaatttgactatggctgatttctatataaaaccagaccatatgtgcaatatagtgcatcggaagctaatcctttaacttatctgcacatataaggtctgtttggagagcttaagattctgataaacaactgattagtagccagctttcttaaaaatttggaaaagctggatttttctacttctggcttctaattcattctggattctatactataactcgtgagaatcatcaatcaataactcccctaaccatcccctttttctccgtttttttaatttttttctggctacctcggtgattaacacgtcgccgttttgcgattacggctcctcgagagcgcgtttgcgaccgggaaaacgcggtttaccggtaatttcactgttaatctcacgtttgaggatgcccgcgtggcggtttcctccaccgctggtgtccggtttgcgatctggttattttgcaaaaaaatccttgtctatgtataaaattttaaactaaccctcgtactacctgacagcctgttgtacttttcacaaaaaaccccttaaccttcagagaaatacaatgcaaagaagagaaaaatctgattttaggggtagctctgtaaaaataacaaatacaagggttttattgaaagataaccacgcctacggcctaccccccacaccccgagccctaacccaatcgtttcccgttccccacttcctccccactgcgccccgcgccgccgccggcctggggctgccgcccggccgccgtcgtcgccgtggtgcggcctccccctgtcgccgccttcgtcctccgcctccccacccccctccctcgccacgccgtggcgtgagccctctctccgtcgccgccgtcattgaccgccttcctccgtcctcgccacgtccccctaagcaccaccaccacggcccttccctcaaatccgcctccgtcgccgacccatccgcgccgccgctcgccctcccgcacctcctcctccccagtgatgtctcctgcctccatccccacctcgtgcaaatcgggggaggtggacttcggcgtggaggaggtcggcggcgtggaggagttagcgaacctcgagtcagcacggaggcgaagcggagtttgtcggtggcggcggctgcagtacgaggccacgtcggcgtcgttcctgccgatgggtggtcgattcgacgagcgtgctgctaggtacgcagccccttcgtctttcttcttccctgcgacccgccttttttcctttcagcatcgggtcagcaacgtacccccccccccacgccgcccctctcctccgaccttccccatgcgtcggcagccgcctgccctcgcctccgccagtcctgttgttgccgctccactcccctcctcatggtcggacgggttcgttccgtgtggcggtcgccggcgggggccatgatttggtggagttgagtcgattcggtggatttggggagtagtgtttcttcctcggtttagtctcttctttccctcacaagttgtggctgtttctttgggtttcttctcctatgggtttccttccgctgtgtttgctgactggaggaggagctgaggatgctcggcgggatctgcgcagcggtggtcggggatggcgaggaggagaagcagctctgtcctatctgcctcgacggcatggaggccgggcacgccgtgcggcgtgcgcgtcctccccggatgtagctgcgccttccatcacgactgcgtccaccggtggcacaccatctcgccgcgctgcctcgtctgcaacgggtgggttatgccgccgttgccaccgcccgccaagcctgctctggattcttgagatggcagcgttgccgccctaccgatcatggctcagttcttggttcttgacgagttcttgatgaattctcggcgattgtcatcgtcggtttctaggctctggacagcggttcttgccaatttcttgttggctatcttgttctcttaagtatgctgccttttagaacttgtgctttctggtcatggacttctataagatgattgatttgtatggacaggtgagttgttctataaatctgacatagtttcagtggatttggccaccgctgacgatagccaccgacagctcgggttctctctgctatcaatgcttcttatttggtatgaattctgaaagctcatttggcgtgttatctgcatgagagtttatgatgacatgtttttttgttcagaccagtgcttctgtttacagatttgttggtctacatattagtaaattcagatgagctgatgaatcagggaattcaggtaagatcatgacttccagcaatttggtactatacaacaaagttttgtcctattgtcctctttaatatgtatttcaataatgctgagtttattttctaatttgtcaaccatagcgagagatatcagtaaactgatttcgcaattgtttttgtcgaactgctgctgttaataagagttctggagtaatatatatttataggtacacaggatggttaagtaaatgtacttatttagattgctatgcctaacatccttagtttatttgatgatgctacatccttcttcaactttaaggtctgctatgcatctttgtattttgaaatcatgggccattgaaaatgtagcactagcaattactttgtctcttgtccagtaccttttctagatttctattctgtacttatttgggatgatttttttgttacttggaccaactagactctagagcgctgtgtgtgtcttttgatcaatgctgaacagtgcttataaaataagtgttgtaaacacagtgctgctttgatcatgtatttgagcctaacaatctctagatgcaccatgcaaaagtagttttttgttttgcccttatagctgttagacataagaatttccttactgttcgactaaaaagttctctttctacttcgataaaagaaaaacttgatgtgaccaggcaaacatgtcatcagtgcttcatataatagttgattctatgaatttttttttagtttcaggtataaaaacgacttggacttctatttcatggagtcatggttaggaataaggaatattctatgaatattccttattcccaaatttgaggactctagcatggacatcctaggagttcctacactggtgggtcgttctcaagaattcttcaagccgagttgtttctttctcttttttttcatctgatctttatctcacatggaaccatttatttccaggatattaactacgtcattcagatcccacagtaagctaattacgcccaacgatctaacacaattcctttctcagctaattatgcactcttttgtcaggaagagctgcattcctggttctgctgtaactgagggttgatctgcctgatgttgatgtgctgttcagctgttgctgttatgaagtgggaatctctattaccaaatgatacctttcttattgttgcctcctctgatggcgcatttgagaaaatgactatgcaggatgtctgtgatctgatgttgtacgtgaaacttggtgttaagcaagaattaggatcctttgcagtaacacaacagaatttggcggattatgtagttgacctttttttatagatagggacaacggacaatgtagcagctgtgattgttccattgggatctcattatagctctaaagttacactaaaagattggtacatatgcttgaagaaaatttcaggacatatatttcaccattacaaaccattccaaaggacatctatttcaccattacaaaccattccaaacaacggaagtcaggtaggtttaatgtacaaaaactcaaaaagttcttttttatcgcaatcaattggcaagttggcaatttgtagtcatgaccacttgggcaatttttacattatgttttgtttataagattgagcttttcattagttttgagaaataataaattactccaataatttgctattgtattacactatctatttatttcaatacatttttaaaattgaagcttattttgtttacatagtcatccgctacgtgtttagagtttgttttgattaagctgttaagcatacttgcgtgcgcagctgtgcgcggcgtggcgcccccttatacttctagtctaaatcaaaagttgaattgtttggggagcttaactctcccacacacacgaccatagttgtgagtggctcaattggatattctttcctagcgcgtccgtaagtccgttgatctcctcctaaatgcaaatgtgataaaaaaaataatttggcattgggaagtccaaacgtcaaatatccacaggccacaggggtgcatccttctaggcttccattccattccattctttaattccccccaattttatcccccacacactccactccactccactccactcttttcgctcgcgtcgcttcccaaaccctctctctcctcaaaaccctagcgtcgcccgcttcgcctgagctccggcgatggacggcggcgaccgcctcagcgcgctccccaacgacgtcctccacctcatcctcctccgcctccgctccgccgaggccgccgcgcgcaccagcgtcctggcccgccgctggcgccacgtctgggccaccctcccggagctccggttcaggatggacgtcagcctcgccgcccacgcggccccggccctccgccgcctcgaggtctccaccgacgcggacgacccggcggcgtcgacggccgcgctccggctcgccgcgccgcgcgtcgccggcgaactcagcttctgcatctggccgcggtgggacgacgcgccggaggaggatgacgggccggcgccggtgaggcgccccggcgtcgtcaagctcccctgcttcgagaaggccaccgagctctggctaatcctcggcctcctcggcgtctcgctgcccaaatccggcgtgttcgcgcagctcaccgcgctcgccttccgcgacgtccgcttcaccggccgctgcgatctcggcgccgtcgtctcctcgaagaggtgccccgtcctgcaaaagctccaagtccacgactcccaggatctgtataacctgaccatcttctcggagtccctcctccacatcgagctgagcgacctccatggcgggatggggcggctcatgatcgtggcgccgctgcttcgggttcttgatgtgcgccattgcttctactggaggacgtacaggtcccattcccttgttcgggatcaaccatatgccgcggtcttcacgcccgcgctggaggatctcatctgggttgatgcgtatgatcctaccacggtccaatttggcggcgttaaacgcctccggaagctggttacccaattacagtgtatggactctctcgctgcactgatcacatgaattcagtaatgctcttgcggcgatttgagacggtatccattcttcagctagaacttgactatccagaggtaactgcacattttccctaaatctggcatgaatgtcattgaataaaacatagagattgaaatatttgtttggtagactctagtcatagtgtgcatggacttcattcagatatataccttcataagtattgacacagctgccctggtgaaatgtgttagatatttatcttttatgtattgaaacaattgcccttggtgatgtgaaaaatagcattttggaggtcctggatctgctatcgcactggtactgaacatatgagatactgaggaacggtattgatcaaccagatttagccaaagaagactagaatttgagtagtctgtcccacaaacaggaagtgggctcagttttggttctatgcatgaatggtggaatatagagtaagacactgcagatatttgatgctgttctgcctatgtaaaactcccatttgtcttgctgtgctcaagtcttgtagctgtcagcttcttgaggctcttctctaaattatcatcattgggactcgcatgtttattaaccatgtttcaattgttagcttgaaaaatccagttttctatcagttgcatttacgaagtattatagtttgtacatttcactatgcatggtaaaaattaaaattaaaattatagtttgacgcccataatctgatattaccttttagtagataatccctccagtcttgaatatttgacattccaaacatacatttggccaaacttttgaaagtttcaccttttgtcttttcccgtgtttacaagaccatgttgattatccaaatgacaagatatgcagtaggcttgtatgaagaccctgatagaagatcttaactaattaaaagattagtatttttccaatcgtcaccaaaattagtattagtatttttcgtccgtatgtgcaatttttttcactcgtccgtgtacgatctcctcccaaaattttggttcattagtacacgcgagatcgagagaccgcatcgctcccgtcccgtacgcgcgtagaagcccagaactaatgcacggaaacgaaagaaactgaatcacaaatccaacaacaataaagcaaaaccatcccaaaaattaaatcaccggggccaaaaaaaaaggaaaaaactgcaaaaaaaaaaaaatcaagcattggccggctcggcgaggcaatggggaggaggagacgaccatcggcggctcggacgcagcccagtgcgcacggtccaccccctcaccacgcacctccaaatccatggacccgcgtgagcgtgtgggcgaagagatgacggatccatgcgggaagggaagaggtcgctggatccacccctcccatcgccgccaacggcggatccgcgcgagaggagggtggagagatgacgggatctgtgcgggaggggaagaggtcgccggatccgcccctcctgtcgccgccgacggctgatccgcgcgagagggagacgaagagacgacgggatccaggcgtcggtggtggatccgcacgagcagcatcaacggcttggaaccgttgcatgaggaggccttgccgttgcccccagtcagccactgcgcttcttcatcttctcgctgtcgcgcttctccatcttttgccgcatcaaggagaggaggcgccgctggccgctgctgcagccggtaggcggaaggaggcgccgctactacagggaggaggcacaagggctgagtatgggaggatgtgagggcgcacgctggtggaggcgctggatgcctggatgacggcgtgcgatgtgaatggggaacgaccgaacgagtgagaagggagagagacacagagactgggatagaggagcctagagctctttgagcagaagacctcttggagctggcaacctcctcggtaatgaggtacgagcttcagttttttcattaaaaaaaaactacgaccggtcaaagttcctttctttattgtgctattgattttcgctgaaaaaaagtttttttagatacacgtaagagtacttcacaactaatgatgatttttctttattacttatattgttgacatcaaaatcacttgaagtttcagtaaatacaaaatatttgtttgagacaaaaaaatatcgattgaaaaaaaaagtttccacgagataagccaaattagagtattcgcgctatcatccacatgtcacatgacctgtctccacgtgagtccacgtataattttgagttgacagatcgagaaagcatgcatgaccactagagactatgagtaaatatgcaaaactattttcgatccgcgacactgctacatgatatattttcttggacgccacccacttttgtttacatgcggtccgtaagtagaaccgcatggaaaaatagggggacaggcgccgggctgtcgcccgtgggcgacttaagccaaccgcacccgaattttcacctgcacgggcccaccgcttttaaccgcgcccgcacacatctccccctccgcccgctcctctcctcccacctccctctcccactccactcctctcctctcctcccactctcctcttttcccctctcccggccggccggcggtgcgacagcatgcggcggcgcgcggcccctccctcaactgcgggtgggaagaagggcagcgagagcatgcggcagcgggcgaccacggcggcccctcccctctctccccttgcggatccggcggagggggcggcggatccggcggcacgcaccccctcccctcctcccccttgcagatccggcggaggggggcggcggatccggcagcgcgcaacccctcccctccctccccttgcagatctggcggaggggaggcatgggtgcccagcggagcggcggcatgcgtcagcggccggtgtggaggtgaggcgatggcgtcggcgaccggcggatctatctctccccctcctctctttgttatttgtgattctttgttatttgtgagatgcgttcttggagttcatttgttgctgtgagatgtgttcttgtgatgtgagagttcatttgttgatgtgagatgtgttcttgtgatgtgaaatcattgtgtgtcgatgtgcgactacagatccggcgccggcgaccagaagggaggttgtcctctgcatcggctacgacgatgatgacctcgccctcgtcgacgtcacctaccccaagcgtgacgtggacaacatgcagtggttccgggaaatcacactgctataccgtggccaccgccactccgcaccctttgtcctcggcctcatcgtgctctgtggccatgcgccgcccaacaactggtgcccatgggggcgagaagggcgtgcgcggccatcctcgggaccccggcaccctgatccgctacgtcgcgatctacatcggcggctcccatgccttgtgtaccagcccgactgcaaccagtccaagtacaccgtcagcgtgcttcctttccatgaggacggcggaaggatggcgcggcttgcagtggctcgcaacaaactaggcttggcttggctcagctcagttagggaaacaagctaaaacttgagctcgcctcggctcgttttctggctcgagccagctcgagctgtcttgcaagccttcctgttgaaacacctcttcatatatattttgtaattattaaaaaatcaagaataaatcatttaacatgtaaaatttaaataagtttatatattcaattcttcaaaatcttaatgataaatttcaatttgacaaataataacgccacaaaaagtaaaataatcgatataaacacatgatggcctaggctcgcaagccaaagcaagcggctcgcgagctagctcggctcatttcagcaatgagctgaaaaggaggcttgggcttggcttatttggcttacgtgctgagccaagccaaccaagctcgagccaagcccgagttgagctcacgagcctgagctttttttccacccctgcactaacaaatatccaacttttacatcccaaaaagttactcgtgtagtgtcccacagctaattaaaaccgtgaagtcacgatgtcctgtagcaaaatttgcctatttggttttgttacacagaggatgagttaatttctccatatcttcacaattttcagctcatgttttatgaagggggcaatatatttcaactccacacattttcttcacatatcaacgcacgggtatattcctatagttctctcatttttttaaggcttatctgcttagaaatatatatcccgcaaatataaagaagattaattgtcaagaacaacgcgactttgatcaaacttcaaccacccactatcatctgttatccgtgcaacgcacgggcattaagctatagtaataaatttgtcaactgtaacaaaacaacttatttttaattcaaggtggtactgtttttcatattgtttattgtggctccttatttgtgaatgtgcagatgggccgcagtcagtatttgatggaagccataaccatgctgccagcaattgaggtcatgtccctggagttgtcaaaaagagggcacgcttttgggcagtgtgttttccatttgctcaggatgtccactggtataagaaagctgaagcttgcattacgtggaggcctcaaggtaagtacatactttttaatattgtactttggttgtggggaattgatggaagtattttaacttttgcatgatggcttgatcttctaatggtcaggactctgaggagaggatcagtgttttgtctacctggttccagggacaccaggtaaaattttcaatctacactattagctgataactagtattgctctgtcatatgtattgctaatacatgtatagcacgcccagtaattcctgtacttgaatagccactgctaatggtgatatgagttttgactatttgaggtgatactttgctatgtaatttatgtagaagaggtaaatgctaaaggatccaaacatatttttgctcaatttgatgtgtatttccaaaattgtgaagtgttgtagttctttttgggtgcctggtaactgttaatgttagactttactgactgaacattgttcaggaactattaacgaatgatcttcatgttgatgaagatggtgcttagttagcgatctggataaatataactttaggcatgaatgtgatgtagtatgatgaggggaatgctcaaagaatcatgaatacagtctatctctctttgtttaagacaaacgaattgattgtcaagtgcatcccttttgcagtttttggatttgtttgatttcatttataaactgtacagggtactgttattttctatgaatggaagtcttgtcgcctcaattgttttgcctcaaaccacgtctctcattctattgttcttgtacaatagctgtaccatactttcggctggtttgactgtctaattactattctttcacctatactccaggcagatgctcgttgttctgcaagttgcatctgtaatcggccacaagcctggaaaacagaggacctcttcttggattctctccaggaagtggaaatcagtggattcagaggatcagagcatgaattggccttcttgaagcgacgttttggatgggcagcaattctgaagacattcaccatgcatcttcatcttgatcttactgtcagcgatgatttatgcaaggagcttcttagcctcgctacccctgagaccgatgtgaagatctacttctatcgtgatgatgatgttcacgctaggccagcttgggtgttgtatacaccagaagagtaaggcaccaatcggttgaagcctggtactaagtacttaattatgcagggtatgctatgaattaccatgaaactggatcttatattttgatgacactggatgttctgttatgatcgggattaattcccatactttgccctgcaaggttggcatgaagagatgctggtttacctcttctcatgttgtgatttgctgctttgcgctctaattgccatttgcaagatgatgtctgagatgactttgtagcatggatatgaactaggtacctgaatgctaaacttgtttaccgactagagaaattgcaacatatatacatcgaattttggatgctctacacggtgaactatgagctgggtactagtaccacacaagtaatatgattttgcaacaaaatgcagatgctccataaaagtaaatacgtttatgtacctttttacgacaaaagtacacattgaaaacttcccgagtagaaatttgaatctttcagttcaatgacttccacatttaaattgaagagactatcaatcaatcgcccggactattttcacatgcaacttgaaaagtttcaagtgtacgtatagttagttactagcttcaaataatatatagccaatttaacaatttattcatataatagttaccaataaatatataataaacaacgaatagctgatctcgcatctcataacacataaaattttgaagttcatgctggctataaatctgtagccttattttctcctctcttctctcgtctcatgtgtttattactaccttataaacaccgctttcctcgtctcttctcccatctcctgtgtttataactaccttataaacacttttttctttactgtaatcaggagtcaggacatagacacttgaattaaatttgaaaatatattattcatttgttttttctcatcaatattcggtacgcaaatatttttggtagaattatagcgtcgatctcatacaattgcgcgaaaataacatggtctcgagcggggacggtgcaagacaggtctaccagcgagcgaaaccgaacatgctggtcgattcaaattaattaattaccaggattagcgagtgattaattatttattaacagctaactagggtaattaatcactaattattactaattaatctctaattatataattaatcactaattattaactaatcgctaattagggtaattaataattaaataagtggcaccgttggacaagacgttaggttttgctgttccattctgcgtgaccgcgcaagaccgaggtgctaacggtcgtgctgttccattctgcgagaccatgcaagaccgaggtacaacggttgtgcgagatcgaatgcatatttataaaaaaattacatcttaaatatttctaagaaaaaagcaaataaacaatatattttcaaatttaattccacgatggcaaaaatgataattagcgatcaactacacgctcaactcagattttctgttgaactaatacgccattaaattggtctaaagtttattcgtacgtaaaatttgtaggtacaaagtttttatacgtacagattatttatctataatgtttcacgtattattttttatatataaagtctacgtataaattctgtttttgccttgactaaaatactactcataatttattaggcctaagattaaacctagagaagtgctaagagctgagggtcagacgctcggcggtgtatgggctggggtgggatgcgatcgtgcggctcctaacgatagatcgatcgcttattagcaatctcccactatggggcaatttggcaataaaaaatacggggtgtagtgaaagtggacatgcggtagtgtggcgggaatcatgccgattgactgcactgtgcattatcgttgcctactccctgagcaacactaactcagtgtcgctgaacctccatgcgagagcggcttgcctcttgacaactctgtaagagagggactagctacatgaagagattcgaacgggttgcaagagtggttgttcgttgggtgacattagcccatggagccatgggacaccagcacgctcttgccttatgtctttggcaatgtccttagccacggagttctcgttgcctcttcctgcggcaccaactcagtgtgaacatccctcgaggcggcaccgccggcatacactcgtgtcgccttcgctactagcgaaatcgagtatatcttcacgatttcttttcgaagatgacatatgtttgcacgatgtcatggaggtcgctcacctcgccgccgctggggtctccgtcctcgagctcgcccgcgtggcgatgccctcccctagtccccttctcctgcgtcgccgccgacgtcgacgccctccttcttctctcgtctctaggcctctccaaccccgagctcgcacgtgcggaacgccctcccttctcccacgtcatcgtcgtcgtcgccgctgccctcctcctctcccgcctcgcccaccctgtcggccagcctacaggaagagaagagtgagagagaggaggaaccgaggaagggaaagaagaggggaagagagggtgatgacatgtcaccaaacatgtcatggaccccacgctgactcagctgccacgttggatgaaaccggggtcaaaatcacctgaggacccaaaatgacccggttttgtaaattgagggatgacatatatcttgttttacggttgggggatgattttgtaattcgatgataaggtgagggacctgtgatgtacttttggctactactctaaataagctggcccaaataggaaaagatcgcgtcggccggtggagaagcgaagcccaaacgaacgcgaggcgcctccgatgtacacgtggcgcctcctccgcccctacaggtggcaagctcaaagcccgaacccgaccactccactgctctgatgctctctctctctctctcttcacgcttcccacgcgcgacacgaggttggagacgcgtcccgtgacgtcatcgtcgtccccgactccggcgagccccgcacccatggcggcggcggccgcgaggggcgccgccgcggcccgctccccgctcgtcctccaccgccacccccaccccgcgcaccaccgccgcctccgcctcctccccctggtcagtcactccgcccccgtctcatttcctcctcgatctctagctccctcctcttgggagtaggcgggattgggagctacctacctcgtgcttgattgaggtggtaattcggtcaactactgattggggttgcaggtggcgggcggcgggggaggctcgcccccgcgtgtggggaggaggatcagggccagccgggagaaggggcggcgggtcgggattagggttttcgcgaggtacagccaggcccaggacttctccactcgcctccaaggtaatcgattggttgatttctttccccatctctgtataattcgatttggtacttggttcaaagccactgtttaggcccagcttagttgaacatttgaacaagcgactgtttctcattaggcaggatacgggtgatgatgtaatatgaagcgagaatttccggtgtggattttcacgagtcgtgagtttgttttctgttcatcgcagtagcatagagaatgttatgtattttgggattcgggtgggtaaaatgtgtgtctcttcagattaatgtactccttattaacattcctcacaaaaataagtagttatgaacaatcttgggatagctagatcacagatgcattgaatattaagtttgtttgttcttcgcaaaatcatcccatgtctttgatttcgttcaaatgcagatagagctggcgaattgcctaagttggttgaggaccttctacagacatcaattagcacagggccacgaggtgcttttaggtttgcccaagggatccaagctgtccttggggttggtggggagtggctaaatgacttctcaaaggttatttcttgtttgtgttattcatctattttgtctaaaaacttgatcttagaatttctgagaactgaaacaatggaagcagctgtagactgaactactaatgaactactgatgtgttgagttggctgaggttgtatgggagaatattggggatttagggctagtctagatgtggatttttcatctatgtagaaaagaggaggttaaatttttgttggtgcacaatgaccaggtttatctaagatattttttttattgataactttggtttcagaagcgtaatatcctgctgttaatatgatgcagacagccaacacatcagcaggaataccagctcagatgcagctgggtttgctttctcctctttatcttagaaggctttttgagcgcatgggtgcaacttatatcaagctaggtcaggtaaggacatgttcatactttgcggtttatgctatcatcaactacaaaatgtgtccatctcaaaagaaaaaataaactacatgtgtatgtgttccttaattaatagattgtcttgaatttcttaatcttctgtaccttttgaaagaaatgccagaattcttcattttactttgtatatgtagcaaacagaaacaaagaccactaatatatctttcagcaacccagacaatagtcagttgcttacttgtcactagacaggtagagtaacctatctttagagtggtcctttgggatgggcaaagggagaggagttaaaatagttattcagtttaatagtcatatattttatgattatttcaacctggatagtcaactgactgtggtggtgcagttcgtagcttctgcaccaactttgtttcctgcagagtatgtcgaggaattccagaactgttttgaccgtgcaccacctgttccatatagtgagattgagtcaatattgcgtgaggagttgcaacagccgttggatagtgtatatgaatacattgatccagttccaatagcttctgcgtcaatagcacaggtttctgttgagaccatcagaagttctggactatttgttgtctggagctaaagcactgatataactttattcttatccaggttcatggggcaaggttgaagagctctcagaaggatgtggttatcaaggtcctcaagcctggtattgaagacactttggtggctgacctgaattttatctatgttgttgcacgtattttggaatttctaaaccctgaactacagaggacatcactggtgagttatcgcctaatgagtctttcactggacaggatttttttcattcattgaacaatcactggtcctggtggttctcggagcgcaggaaaccaaaatttactgctttctttagtataatcagaagccagaaggtcaaaatatatttttgtttgattcctgtatgcagcaagcaatgcatgccatgaaattgctcccatgaccatgaggatatgtttttcttttggtagttgaggcaagatcattgaacttttcacagttgatttacatgtatttttcaattctagccactgtgctagagttggcacaattaggtgcagaaacttttaatatctatatccttaaaatttattagttggattgaaggcaccacaatattcctaagatcagaaaaaatatgagtttaaaagattaacagaaaattcagaaaattctcccaataatcaagagagaaagaaatgtcttgccacttgcgtgttgttttgatggacctagattgtaacctagtagattaactatagttgttatagttgtgtaacaaatacaactgcacctctaatcattgatataagagctttatagcaaatggaattattgttaaatgtaatcatgcaactgcatggatatcccactaaaaaattgaatatcgaataaggaatatttcatggtggagcacaatatatcttgagcttgtgacatgaggagttgactatatatattattcacgtactataactaaaaaggaaaaaaaacaattagttcacacaaccagaaacaaatgaatactttatactttgtagttcatatatgtggaagtagagacagcatatagcaatcatgaaattttctgtatacttggttatccaaattttgtggtatcacaagttatagaagaatataataagagatgtccttatgctcagaattttatattataggtaggaattgtcaaggatataaaggaatctatgcttgaagaagttgatttcaggaaagaggctatgaatattgaggcttttcagaggtacatcgatgcaatgggatttgacaggcaggccaaagccccttttgtgtatcgccactgtagcacaaagcgtgtcctaactatggaaagattgtacggtgttccactcactgaccttgattctataaggtctcttgttcctgatcctgagctgactttagtcactgcacttaatgtctggtatgctccatgcgtccttgtgattccatacatcatatatttgggtatttctgccattcattgccttattcaatcctcagaataggcatgttgacatatgtgcaaaatgtgcaggtttggaagcttgatttcatgtgaatccttccatgcagatgtgcatgcaggaaatttatggttgctccgagatggacgtgttggatttcttgattttggtatgtaacatattctccaatctccacggtggcacggttgctctatatctcattaggcaatttaggatgcaccttgtatttgctaaaaaaggaaatattctggccttttaattcttacattatctattagtcaaaacacaaagtggtcaagaaagtttatcactattggttaataccatttcacaggaattgttggccggatatcgccaaggacctgggctgcaatggaggtctttttggcttcatttgcaactgacgattataatgctatggcatcagccctttctgaaatgggtgctacagggaatgatataaatgttaatgaatttgcaaaggacttggaaaaaatattctcatcaatacaggtaatatttcccaaaatagtaggttatttgatgtcatgaaggcctggttatcccgtgaacatggtgacccaatttcgactgttgaagtgccaaaaatgatgccagggtgaaacctgggctgtgtttcacaccaaaattggaagtttggttaaaattggaacgatgtgacggaaaagttggaagtttgtgtgtgtaggaaagtattgatgtgatggaaaagttggaagtttgaagaaaaactttggaactaaacacggcgctggtctggcagtagtaaaatgctgaatgcaagcaaaagtggcttatggacaggaatttttgtggctactggctagtcaaatttggatatcgttctttagttagtgttttaccacttatctcgtggttaattttcaattgcattctcatttgtgcgcaggatttggatactgaagtcatagttgcaacagcaagaactcctgatgctacagcagtatcggctaatgttgtcgttgacgagagacagatgaatgcattgtttcttgatctggtgagctactttcttttctctctcggttagaacaaggtagagagaacttctaccttatacattcgtatcactgtatgttcttgttggtaaatgttgcctgccagcgtgtattgttttcacgaaagaagagagatgagggaaaaaaaacaatgctgacaattctgttgctctgcgtcttccaggtgagggtcagcgagtcgtatggattgaaatttcctcgcgaattcgctcttctgatgaagcagcttctgtattttgatcgctacacaagattgttggctcccagcatgaacatgctgcgagatgagagggttaacattagctcccgccaacaggccagaagagtagatcgtttccagtgaccgatgcttgtgatacactgacaagtagtacgtaacaagctcgtgtaagtgtaacctactaactgtatatattttcaccagatcaacataggaatgaaccgcagtgcagcggccaaggaaaatttggacgagtataactggacattttcatagtagcaagtcgctctgtaaaaggtgtacgttaagatggaagtaaaatgtagagaaaatagaactgccggggccgctgggctgactccacatcatttttctgaattctttctttactgctctcctcacaagccggcgctgcgtaaagaaggccagtttggaaaacatgattattttgaccgattatactctagtggattattaagatgattatagatgtaaattaaatattttgataaataagcttaataaatagcttagaataaataaattggttagaataaaatggagtgttttaaagaaaacgtatttttatagacgtagagcaaatggtttgggacaataatcctagaaacgcttcatatcgagcgtacggtagtgcatgcctcggacgccctcctcccccgtcttctctcccccatgcccctcctcatctctctcacgccgacagtttcttcgtgctcacaatctacaaccttggcgagttaccgcctaagcgcatcgtcccactatagctgtttgagaagggttctagctagctattatatttgctctcatacagtgcaatttagccgctatagcttcatttaacctgatatatatagctgtttgaaaagctaaccgctaaaacattgatcgccaaccagccattgagagctgggccggcaaacgagctgatcttgtgctcggcgagtgccgtgcagaggtcttgttcaggcaggctggagctgaactgacccagagcctcaagctcggggagaggatcgatgacctcgatcggtgatcactcgctcttcttgggggcgaaagacttcccggcgttcaggccaaactgcgactgcgtacatgtacttcgcgcagcatga

SEQ ID NO: 43315 - DNA, 1607 bp, Oryza sativa
  unsure (1)..(1607): unsure at all n locations
atatatttaacaatgaatcaaatgatcggataataattaataactaattaaaatttttaaataagacgaacggtcaaacatgtgntaaaaagtcaacggtgtcaaacatttcgaaacggagggagtaccattgttgcagaagctgaccttctagcatcagcaaagcccctgttgaggacttgagggagagtaaagctgccttctctagctaagctcctccaccatatttgactttattttggttaaagaaacctgtaaaactttgaccatcaatagctctcaaaatatttaagctcctccgcctgttccaatgagattgagtcaaatatcgtatgtggagttccaacgggatccagtgccaatagcttctgcatcgatagtacaggtttctgtttgtctggagctaaagcattgagaaaacctttatgctcatccatgttcagaaggatgtggccaaacacttttatatacccactcagcttctataggaggcagcttccactggagttggaatttagagttgagagtttaagtttggaattctaccaaatagggcctaaggtcctgaagcctggtactgaagagtgaagacactctggttgctgacctgaattttatctatgtttttgcaagtgttttggaatttcttaaccctgaactacagaggacgagttattatctcctaattagtctttcactggataacattttttcattcgaaaaatgtttttttagttagatgcattgtccggaagaaacctcgtttttatgaaacaatcacttgtccatgtggttctcgaagtggaggaaacagaaatttactggcttcattagtataatcagaaagtcacagaatctatttatgtttgattcgtgtatgcagcatgccatcaggttcattgttctgttatgttactgcttgtgatatagagacagtaaaaagtttgtgtaaccttgaactgtatatatttcaccgaatcaaaatagaaatgaaccgcaataagaataatcaatggaaatttgtacaattgaacatttcatagagcagctaatttgcttgtaaaaggtatatgtttaagactaatgtaaaatctgtgtagatgtaaagataggctgcctccatttttttttctttttttctttattttttagaagatgctactgacactcaattaacctagagtgttatgcttacagttattagtcaaatccaactaataaaacctagagtatgaggtcaaaatctacttttgtttgattcgtgtatgcagcacgccagcatgtaatttttttcatcatgaaaaaaggagatgaggaaaaacatgctgactattgctacccaagattgttgattcccagcatgaacatatgctgcgagatgagaggcctcagtaatcgcgagatgagaggcctcagtaatcaatggttactgcttctgataaaaagacagtataaagtggggtgtaaccttgaactgtattcatttcaccattatcaacattggaatgaactgctgcaatacagaatcaaagaaaatttgagcaatagtagcaattaatttgcttgtaaaaggtgtatgtttaaagattaatgtaaaatctatggat

SEQ ID NO: 43316 - DNA, 8678 bp, Oryza sativa
agaaggttgcttcgcttgccttgcattagcctttcccccatcagaagcttcttttgacttcgatttcttgggagcacgattttcccgacgatcaagaggttcctgcagatcagttgcttgactgctttcggtttcagaaggttgtgtgatttgcgtcgccgtagggctaccttcttcatcagatgcttccctggactttcttttcttgaaaacaaaacggtctaaatcatcattctgctcatcagaaacttcatcaccacactcagcctgagactgacttgcacatacatcattctcaatgctgccctcccgaacatcagattctcttggctcaatgactgattgcggatccttggaagttgacctgtttgaagaattaccattggttgcatccaacagagaatctaactgtgttctaacaaaaattgctacggcaactgcatggtcactaatcaaagtgtcactgggtgggcaatgaacaacattagccagtgcctggtaatagcgaaacagtgccaaggatggtggtgccagccccctttggcggaagactttagttgacttaatggcatgtttgcaaatgtttcccttcctggaccagctacaatcacacaatgcaagatcagaacctggattcactatgacatgggacctctccttgtttttctggcaaaccactctggcgcaattgccttcgacaacaacatcagaatctgggatttgcaatccctgctgccatggatttgggccacttttccactcactcctccagtaacgagaaaagttgtccttaccagaatattcatccaaccagtagtaggaatgaaccttcgtacccagcttatgaaccaaccaatctgcacgctggtatactctttcatttgcctcattcaatagcctgagttttagcaggtgatggtagctctcgattgctgaagcaacctcagtagtagccaacggggtggttcttaacatagttatccatgaccctggaatacattcggcagtcagcactagcagattaaatagtgatagaaaacttcatcaaataccagtagactcaaacaacggaaactgaaattcagatgtgggctaagcaaatgtgatacaggaaagagacatggaccaaccaagtcttggaaaccatagagctctgaagtagtctagaaaaccagcacaatcaacaaaatcttccagaaaggcttcaaataattccatgccaccatttcctctgcagatattgcagattaactccccaagtcgtttagccatcatcggacgcttctcaatatctgggcacttcttcattaaatttttatgccaagcatgccttatgcgccatgggctaatcagcacagggcactggaatacttccctgttcagcatgctattacactcaggaactgcaaccccagaaagcgtatagtaatgcactagattaaaatagaaaagcatcatttaccttatcgtgcgcacatctgcaaagggatcatcaataataaagccacccaactgccatgttggatcttttgtacgaactcgatcataaagggcacccatccatctatatgcttcaccatgtgaaaaattcggagttatgatccaagcaacaggaattgcatttttctgcttgtcgaaaacaaggaggctatgtacaggatactgcaaaatggtaaatagaaatgctaccatgaaatcaagcaaaccttaaagcactactggaacaaaaatgaaacaactgtcattgacaaacctttaatttgtttgttccaaactttgaatcagaagccaataaactacggttgccatactgaatcatctgctggagctgccaatctgtctggatgcccacgataaaggtgtccttatctgaaaagtcctcatacaaaaatatatggttttggtgattttcaacccatatgttaatgcttatagcatcatcgtcatcaagttcgtaaacagaacgacgaattttcctttccaacctcctaacatatctgtgagtaagaagaccatctcggtttgatggtcctccttgcttttcgatcatttctgtatgtctctgcattatggtctccactggaataccaacacagagcaaagacataatctgaagacgaagttcatctgatatgtaaggcgcaaacatggccttcgtcccaatagccatattgtccatgggaccatggcagggcttccctatcttatctacatgcttatcatggttatatatcacaagagcgacagatggttcagcaatcaaacgcttcacaataaaatggcaaatacagcccctctttgtatgaggacgaccagcaggtgttttcctctttgttgaagagttcctgctagggcggacagagccaccctttctataatcatctggaccaaaagaacaccaatacctgaaattaatggtatcatgaggttcaaaagcttaatgtaaattataacctatttaacagagcatatctaatgttaagagacataaatagaaggagcattatcagccatttaaaagataagatcgatttaacaaatagcaataataaatttgttctagtttacaagatgaataagaagcccaggttcacattccagtttaaaaattagtcggacagaaatgcataatgcttacatttacttacagaatatactcgagtatcccatcaacttttggtttgcagttcattgttggtggacgccttcgccgtgcttctacatgaaatcttgttgggcactctttgttgtttgattctcctctaacaaaatcattcacccttgaaaatggaataagcgcaagcctgtccattgagtccttccatccctccaccctggaccacatgatatctgatgccgaaaactctggcgtgggtggattctgaactggaagagtcaaaatttcatcccacctagccatctgcatttgcataggaatcatcacaaataatcaacgaaatcaaagccaaagtagcatatatttttttaagaaaaaaaaaagctatggtctgtgcaaagaggacagcatagacaaacaaaaaaaagagcatatatttgtaagacagttacacctaaaccaagtgtcatgttatgccttcgaaaatttaaacattagtgttgttcacatcacatgattaaaaacaaatacttgcagttgaatcgaaaagagcatatccacaatctcagtaggtgattcaagcaccccaagacaaggggaagttcgcattagattttgtggtatgctaagactgttagacatgaatcagcggtatcctttccacgttcatccttttctaagaacccataagtaaaccttcttttttctcaagccgggcattcgataacttgcattctggttgcaagagtgctgtaacagcattactacctctgaatgaatcaactcgctagcaaaccagacatttctaagcaatcccctcacccaagaacctgcaccgttggctacacttgttcaagtcctaaccctcctcaaactcccccatattggcctacgcacgccttaacccttctccaaaactcaccaatcgcgcaagtcaatggtgacgacgcacgcaagccaactaaaacctagtatatgctctacgatattgcagcggaaatattccaattccactggaatggattctttttgggaagctgacacagaagcccccagatctacaagagaagctagttctatgggtagagggaggggatagtgtggaggtaggtatgggtgctcaccggtggcggcggcggcggcggcggcggtggcgctgctcccttcgctggatggaggcggtggagacgggaaggccgtggggacggggagatcgactggctagggcgcacgcacgctgaggctcgaggcccaatcacatgtgtatgggcttttcctgtttccaagggaggctaaatagacttattcattgctgatggaccatgggaccaggctgaaaaatagactgccggtccttagagttagagcgtggtgtcacttagttccatggtcttgtaaaatcgacgttaagacccatgaacttgtttaagtgaatcattgcggttcaaagcagtctgaccagaatttccgtcttgcgtggttctccatcgtggccgcatatttgcaattaggtccctccacgcccgttccacccctcctccccaaatcttaagggctggcgccaccgcctgcagcagcctacgattgccgacgcccaattgccgtgttggagagctggccaccgctagctcaagtgcttgtagacgagatagccatatggctaccaagctcatccccaaccatcgtcaacgagctagccctgcccgcgggccgctgggtatgaggtcgacgaggtggccgtcgggagctcgatagtgaatcaggagtcgtgtccacggcgtggcatcagacgagccggccaagagccagaacggtgagggaggcagcagcgaccgacgacttagaggtggagaagcggaatccccagcgcgaactcgccgctcgtggccatggctcgccatcattgaggccaccacctggcagatgacagcgacggacggatcaggcgagggagagggatgcagatgagatgtgcagtgcggaggccctccccttccccttgtgccatctcccatctcatccgccaaattggctagctcagctccaggccccagctgtcgtcgtcgaggccctccgctttacaccatctcctccaccactccggctagctccaccccagccatcatcgtcgaggccctctattttccatctcctctgccgctccggctagctcctccctagcagccttcgtcgacctccttcactttcccccatctcatctgttgttcctgctagcttcgtcgttgtcgtcttcatcggcgagccaaggtcgtgaagcgagcacctcgtgcggtagcaattagcagacacaatgagaagaagaaaggaaaataaaaaggggaagacttgggggaggagggatggattggccgcagaggggcttaaatgcaaatatagggccacactagacagccacgtaggacgatcaacccggtcaaacgtgttttggattgtaatgattcacttaaacaacccgatcagacaaggtttacgtcaattttacaagatcgttgacctaagtgacaccatgtttcaactttaaggatcggcggtgtattttactaagaaaacaagtaacggtaagttggtaaacggacttgcccaaaatagtctaatgggaaattcactttatcgaaggctttacttctggtccattcactttatcccatttggacatgtcatcgcaggccagatattaaatttgtattctctagaagatgcctctaaaatgtaacatattggaagaaccgactgagcagatattctctcactcctgaagcatgatatatacaacggatgctcgtgagatcccccatcttttgcagtcacaatttttagcattaatgtcaaacaatgtacttagaattcatatgttctacctaaaaatagtacctttttctagctagcaaagcataacatgtgttcaccatatctgtattcttcaacaccttcttcctcatcttggggcatataggctattgctattgctttgccatttctttatgcttattgtattacctactcatcagttgacctttgattctttctagcattttgaggattggtaagtctctagcctctgagatgtacttgctgaatgcttcacaattattgttcagtaagatgtcacacatagggaactcaccgaaacacactctgaccttgcggaggcgaaatcgaagtattcataaatctcccatggcacaccacaagtccacaacctcctgagcgctcaccgctgactcttagccatataggatactttctccaagagtaacaaacacagtcgattatttgcttactataaactctcaagtgctcaaatggatggagtgtatctctcttgttctcaatccaactctttcctcttctcaaatccttctcatagaaagctactccaaggtaaggggatgaggaaatactatttagttttggatataactcacttttgcaaacccccccccccaaccagtagaaaagaaaggatgagggatttaaacaacatatccagatttttgccattgggataaaaagattacaacatcataaattctgatgtggacatcagaacttccggtcatttcaaaaagaaaaacctaacagtaacaacacacatgctttgacctaggattttacacataagaaattctgatgcacaaattaaaacttccgataatttgaagccatccaaactgagagcaagaactttggagatatcaaacattttaatactcaaaaatctagatattcacattgaaaaatctattcataaaccttgaacacaacccaaaagcttaactttgaagaaaaaagggacattccattaaactgccacataagagcttctagtattactcaaaccataatgacttgctttgaagtctgtttttaatgatcgtgaactttatagaaagctcactcagagggttacccggccaaactaaaacacaaggtctaaaatcacttgaacgatacggcaatacttgagtttctctcaacaagcacttcgatagatcattttgagtaccaagacatatacaaacacatcaatgattgcacccctcttaataggtattcatatattcaaatgtaaatagaaaaaaaaaatataccaatagaaatacattaatgtttatttgtcaataccaaaaccatttcttctttcatacttaaaatgattgatgtggagtactcatagattcaaaatttcaaatggctttatacggtccatcatgacaaaatcatcccttgcccttcaagatcgtttggtccatcgcagctgagtattgcattccctttacctgtctcgccatagatattcactttgttcttcgcatttccaatattttcactttgtaattttgttcatcaatttgaattttccatttcactttgtttttgttgattgatagtttgaaatccatcttctagatcttcatctattctcttgacagcaagcttgatcatgaattgagaaaattttatctttcacaccattttcttcttgatcatgcttctcttctcatgaagtaacttgaaaaccaatggctgatgtctaccttgaagttcttcgtagagcatcttaattgtcatcaacttcacatatggtatttgttggcagttgttaaacaccattttgaccccaagcttcggcaatagaatgggtgaaacaatgttcaattcatccatttactttagattaatgaatcaccatgagctttattgttcgttacttcgttagttattttgtaggtactatccaaataaagatgaaatgtggaatttcaaatgtttgaccaaatcttgtcctaaatgacgtatgtttagtgacaattttgttcgttggggtcactcttcaacagtgagatcttattaaccttgcctttaagactttggtccagcttttaatttttttttgatacaaagtataatataaattattaatattggtttgaataaagtatattgtatagctaagtgataatttcacggaaacataaccctagcatctaagtgcaataaatacaatcaattaaattcagttgtaacatgttacaaccttaacaatcgaaccgcctctaacaccacgatataatcggtccaatcgtaagattcaataacaacattactaataaaaaaaagttaacgcgtgtagttacaatacaaatagatagcaaaaaaatccatgcagtaaagaagtaaacatcaatcgtcactaacaccacaaaaccacaatacaaccagttcgatcatagaattaaataacgacatcactacttttaaaaagaatataagaagtaatatgtttaaatagataccactaaaaattatagtatgtaaataaagagctaagcaccaaaattaacagctattgttgcctccaatccattaaccacttgccatctatagatggctgtctccagccacaccagtgaccagccaagcaaaacacagcttttgcttgattacttccttccagaaacggcagcccaggcttcgttcaaactcactcacagctaagcctttccttaaccccgtttgaatttccgagcttgcgtcgaatattccggatgcccatccccaccaccaagggcaccctcgtcatttccccatcccccaccccgaccgaatatgccccgcgcggcggtcgccccgccacgtggacgcgcccccacccgacgaacgagattcctcgcgggtgcccccggccgcgtaattaccaaactacccattctactattccgcttttataatatagctgcctcttcgtcttcttcttccccaatttccccttctcctctccttctcttcccgctttgcttcccaatttctccacgccaccgagcaattcgtgagagggagaagggatcggaaaccctaaccctagcggtgggagccgccatggatgcgcggatgcggtgagcgggggtggttttcttggtgggtgaggcgaggtggttgggggtatgggtggggggaggaggaggaggagcgcggcgatggcgatggagggggaggtggagggtggtgggaggaggcgggtggtgcggatcatctttcg

SEQ ID NO: 43317 - DNA, 9599 bp, Oryza sativa
cgacaccgccgaggccgccgccgccgcctacgacgacgcctgcctccgcctccgcggccccggcgccgccctcaacctcccctcccgccgctgcgtcgctcccgctccgcctccaccgcctcctccgccgccgccgacggccgaggagaagaagctgctgctgttcccgccgccgctgcctccgaggaagaaggcgatgctattcccgctgccgctgccgccgaggaagaagccgctgctgtacccgccgccgctgccgccgaagaagaagccgctaccaccaccatcaccaccgccacagccgccgctgccggagaaggagaacaccccgctcccgccgctgctgctgcctccaaagaagaagccgcttccgccgccgtcaccgacagcggcagcgaaggaggagcccatcgagctcgagcatgcggcgccgccgccgcctttcgtgccccggccggtgtggcccctcctggccagcggcggcggcgggaagcggaagaagcagtcgggctgcggcggccgcatccccgccctcaacaccgccgccgccgccgtcgaggagaccggccgcgcctgatcctcctccccggcgacatggatgccaccaaaaaaaaactaaaaaaaataaaaaaaaacaaataacaccaaccatcctaatgtgaaaagcttagtggatcattccttttgatgtgattcgatgatgctgttaatctaaatctgatctgatgcgattatcttctttttttattttttgtacatacatatgctttgcttctcctgcattaggatcttgggagaaactcaaaaactgatctgtaatattttctgtaatatcatctcgtctcatgtagttgtgacattgtggtgttgacattgtaacgaatcggtcgattcgaagagaacttgtggaaaaagaatcgagtcaagattgattcaaagcctggtttcgtttcgtttcttggatgttgtcaaaaagctttggttctgtttgaagtgcttctataatcttcagctgtcaagcttctctaaacaatttagattttcgctcggtttatgagaagctgctcggtttttaagaaactgtagttgtaaaatctttagtttctctatattttatccgttatttcttagaattttagttgtagaaggtcgttcagattttcgcccggtttataagaagctacttaatttctgagaagctgtagttgtaaaatttttagcttctctatattttacttgttgtttcttagaattttagttgtagaatcttcagcttctctttcttattagttgttttttaaaattttaaactcctcaaccaaggtcatagactcatctggtttgcttggtagagggtaaaaaagagactagttttttaaggatgagttggatgctgtcatcctggcgttcctgtggctgtggtccaagccgttggatttggggcgtgtggttgagatgagatgagatgagatgaccgcagcaagattattatcttccttttcttctgtttgtttagtgcgtgtgcacgtgcattcttcttgcttttctgctactgctgctgatgtctgccagcagcaggagtgagtatcttgacatcgagtttttgcagtcgcaggttggtcatatggattgcaggtgtaaaaaagaaaaaaaatacatgggagattgcttcttttagtactagtcgtgtgatggagaaacaaaaataaaagcttactttctttttcgatccgttgtgttcagcagtagtttatttttatgtgtgacttggaaatatctcatgtttgttggctacggtctgcaccactgtttctgtatagctgaatacatccatgtatgtggttgtgctagtattggaaaaatcttggagagtaggataaatacttgtccaccctgacgaaatcagaaattgtcgagacttatgactcgagtaggactcaactggtgagatattaatttttttaacacattacatagtggtttatgaagatttaaatataattatggaggcaaacctagagcttaagttcaagctgattttggattacctacgcccctgcttgtttatggctgcaaatgttggaaacatcttagaggatgattttttttttaaaaaaaacaaattaccattaggttgatttagatttagggagtaggagatatggtgataccatggtctcaccactattaccaccttattttcttttcatggataaagaaagcgtgattgtattgaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaaatttgcaggcggcccccttgccgccctgggggagggcgattttgtactgtgctctatattttttttatataaatatcaatagttatcaaatctttttatattgaaaactatacaagattaaaatctccaagattggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtataggtatttaacagtattaataaaaagtaaagtaccgtgtgggcgagggatcgacgctccgtgagaggaagagctggcgaacgcgcctaaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgatgtccacggcgctgcgacaggagaagacgcgcatgaccgcacgcatcttctcctgcatccagtcgaaggtcgacctctgctcaacgtcagtcaagtgcaaacctctgttcaacctcacctggactgcggtgatatcggcactgatatcccgtgccgcatcagcctatgcaagatggaaataaaaaattcagtagttgtcctatattatgaaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtattgctgtacacgtggagcccaaagtgcgcctgctagctgtccccgtcgagtcaacctgtgaagagaggtaaattgtatggctcgatgatgtaattatcataaaaatttagaaatgaacaatccgaactcacgagtggtcggcaggggggacggtcggctgcacgttgccgggaaacacctgcctaagtccgaactgtctcatcacacgctgcggccagtgaggctcaacgaaaatgtcgaacaccattggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaaggaaaaaaaaagaagaggactgataaacttataacgcagcgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtacaaaacactgatccggtcgcaaataagcacgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtcgacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtataaaacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaagattgaattgaaattacacgatagaagtatttagtccgaacactcattacatcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatgtcttgtaagtatggccgcgcagatcacacttgctgcagcgtaaagtcctcccacctgcttctgactcatccatatcatttctgatgcgtctagtttggcgtcgaccctttttcaccctaaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaattggttgtcattatgccataccgagatccatcggtgtcgaacaatagagcccacttctccttaggctcattctcaatccactgagagaaatttctgatggccgaccctgacctccttctcattgttggtgggtcatcaagtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttctatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaatgaaactgcccaatgcttcaccgcctccttcatctcatccttatgagcataccttgcaccctcaattacctcgtactccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgttttttttggatttttagtgaatataatgaaatttcataggggaggggctgggctttatagggggaggcaaaaatcgccctcccccagggcggcaagggggccgcctgcaaaattccatgccccctcgccgcccat

SEQ ID NO: 43318 - DNA, 3347 bp, Oryza sativa
  unsure (1)..(3347): unsure at all n locations
ccctcccagagggcggtaggcgactatttccgtcaattttcaaaatggaaaattatttttgtaaaacttttaataagaaaaattataaataaaaaaaattctgattgtattgtggataaaataggtgccaatttcatagaataaaagtcagtatgtggctttttggtgtgtctggaactaatctctatgtgtcgttgatattgatgtttcatcattggtcttggtgaaagtaccttcatgtttaaacaagaggtataactcttagtatccttgttactactatatcgaaagaactaatacgttatataaccatcattctcatcaatcacccactctaaatattattggttttgtgcggtgtttaacaccatattgtaagccatggttaaaaaaataacacgattccaccatataattattagcaggaatagtacattgcatcagcaataatagccgcttattgtaatgtctattttagaacgtatttacatgatagttgttctcaagactaagtatacataagattgatataaccacattaatttgtgagattattaatatcaccatgatatcaaccatacacaacaattaatatatagttgcacatagctcatactatcagttactcctacttaatgcgtattactttgcaaaaaatatccataagtccatatatatactacatgttgcctggagctacggtgacaaggatgatgaatagatgaaacgaaagccataagtccattgcttgttaccgttaataatgaaaaatatatataatgaaatattagatgtcgttttatcaatcaagagtaagaaaagtattgacctactagtatttttttagactagtccatctacaaagaaaattcaactatactcagatgtcacttgtacaaatagagaaaaccgatattatgtaatacaactacgggtaaaccttaaatgcaacttttttactatgattcctctagaacgtaagattcttaaagtataggaatagagaaaacatagaattaaaaatatcatgccatgtaaaatcctacaagaaagaaagctacagaatttattcaaaacatgtatttggtgtaccatagaaaaaaacaaaagaattttaagattatatgttgatttgctagagagataatggagagagaaaatgccttaaaatatcaaaggaatttgaaataatgaggttgaacctaatgctaaaattcatcaacattgtggaggaatttttcctatcctttaaattgccttaatttgaagcaatcctgcaatcataaggactcattcctttggattggatcctgtcttttccttaaaaaatccttcaatcccaataagccctatatgtttacccattaaaaattactcctacctactttctccgtcccataataaatttattttgcttgtccgaaaataattttatttttagagtaactattacatcgaagtttgtgaaataagaaataattatattatgagtagataaagtgaggaatagttgtattgaaattcgataaagtaggggaattctagtttttttattagtatgtgtggaataggtgaaaataatgaatttattttagaacggagataggacataacttctgcatgtatgttaatatagtgtctaaaagattaatgtttcttttttctggtccagcagctaccaatctacttctactataccatcacatgcctgcctatctctgacaataccttaccaaaatatcagaggcaccattttacagaaacacatggataaggaaagagcaacttggagaaaggggaacaaggggctgtggctcaaacggagcaacctcaagccgcggcttttgtgtgtcgtttgtgtgctcaattgttgagagatcggcttcttcttcttcgtcacctacaaactgctgagagggagagcacgtaagtacgcaatcaaggctgacacgctaacggccgacatcgcctacctgccatcaattaagctttagctatatatactaccactgtatagctaggtcccatgttgcgttggtgacactagctgctgctgtcatcacgcattccgaggaaacacatgtttttaattattttgttaattacaacagctttgatacaatttcgatcattttattcgttttaagtcactgagcgtttcaagagttgtccttccggctaggacaaattaaaatggtagtataagatattgttttttaataaaaatgaaacaatctattatttatttattaattgtctttttgttagatttctctggagatcagtacaaacttcttttggtctatatcctcgtataatatactccaactcatatttttggaaactggcttgtgggtattgataaaaggaccaataaattcattcttgtaggacaaatcactgtttaaatcttatatgtaggtactttttggaggcaacgcactagattcggttttggacgtaactacaatggagtgatgaggacatcaaacttattcacactgcatgctgcaacctaggggcaatggtttgcagatttttttcaacttcggatggagattcacaaatagggtgcaataattgtgaagtcttttgtctagtgttggtggttattagtgggtgcatcacttcatgttttcttttggaggtgccattatgaaattgtttgttgtgtgtgcttatcaatgaactgattttttaataataagctgtagctcttagagcaaagaccgaaattatattccattatttagaaaataatttatggtcagagatagatgtttgacataggataaatctaaaacgacaaataacaagcagtaattcaaaacgatgagaatgttcattcgatgcgtttgtaatgccatttggacttctaatacctatgtggtggtttgtttgcacattccaacaaattttaatgccatgaaagcattctttacatggatgtcgttgaaggtgtatttttaatacatccaatgtgaattaagatattgatactcaaaatttcaatacataatattgacattgctgttgttttgtttgtctcaacggttttcaatgcatatactagcttctcgaatactactacattttggtggtcccacggtgaaagaccagcagatgcctgcattggagatttggagctgaatctgtatttctagagacagaatatgctctttagtagatttatgggctacgccgtttgcttacatccataagattaattggtgagtgtataattagtgatatgtgtttttcaagctctttaagtagcttatggattataggcacacttctnnnnnnnnnnnnnnnnnnnnnnnnnnnnnnnnnnnnnnnnnnnnnnn

SEQ ID NO: 43319 - DNA, 50708 bp, Oryza sativa
  unsure (1)..(50708): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactccagaactttaatctgtttagatttgaaaataggatattggaatgtctgctcagccaacccgcccctgataacaagtttttcaagactagtaggattcagggtttcaaagtcaagagactcctcgtccacacgacttgcactgacatgcaaactagaaagacaggaaagcttcgacaatgaagaaaacaatgttttgctggatcggccttctccaataacaacagatagagtagttaactgggtcagcttctccacatgcttctcaaaggtatcacttgcctgcactgtctcgagagtccgcaattctttcaggtagttcacagttttcggggctttcacagctcggtatatgtctgggccttggccatccaatgtgtcagcagaaagatgcctcaatcttatgagtttgcctatccaacttggcagttcatttattctgctccccctgaggtccaaagtttgcaggttgtagagattggccatggaagatggaaggcatcgtatttgtgattttcgcaagccaagatatcgcaaattaaacagctggtagccaatacctctgggcaattcttcaagtggagattcttgcagtttcagaacagtaagatacttaagtttggctgtcagtgatgccggtaaggacttcaaatttgcagcagcatttctgctggccataagagtccgaaggtacggaaaatctactaatgcaccaatatcttcagggttttccgagataaataggcagcggacattggtatccatctctgctagtttaccaccatggcagatagctccaaattcttccttttgagagatagatacagccagctcatgcaccacaataggcatcctgcaacttgctactctaccttgttcgtccacatctacaacctgcagaaatccccagtggattagctcctttatatagcgctcaccaatttcctccacttgcaatgatccctggttctcgatgaaaccctctgcagcccataaccggacaagactctcaggcaacaggagaaaaccagccggaaaagtactacaatacaaaaggcagttcttgagatgcattggaaggttcttgtaactgagatatagtactttttgcacattgttcaggcttgacttgcttttttgaatatcttcaatttgttgagccatttcactccagactgactctgttttttgctttgagctgagcaatgctccaatagaaacaattgcttggggaagaaaattgcacaagccaataatcttcaaagttacttcacggagttctatagggcagtcacttggtcttccaaaagcctttgtacagaagatatcaaaactgtcattaggatgtaaacaagtaagcttcatgaattccttggggactctcgccgagggtcttacaggttccagcgaactagatggtgtttgggactgtgactccactgaagattcacttcttacaaaagcaacctctggcatccgagcgattatgattatccggctgcccattttattatcagaagctgcacggtgtaccttgtgaaccatgtctggcacccatacatcgtcaaatacaaacaggaacttgctatcctgattttccgtcattactctcagtgaggtactctcagtggaagtgccaacttgccttcctagttcttccatcatcattcttttcaaagcatcagtgtcagcattgggacattgagcaatggaaatccacgcagaagtactgaaatacttcttctcactagcataaacatccttaacaagatgggttttccctgacccaggctgaccatacactgcaatcacagaaagagctccatctttcgtcatatctttactctttagcgattcaatcagttcttcctttctttcggcatatcgcttagtatctatgttgttgacatgaggaccaaacattgatgatgaagaagctaatgaggtttccttgtccacttgaacccatcgttttttcattttggaaagatgctccagctccacctcaatttctttcagctgagcagtgaagcgatgtgaggccagtataacctgtactctcttggtaagtcgatattgtttgctctgtacaatatagacaatatattcgtccattatttgttcaacaaggcatcctagtttccgtgcttccccaatccaactttgaagtacttgcttgttatcatatcttgtttctatttgagccaggaagcaaaggatcatgcgaagttcactttctattcgcctcaatctaccttgaagttctgcttgcctaagaactaatatatcattactattaataatctcagatattactctggtaagagatctaattagaaaggatcctccttcaaggccatgttccaaagctgatcttccttcaaggtcatgttccaaagcagtagcacttctctctcgtcctagggcaattcctatttttctgagagctaggtatattgcagtttctgccatttgccttctatcccttaatcttttgacattaaatggttcgtgaaaccaaaaaggatgcttccactacagtttggagtacaatacactgagtgtcacatttcctccctccctttttatcctgcatgcaacacatagtttggggtacatgttcttttcagtttcaaaaaaagaagaaaaaaattcagtaggagataatctaaagtaatgaaagaaacaacctttcttgaaaggacattgggctacgcaatgtgaaaaacaatgaccataagatgaatgtttcgatgaaagatggacatctgatcattaacatacatgcggtaaaaaaaaaaatgcactagacacttccctcccgatccttcgagtgtctcccctcagacatgtggcaagcaagaaaaagattactccatgaaaaatagataatgggctattggtttgcatggcaattaattggcatactttaatgggctgcactaattaagatcaattttgagatgtcaaataagtaaaataaacatgaacggttgttgtgaagaaaaataggaatacatattacggtagtactgtatgtaacttacgggctacttcagttgtaacaatcaggaaaaaataccactataactacaaggaaaaaaaacaatcttaagatctttcaacaaagatggcatctcatagtcgcgcgaacacgcgactccgagaggctaatctctatgtgaaatctaaaagtaagttataaaacaattatcaactagccaacagaagggcagtctttttatgactgatacaatagacttacaaagaatgacatcagaattctcacttgggaaaaaaatgataaaagtacgctgtttaaaatgtggtagctattagatgatccatctattacattatagggatttgctattcataactcaactgaaatttttttgcaagaaaaatcagattcctaacctttggatccggcagagattcgtgctccggcgagattcttgactctggcggccgtgcaacaacggcaagagcgccggattaggtttcaggtggggttggggttagggaagggggattttggggagagggtggatccccgggtttagcgggaggccagcgaggcggctgaccggcggtgcgtggaggcgccgccggagccgcgggctggaagcaggcggtgggcggagtaggcagcgggggcaacgagaagtcgagtggttaggaggcggcggccggatccggcggcgctatgctgcggagacaggggagggtcggcggcgcggaggcatcttgccggaactgtaggagacgacgaccggcttcgagcgataagaaaatcaatagggaggacggaggaggtagccagtggcggcggcggcgtcttcgaggcagctgctgcggcgcgtgtggcgacttgctactcgcgagcgaacagacgagggtgacgagagtgttgcagttgcctaaatatgtactccgtcgtatttttacattttgcttacatggtttaatcatttatttattttattaaaaatatttagaattattatttatttttttattcacttttttatccaacgtactttaaacacaattttttgttttttgtgttttatatttgagcaaattttttaataagacgagtgtttgttttttaaattttatatttgaacaatttttttctagtaagacgagtggtcaaacggtgtaaataaaatattaaaaaaatctcttatattttggagtagagagagtatgtactacctccctatcagaatataataatatgggatgggatgagactcatctcagaataatttatctggatatgtttagaataggcctcattttatcctacgtggttatattttgggacggagggagtaagctcgtttttcttgctgcttcttttagtgtgctctaactgctctctctttttcgtcgtcgtgacttttttaagtcaattagtttataggaaaatataggccgagtatatttccaatttttttaaaaaaaactttctacttttttatcacatcaaaactttcctacacacgtaaacgtctaacttttccatcacatcgttccaattttaactaaactttcaatttttgcgtaaactaaacacacccatagtagcttttttaacacaaaacaaatatattatcaaaatatattcaatagcatattagatgttagtaaatttatttacaaatttaatcaaacctaacaaagtttaaatagaaaaaaattaaaataacttataatatgaaacataggaagtagcttatagtctatattgtacttgttgtaattatgcctcgttcttttcagcaaattcaacatgcaactttctttttttaagcacgcttctcaaactattaaatatttgagtagaatttttctacatagaagttccttaaaatcaaataaaacaatttttcaaatctttagtaattaatactcacttaatcatgtgttaataacatgtctcatttcgtaagaaaaaaactaacaggatcaaatttataatggaggtgactaatatttatgtagtctatcaataaattaagaggggtctcgtatgtataataggttgtttctaatacataaccgttaactgctctaacactttcatatttttattgaaacttacgtagagattttcctttgtatgaggggtgtttttttctcttctccatcttaccgttcaggccacgttctaaactctaactattcaacttcctcgttttccataagcgcggttctcagaacgttaaacggtgtatttttttgaaaagaatttatataaaagtttctttaaaatatcaaatgaatctaattttcaaatatttaataattaataattaattaatcatgtgttaattgtttgctctggtttccgtgccggttaaaatctcaattcctatgcagaaacgaacgaagcctagtcctaaatgatacttcctccgtcccaaaatataaacatttttaacacagtgacaagtcaaacatttttaactttgactattaatagcaaaaagataaaaaacatcaatcattttatcattaaacaaactatcataatatacaactttttatttaaaacatattactatatatatatatatatatattgtatattgtattgatcaaagtagtatatcggaaactatgtcagggtctaaaactgcttatattttaggatgaaagaagcatcccgtatcttgtgtttacatgtatcactttatccagcatccacctcatgaactgccaggggcggagccaccgcctggctagcccaggcagcctgcctgagctcgctggcaaaaacttcattaaattttaatattgttgaataaattaatgatgtaatttttattaaaaatgatagttatagtgaagtttgctcgggctaaaaaatatttctacttgcgccactgcgacgcggcaaatttactgtcgtcagcgctgtaagtctgtaacacaactaaccatgtgttctagtagttttgaagtttcaactccctcgttttccagaaatttcaaaatttgccatcgaatacgcacggttttcaggacatgccatctaattcgcactactttcagaatacatcattgggacgcgaatcttcttcattctacgccactccgtccgccgacgtcagtcctcctcgtcgtccgtccgtctgccgccacctgcgccccgtccatccgccggcgccgccgcgttcttgttcgtccgccggcgccacccacgcgccaccgccctcctcatgctcggcgtcctctgccactcgctgtcgctcatgcagtcatgctcaggtacgcgtcacctccggcgagcacgccatcgtctccggcgacgccgccctcgacctgtcgtgtgcctgcagcatcgtcatgctcatcgcctacctcttcttccaactcaagacgcatcgccagctgtttgagccccaacaggttcgtgattgatcgatccgatgcatgtcctgtacgttcgatccatccaaccaaatggtaatcaggttgaggatgatttagtgatcgctcaagatgatgagccagtactgggatgatgacgatgatgcgcgcgggggcatacgaattggatgccggtgtcgttgaggatgctgacaccggcggaggcgaagttggcgcagacaagcaggttctcgcctcggaggtcggggtcaggtaaggcagcgcgggcatgtgagtcaggaagtcgatcccgtacggcggcgccgctcgcatccgtccgccggcgccgcccgcgtccccgtccgcccgccccgccatcgcccactacccctcttcaccgaatctcgcgcgtctcgccgaggagcaccatcgcgcctccacggggaagatggctgtgtcggcctcctcgacctactcgacgacgacctccaccacgagctcctcaactagggcgattttgtccaggcggcgtgtcgggtgttcgctcgcagtggccgcgttgagcaggccgtcgccgcggcggcggatggacggggactgacgcagctgtcgtcagaggtgccggcggacggacggggacgtgggtgcgcggcgctggcggatggacaggaacgcggcggcaccggcggatggacggggacgcgggcggcggcaaacggacggacgacgacgaggaccgacgtcggcggacggagtggcgtagaatgaagaaaattcgcgtcccaatggcgtattctgaaagtattgcgaattagatggcatatcctaaaaaccgtgcgtattcgatggcaaattctgaaaattctcctcgttttctatcaagcttccaaaactgctaataaaacgttttgttttcaaaaacctttcatataggcctggtttaattccccaaatttttttccccaaaatatcacatcgaatatttggacacatacatatagggcaaaaaaatatagattaaaaaactaattacaacgttaggggagaaatcacgaaacaaatcttttaagtctaattagtccatgattaggctcaaaagattcgtctcgtcgtttccaagcgagttatgaaattggtttttccattcgtgtccgaaatactctttcaacattcggtcaaacatccgatgtgacactcaaaagttttctttttacgaactaaacagggccatagaaatttcttaaaaatcaaataaacatatttttcaaatagcatccctacaaacactcatagatcgtcacatggtgttctaataaatcttagaaattctaagaaaaatttaagacatttagccatcggttatcatttaatttggtggatccattgttttcaactattagacctattaaaaagttgtgaattcaatttatctctaaacaacaagtacggtatgtatgtcgtcgctgatgtgatgcacgcacttggtattggaataattaactatttaccactcttacaagtggtaattaaatatttgccattagactcacatatcataaaactgcgagtagcaaatttttaattaccacattttaaaagtggaaaaaagttaaattaatgaccacttggtatcgtccccgacacgagcgtaagccacccaagtgactcaaaactgcaagcctagtctaatttgcaaatggatggtaaagatacatgttgcaaactgaaaatatatgcttaggttgggaacccttctcttcgacatgcaaaacgaaactcgtattattacatgattaactgttttttaacaatggattaatataattttttaaaacaacttacatatagaaagttttttataaatcacacaatttagtagtttgaaaagcgtgtgcgcggaaaacgaaagaggtgggttgagaaaagggggaagaacacagccttagtcttggggtctgtttggttggggactaatattgccacacattttttactaaggtagctaagcttagtcttgccacacttttgtggcaaataaaatgacaaattaagcttaggcaatgtttggcaagaaaatatagtgtatgatatgtgggccaggtggctaagagttaggcaaaatagacttgtgacaagaaccaaacactatctattaaaactttggcttgcctaaggttaggtgtagtaaatttagttgccaaccaaacaggcccttagtcttagttcaatgtatcactttggtcactttaaatgctcaaaaagtgaatgttactctaaagagtcttaaaaaaaatttgtccccaaaggagggccgtgctggggccaccccgtgtcagagcaggtacaatagcgggctattagccagctataaacatattttaatgagataaaagatgagagagaagagcagcgggctacagatctgtagccaactacagcacagactccaagacgcaatgtgtatatgacaggtgggaccatatgttaatagtatagtaagcaactattgtatgaattggctattagatcggctatagataatttggagctagtagtgggctatactattaaacttgttctcacgggagcatgacctcgccaaaagcaacttgctagacgtgcctccacggcgtaagagcaggtacaatagcaggctattagccagctgtaaacatattttagtgagataaaagatgagagagatgcgcaacggactacaaatctgtagccagctgcagcgcggactccaaaacgcaatatgtgtatgacaggtggggaaccatatattaatagtatagtaagcaactattatatgaattggctattagattaactataaatgaattagagctaatagtgggctatactattaaacttgctctaaggacatggccaacggtggccataccccatcttggaagtgggcccaaccacacgaggccctcaatcccctaagagcaggtacaatagcaggctataagccagctataaatacattttaagaagataaaagataagagagaaggacagcgagctatagatttgtagccagctatagtatggactccaaagtgcatatgtgtatgacagatgttatcagatattaactatgtagtatatgtttataggtaactattgtatgaattggctattaagttgactatagatgatttagagccggtggttggctacactattaaacttcactggtggagaaatgatctttgctgggtcgacccaaaaccacaataatcccagttccaaaaagaaccgggactaaaaatgatctttagtcccggttgaaaaccccagaggcattgtatgatctttagtcccggttagtaacaccaaccgggactaaaaattatctttagtcccggttcatcccctgtcagattgatgtcagggggccgagcatctttagttccggttggtaacaccaaccggaactaaagatcaccactttagttccggttgggaacaccaaccggacaaaagatcaaaccgatctttactcccggttgaaaacaccaaccggaactaaaattcgaagcgtggtatataatccatatcccttatcctctcctcaacagatcgaatctctcccttctttccctccctcctccgcttcctccatcctcatcccgatccatcccctccacctcctccccttcctcatccgaccccctccctttcctccacctcctcctctccccttcctgcccatcctccccttcccctccacctcatcccctcccctctcctctacctcctcatctcccctttcctgcccatccacctccccttcccatccggcagccggcggggccgtggccggcggcgggtcggggcagcggggccgcgccgggcggcggcaacggctttattttctcttttttttaatttgtgattcacatgtataattttatgatttattggatgaatctgagatgacctgtgatgtatttgatttgtgtgtaattttttaggatttgtgatgtatttgacctatgatgtatttgatttgtgtataattttttaggatttgtgatatatttgatttgtgtgtatatgtaaatttaagatttgtgatgttactttatttttgatgtggatttgggatgttactttcatttggggatatgcttctcacttgatttgggagaaaatagatatgcttcctacttgatttgggagaaaattaaaaaaaaaaagaaaaaggaccgtctggaattgccgctattctctctttactcccggttggtgttaccaaccgggactaaaaagagggatctttagtcccggttggtaaagatccatctttagtcccggtaaaaatagcgatctttagtcccggattcgtagtcccggttgaaaaaccgggactatagggggttatgattcgggagtaaaaagtacttctctaccagtgcttgctctaacggggaagtaccctcagatgagccatactcaatccaaaacttgcactcccgaacaagttgaaggaaccacagccatcaagtcgaaggcccgatctctccaatgcatgccttgacttaggctatgtgtagttccccaaaaaaaatttacaccatatcacagaatatttgaacatctacatgaagtattatataaagactaaaaaaattactaattatacagattataagatgaatgttttgagcctaattacttcataatttgacaatatggtgctacagtaaacatttgctaatgatagattaattatgcttaataaattcgtctcgcggtttattggcggattctgtaattaattttattattattatccgaacaacctatgtaacaccttatataatacccgatatgacatgctaacattttacatgcgtgaataaacacccccttacaccctcgcctcgaagcagctgtttcataggggtgagccgtgagcgattgttgcagaagaatcgcgccttcttgcatcttgcaaagtccgtccttgttcgctttttctgccggggttcgtatcctctgcctttgctacgtaatggcagggagtaacattctctctatcctagccctctatccaatatcaacggctgataatataggatgtactagttggcacaccacataatagtgattgtagttagcaaaacctcacgctggttggtttctatcctgggaaaaatattttatagataaaattttgatatggatgttcgtatagatttaaaatataaatgatgaaaaatataagtatagtaaaaaaaattaaaattagttgccagtcccatctttaagatacccaacccgtcgtatactgcaatattttacacttcatctttaggttgtgttcgtcccaggagattgagagaagatttatcttgtttttcgtatactttcgtatacttcatctttaggttatttatcttgtttattttttaagtttgaaatgattaatacccaattaattatatagtcataacttacctcattttgcgtattatctcaatattctcttttcccctctgattaaacactccctcagccttaagcttataagagtaagcgaaaatttaaattttaaatgctttacacttcatcgtttagtctacaccttatatgagtaggtgacattttaaattttttattatactttttttcatcatttatattttaaatcgttatgaatatctatataaaaaatttatctataaaatattttttccccggctagaaacctacaagcgtgaggttttgctaactgcaatcactattacgtggcataccaagtattacgtgagtatgttatcagccgttgatattggatagagggctagaatggagagaatgttactccctgccattatgtagcaatggcagaggatacgaacccggcctggagagggtacgtacgtgtggccaacattaactgatgtggtgttgcggctcccacatttcgagccgagactatatgcggtagttatgtaagtgggtagtctcgctatccgtatagtaacctacttgctagtttatttttcgtatgttagtacaaaacttaaaagaaaaaataataaaaaataaactagaagagagataagtgggaaaaaacccgcttacacgtcccgcttgcatgtctacttgcggcgttctgtgttgtgcatggtcttattttttctaatgcagtgaggagaaatatcatctactctaaaatataaagataaaaaaattatgttgtttagcaaataatatctcaggtcattacttttacttatttcagttatcaggttttaaactttgaatggcttagattctctttctaacttctaataattggctttcaaatcatggaaataatgggcatcatgtgaatcagtaaaaaaaatgcttatactattgtataaaattcaaatattgaaaatacttttattttaaaaggaaggaaaccgtctatcgagtacaatgagcatgggtagtagtgtatacccatacctaccagataattttatgtgcacagacatacccattgcacatgtgacgaccagagatgaccttgcccatgcccattagccgcaggcgtcacgtgccctagatctgcacatttacccattaattatacttacataacataaacaaagaaaaattatatagctaataaattcactcatgtattaactatataattgtgtttaagaggataggaggagaaaaggagaagaagatacgagaaacgagatgagcaactagctcataatatttgagtattgattatttcaaacttaaaaaacaaactaatataatttctaaaataactttcgtattttttctaaaaaacatatatagtttagcaattcgagcaatgtgctcacaaaaagacaaccttttctttttctgtcattcaaatgaccctaacaaactaaggctgtgttctccggcacgcaaaacgaagctcatattatcacatgattaattaagtatcaactaattttttttgaaaaatagattaatataattttttaaaacaactttcatatagaattttttttataaaacacaccatttagtagtttaaaaagcgtgcgtgtgaaaaatgaaagaggtgggttgggaaaatggaggaagaacgcagcctaagggtaagttgttctagtttaatagtagagctaactactactgcctctgttttcaaaataagtttatttttcattcatcttacacataccaatacaaatacaaaaatacctctactttatcagatactaatgcaactattactcactttatttacttccaacacaattattcgctactttcacaaactacgatacaatgattactttaaaatgaacttattttgagacaatgtaaggaactaaaaaataacttactatgggactagtgaagtagctattaaagcaagttttataatataaccaactactacctaaaaaaattaacatatcatctacacttgctaaggccattcccaactcaagatactatggcccgtttggcacagctctagctcccaactccaacttactagagccggagctgtgacaaatagtccagatcctccatttttgagagcggagttggcagagctgttccacaaaattgtactatgggggtggagctgggtttttctgctccacagctccactccaccccaaaagacacactaccctttaatttttttagtgtattttcaccaaaattccactgaactaccccttcctatccgatctcctcctgttctctctcctcctccgtcttcttggatagcccggcggccagcggcggcgtcgtcggcgtcggcagtggccggcggatggcgtggcgatgagggccacgggcggcggcggcggaggtaggcgcgcgggtggtggcgcggggtggcggtggcggcggcggccggcgagcagactgccagcagcggagcgggcggcgacgcgcgggcttagcagcggtagtggcggctgcgcacgggcggtggcgcgggttgacggcgcacggccggcgcgcgtgcggtggcggcggcggcccatgggatgagcggtggcagcgacgcctaccaggtgtttgacaaaatgccaacaagggacgtggtggagtagagctaaccaatctagccaaacactttctattccacttcagctcttataggaaccagctctaactggacttggagtttagagttgggagttggagtttggagccctaccaaacggggtctacacatagtttctataaactttacatcatcaagaaactaatagtagacactactctttcaatgcaaacaccacttttccatatttaaatttaatgctacttatcttacatgatgtcttggatgttgtgtagaaaccatgtctcatgcaagacctggtttccttctctttcctcatttattctcttgccacatcatctttcattctaagtgttatgtataccatcctagtaattgggtcgggaatggtctaactaaatagtccatcatacaatagttaactatcgatacatattacactattaatgcataccttacatttctctctcacataggttatcggatctcgtgctgtaacttgctacaaatatgtaccccctatttcctctctcatctcttttttccttcacgtacgcacaaatataacgtgacaacctatatagtccgcttccatcattttattatgtccattttctcctcctctctttttctcttaccatgaatcaaatacatatatattataaaaatgtgtagagttaactttgcacgagagtgaacactttacagatgtctattattattctagtcatttgcttaatgcagtcatacgtaagtttgtggagaagaaaagcacctcaacattattttgtccagatttattgtactaggaggtcgtattctcttaggttggcttttttttaatggatggagtaggttagatggttggaaccctggaaagctcctcgataccagtgatgtcacatggaacctcatgttggagtagatctgctttatagggagagatgcttcacatagggagagataatagtccggtgggttaggatgaaatagttttttactaccgtcctactatttcctccaacttaaaatataaaaagctaaaattagatcagatattctttttagtattataaatctagaaagattgtctgtcagtccaaattcgtactactgaaaatctgtccagattcgtagtactagaaaaatgtcatatcttataatacgaattcaatgccaaaaatcagaaggagaatggtgccacgtggcaacaccggttttgcaggctcgacgaaacgtgcgtccgcgcgtgcagggatcgatgaaatgctcttgcctgcgtgcgtgcgtgtgcaccggtcgtccagaaatttctccccaatccggcgcctttacgtggatgagacgagatactatgcatacagtgcaaacacgttaatttctcacattcccaccgtagggctggcaaagctcagtcaggcaggccgctatttcttgtggatcaaagaagtaataatacctactttagttagagattaaaatagggttagcaggatataattaaatcatccactaaaaattcctacgttccaaagatccatctttttaagttttctatggtttttattcatctgttttacacacgtatttatgtgttttatattccaaatattttctttcgtgtattttgtttttctgagttccaaacataccttagcctatgtttaagaggagagaaagatattaaggagataagtaaaactaggtgagccattatcgcataattaattgactaataattattttaaacatgaaaaatatagaaatatgattttttttataaaagggtaacttttctaaagattttttaatgtaaaaacacgccgacatgtgggtgaaaaatgatggacgtttcctttatttgtccctttgtcgaatgcaaccttagaacaagtacaatataaagcaataagctagctattgaacaaagaaggagagagaagaaaagtggactacatataaatatttaggtgcagtatgagctccaagatagtatgtgagaagtaaccacccctcatgcaagtggtaatttcttcacaaactctaagaaaagaatggtgtggtttggatgcaaattgaaaccaatatgctacatcttaattaattagttgatgatgtgaataaatttgaggtcgtaatcacccctgctataaaacttgcttataaaatttgctcttagagcaaagataatagactaatagtgggctataaacttatgtggagaatagagatttaaaaaaaacagtgttggctttcaagtaaaatctagctctacacatgcttcaaggtaaagaaatagagagacaatcttatagtcaacttataagctctaatataagcagctttagttatctctactattaatctctggctcttttatatatgtgtattaatttgttacaggcccaattggccaggctcagtataccatgcgtggcaaagccgcgcgctttttctagtccaatcttaagtttttatattttgggaaaaatgtactatatgaaataagaatggtctaaatatcttttatttaatggggtggactaaaagcataagtaggaaaaagattgaaagaaattctgaatggtgaatgattgtggagagaataataatactagtagtctacaaaatgtaattattctcagataagtttgagtgctaaataatacttatagtgagatgaaggtagtattaacgtggactcatgtttagagctctttaaatctaggattttatttatttattgagtggttgcacgtaggatacgaattattaaatttcaatcatatttttcatcaatccagtggttctcagtactcctatttttatttcttattatgggaattgctaactgtctgttgttgacagaaaattgatggttaaatcttgcacttgttaaaccgttggatgtgttcgggatcgtgctagccgttcgatacaccgtgatttctgagaaaaagagaaaagcaacgcacaaggagggatcgatcctgtgatctcatcctatttatacaagttacagtatatgctaggtacatatgtaattataatacaattatacaattatagtgtaattatgaaaattatattgtaattgtattgcagtaacatttgatagatttttaggatacttttcagtcccttttcttatataaaaggttgacagatattacaagaaataaacttactatttatacattacaaaattatatgaaaaaaatattcaaaccatgataaaaataaagaaaaaaggtatataccaacaaaattacatgtaaaataccacttcaattttaggtatatgaatatgcaatcttatgtgaataaaaatttacaaactttcgagcacataaagatttagcattgccccgagaagaaaagcacctctattcatgtgcagtcatatgggagctcgtgatcacatcgatacatgagctcgtgatcacatcgatacatgtgctgtgacatgtaagctcttgatctctgctttgcacaaaagggagaatattgtactattggttgatattgtacttctattcatgtgcagtcatgtgggagctcgtgatcacatcgatacatgtgctgtgacatgtgatctcttgacctgctttgcacgaaagggagtatattgtactatttgttgatattgtacctctattcatgtgcagtcacgtgggagctcgtgatcacatcgatatatgtgctgtgacatgtgagctcttgacgtactttgcacggaagggagaatattgtactattggtttatattccatgctttgatggggaatgcatgagagcaagtataatagagggctataagagcaagtgccacattggattgagtaataagatggaggagagaagtgaggagagagatgatgaaccatccctaagtcaagaatcaacctccacacaaatttcaagaagagtgtgagagtattagtgacattgatatttatgtactagaggtgacatattgtatgtgttgcctcttaatttacgagtgaatgatatggataaatttggatatggtaatcacatttaccataacacttgccctaagaaggctgaatactgaggtgtaggctgaatactggctcggctcggcttgcagtggctcacaacaagctaggcttggcttggctcggctcagttagggaaacaagctaaaacttgagctcggctcgtttcctagctcgagccagctggagctggcttgcaagccttcctgttaaaacatctcttcatatatattttgtaattattaacaaaaaagcaagagcaaatcatcgacatgtaaaattaaataagtttatatattcaattcttcaaaatcttaatgataaatttaaagttgataaataataactccatgaaaagcaaaataatcgatataaacacatgatggtctaggttcgcgagccaaaataagcggctcgcgagccagctcgggctcggctcatttcaacaacgagctaaataagaggcttggacttggctcgtctggcttacgagccgagccaagccaaccaagctcgagccaagcccaagctgagctcatgaatccgagcttttttttccacccctattgaggtggccgaaatctgtgagacagacaggtggaccatatatttatactgaaaagttaaccactatatgagtaagcttagagataggctataaaaatctatacagtaagcagttggctgtattattggccttgctctgaataaacataggttagggcaagtactataagcctctacatgttgctcctaaagatgtcacataggattaggtgatgatatgaaggagagaagttagaagagagagaatgtgccagcctcatacaagaggcaacctccacacaatctttaagaaaatataagacgatgtgagaattaataaaccaatattgaagtttgtgtattagatgtgatatgttgtatttgttacctattaattaatagaacttgcccttaagtagtagtgctactatcaaaatgatagaaacatgcatgttaaaaatattgtacaaatgatgtgcagttgttgacgtaaaatctaaaagaacagacggaagcgtgtgagttctgcttagctttagtataggtcctatggatttcagaatgtgttagttagtttgatcatacaactaacaagataaaatacagatagattagattaaaatgacccgttggctatttcggtctatatggaattgtgggcctaaccgaaaccaataagattcaggtcaacggctatataactgatagagtttgttattcatactatatattttcctcatttctcttactcgttcaaaaatcgtacacacaactaaagaaaattttaatcatatatacaatttttcacacggttttatatattaataaaatttatgcatgtcttatgtataatgaaacataatactaaaaccattttatatttctactacattcatactataatatttcttgagtcctaacatacatagtacctaaaaattctaaacttctcacataactaaactatttatatgtaatatatgcacactacattaattattacttatccaacacttaatattttcatctaatacataaatcatcgctaaatctatacttcataataattaaagtactaaaatttacctctattttcttcgacttatatccctcttggcttggaccattacctcttcatttcttctctcttcctcaagctcttctcttctcttttttatggcatgagcacctcgtctggtgcaaactctcttctccttatatggcgtgaggtgagcaagaaagaggaacgaaaagagtgacgttttcaccgtgcttgattgctcaaagtttgagagcattgtattgacagcgcggattcctactctgtgcagcgcaactgtgctgcggtacgggcctagctcaattcaagagtattcagatgaatacccaagatttttagataaaaaatacaatatgaggtatatatttcgtatctgttttagatgaaactatcatcagaatggccagttttcagttagatcaatgtacttagctttaattaacaatggttacattgacagaaataagttaatttggaaacttaagatgccgcttaagatcaagatctttatgtggtatttgcttaagggagttgtgttaaccaaggataatttagcaagacgaaatttgaatggtaatttaagatgttgcttttgtacgaaaaatgagtatatccaacatttgttcattgaatgtcattttgcaaagtttatttggagagcagttcagttttcttttggtttatatattcctactagcatatctcatatttttgatgatcggctttagggagttgtaaacaaaaagagtaaactgatacttgttggagcttctgtcttgtgttgggctttgtggttgagtagaaatgatagggtttttgacaaatcacctacaattacttatatgcaggttattttcaaggcaatatattggcttcgtctgtgggcacagttacaaaagtatgatgaagatgaagaattcctaattgttgtgtgtcgtatgcttgaaacgacggttatacaactgtttgtcaatcatggatggagatttaccaatacactgaaataatgttattttatctttattggtttccttttaattttaattttggttggtgtgtttgctttcatttggactgcactcttacagagtgctagtttgtaataattggctgtaactcttttgagtaaaggtcgggatgttatttcattccattattaaaaaaatatattttgtatctgtgcagagaaataaagaaaataaatactattgatcaaaagaagcctaacaagaaagcctagcacactggctccctcatcccacctgtcttatcttctcattatgtaggcccaatagcccaaaagaaggggcaaagtcaacctagaccaccactggtcgctgttggttgttccaacttccaagtcgcaacatgtccctccgtcttgctcatcaacgcaacgccgcgctgccgtcgtgcacgcgcagatgtggagtagcccgcggcgtgccgacgcctatcgaggcctcaccctcaacaggtcgcggacgcccttccctcgctcggtcaaaccctctctctctctctctcgtcatatggcccgccccacgcctccggcaccgttggtcgcgctgccgcggccgcttccgcacaacgcgcggtgcaccactgcaccccctactgcccctaccaaatcgcctcgccgaacagttccgattcgattcaataggtaacccgttcaatctacattctcccaatgtgtttaatgtgaatatctgaacccaatttattttttagattgtactacatatgttttttcataaagtatatcccaataaatcaagaaaattgctgaaaatcttgacgcaagttctaattcaataagcagtactaaaatatcatactgttgatcatacataccaaatattatgcttgtgttgtaaaacttttttttttacccctttccatttcgaatacctaatttcaaaatcctaggtccgcccctggcggtaccgcatggatgccacgggaccgacatggtcccgccctccaccacgttgccgcacacccaggccgcagcattgacgcggtgccgcaattctggcctacgggaccaaagcggtgccgcacgctcatcttacgtgaacgacccagccgactgtctcgcgtggctacgccgcaattacgtagcgctcccgcgtgcccatcatgccgtaaagagatatatttgtgcaaatctttcccatacatatatataaatgcaaaatcttaaaaaaagttatattttcaatctattatattattaaacagctttaaaatgaggcaccacgttcgctgtgggggactaaaatttcccatattaaccagagaaaaagaaaatgagagttcaagtaaaaatacaatttaaaaatagctgaaattcagaattaaaaataagcaatattgagagaagagtcaatataaaaacccgatacgagattaatcaaaatttagaataaaaataaaataaaatccaaaattagaaaagaaaaggagagtccatgtaggaatacaatttaaaaataactgaaattcggaattaaaaatcaggaatattaagagaagagtcgatataagaacctaatacgagattaattaatattcagaatctctatctctatctctactacttaaaataagaggttcttccgtcgtccgtaaaaaaaaaggggcgaaaaaaatcagtctaatccaaaacaaaaataagaggtgcttccgtcgtccgtaaaaaaacgggcgaaaaaaatctgtctgatccaaaacaaaacgggcgaaaaaaacggacgaaaaaaaccgggtgaaaaaaaaagaaaaaccaaatctgtccgatcaaaaaagggaaaaaaaaggaaaagaaaaacgaacccgattccaaggtaaaaaaagggcgaaaagaaataaaaaaggaatctgtccaattcctaaaaaagggcgaaaaaaaccaggtgaaaaaaagaccagcaaaaaaaaatgaatctgcgtggacgcggtaaaaaaagagcgaaagaaataaaaaacaaatatgtctgattccaaaaaaaaaaagaattatatgtgacgcggtaaaaaaaattgaatcctattatatttgacacggtactatatatctctatcttatctatatctactacttaaaaatttaaaatgtttctgttgtccgtaataatgaaaaaagggcgaaaaaacattagaacaaataaaagaaagttcgattcaatttacttccgtcgtccgtgaaaatcttatcttatcttaatctcaatctttccgaggggacgagcggtgccctccgtcctcacccgcgggatgaaacgccagccaaagcaaaaaaaaaacgaaattgagcaaagggataaactagattgaagtttccaaaattaaaagagggtaaacgatattgaaactcccctaactcgtaaagagggaataaaatagattgaaatttcccgacaaaattctctaaattcgaagaactctaatttcgggtaagaaccataagagtcaaatccaaatcaattaagttaagggttcgggttacttaccggatttgaagccccagagctcaccggagctttccaggaagcggcaccgccgcaccttcacctcctcgcagtcgtgtcgggttccctgcgcgcacgctgtcctggagcacccctccaccatcctttgctgaagacgggaagcgtcagcttggcgtcacccctaccgtcgacgaggtccaggctgctcggtgctcgtcgccgtttgcacgcccacctagccggaccgccgacgtcgtggcacggttttgcgtcccccagccggcgaagcaggagccgctcggcggtcgtcgctgcacgcgcgcaccagcttgccggaccaccgtcattccactcgctcgtcgccggagagaaatgggatcatgagagggatttgggagctagggttttgcccctctccccggtcggtgcttcattcggcgcggggacgattggagccgtccattagatcggacggcttagattcgcccagcgtcgggccgtcgccgccattgattatgctacgcccaatgggccgcggaagtgcatcggaccgtccccgcatatgtaggtcgcgcttagctgctcagcttgtgggccgtcgaattgactcaactcgccaaagatgggcaagcccaagtttgggccggcttgggaaggcttgggccgaaagcaaatttgatcaaacaatgtggctcacatttttcaaattaaagtccgtcggataaactgctaagtaggctcaaaaaataaatctaaaactaaatcctaaatcctatgctaattgatcaaattagactcggttctacctatttgttaatatatcaaattatacttgatttttacagatttgaggttttcaaggtgtcacaccatcaaacggtgtttttcccgttgcaacacacgggcactattgctagtaaaaataaaaataaaatccaaaattagcaacaaaaaaaaaagaagagttcaagtaggaatacaatttaaaattaaccgaaattcggaattaaaaataagcaatattgaaagaagaatccatataagaacccaacacaagattaattaaaattcagaatgaaaaataaaataatatccaaaattagaaaaactaaaagagagttcaagtaggaatacaatttttaaacaacttaaattcaaaaataaaaaaaataaattatgaaattagaaaaataaaaaagatttcaattaggaatacaataaataactaaaaattggtgataaaaaataaagactattgaaaaaaaaagatcatctaaaacacatgacgagataaattaagtaacaggtctataaagaagtagagtggtggcggttgatacgacatacaaaaactattaataaaacacaaaatagaatcctaatgacgattaaaaggaggaacgacaggcagaccgtgaagctaacgggcaaggcggttgctgggacttctagaaattaaaaataaataaatcccattgataataatattcgatatttaaaatctcaatggcaatcaaaaggagaagcagcagacggggtgtataggagtgtagttgcagagccgctgacggttggcgagacttctagaaaataaaaaataaaaaatgaattctaatgataattatgttcgacttttagaatcccaatgacaataaagagtaggcggcggatgggtcgtggaggagtatagtggcatcgtttgacgggacttataaaaattataaaaaataaaacccaacaagacaataaactctaaaaactataaggaccaatttttaaaggttcggaactttcaaaaaataaaaaaacccaatgataatcatgttcgattttaaaatcttggtgacaataaagaaggaaggcagcaggtgagccacaaaggagtacaatggcaaagccgctgacggtttggcgggacttctataaagtaaaaaatgaacccgaacgataattatgttttatttttaaaatcccaatgacaataaagagaaaagacagtggacgggccatagaggagtataatggcagcgtttgacgggacttctagaaattataaaaatgaaacccaacaaaacattaaactctaaaaactacaaaattcaatttttaaaggtttcagggagaataaatagaaatagtggtagattgagcaagcaaataaagaagcatatgacagaagtaaagggtagcaactggtgtgacttttaaaaactatataattagaaatatagggatgataagatttggattttcaaaatcttaagacaacgacatagatatttaataaattttaagtaaaatcatactaaaaaaatatatgattttgtttgggtgctagccgcagaattgcgcggaccacccagctagttttttaaaagtcaccttgcatggcttaacttacacaccggcagttctctctaaaaaaacacaccggcttaactatgtttttgcttttatccctcttccacaatttcaggacaaacatcaggcgcagttggttcttcagactgtgcagaagcagcattactggtttcagcatccttcgtccatactttattgttgtctagcggccaattagctactcctgagcagtgctgagcttcgacaaactccagcattggatacagttcacgcaattcctcccaacaaaactgcagatccttgaggcatctcaagcgcagcacctctactttgcactccccattctgaatttccagactatgcaacttcccaccagtaaaatacagtttctttaaactgtcagaactaatcgtcccaaattgtctcgacgggaagcagtagagatccagctttgaaagattagagggaagaacaaggttaaattttgcagcatctgattcgtcggcagcatctcgtggagataccattccccatgtaatcttcagtgatgcgagactggcaaaattggcaagcactttcagctcatcttctgcacgcttcagtttcttgctaacactgatgctaagtttgcgaaggttgctcaagcttaccaactcgcccagattgcaggtgtttcttttgttagagtttactaccaaaaaccctttgaggacttggagctgagacatcttgttgaatccctcgggcatatcaacgagcaggtagcactcggagacatccagatactggagcttctgcagcttggtgatctcctttgccagcacctgcagatcgtggcacgccctgagatccaacacgaccagctcggccagttctccaatggcagccgggatggccataattctcgatatgcctctcaagctgaggtacctcaggttcttgcacgccccgatccccttgaggtggtggtcgtcgatcagctcgatgtggctcttccttggataggcaatctggtcgactgggtcagccacccgccactgcccgagctgcaccgtgccgagttgcgatctgtaggtgaaccacgcggtgctcagcttgacatagctctggccaacgttgtagatcgtggagagctgcgggtggaacctggagccctggagcagcccgccatcgtgcaggcatgcgcggtgcgtcctagagaaatcgttgtttgaggcggaggcgccattgccatccggatcaatctccaagaacgcgctgctccttgcaacggccacgagcatcctgcggatccacgggtgcacggtgcacgcgtgggcggtgtcgcagtgcccccggcggcggactgtgcgcacgaaccgcaagtcgacgagctgctggaacaactcattgccgtcctccaaggatgacacgaacttttcgccgatccaccagtggatgaggagccgcttttttatgacggcgccctcggggaaggctgcaaggcagaggaggcaatgcctcaactgctcatccataccgtgcacggctcgccgcaggtgcgccatctgctcgccgtcacggacacatctccttatccctgccatcgtcggcgcagaagccgaatcctccacatcccttcctctgtccggagatggttcctcttgtatctttatcttataggatcctgagattgcctccctgatgatgccaatctgtactccgacaccggcgagcttcggctggagcgtggagatctcgccgccggcggcgagggaattgagtacgtcgtcgacgagctcctcgatggggtcgaagaggtggacgatgcgcctctcattctcgcccatcttgacaaagatagcttggagttctctcatcatgtcacggatgctgtcgagctgagcgaggtcggagctgctctcagcgccgcggaagctcttggcgtcgccgatgacctgcaggctggagaggagaggggtgaggatgccgtcgtcgatgtacttggagaagaggatgcatccaccttcaccttcagcttcagcttcaggagtggacatggtggatgcctctacaactactctacttgtgttgctcttctctttcctcgtaccattaccagagtactagactttccccgatcggtagagatctccgggaggggtaagattgtaatttgcacaaaaaaactagaaaccctaacaatgcgtcgtgcttaattgggccgcggctattgggccgacagtcgtgggagactgcgagtggagggaggccctggcgcgggaaaagtacacgcaaggtccctcaacttgttagccagatacaaaatcgttcctcaaccgcaaaactggacatccggcgtcccccaacttacaaaaccggtcacaataggtcccttggcggttttgaccccggttttatcccacgtggtggctgactcagcgtgggatccacgtggccccacatgtcagtaagccatgtcatcacctctctctatctttcctctccctctctctctctcacttatctcctctcggcaggctgggcgggccgggcggtgggtggggaggtccccggggtgaggcgggagaggaggtccgacgaccgccgaccggcgacgcggcggcggcgacacgggagaaggggagggcggcggcaacccagcgtggtcgtggcgcccaacagacaggcacgggacgggcggcggtaaggacggtggcggcgcgtggttgtagacgaagccgaggaagacggtgtcgacgtctcccccagcctcagccaccaggaaaggagctgggcgcgggtggcagccgtcgagggcgtcgcggcttcggtcctcgagcgccgtcatggcgtcgccgtcgtcgctgcgttcctcccgcctcgccaccaccgccaagccgacgccgacgcgttcctcctgcctcgtcgccaccgcctagctgacgagctcgctagcctccccgcgcctccgccggccgcgcgtgtggctccagctcggccgccgcggtcacccgccgcttctcgtcggtgagcacggaaaggaagctgatgccgccgccttgctcccctgagccaacgccgacgcattcgtcacgcctcgacgccgacgccggcctccccatgcctccccgccgtcgtcaccgcgttcctcccgcctcgccgccggatttggacttgggaggagctcaccggcctccccgcgccaccgccgattccgcctccgccggccgcgcgtgtggctccagctccgccgccgctcctcctctccgccgcgccgaccctcttccccaccgcgtcggtgacgtcgccgccgccgccgccgcaccggctctcctctccgcatcagctatgatggccgcagccgcgtgccaccatagctgaccgcacgagggggacggggaggccggcgagctcgcaccggcctgagctcgcgcgccgccacccgagagccgttgtcgccggccgcaccacccttcggccgcacgctgcctcctgtgcgagagcagagagcgagaggaaaggagagaaatagagaaagagagaaagagtgctgacgtggcttactgacatgtggggtccacgtgggtctcacgctgagtcagccgccacgtgggacaaaaccagggtgaaaaccaccgagggacctattatgaccggttttgtaagttgggggacgccggatgtccggttttgcggttgagggacgattttgtatctggctaacaagttgagggaccttgcgtgtacttttcccccctggcgcggtcgggtcgccgtcgccgtgttcggcgggtgaagtgtcggccgcggctgcaggcagagggaggcgctggcaccgccgccgtcgagcaagtagaggcctaaatttcatgggccctagcccgtcgcccctctcgtttcggcccaggaacgaccctgatgctctgccatctcatctaatagtttaggacaggaggtatcgaaaacaacaaattaaatgcaaaaccgggcaaatacattttctcagtttgcaactttgcatacaaccaactaatttttgacggacaggtggattgagggtcgctcggtgggctcctcctcttgcagtgcttccttatcttcgggctttgggtacggtcgcctctatcctcgtgggcaactcctaggtaggggacatccgtgacgctctcaccgtaccagtcatctcccaattcctgatgctctaggatgcagtgctccctatccagctctcgccaggcatgacggatcgtcttgtttggcgttggatcagtgaccagcgttattcggcccgctcagcctaccaggttttcttccttgggcaacactccttagcttgcgtcgatgtgctctggcatgcaaaaggccctgctaaatgcaagctcttcctctggttggcgtttcagtagcgttgctggatggctgaccttctgcaaaagctaggtatcgatagtcatttggtctgccccgtctacgctcaagatcctgagacagcgaaccacattatccttgattgtgtgttcgctcagtaggtctagcatcttgtgttgtctattcctggttaggctaccccacttcgtcccgtggtgactcgctccaagcttggtagccgacctctagggcctgtctgcctgagtatcttcaagtgagcttcgactccgtagttcttctggtctcttggcagttgtgaaaagagtggaattctagggttttcaactcctttctcagtctctgtggttctcgagtccatcctccaggaagaccgtctgtggtcttctgctagcaccgcggcctttggggacttgttgggagcgtagtggggctctgccaccaccctccctctctataggagcaacgtttctctagtagtagtttcctgtctttagcaatccttttgtattttctcttttttccttgtcctctggcaatggacatccagccgattgcgttgtgtaacgaaaactttgctttcttctaatatattgaaaaaaattaaaaaaaaagctgatggaaaatatgatccctgcctccctgggatttgccatattacaatcaaggttcatacagtaaagataaaccatcctaactcacaattctaagctctaaacatcaacataatagagtactgcacatcatctagacagaatttatgtagtagccgccatgcaattccactccagttcaaagacatttgcagggcattctctagcatcaagtccagcagtgttctccccgcaaaaaaaaaaaaaaaaaaaaaaagtccagcagtgttctgtcctgtgtggcaagttttccactgcacaagcaagtgagcaaccactgttgccaacgcaaagtatccctgtctgtttccccagaacatagaccgtctggttcaggagttggcggccggcgggagtcgacgagggcggcgaagagttgccggcggtcggccaccgtcgcctcctctggagcggcggtcgtctggagttaacaaagtcggctggaggctgctgttcggcgcccgtagccggccacggcgacggcgaggtgaggcgcgctgctctgcacgagctgcctccgagcgacagatctcgatcctccctagtgtggatctaggggcaaaaacgtccacaaacttatcagagaaaaggaggggaaagtgcatttcgcagctctggcggcatagttgagcacttgagtggtaaaattgagctagctctttctcctcctcctcctcttcctcttcttattcttgttttctgatgttcttttcatttcctgattattaccttctcgagttcccaccagatcggacggagtggcggcgttgtacctgtcgtagagaagaagcgaacggtgggcggccgcaggatgtcggagctggaggtgtatagcttgctgcagaagatggcggcgatgagggacggcggcgactggccggccggtgcggagttggagttgcaggagttgtacaccgtcctcgagaaggtgcagcgcaagatggctcacgcggagccgctggtcgtcgtcgacagcggcaactccgcccgcgccgcctactccctcttcctcgcagaccttcgccgcgtcacgttcaccgtcgaccaagccctcgatagctactccgccagcgcccgccgctccccgttcatgcaccgcgtgcgttcggtggctctgatggggatggcggcatatggtgttttcgcgtttctctcggcccgttcgtcttccctgctgcaggaaaagcttttgccgcagccgctagagctgcgccccaagatcgccagaaagttggaagaggccgtgaaggacgtgaggatgcttctccgcctcttcagtacctacgtcgccgatctcctgccgccgccggagcaccagcagccagagcctggtctcggcgctgaccccgacgatacgtggtctcttgccgatcaaaaagaagccaacctccttgtcaaaggaagagaacaggacagatgtaaggtacggcagatcctcgaacatcctggaacgaaagtggtcgtaattgtaggaatggccggggccgggaagacgaagctcaccaggcatctgctgtgcgaaatgtgtagtgctactacgcatggcttcaactactctctttgggttacagtgtcccaagatttcaatccagaatggatttatcggcaggtgatgtctaagctgagcgatcaattgaaggcaggcgaagatgctgaaagcttctggtggtctctaaattcagatctaaatgaaggcttgatcaataagaagcatttgcttgtgctcgatggcgtctggaacgaagaccctcgtaagtggaaggaactgatggatctcctctacggcaattgcacgcaaaagaccaaaatcatcgtcactaccaggattcctgcggcggctgctgctataagctctgcagtaatctaccacctgcacccgttctcggtggagcataccttggagatgctccaaacgatcaatggggagctgcctgagaagttgctcggcggtggcagtagcaacgctaccgtgtctactgctgcggctaaagaattgagtaagaggaaggtcgcagagaaatgcagcggtttgcccaccatcataaagttcttgagctcttctcttgaatctatctgtgcaaacgaggttgctgatccactaaaacagtttgatatgatgtgtgctggcaaccaaggactgctgcacatcgctgaggccagctataaccatcttccaccacatctgaagcggtgcttcctctactgctccttgttcccatatcatcacatctttgatactgacgagatgattagcctgatggttgctgaaggtttaacacagactacaagcagggaagcccaagtggatggtgatatcagcaggcttcagagtgaatgctttgatcttgtcaataatcctgggtctaatgggggaatcagaagaggatgcatgatgcatcgagtattgcacatccttgcacggcacaaagggcaagaactatataaagctattgtgggtgatcattctgctgctttgaaagaacattccaatatcagatatatgtctctcacagttgatcatacaactacggagctcccagggtcgctgactgcgcacacagatttgaggacgctgatcctactcagaacgcagaagatggtcttgtctggtcagaagtctgaaatcaaagagatcccttctgattactgccgctatctcacatacttgcgtgtattggacctgcaggcaaccaagatcaataagttgcctgagaaagtcgaaatgctctcaaatctgaggtatctgaacctttcccaaaccgatattgacaaactgcctgaatcaattggcagacttcagtacctggtatccctcaacatttctcaaacatgcattgcgacagttccagattatattggcaaaattcactctttgaggtacctcaatctttctcaaactgatattggaaaactgcctgattcaatttgttcgctccgactgttgcaaaccttgcagctatcacgctgtgaaaagcttaccaaactaccacaaaatataggatccgtgacaagtttacaaaggttagacctagaaggttgctactatctatccgagatgcctcaggatataagcaacttgaaaaatgtgaaggagctaaatgtactggaatgtccctcactggataaaatgccttgtgggctgagtgcactaaccaagattgaagcattgccaaggtacattgcaaccagtggtgacaacaatcccatattggagctgcgggatttggtaaaattgaaaagactgggtttggaaaacattgcaaatatttccaatgaggatgccgagaaaatacaactgcaaaagaaacatgagctcgagcatttgacacttaattgcaatatggatgctgaaaacagaaaatcaagttctgaagtgaaggagctactggactgtctagagcccaacccagggttgaaaatactggagatcatttcttatgcaggggaaacgttcccgtgctggatggccaacacaaatccacaacttaagaagctcactcagatcagaatcatcagattgattaatctgaagtgcagcagtctcccgccgcttgggcagctacatcaacttgagactctagagatcagtggaatgaatgccataaaaaatgtcagcagtgagctacacggtgaactgaatgctgatacattccgttctctaaagaagatcgtcttttctcatatggttaacctacaatgttggccggtggaaaatggtgctatatgtgaacatcttaaagagttgtcaattatccaatgcccaaaatttcacaagctgtcgatgaatcttaatattgaaaagctgactctattgatgagtcctcacgaattgcttggcagagaaggattggcaggtgttgctaggagtctaaaaagcctatctatttcactgtgtgaagagctatcagcatcatcaaattgtgagggtctaacgatgctttctaaccttgaggagttaaagatttctggatgtgatgaactggagaacttaccgccgggtatggaaaatcttactgcactcaaaagattgtcagttattggatgccagaagttccaaaatttaacggacttactggaatgcactgctctgagctccctggtcatatcagattgtccaatgctaccatccgtcccacagggtttgagagggatcacaacttgcgagtaaactaacagcggtatagttcaaaaacagatagaagaactctagcacaaatatatcaagtatgtgaatgaccaagcttttgcgtcattttttctcataatcctatccacatacagtttcaatttttagatttatttatagatgccaaaaatgtttctgatcggtatctccaatgtattttatataagtttcacggctatcaagatacactatccttgttactttgcctttattacttacatcgatgatacactagcaggtggattttcattaaattttattgaatagtcatctcgttctcttaagattttaaaagatagaaccattgtcacaccccaatccggcaccgccatacaacagcacctgatagaagcgtgtcgtagcaaaaacggcgcaaaccacttcctacaaaaccacgatatcggtactagtcccagaacatagcgctggtatctacggtgacaattatgaatcattacaatcttgaatttaaatagaggacttatttaccttaacttaggctgcagctctcaggggaacccgataatgcaacagacgacgcggaagcagcaacaacaggagcaaaggcagtggaaaccaatgaatgaatacccaataccacaggcaatagcttggaactaggacgaaaccctaatctttacttcacttcaacttcaccttcaaagttggtagaactatatatagagagagcaaggttacttacgtacacagcaagtcagggaaacttaggtggttattgcaagcttcaaggggaccgttatttttgcaatcgattttgttttccagttttcaacaatctaagtatgtgctttccacaaccagcgtgagacaagtctcagctcggtcgggagtgagaagtaaaccaatttatttgcaagatttgcacacctcccagagttggcctaagctggtttcccaaaccaaaccaattttccaatctttcagagtttggttgcctccaaacaaccagatacttccagggattccctgtcccaatgtctccctaacagccacttgctttttgaaacatcaggtttcccaaacggcaacaccatttcataaaacagggtaaagcaaaaactacgctaagaatcacctcacatccgcccattaccgtgggcaaagctgttcgaatagttcgttaatctctgcaaaggggtacactttacccacatgacattactaacctaggtcacctagcccgtgcagaataaccacgtctggtgactttaaggttttcacgacaagacatttccaaagccggcacagggtcaccatatgccaacgagaggggtctcagaccaacagcaggttaggtcccagaccatgctgtgccaggaagcctaggggttctccctgacaccaccccgacgaatccacttgtcccttggcatcaaggtttccctggcctagctagttactcagccaggggtgttccatttcacctatatggtcgcacttgttatatgctcggatgtaattccaaaggaatcaatccttcaaagcgaccgcacaagcatcccgcccaggaatggacttgtgtcgtgagttttatttttaaaactcattttctttcacaatgcaccgacccaggcttgggtttttccaatgtttttgtaaaccaagtttttagtcaaggcgtttctcagattttaagtttgagggcgaccgtcgatactcacacagagtgcacgaataccgaggcacaacacaggtggattcaaggaaacatgatatggcaattaacaagggagaatcaaatgcaacaagttaggtaggtccaccgattgcctcgcagatggggcaaatagctcaagtgcaatcctatcaatgcataaatattttgcaagcaatataattaagttcaaatataggctcaagatgtccaaggtggcttgccttgctcaaggtcttgagcttcacgaatcttcaagaaatccatgcttagaagtaaatccggtaactgcaactatacgcaaacaatcaaaacctaaacaagggacaaaaaaaaagatcatattaaaactaattactagtgccattaaatatgtcacaattttagagtattactggaagtggaacagagtcaaacggaattagggatcaacaaatataagttttggaaatttatctgattttctggacaaaggaaaaggacttgttgaatttttggtaacatgcagggccagcaaatgtggtgggaggagagagggacttcggtccacaggtggctggtgagggactggatatcgacttttgttgagcgggtcgagagataaagaatcggctcggcagctcacaaggctaggggtgtgagcaaggcggggaaactgttttaaacactccggtggacatacacctgtttattacatgttatctaaaaagttatgaaaagttttcaaaaattttgacataataggttaatatgtaatatatcacttcacaaacatgcaaattcaaattcaacttctacaagttgtaacaaaaataacaaatttgactgtgaatatacgtatgctagttagagtttaatttgttatttttgttacaatttgtagaagtcgaagttgaacttatatgtttgtgaagtgataatctatcttgtaaatttttttaaaaattatttgtaatcatttagttgacatgcaaaaaagggtggatgtccacccgagagattagaatccatcttcggtcttgggtcgcagtcagaacgatatcgcacacatggtctcggattcgcagtttctgggaaagcacaggaaccgttagcatccccgtgagcaaagagtttacgtacttgcacttcctctccttcctagttgttagggcatccacaatgtacttcaaaagtggtccataagcaatataatatttgattcagccacctagcaacattgtggaactagtccatagggaagaaataacaaaagctacccataagcatatgggctgcccatagagaataaaatatattatttgtctctatatcttctctcctactaatactatttactattcatatacattgtgaaggttacaatagttaaagttcatatatgtgggtcccatctttatagactacttttaccatatacattattgttgcccttattcctttttcatgtataatcgagataatatctatctatctattatattattaaaacaaccttaaaagagagcatcatgttcactgtgggggttaaaaattcccacattaatcaggaaaaaaaagaaaagaagagtccaaagagaaatacaatctaaaaatagctaaaatttaaaattaaaaataagcaatattgaaagaagagtccatataagaacacgatacgagattaatcaaaatttggaataaaaataaaaaaaatgattaatcaaaatttggaataaaaaaacaggggcaaaatcacaaaccctaattaaaaagcaggggtaaaatcacaattgaatcgtaaagaagggcagaaacacaattgccccaaaatgtttcaatagtttaaatcgggcgttgtttcaccttatataaaaacaatgtttcaacaaatagcaaaagaatgtttcatttcaccgcaacattaaatccatacatagcaaaacattgtgagtacactaggtgaaacattttgtggaacaaaaaatgaacgaattctcttaatagagggtttccaaaatatgtgggtgatttgttacaaaagaatgtttcaattcgctgcaacattagatctatacatagcgaaacattgtgagtacactaggtgaaacatttttgatggaacaaaaaatgaaacgaattcccttaatagagggtttccaaaatatgtgggtgatttgttgcaaaagaatgtttcaattcacttcaacattatatctatacatagtgaaacattgtgagtacactaggtgaaacatttttggtgaaataaaaaatgaaactaattcccttaacagaggtttccaaaatatgtgggtgattttttgcaaaagaatgtttcaattcactgcaacattagatctatacatagtgaaacattgtgagtacactaggtaaaatatttttcgtggaacaaaaaaaatgaaacgaatttcgttaatagagggtttccaaaatatgtgggtgatttgttgcaaaagaatgtttcaattcactgcaacattagatctatacaaagtgatacattgtgagtacactaggtgaaacattttttgtggaaaaaaaatgaaacgaattcccttaataaagggtttccaaaatatgtaggtgatttgttgcaatagagtatgtagtggagatacatggcaggagggaatagggacacctaataggcccacaggatcacgcgcgcgcgtgggggggggggggagcgcccgatcctgctccacccccaccggtcgcccgggtttaagcatttccacatattttcataagggatatacagttatatctattatctattatatactaaaagtccattaaacttcctacaaacgctctcaagtcgccacatggcactctaataaattagagaaaatcctagaaattctaagaaaaaagcaaaacatctaccccttaattttcacttaaattggtgggtccaatattatacaccgttagatgaaattgatcttaaaataaaccaaaccaaatactatgggccccacctctcctcctccctagatatatacgtacgtacattctttcatttctctgttttttttcagtttttcttctttttttcatttatataagtacgtacgcttcttctttcctttctcttttttttttcattttttcttcttttttccatttatataatagatatatatatttttaaataatcataattcatgcgtacgcttcttctttcaattctttttttcctttttttactttttccatttatataatagatatatatattttaaataattatattttacaaacaaaaaatctaccatcatacaactcaggggtaactaaattatctctacaatttttgaaaataaaatttacatcattatctgttactcattaaattaataataatgtaagataattttcatttaaattagtgtactcattactttgtactattatgtttaaataatacactattttaaaataaagtttacacagttatatgtgtacatatgtacgtgtacgtacgcttctttcgcttattttttttcttttttccatttatataatggatatatattttttaaataatcataattttacaaacagagaatctaccatcatacaactcataggtaactaaattagctctacaatttttgaaaataaaatttacaccattatatgttacccattaaattaataatgtaatataatttccatttaaaccggtgtactcattactttgtactattatttttaaataatgcactattttaaaataaagttcacacattatattgtatacatacgtacgtatgtgtacgtacgcttctttcgcttattttttccccttttttcttctttttttctatttatatatggatatatattttttaaataatcataattttacaaatatagaatctaccatcgtacaacttgcatgtaactaaattagctctacaattttaaaaagtaaaatttagaccattatatgttacccataaaattaataattaccacttaaaccggtgtactcattagttcccaatagactgatttagtcttaatagtattagtgttggaagagggtttactttgtgctattattttccaataatgcactatttaaaaataaagtttacataattatattgtgtacctatcaaataaacaatttgagatctatattaactaatttgtacgtgcatttaagccgatggactcattatttaaatcactggatttattttttattacattggactattattctccaataatgcattgtttcaaaataaagtctacactattatattatattatgtacccattaaattaacaatttaaaatctatattaactaatttacacttacactagaaccggtggacccattatttaaatcatcggatctattgttttcttataaataaagctttcgaagttctcttttttggcccgctacacaatgcacgtctgcacttttgccttttgtacgcgtgacaaagcgtcgtgtctaaggcatctaaggtgattaccaccgccgctacgctaccactttgccacatatcaagtcatatatggagttgattaattttattaataacatgtaaagtaaattaaaggtgtgatgccgtgagagaataattaagcaccgcgggttgaattttttccaacacttagctctgtttaacctgaaactaagagttgattatagaataattataatgtattgtgttatgtcatatttggattttgtactatttattcgtacaggtgaaagaaatcattatgttataaatgtgagcataatattaacgaatattaatagaacttttactaagacaagcgtgctataagagagtttaaccctcttttttttcccaattccatagtttgggttttcgtttgcacgcttttcaagtttctaaatagtgtcttttttaaacaacagtttatctttttagaagtcaattcattcatttgtaccctcaaatagctatcatataaataagctattctaaatcctaagtagtacatgtttttttttcatgtgagtcatggtgatcagtaaattggggatcaacagataatcaaagtcgtaagataaatatgtaagagctactatgaacaactgtaaataggtgtcaaaattaattgctattaattagacatctaatggcttgctagccacataattaatttctctctagatgtatataaacatggacgaagctgcaataaataataccatatgccccatgcatatatattatgtggttaatattctaattacatgtgttaagtcctttaaaatttcttaaaatgctctcaaactgctacgtggtgctctaataaattaaagcaactattaaaaattctaagaaaaaaaaaagcaaaatatctattatttaattttcacttaaatcggtatgtccaatattataaaccattagattaaattgatcctagaacaaactagatagtacgaggttccacctctcctcccggggcataggtacgcacctacgtacgtgggtacgtatgcttcctctcccttttttcatttttccctttcttttttttccatgcatgcgctttcctcccgttcttactatatcatgcgtcttcatgagatgatttaatcataagaattttaagtatcttgctctataaatggattgtataataattaacttgcaatagtttcttatttactcgagaaaaaaaaacatgattcaaaagtcataagtacttaatccatctcctactcaaaagtttgtgaatgatttttttaagatactttaagaaaaatagaacccttaaattattataaaataacattatccaaacattagtttgcccttaatttatgagacaaaattttcgaacaaacaataatcttatctttcaataatataatgcccgcgcatccgcgcgggccaccttcctagttgcagtaaaccaaacagccaggcaaatagttgtatccaccttaagccacaaagagttttatgtaacagaaaatggtgtagtgttggttgttagagtttatgatgacatcatattggtatctatgggtatcatttctaacacctaaaatatcatattaacatcagcatagtaccaacatgctagaatttgatacctatatgtatcttgtctggtaactgcagtactgcagtgttcttgaaggaacgatataggccgtgtttagttccacagacaattttttttaaaagtatacggacacacatatgaaatattaaatgtagactaagaacaaaacaaattacagattccgcctgtaaactgcgagatgaatctataagcctaattaatccgtcattagcaaatgtttactgtagcaccatattgtcaaatcatggcgtaattaggctcaaaagattcgtctcgcaatttacttgtaaactgtgcaattatttttttcgtccatatttaatgcggcatgcatgtatccaaatatttgatgcgacggaatttttggaagtttgaagggaaataaacacagctatagtgttccctagtcatcctcttatgtaacagtctcagatatcaacaatgagcttggctctggcgtggccagactccaccctgtattggtctcccacgccgaagtgcgccatgagcagccacaccacggtgagcagctcgcctccctggctgagctgcctcgcgtgggcattgccactgcactttccggccgaatagcacaacatctccacccacacggcggccatgagctgccatctcctctcctcagtgatgccctcaagctccatgagctgcttcgcgagcttgcacgcctggaagagcaccgacttgctcctgtcccccttcacgtcccgtggctctgcgatcgacgtgtccacgtccgtgagcctgttagcacatcccttctcgtccctggtctcgtcgtctcgccggaagaagttcttggcctccgcgcaggtgtcaccaaagcggatttgaccgatgctcgccgtcatcatgaacgggcgcatgaccagcaggaacagcatgtagttcgatatctccctgctcacggtcaccagattatccgggtctctttctcgtgccgtggtgccatgatcgtcgtcgttgttgccggcaggggccgagctggagacgcagaggcaccggagacacttggacgacgaggagcagctgatacagcatccgtcatcatccttctccgccggagcccgataatgtttgttgtagaagcagagttctgtggcgatgtgccagaggaggatgctctcgtcaaactcgcagtcgacgctccagcccagcttctggtagagacccttgcgctggagcgcccactggccacggtgctcgccgaccttccggtagctcttgggatccttgctgatgctgcttgccttgctctttagctgttcgaagatgtggctcttcagctgctccgaaacgccgatgctcgtggtgtacctccagctgtcccacatcgtcttcacgcggaagttccacctccactccagccactccatgggtttcttgtaccagcgggacctgtccttgacacaatagctgatcaggttgtactgcgacatcttgttcgaccatctaggccgcttctctggctggaacaggccgatcagccaaaacaccgccgctgccacggggcggagcgcttctgtcctgcgcatgtcggtgtaggtccaggaggacacgacgatcaggagaatcgcgtaggtctccaagaagatggctccgcccaggagcacgaaggagatgttgatgtcaacctgcttgtagtagcctcgcatatcacccaacgcgcgggtgaagagcacgagcgacacgaccggcgcggccagggtgaagaagcgtaggccgcggcctaggcgaccatgaatcacgagggccttggagtggaggcattcgtacatgagcaccagctcgatctccaccaccttgtacgcctgttccatctccagcctccggaagaaggagaggctgtcgatccggtcctggaagctaaggatgaggtcgacgaagaggcggcggaagatctgaaagaacctgtgcgcactgtacaccaggtcgccatattcctgctgcttgacttcgacatggtggtcgtcgtctggaggccgctcctgcacgatgacgatcttggccaccagcccggcgtccgtcctcgactggcactcctccacgaatttggcgtagtttggccccggatctggcggcgtgagcatggagctgcgcaggcagcccatgctcgccgccctgagcgctagcgtccgctcgccgtacttggtgatgccggcgacgaacatgattatcgccgggatcatcagccggacgccgggccgtgatttccagtagacgtatccggcgagagcgacctgcgacagcaggctcaggaagtgacgcagccagagctcgttgtcctccacggcgaaggcggtgatggtgtcctgccccccgagatgaaggatgaggaaaggggcccagaagacgaggaggtgcatctcgccatcgagtgagccgtcgcagagcttctggttctgggacaggttgcccatcgcgtagatggcgatgtagtcggcgaggaggtaggcaagccagagtggcatgcgcagccaccaagcggctttgcgcttgcgcaggccgccggtgaagaggaggaagacctgaagggataggctggacaggacaagaacgcggatctcccactcaccccacacctcccgtaaccgtctcaggttcatctccgtctccaaaattctccaatgctccctggtttcaatctccccggctagctgctagtgaagctcctcctgcatcatcgatcgaggataagcatttagcactgtgcttgcacaagaggaatgctttctttttttcatttgcaaaaacgaaccgttctctctcagtttggacatttgtttactatatggctatccatggacaatgatttttttataactaggtgccatagcatccatcatttacatacgacataaatagttatagaaaaaattgaaaaaaaattagtaacatcgtttgtacaactagagaaagaaaaataataaaatcagaaagtgaatagtacacgtatattgtagataaaatttgttattttttcttcatatatcgatcgaatttatacttgcatgtttgtatgatgtctcatattatcatggtttatcttatcaaattttatgatatttttatataactgtttaaattacatgtatacatatagatgtggcacctagatatagaaaatactttctgggccatccagttgaactattaaagtcaactaatcattacggacacagtatttgctctatcgtgagagcaacaaggaggtgtgatctcttgcaaactaaagcgcacatgccagatgccattgcccattgacccaaatatttaacgcaaagttgccacctattaattccaagctagttttctctctagactccgctggctctagacttcgctggtcaacttgcattatcagccaacggttggctcgttagtcgttatctggcttaggggtgtgttcatctacacatcgacccagtctaaaacggaaattagctgtttttacggtttgagttatgcgggtttgacggaagcaacttcgagtcggacacccaattggagagataaatatcgggcgtcattacggggtgtgtttagattaggggatatcacatgtataacttaattttaattttagagtgtcacatcggatatgatattatatagggtgtcggatatgatatagggtgccgcatgggttttttttgacactaataaaaaactaattacataatccgtcagtaaaccgcgagacgaatttattaagactaattaatccatcattagcaaatgtttacagcttactgtagcaccatattatcaaatcatggagcaattaggcttaaaagattcgtctcgcaaattagtcgcaatgtgttgaattagttattttttagcctatatttaatatttcatgtaggtgttcaaacgttcgatgtgatgagatgtaaaattttagggtaggatcaaaacaggccctatgtcgtccgatcaattctgtatgcacgatcgaagggactctgcatgctcgaaatgactttgagggactctgcatgttgatttcagtgacttagagggtgtttagatcccacacaaaaaatttacatcccgtcactgttaacgaccaaatttggtaaatcatagatcggattcgaagttacaatcaaagcggatttggagagactttgtttctcagaaacagagtacgcatcggctattgactgcatcggctgacactgaatcagacaaggagaagcggatgtagccgatccccggaagatggttctagaatcattgttgggatcggttgaggcgccgcacaagcattgccacgagtggaaagagtccaaagaagacaattgtatctaattaatattttagtagttttcttagagatattttcggtaagagtcctcctaagaggcttattcgtatttttaagttataatagagatagagtcgtgtccagcaatgacatattatgtatttcaggtataaatatggccggacaccttgtaaaaaaggagatcaataataatacttttggcgcatcaccacctttatctacacttattgttttcgatgagttcttactttcgagttgggctgcattgggttcgatctcagacgaaaaggtaaagcttgttatggcggtttgcattctcgggattagtgcctacatcttcatgacaatctaatcctgttcatgtaaatcgccaagttatcatatatgctatataatctagatcaatatcgttatctgaccccattggctagtctctatcatcaaagacagccgatagggttagataccaacattgaattagattatatagcatatctaccatctaaaaaaggcttttataagcttgtttagatcttgtgtttttcttcgtgcttaatgttgcatcagttaagtttgatctattaagtaacgtgtagaccataatatctaacttgttttataattgctagtagagatagcatcagagattcagccgatcttacctggtttagtcatcttgtttccttgtatacttacttgatatgctaaacctgccctttatattaagatatcgcttggtcagaatatattaagcttgttgttaatctattaggtcatcctgttattagattgattttggttcagtatatttcatcttcattgatatcttggtacagattagtatcggagtactagccaatacatattaggtttgcttcatcggctatgctatgaatctatataatctttactttaaagtatttttagacatacgtgatttatactgtctcggcgtgctgtccgatctatcccaatcactgggtttaagcataattcggattatatagttattgatatctatagctgatcgagtagatctatttattcttgcattacatgttctcactaccgatctgattcatatcgcatcgccctggtgttaaatgatacgtcatcggcagtctagccaatcgactattgtttatggatttaaccttgttcttttttatttcttgttggtagcaagatcaaaccaactggccgatgacgtatattcaaatttaaaatcccaataacaataaggagaggaggcagcggatggactatatagaggagtatagtggcaatatttgacgggacttctaaaaattataaaaacaaaactcaacgagacaataaactctacaaactaaaaggtctaatttttaaaggttccaaagagaattaatagaaacagtggtagatcgagcaagcaaataaaaagaggagtgataaataagtaagagatagtaactgcgtgacttttaaaaactataaaattagaaacacagggatgataaggtttggtatttcaaatacttaagacaatgagatagctatttatcaaattttaaataaaacatattaaaaaatagataattttatatgggtgctagccgcacaattgcgcgagccacccagctagttttaataagattaacattaagtacatccaaacatgcccatgttctattaacattaggaaacgtggtgcctcctagtatctactcgagcaccaaaaaaagcctcctctagataagtatcatcttcaagtaaggtgtttccaaggatggtatagtcatcttcactgatggtttcttcaacaagccgaatgatttctttgtgcttcttgacttgagtagtagaatatcctcctacaagaacaatgtacttcccttaaaagcatatcattgattgaaacaagtgaatagcagcaagttagaaagcttctaaatataaatttttttgtggcgtttcctgaaagagaaaaatactccatgatacaattgcgagattacactttaaagggaattttttttggaagataactattcacatatggcaacaagaagatgatggtatactaaaagtcaattaaacttcctaacgctcctaagccaccacatagcatccctacaaacactctcaggtcaccacattggcgctatagaaaatcaaaacatttagccattgattttcattaaatctagtggacccattattttccaccctcccaaaaatacgtacgtacttctttttctttttttctttcccaaactaataattcgattccatattatctatgcttttatgctttaatttataaaaatatatttgattagtattattaaaaattactcgcttgtacggtaaaataatgtcacattactaaattatggttttctttatttatatattattagaaaattaacgaacaaatatattattttgaaaccaacatcctctctcctacttagactacatttgatctagctcattggttgaccttatccattatccagggcacgttaaacgacgtaggtcgtcagcacaagattaattaaatattaaatattacaaacttgaaaatagatttatttttctaaaaaaacctttgataggaagtatttgcaaaacatgcacaatttagtagttcggaaggcatgatcacgataaacgagggagtagccaatccaataaacactttagaacttaatcttaaatttattacttttgtacttaaacacttaatatgtagtatataatatactttgtcaatccaaaacagcctaatgtatcgatcgtatgttcctactaatcctaatgtatatagattctatatacaaaccactatccaccaatcgccaagtcatattgtttacaaggtatccgtgcatagtgcacctaatatttagctgacatgcaatggacatgtgtgtgatcaagtacagaaaataaaggaagatagtaagtgggcaaccatcaagaaatgatagataagtagaggatgccatcaaggcacaacaaacaatagttgagtacaaatagattgtgattatgagtaatagtgtttctacactcctacaaaaactccttatatgccacgtgatgctctaataaattagagaaaatctaagaaaaactataagacaaaaaagcaaaat

SEQ ID NO: 43320 - DNA, 49761 bp, Oryza sativa
  unsure (1)..(49761): unsure at all n locations
cacctaacccctatgagagaaaaatatttgtcaacaaaaagaaaaagtacgtacatacatacgagagattattattggctagaaaaaaaaacatacttgcgtataatcggaaatgtcacgtggaaccacattatatcccttataattatgtgattctcatctaaatagtgttaacaattagcaccccacaaataaaacaagtggcacaaataattttgacaatatagattattccatcgtatatatattacccacgaagttagatgtataataaaagaaaaaaacctatattaattaactcatacgtttgagaaacatggtgacaggcgagattatatataactggaacaaaatgatttttgtttgaacatgactgttattatcattattatgtcaaaatctttgatctactccacggtataaatatttctcttttacaattataagctagcgtgttgttaagatatgacttatttcagtattctttttataaacaataaataaattggccgcgcatctgcgcgggctttctttctagttatcactataatagctggaactagaaattttgccaatagatattactctcttttgaaaaagagtaaattgctagcggtccttaaacttgtaagtaggtttcatctagatccacgaacttgcaaagtgtgtatcgaggtccctaaacttggtttattgtatcatcccggtccaaagtctcatttgaccgtggtcttacctacgtggcatgacatgtagacgatgacatggcacaatattattattatttctttttttttctcacttcttcctctctcatttccctcttctttggcctcttcaacgtgggggagctcgaggtggctctagtggaggaataagataaaagaataggaggaaaaaagaaaagggggaaggaaaaaaacgccatgtcatcgtccacgtggcgtgtcacgtagacaagaccacggtcaaacgacgctttggactgagataatacaataaaccaagtttagagacttcgatgtgtgctttgcaagttcgtagatcttagtgaaacctcatgacaagtttaagaaccgctagtgcattttactctttgaaaaatgtactgaagtgttaagatacctgatgattgttctgtcaaattggggcagtcattcatatgtatttcgatactgttgccacgtagcaagccttcggaaatagaatgtagcgcaggacagcccgacaaacgtataacttggagagaaggttggtgctctaaccattctggtaaagtctccagtttgttgcaattgtcaattgccaagcttctaatagaagaaatatgttgcagaccttgcgggaggcatgtcagctcatgacacccgcatatgtttaacttcttgagcctggcgagatcttgcaaaccctcaaagttagaagaagattccagctcttccccaaaacagattgatatttgttccagatttcttgccacacttctaaggcctccttttgaaccatataacatcttgttgttcatccacaaggtcaacttttcaacagatggaagctccatatgcaaagcactcaatttggggcagtgaataatttccacttctgcaagacaaggaaacgcacccgtcctgtctgcctgttcccagagttcaaggttatgcatataagagaaagttaacttctccagagaggggaatgtgccattgtgaccatagaaattgttgtcaatgcaggtgatactttcagctccacttatctcggctatcctcatacgtggtagtatccccagaggaggtaaggatttacattctgtgagattaatcagtcttatctcaaccagagatttaagatatggttcggtgtgtgtcatccaagatggaagcttatcaccttcatacgcaacaagctccagctctttcagctgttgtggcggtcgaagaatctcaattagttcataggctgctgtattggcatgttcagtatccatgttccacctcagtgccaatgattcgagttctagcttatcttgcagcatggcatctcttgcatctttcagatccaaaacattttcaagtctttctaagcttagcctgtgcaggtttgccaaaggttgcagctctgacagcataactacattgctgtttgaaacaacataccctagcaatgtctgaaggtttttaagatttccgaatctgtgaggcattcgagtaagtgatgcacatccaagaacactaagatactcaaggctattaattttactgatgttctgaggtaattcagaaagatagcggcatccttcaaggtctaacttgtgtagccgagaaagcctgcatatatttcgatgcagtttttggagctttccacagtaggataatttcagagtatgcagaagttgtagtttggatattgagctggggatgactctgatatctgtccctgataggttgagaaatgtcaagtggaagagtaggtcgaatttattagggagcttcctgatcttagtggcttctaaactgaggacttcaagatgtcgaagtgtttgacacaattcttggggaatctgtttgatctcacactgccgatcagatgagcacgttttcccttcctgtagcaaaataaatgtctttaacatcttcaattgggacatgcaaattggcagcgattccgtggaaggatgaacgagcagtgatgcactccgagtagacaagataatgtcttgaacagcattgaactgaccaactctgatgattgagctggaaactctgtctgcatattgcacgaagatgtgcaatatcttgtgcatcctgtacatatgcctacctccatgatcatattcttccaccggataaaagcactcatcaagaaactgttggaggaatcgtattcgttgggcttcaggcacggtcgacggtataaagcctttggcagcaaaaagatcagccagttcttcagcagtgaagttgaagtccaatgggaacagcgagcaaaaaagaaaacaattccgcaattcggacgagagatgctggtaactggcataagctctctgaaagacatcagtcagttcttcctcttgttgaatcctccaagaaccttccagaactcttttccaccggatcagagttagctggtccctttgaagtataagaaatgatgtgtactctaacagcagaggcacaccggcacatttttcgaccaacttgataccgtactcgtgataagggggaaggtacatgtccatgacgtgtttggaggattcctggtccagtggttgcaagaagtaagcctcagtggttcgcatgacgacggccgtccgtggtatgatagagggagttcgtgtggtgagaaggatcctgccatttggggggaatgccagcataaggttgtcccattcaggccagtcgtgctggccaacattccacacgttatccaggacgaccaagtatttcgctcctcctcttagaacactggaaattacttgttgcagataggatggcccatccttcctatcgaccaaccagctgcttgtaatcgtactgacaccctcagatagatcaaaatgtggtgagagatgcacccaatgccgcacctggaacgcctgcttgaccctatcgtcgttgaataggaaccgggctagatatgtctttcccatcccaggccctcccactatcggtaaaaccagcggcccgtcgccctcctcctcctcgccgtcggcgagcaacatcctccccagcatcttctccgccagctctgatctccccaccattggacttttgacatagtcgtcgggacccacatcgttcgtcgaggttcctactggatacaagtcttcgtccatactctctccagactctggcacggaggcaagtgattcctctagccccgcaagcttcttcaacaaactcctaagctcacggacggtggcacggcgaaagaagaggttgctaatgtggagagcggttacctgataccaagaatctggttccacctgcctgctcaggattgcctcaagctcgccgcgaaggtgggcgaacaatcttctcgcttcctcgagacggcgatcataatctccacatgttgccaacacaaggcatttatctcgcctgtcgatgatattgttgatgatgttggggaagcgcgcgatggagtcacgcactgcgccgagcagggcgtccaattccagcagccggctctggctctccatgcgcgccgagctcagaatgtcgatcaccctctgcagatctgctgcgacatccatggctccctgatactcttaacgctctaacacctctctcccagtctgcttctcggctgatctcctcgctcccgtagtcccgtcgcatatagactacagagttggctcctctgcattcatcctgtacttctttgactagatccatttctttaaaattcgatgggtagtacagatcacacaccaaacctaaatttaaaccagaacgcatatgcacgggcatctaatttaatgttgcttgaaatattactctacacatgtggatataatatttgtatatacgtgatgattctattctcaacctgttttttttaaactagctgggtggcccgcgcaattgcgcggctagcacccaaacaaaatcatatatttttttagtatgattttacttaaaatttattaaatagctatctcattatcttataatactttaaaagaccaaaccttatcatcctcgtgtttttaattatatagtttttaaaagtcacaccagttgctaccccttatatcatctccttctttatttgcttgctcgatctaccactatttctattcattcttcttagaacctttaaaaattggatttcatagtttttagagtttattgtcacgttgggttttgtttttataatttctagatgtcccgtcaaacgttaccattatactcatctatggcccgtctactgtttcttctctttattgtcattgaaattttaaaaatcgaacataattatcgtttgggttcatttttactttctagaattcccgccaaaccatcagcggctttgccattgtactcctctatagctcgcccgctacctcccttctttattgttattgagattttaaaatcgaacatgattatcattgggtttttttttactttttggaagttccgaacctttaaaaattggacttgtagttttattttttataatttttagaagtcccatcaaacgatgccactatgcccctctacagcccgtccgtcgcctactatttatttttaattcatttttaattttttagaagtctagtcaaccgtcggcagctctgcaactatactcttatacaccctgcccgctgcttctcctttttattgtcattaagattttaaaaatcaaatatgattatcaatgttttttttttactttctagaagtcccagcaactgccttacttgtttgcttcatggcctaactgatgtccctccttttaatcgtcattacgattctatttggtgttttattaacaatttttatatgtcgtatcaaccgccaccactctactcctttgtaggcatgttacttaatttatctcgtcatgtgttttagatggtcttttcttttaatagtctttatttttatcacaaattttagttatttataaattgtattcctaattgaaaacttatttttctttttctaatttcagaatttaatttttaaaaaaattagttaatatcatattatgttcttttaatgtttttattttttattttcaatttcagttgtttcaaaattgtatttctacttgaactctcctttccttttctaatttcgtattttattttatttttattttgaattttgattaatcttgtattgggttcttatatggaaacttctttcaatattgcttatttttaattccgaatttcagctatttttagattatactcctacttggactgtcctttccttttctaattttggattttattttatttttattttgaattttgattaatctcgtattgggtttttatatggaaacttctttcaatatcgcttatttttaattcctaatttcagctatttttagattatattcctacttgggctctcctttcctttctaattttggattttatttttttatttcgaattttgattaatctcgtattgggttcttatatggaaacttctttcaatattgcttatttttagttccgaatttcagcaatttttagattgtattcctacttggactctcctttcctttttctaattttggattttattttatttttatttcgaattttgattaatcttgtattgggttcttatatggaaacttcttttaatattgcttattttttattccgaatttcagctatttttagattgtattcctacttggactctccttttctttttttttctttttctccgattaatgtgggaatttctagcctccacagcgaacgtggtgccttcttttcgagctgtcttaataatataatagatattttgtttgtgactattttgaatgctaattatccttgcaacacataaattctaaataaaaattacttacaaccatgaaatcttgaattctaggaaagtattatgtcgcaacaatagagttggttcctatgaactgtcatctaaactatatgttctttttaatacatatcaaatattcgcgttggagtgataaactttaagaaagttattttcttaagaatagttattgaacttcaagcaaataaaagttccaatgatttttgcagtttgttttgggctttggattcaacaaaatttgtttaaatttagcccaaattttgtttgaattccatatgtcctttctacttcttttggagtattagaggtctatgttctatcactcgttcttgaaatgcttttgatctctttaaattgggacataaacataactgtgttgagtgtacaactcgatatgggataaatgcgtcctttctaaaatcctgcctctaaaattgagccaaaaaattataacagtagacatagtatgttttacttcctctgagatcaatatctgtgttgagtgtacaactcggtatgagataaatccgccctttctaaaaccctgcctccaaaattgagccaaaaaaaattataatagtacacatggtgtgttttacttcatccgagatcattatgtatgtgagacatcaatgtgaatatgcattaagggacacgcaaaaattctattttagctatcgcagaaaaaaaaagggcaaagaaggcgcatatgtacgtacttgttgtagccgtggagaatattttagaattttatttgttagatctaactgtctagaccaatcaatttattagaaattttttcaccataaaagagcataatatcttttaactaccgattctaaccaaaaaaaaaaagggggaaaaggggcatgataaggaaacggctatggtggttgggaaagttatagcagcaaaagccatcaaatgagcaattgtcccaaaataactgaagggagtagaagagaaaattgtggttgggaaggttatagtagcaaaagccattgaaactaatattttatatacaggaataattcgttttgttattaatgggaaaaagtgtggctaaaagaagagaaatcattagaaataaatgctccctccatctggtttttaccctttttaccaccccaccctcacctttcctccatccatttttttcactttttaccccccccccccctccgtgtttctttttctcctttccatctcatccgtgccccattgaagcgcccgataaattattaaccatctagatttttttttagttttctcgttccttcttttcagatcttttttctcatttaattaaaatatttaccatctagtttttctttctgacttttatgtttttatagtgtttcccatgtttcaatagtaacaaatttactctttagagttttccatttgctcccatcctcccacttctgtatcttcaaaaataataaatttactcgcatgaatgcccccttcacaagtaacaaatttacttgcaagaatgcccccacatcgttcggcaccattcctagatggccttaaaaaaatactaccaacttacaacgctagcaattcttttaccagtgttacaaatattgtttagacttcgtagtctgcaagtaaaacaattatcacctttctctcaatgtagtccatgttcaatgtagtccatgttctcgtagtcaccacatagtaatatatttactcatgtgtttaatacataatacatgagtaaaaactgatactaattatttttcacagagtattgttaatttgaatcacaaaatgattgtccgaatgaaaaattcataggctcaatcacacaggtgaatcaaactagaaaagaaaaaatggttcagctaaaaatccatcttgaagttgggatcctagtggctttgctggatcttgcgacaaggatcgagaggctggtctatatcttgtgactggtggtggagaaggcaaccgggtggcaagtgacggtgggctatggaatcacggaaggatgtagtggcgcggtatagagatgagctcggcaatacccataaggccatccatcgtctagcaaccagaaaaaaatgcaaaaaaaaacattcttgttcatgtcacagagacgacgagcaaaaaaaaaagcaaacaacctttgtcaccggctgactccaccatatactctgcagccagccacatggagaacgatgtgcacatgtagaacctatgcagcacatcaattcagataaggtaattgtgcagattgcacgctaatttgatttttaaaaaagaaattggtgttacatgcgtgaatgtgaagtataatatccatatccaaatggaattgccattaccttattaactcctccagtcaatgtcgtcgccgtggtaaatgatgtggagtacccgctggttgtttctcttggcctgggtgaacatctcccccttgctggcgaaggcactgcccggcgtccggcggcgaggcccggagcttcatcgtggcctttatgctccacgcctcacctcaccggttcaggcagcagcactgcagtgcagtccatccaagaaacgtacagcgacaaaccgacggtgaatgcactaaattgccagaaaggaatcaatcgcttgatgggctcacctgtggtggcgatggaaggagaagcgaactccgctggctagagaccatcccctcttgcatccgtcgattgagcatgtctctactcactatccagagaccacggcttgccgctgccaccaggagagggaaagggaggcgcgtacgcacatgagggggctgatgaagacgatggcgatggctggttctcccgtcttcgctgcgtgcgagatgggggagcacacggacgaggttgagggtgggaagcccccccataaaaaaaggtcggccaccaccatgaaccgtcatggtgtcatcatcctcctccctggtgcgcatcgctcgccgaccaccgctgtcaaccgtcggggtgcatcgtcctcctgcatggtgcgttaccgatttatgggttgggacggtggatcgattcagatcccaaaaaaataaaaaaatgaagtgtggtggagaaagaggttggtcgggtacaggaaaaatagaatatataccggaagtagaaaatttgctttatcgaagtaaattgtttactctaataatggtgagcctggctgatgcatgcttggagtagtacttagcgcgcgctgcgcttgtactagttactctattaatatgatttttttaaaaaacaacttttccatataatttttttacaataaatacgttgtttagcagttaggaaaacgtgctcgtgaagaacgagagaaatcttctctcaatcaccaactaccgaacgcagcctagctaactctcgtaatatctagtctgagaaaagaaagttagattttacttataagtaattttgtaataatatattttttagatattatcgttgtattttaatagaaattttgtgatcaaagttctacaccaaacatcaaataaactcagtggtagtagtacacccttttctccctaagttatgttatggggatggaaatgagctcgctcattttctccgatccataaatgtactaccacgtctccatttagttgtggtactgttgactattatattacggactattgacgttaatttattggtttacggaatctcgctaagaaacctaattgactttatttttttaccgtgctgaatttctaaacaacttgcaacagattgtccttctttttttctttactattttatggaattgctaaaaaaaaacttgcaatagatttttttaatttggggacgtcctggaggaatggaacatgctgttatgaaattattgtgttatctcatcatccatatattggatgggattggcaactgaagattaggcatggcttagtgaacaattagcacatgttaattctgtttggttatgaagtcctcatgatcatgaggggacgtccacactatgttcaactacaagatactcctctctcgctctcgctttgaatctcaacacgttatcagaaatgcccgtgaaggagaagatgaagagaaggaaatcaattgcgaagatacgatgcctaactttggtgtgatcttggatgttgttctcggcctctctcattggcaccgcactcaccgtctccaccaccttcttcgccaatcgatgaggttgcgctggggctacagcgccagagcgaggattcggatcggtggttggcgccaccaaccccggcgttgtgtggtcgccgatgtcggactggttgtcgctccgccggccccacactcccacttactcactctattaatttgcaaaactccttaaattttctattttaataatttgcaaaactctttaaattttctattttaacttagcaaatcctattaattatgtataaaatgattaatgaaggatttaatgcatgttagactacatattttgacttacaattaaaacatatagagatgtagccctatactttacctacaatagtcataatctaggctaattactaagaggtctacatcttatgatattacgtacatgtgttatttcgagaatatgtttgaaatatgagattattttaaatttggatatgtacaaggtagtagaatcctaaacatcggttgtggtatattcattagaatatatttgcttagagatcatgtttttagacagtgagtttatcttgcccactattaagagatctactccacagtttaattacttggagattatccatattgtgctgtctaattttaaattctaactcaacttgtaaggtctatattctacattttctaaacatgacaaaatatgatgccttatatttttgcattgagattactgttggtatttcttacgatcacaaataaattcgtaagcgcacggataccgctgtagcatttcaccaatgagtattccaagggtattgtatttatatttccacaaggaaggtgacggtatgaagatatgtttatatctctttaatcaacctatagttaattcaccatagtctaaaaaggggttaggataataaatgataaggtagtggacacacatgagattcacctctataagaatatcgagtatggaaatagctttaggaaactacgatttgtatgtacttctatactaatcatgtctagtatacacttaacatatatagatgcttacaacatatgacttagttctaggcacccaggtactatcgagagaccactcccttctagtctgccagcgtgattatagcatttatgcactcttacgtcagagccagacgtgaaggaatacaaaggacagacaacgctatcaccacctgccgcctgcctcactttccgtggggcacacccacatccaatggcatttatctagcctaagcacatgcttatgccggtaaataatatcactaactcccccgagactctcaccctatggatgaacaagttgaaacaagagcaatctataaaggttattggactgttatcatagcatggatcgactagtcaaagatgaagtatatatacaaagtatatactactcatatgacatatactcaataaagaaatatataaaccataagcataaataaacaaagtataattctattaattcaactgtattcttacacaaagagggaaatattagagacataccaagaactccaacaagactataggaccgaagctcctaagctttattccatttagaaactatagagaatacaaagtggaagagggaattgctccttgaggtgtgttgtgggatcctctatttgtagcctcctaataacggtagttaagtcggttgtaggtcgaaaaacgggtataacagtcatcaaaagtgaaggaatcgccacgtggaagctcagtggcgcgggcgccaagattggttcggccaccgcctttggtgagggaaattttattctttttgaaaaaacaaatgctctagaattccagtatcactcagagaaagatcataacaactctatttcaccaattcatatccaacaacaatctagatttagatcatgctttatgcaacccacaagtttcatgttgaaggcaaagatttttttaccaacaaactcaaaaactatagtgaagactaagctgtaaactattccctccgtcctaaattataaggcctatattttttacacgatcttcagtaacatattatgaacattaatttattccatgttatattcccaacaaatataaattagcatcacaaaaaagtactttaaaacaagaatctagtgatataacgtgcataatacttagcatatatatggttagtatgattattagttaaaagttaccgagtttgattttccttaaaaaaagagggtgccctataaattggaacgaagggaataaatactagatagaaataataacagagcaaatcatttcaagtgggaaatcttaaaacattcttatcgcgtatatgatagcttttttggtaatttttatgctttgcaaccttttgtcgtttttctttttctgattcaataaaaaatgaaagataaaagttaccttagtggaggagagagcccccaagctagcttcttgctagggtgcatgatggggatcgaatccatgcgatctgaagtagaccgtcatgtcagcctgactgctgaatggcggcgttgatgtccgtcatctggtcacagcctcactggtatgctgctgccatgagtgggtttcctggacatgctggtttagcatgttgtgcatctcatttgtccggagatccagatctcccagctgccgagtaacatccgcaaatcctcgtccaaagtcacgaaaacttcgataggagaatgagtagtgtgcactggactgcagggtgttaacaacaaaaattggtaagatatacggagattgcaatagattcgatgcggatttggatgagataattcggtttctaaaattagagttgcgcatcggttgaaaacaatatcggccaattttatataggagtcgaggagaagatctgaagatattgccaaacaaaatgaagctcgaagggggtaattttatatattaattaggacaagagtcacttttcctcaatgtctttgggaaatctttgttagaatccgggatcgatggactgacctgatgtgtttattttataatcagctcgagtgctttggtaaattgtgaagatcaaactttaaccacccgccattatgtggtgtaattaatgcagggtattttactaatcgcctataatagcctggctccatagaacgaaacgcccggccagcttgttcccacgaggcacagctagctggctctccagcgacgtgcgctgctggttctccagcgaacgtcctcaagaaaaaaaaacaaatgttaaggtgacttttatttgtttaggtttaatggccgagctaacggctaagagtaagtttaataatatagctaaatgttagcttcaaaacatatatagctaatctagttaaaccattgatataatagtcattacctatgaaaatatactacaccattaatacccggtcacatatttcatagacacacaacctcttgagtccagattgcagctggctataaatttatagtctgttttcttctctctcttcccttttattcctgatatgttattatagctggcttatagcctgctattatacttgctctaagtataaactcaaattctagaactaatatgctgatccatgtagaactaattaataaataatatcctagctaatttttacataaaactaacacagtacacttcacattttctttttctccatgtgtatttatagctaagcagtgttaaggtggtgtttgaatctcatgaagatgaagattaagttagcgcacgtaaaaaaacctattagcatatgattaattaagttttaattattttaaacttgacaaattgatatatttgatattttaaaacaactatatagaaagctttcacacagaacgtaccgtatagtaatttgaaaagcgtgctaacgaaaaccgaggtaaaatctatatcttcatgagaaaagaacaaggactctcatgttaaaactaattatacattactccaaaatatatacattaaatatataagtttcagaaaaaattgaagactatctcatagtcaatctattatacatctttaatatgtttgaattgttgtgttcccccgcaattaaattaacagttcatcacccatattgaccatattttaactttgtctcatcacatttgttatgtcatccaaatgaaaatttataaaaaggagctgatacagatcatattatcatagattacttcacatgcacgcatagttaaattatatataaagaatattccaaatcgttgtattagattttataaaagcaggtccacgtggtgcaactactgggtgcaagccacctattccacagtcccatcacggcgcgtcacgcatgcacgtttccttgtgggtcctgaccttctggcctctcctccgcttcacacattctccttttctcccccattattctctttcagtagttgagttagaatatatttgtaacaataaatttttgaacagtcgtaacttttaaattatatatttaattttttatctcttagcaccatcgtattatttatgattaaaattacaacttaagcctcatgttaaccatttttttttgaaacgaaccatataaaatagtgtgagattttatattaatattgtagagtgtgaggtttcatattgatataacataaagaaatagttacaagaccatagccctaagatgctataatgagaaaaaaataacaagtcacaccacgcgtttgcaaccaaaagaacacgatatggaagaaaccagagtgcaacgtcctggttgcactcaactccatccacgtctttggattggagaagcaaagggcgagagaaaagatagatccattatcccatgcacacaacccccgctaacatgctcatcttatgacggacggaagcgccaccacaacaggacagatggaatggaaatggacgttcaaagtgatgcatgatcgagtatgctctatttcctaacaaaggttcctatctgttgacgcaaaaaatgttgcagacatcaaggcctgagatatttggtttctctagtgcaggtactatcaaattgggttcagagcgtgtcagttagtttgatcctacaactaccaaggttataaaggaaatattagtccttgggccaattggctttgaagccgatacgaaatcgtatactgagagaatgccgatagtgattgctggtctatcggcaacaaccaatggaaataaatagcatcggccgtaatatggatgatgatgatgatgatgatgatgatgatgatgatgatgatgatgatgatgagatacatacatacatacatatagatatatatgcacgctaaacctaaatcttgttataatcaatctttgtagagcagacccaactgagacaatatgagattcaacaacaataaaacctagatttaacaagtatatatgatttccagatgtaggctaatgtatttagatattaattagaacttatcattgttcattattagtgaataaactaaaatcaattctagtaaaccagaatataatcggtaataatttgtagctattacccacaatcttgatagattgggcctaaccgagacagtgtaacattgaagataataaaaacagcaactagccgattatactaaattttgtaaaccaatcaataaaatatttcatattatgataagtagataccattacctcatggactgaaactctgatgaaactatgataataacttattggcttgaataaatctaattaacacacgataacctacaagatcggacctaaccgagacaattcaaggttaataatatgtctaatagatttaaactagccgatagatactattcagagtgattgatatagaaaccctatctagaaagcaaaagcaatcgaagcaagagccgatatatctgataagcaacacaagcagaagaagctctatggtgtcaaaagctttctcaaaatcaagcttaagaagaattatctctctcttggactgctcgcactgatgaatgtattcaaaagaccaagctaaacaatcttgaattgtcctgcctttaataaacccatattggtttgtatgaacaagcttgaggatcactccttgcatcgtatctgccatcagctttgttaagattttcaaacttataatcatcaaagatatgggccctataatcatttactttttgaggagaaagctttttaggaacaatagtaatgtaggatgtgttgatgcattgcagatcagtgcattctgcatgaaagtgggcagcaagcctttaaaagtcatgtgtaattataggccaacatttcttaacaaataggccattaaaaccatctgatctaggagctttatcaattgggagcatagagatgagattatcaatttactgagtgaagaatggatcaatcaaactctccaaatttttaggggtaaatagagacttagatttagggtctctttggcagagctttagtttcaacttcatttctcctagagctaattaagtctagctaaacaaatttagtttcacctaaattgaaaatgaagggggaattggatttagcctgtcccagaacagacccttgtgtaggggattaacgtaggggatccggatcgcaaagaggctagtcagtcattcagtcccgatcacggcgccatgtctgtcgctcagtccaaggagcgtggtaaccccgcggcccgcggcgtcgaggaggacatcctcgtcccactcctcgcccgactagcaaccatcaggaccgtcctcgacaacgcgccggctccaagtcgccgtcgtctaccagtgcatgtgcgcgacgccgaagaggatgctagggtcgaggcccgcgcgctgctggagaaggtccaaggagagatgtcctacctccagcgcgtcttccgccgcattgacgaagccgaaaatagcatcctctacggcttcgaccctgtcgaggagcagatcgacgacgcgctccagcaagcgcaggttgggcttgacgtggagcaggtacacgaggctctcctcgccgtggacgccgacatcgaggtcatcaaggccagcatccgcgaggtctacaggttcccctgcgacggcgacgaacgccgtggtcccccaccgccgtcgaccgcgccggccacgggcgtggtgatgacgaggaggatgggggagatccgtcgcggcccgcagatgcggcacctcggcctcgccatcggcggcttcgaggcgcggctccgcggctgcgtgctcaccctcgccgcgttcccggagtgcgccgtgatcaagaagcgcctcctcatccactggtggctcggcgagggcttcgtccgctccgccgccgaggggaagagccgcttcgacgagctcatcgccaagggcctcatcgtcccgatcccgggccatctctgcgccaccgtccaccgctgcacggtgcggccatggatgcgcgacctcctcaccggcgtggccaaacgcaccgccttcctcgacctcgactccggcaacgacttcaccctcgcgcgccgcgcgtgcctgaacgccggcaggatgtcctcggggttcagcgccgaggcgagagccatctacaacatcgaccagaaatacctcgagctcgacgacgcctggttcgccgggaagaaggagctgcgcgcgctgcagctcggccagtggcgagagttcggccccctcgagcagattgccaaccccatggacagccacatcgagctcagcggcgtcgaacacctcgcggacatggagagctgcaagaatctcaggtacatcagcttcaggggaatctcaagaatcgagtccctgcccgattcgatcggcaggctgcgtgagctcaccgtgctggatctccgggcatgccataatctggaggaattggggcaagggatcacaaggctggatcgattggggtatctcgacttgtctgagtgccacctgctcgtcggaatgcctaaagggattggccggctcacacggctcgaggtcctcaagggatttgtggttgcaaatccaagcagaagagagccctgccatctcaatgagctcaccaagctgaacaagctcaggaagcttggcattgtgattggcacaatggctgttccgacagatgatgagttcatgaaattgggcgagttcagggcgctcgaatcgctcaagatcagatggggtgtgctggcttctgatagcaaagggaaaattgaagcatcgtcgcatcaaaaaccgatcgacaaaatgaagtttgcgcttcctccaaatctgaagaagctagatctccgatgcttcccgctgacggatttcgctcagtgggttacaccgaagggtgttaagaagctgtacattaggggaggaaaactgatgacacttggagatgaacagggctgggaggcagaggtgcttcggctgagatttctgaatgatctcgagtatgatcacgatcggcttaaacgatcattcaggaagctcaaacctgaaaatacagagatccatgcatgtccaaagttcatccgtggacaatgatccagatatccagtgtactggtcgcctcagcttgcaacaacctgtactggttgctttttctgaaggatatatgggctggttttactgctttctattgagtctttgaaaaagaaaagaaagagttaccattctattctccttcacaagcaacttagctggttcttgccattgtactgccttcctgaaagatgttgtgattggttgtttccagataagaacaatatcggtcatatactttcttatagccctgctacattttcaggctataatgttcaggaaccctttttacccttttttctccatgtctgaagaaattcgctgaatcctatggtctggcctgttgtagaagggctgagacaagagtcaagacaagacaaaaatgtggtaccaaaatacaagttgctgctcccgtttgtggagtccgtcaggtacatccttttgcattttacataagtgaacaacctttttgtgttcagcttaacaatgctgctgattcctcatgatattacaatgctgtgataaatcgggtgagtaattcaatatagaagaaattctcattttacaatacagagaacatgacagattaggatcgaactagaactcgattacaatatagaacataacagctaacatataacaggtacaagggaccctaaaattacactgaaattattcacaaaggaaacatgctcactacaattcttcgtgcacgaagagttacatttcctcaagatgttagggcctgtttgtttgagttgtaaaattgattgggtcgaagaaaatagatgaatattaatgcatgtttatagcccatagtaccacaccaactgagccaaatagcaatcgggctctacttgcattatataagaaagatttatcctatccttgccggaattgtagttagtgtacgaagaattcagctaattaccatctgatgaatctatgtgaattagcaaatcatgttagactatatggataagatcgtattgtatccggtttgttatggtaggataggattagtttccatctgtatctgtttggtagaactcagtagataagtcagccacatatttgaattcaaaaaatggagtacgtggagtatcacaactctaccaatctactatacttgaagcctagtaggactcgggttggagaaacggatctttgcattgcaggctaggagcaggaggcatcggaggtgactatcatggcgagctcgccggacaaagggaaagagacagcagccgcagccgtggacgcgccgtcatcgtcctcgggatcctcgccggagaagaagaagaagaacagcagcaacaacaacaacaggggagaagcgacggcggcggcggtggccggagacgaggggaggaagaagatggtgaggatgtcgccgccgcagatcaacctgctcatgtcgttcgacccgccgccgctggagcacgtgaggggcctcaccaaggaggaggaggggatcgacgcgctggcggcggagtgggagagggggatccgcgcggtgacggaggctgtgaggacgcagtacgagcagggagggtacgtcgagtacgaggccggcgccgacctgcttgcgtgtcctggccgcagtaagaagaagccacagggaggaggagaaggagcaaattcaacagagctcagtgtattttactttgggtcatattttattaccaatgtataattttagattagatcatccttcatccaatgttttcacgttggatcggtatttttatctttgttgctcgcgtgtcctggccacagcaagaagaagccacagggaggagaaggagcaaattataattgtttttttaaagtacatttcgctttgagtcatattttattaccaatgttttattttagattagatcatcctttatccaatgttttcattttgcattgatatttttacctttgtgtcacttcgggaatcctccctcggtcgctcgggggagagagcaaaatcggaatataatgttgcagtgagttgaaacattcttttgcaataaatcacctacatattttggaaaactctctactaagaaaatccgtttcattttttttcataaaaaatgtttcactatgtatggatcaaatgttgcagtgaactgaaacattctttcgctatttgccgaaacattatttttatataagttgaaacaacaccaatttaaacgattggaacattttctatctactcagtgaaacaattccgatatacttggtggaacatcgtgcaacatttaaaaaaaaattaataataagctaaaattttttcgttggattatatccatgtgtggtcttgttttaaagatttaattgcaacgaatttaatggtgcaatcggatcatgatttagataaattacttaagaaaataaatagtttaaagtggttttttatgcatgtgtcatgctgacgtcagcgcccgattttcccccctccccatcgggcgcccgattctgagttgcgtccatatcactttggatcaccattaactttttttatccatctacctctaacttgtcatataccaaagaaatgatattgcatatgaccgtgagagtttattgataggtgggaactgacatactctagatcgttcatacgcttgataagagagtcgagatggtccaaagtgaaacaaagctaagattactcggtccaaactgaaaatattgattaataaatagtgatctgaagtgaaacatgggtaataaaacatagtccaaagtgaaatttactcttatttttttatcggtagttggttattgtacatacttgttgatttctttatgttatgttaggacgagaggatctgtggggaaatacttgtatttactcaaacacctaaatagttatgaaattgtttacaacatttcgacgacatacatgtattactccgcaatatcttaagcctaaattcaactcatacatcaagaaagagacaaatttaaagtatgaatatatatattcatacccaaatttatttccctagattatgtttgaagtaggtatcattctactctgtattatcaattttttctactaaattttcacaactattcttatgaattaacaactattctaatgaattcgaatgaaaaaggtaaaaggagacatccctttcttcgatcccacaactattcttatgaattcgattgaaaaaggtaaaaggggacatccctttcttcgatcccagttttgtcatcgtgttggttattgcagttcaagcaaaaggtcagcaaaataaattcgactttgggaggctttcataggtgagataataccccaaagagaaaaaaaatgtgggggcattttacaaagccaaccaaatatatatgggacaaatgagcaaagttaacaatgagaaatttcccctcatattgcatgaagaaataatgaataatgctggttcgctatgctgtagtacaaatatacaatgaaacttaaacattattaataattaataatttccactctaaagcattaaacatttattcgagcgcctaccactatgaaacttagggcctgtttgggggagcttaatattctgagaagcagctgttgagaaactagctagtgaaaatctggtgggaatctagagaagctgggaaacccagcttttggcttctagttcattttctagattctacaactacagattctcagaatctaggtaaaaagctagacagtttgaggaagcttctggcaactagagattctatgaaagctgtagctgctaaaagcttccccaaataggctcttagtagaaccaactaagctggttcatggaatcagttccagtcttacagaacttaagtacacagaaagatatataactatgacagctaactatttttttaaaaaaaaaagataaacaattgggctgctgcaatctctgcatcagcaaagtgctaagcacatcgcttcttggctaattcagcttgttaacttttcctgccttgatggaaacgccgggccgaaaccttctccgaccaggattaggagctcgagcttgttcatcgcctgctgtatcggttaacgcttcttcctcctctccttgtgaattatctgcaggagacgatgtttcgggaaagtcttttctgcatcagcacctaggctgaacaccacacgatgtgctttaagattcgcacgtacgcagtacccagctgcagtattccatctgctatccactttacctccatttacggcaggtgccatcgaaatacacaaggtgggtcccaccgtataagtctccctctctctctcacatgctccaactgcttgctttcgtattagcacactgcccgatcacacatcatctccactcctttatactgcacagctgcccctcttccagtcttccatttgtgttgggtagtactactattaaggtgatgtttggatccagtaatttaactttagtctatgtatttagacactaatttagagtattaaatatatactacttacaaaactaattatataaatgaaagctaattcgcgagacaaattttttaaacctaattaatccataattagagaatgtttactgtaacattacataggttaatcatggattaattaagcttaatagattcgtctcgcgaattagtccaagattatagataggttttattaatagtttacgtttaatatttataattattgttcaaacatccgatgtgaaagggatttaaaagttttagtccgatctaaatagagtctaagaaactttcttgttcaatcatcttttaatcacatcttttattcatccaaagaaatttcgttggtgtgcggcaaccggatgatcttcgccaggatcactggtgggtgtagttagtggtcaaatatttggatgcttggtttcaggggttcacattctctaccgttctctctctctgccctcttccagaatgttgcatattgcctcttccaaatcttcttcagagtttttagttttgttttagaagatttgtttgaacttcttcttattcttccaattttaaccaaaatttgttcatgaagacttatatgttgttgacttgttgttcaactgttgtgttcccttcctctatttctctcccttacccctctctctcttaatgttcttgttaaaagaatagatttctagttggcttgttcgtttctttttctcttgaaacaagatcagtgcactttttcgagagagaaaaaacctctatttctctcccttaccctctctctcttaatgtttttgttaaatgaaagagattcccagttggcttgttcatttctttttctattgaatcttgaaacaagatcagtgcacttttttgagatgaaaaaaaagaagaaacaagatcagtgcaatcttctccgcgagtaggatggacaaatattccaaatctaatttctctagaaaatgcatcttcttacccaaatgtcatcttgtgttccccgatctgttctccatctgtatctagaccctcctacttctctcacctcttgcatgcatctacttcactcatctctctttcacggaagcaggctgagggcttgaatttgtaatgtagattgagggacgaggaagaaatatcttaattgtcttcagtccataatctccctactcttttctctttccccccaaatttacctaaatttgataccccacaatggttcaatgatccaagcagtctggtaaatccctcatggttcttttttttcgacgtgaatccatggttccttttccatcttgcaattgaatttgtccccctttttgataaataaaaaaaatcatttgctgcaatgaaaattcacctcttttattgccaatagcaactttatgcagttgtaatggaaatatactctcatcattcatacttggttgaagtctctctctatctctctctcaaattcattttcgtctctcctcctgaggtgttgtagacggagatggatgtcaagttttctttttttttttccttagtcaatgtgagtcctctaaatttcgtttgtccaagaagtttgggagatagagacggtacgaattcatggaaaaaaatgctgagatgacgagcatgattttatatttgtttttgatctttgagctctggtaatgtgatttgttcattccttgttccaccacacttcggtgctttgttcatatggattcattgataccattcgaatctaggctgtatttagttcacgccgaagttaaagtttggttaaaaattgaaacgatgtgattgaaagtttgtgtgtataacaggttgatgtgatggaaaaagttggaagtttggaaaaaaactttggaactaaacacacccctaatcaattttggtgaactttttttctcataccatcagatattctgcacttcggatgcacatgtactctccccgtccaaaaagaaaggcaaaccctcggtttccgtgtctaactttgacagttcatcttatatgaaatttttttataatttgtattttcattgttgttagatgataaaacatgattaatattttatgcgtgacttgtctttttaatttttttcataatttttttaaataagacggacggtgaatcgttgggcacggaaaccagggtttgtcttttttttgggacggagggagtatgttttaaagtactaactaaaatagctgtgaggttgaattatcacccaaattttatgtaaaactcctataagtttgtttgccacaattcagtgggtcatcaattgtctttttttgtcttattggttttctcttctactacaagagcagagcagaggagtagtatgtactcctacaagagcagagcagaagtgttctggtttttctttggctcgaattaaacgacaggagagaggacgtgctgtcgcctcgctgtgtactccgtatgagtgtgtgtgtgagagagagagagagggagagagggagaggtgttctttttagctgaaaaattggagtcatcctgactgcaaaaagtccatctctgaaataattagtaagatttaagaactgcagacctcacggaattaatcattatgggtgtgtttagttgctgaaaaaaagtttaaagtttaaagaaagttgggagtttgaaaaaaaagttataaacttatatgggtaagaaagtttttgatgtgatatgatgtgatggaaagttggaaattagagggaaactaaacacggcctatattagcctttcgccccatgaaagcaaacctgcatgaatccatcttgccaatcttgggtgggtttagtttacgtcaaaattgaaagtttgattgaaattgaaatgatgtgacggaaaagttgaaagtttgtgtttgtaaaaaaattttaatgtgatgaaaaagttaaaaatttgaagaaagagctgggaaccaaaccagacccttccatcaatcctgtactcctgtcttttatcagcgctactaccattttggtgatattttacctgcatggaaccatggacttctacaaattaaaggatacaaataaataatcatccttaaactattcaaataacctcttcaatagccttgtactacctccatcacaaaagatatctatgacgggatttaacctatctaagataataaattttaggatgaatcaaatctcacgaggaaacaacaaagcctgtgtttagtttcacgtcaaaattgaaagtttgaagaaattgaaacaatgtgacagaaaagttggaaatttacgtgtagaaaagttcgatgtaacgaaaaaattaaaaattaaaaaaaatagggcctagtactagtaaaaagtctcgtagaaagtctttctgctctccctctctccactggtctggtgtagcagatgtcagtgcagtgggctccattgctacagcaatacagcatgcaaagcaatgcattgcctgaccagcagatgtggtgggcccggcacctagctgtgtacatgtacattgcaggttagatactacgagctgtacaaaagggtacgcgtattgcgtggaaagtcaggaaatacagcacgaatcactgcacagatcgacgtctcttagcttaggtgctgctgcacctaggtgcagaaaaaccgcgtccacgatgtttcttcttttttttcttcttcttgctcatcatcatcgtcatcggtggcctttcgcatcgcgtaacctttgcggtagtactgattcaggatcccgtctctatgcttcatgaactgatcgtcaatctggtttatctccctaaaaatcttggcgacgtaatcgtcgatctggtccatgggtacagggaggtcgcctttgtgatcagacaagtccgtgcatgctaacctctccttgcttactattgggaatatttcatctggcatcctgattgtctgataattgatgtagctgtcgatctcctcctgtgtcatcctcaccttcctccctgcagtcgtcttcttcttcttcttgcctccagccattgccggcgacggcggtttctccttctcttggttgggttggtccggtgagcttgccatgatcaaactgtcgcagaatatgcaagtcgatctctccgggatcaggatgtcacgatggcaccctgcaatattaattaattgttgtgggatcgattggatttgtgagaaacctagatatattcatgctgcttttatttgtagctccagcgcgctagctaggttggaattggagtcaagcctgccgacttgatccgattcctagctggagttcagtgtactcaattcttggatagaaatctgtaatttaatcgagttcacccccaatctattttatctacgcatcaacgaagaataacctgcacgaaagggctgatcagcgatcagccgcgcgcgccctcccccgcgcgactggacacgcgtcgtgtgcggagaggggggcgcgggcagcacgcggtttctccttttttttttttgattttttagtgttttcttcttttctgtttttttttcttttcgtatctctttagtccggttttcttttctttttttcgcatgttttttctgtttttttcctttctgtatctttttcagttttttcggttttttaatatgcacgtatacaaattttatatgcatatatataaactttacatacgcgtatacaaagtttatatatgtgtacgtacgggatgcaaagtttgtatacgcgtatataaaatttgtatttgtacgtacgtataaaaacctaaaaaaaaacacgtatatgaactttatatatgtgtatataaactttgtatacgtgtatataaaattggtatacatacgtataaaaacccaaaaatacacatatacaaactttatatatgtgtatacaaactttatatatgtgtatacaaactttgtatacatgtatacaaaattggtatacgtacatataaaaacctaaaaatacacgtatataaagtttgtatttgtacgtatataaagtttgtatacatatgtattaaaaacagaaaaagatacgaaaagaaaaaaacaaaacgaaaggtacggtagaaaaacagaaaaaacaaaaaaaaaaaggaaaaagcggggcgctcacaggaaagaaaagagaaaccgaaaaaaaagggaaaacgcgagagcgatgcgccgtccgccgccctatatacatgcagtagttagagaggagagactagaaggggttagaattgatcgcgcaccggtaaagagacacgatatattgatcgtccattagggctcccctaacctgcaaggcccagccgttcgtgcacaaacctatatgtatcgtaaacagcagtagctatagcaagttcggttctaccctttcctaacttctattcatttttcgtgtgtatggtttccaaactgctaaacgatattttttttcttaaaaaaaataatagaaaattttgtttaaaaattatatttttaattttttaagctaatacttaattgattatacaattaattatgagttaatgagtagctctgtttcgcatactcggaggaagagtttctaaccattacctatgtaccttcgaacacacctgacggagctcgtggctcctcaccgggagaccgcgcaggcccccctttgccagttcggccgggggcttagggtgaaatctcaagctctcactctctctgtatgtggaaatatcgtatgccagccagaaaacacgagacaccgacgatctatacaggttcgggccgctgagaagcgtaataccctactcctgtgttttggtggatctgcgtatgaatgagctacaagtgtgagctgacttcacccccgttctaagctcataatctgggaaagaatcaaccccctctctatgggcaaggtcctccttttatacttcaaggggataccacatgcacccttctctttccaaactggactgttctttttctcttgaatgggcggagatcagcacggttgctgtccgaatgacgctccgatgggacagcccacacctacctccacttccgccgggggtgagcgcgtcgtgggaacatggctgtgcgctgacgatatggtaagtgtcagaccggtcacaaatcggtcattcttgtccaccgcgtgtaatcttggcaacgtgcatgtttgcccttcttcacacaacatcttgcctgtaatggttaagatgaagcctggcatatatcgaccgggtctaacgtgtcatctctaagagataacacgcttaacgccggcttgagacgagtgactagaggctttcgtcttgacgggatggggcatggcgtgcgtcagaccgccagtcgccacctaacccgtgatctgaccggtctgtgactggtcacagaccggataaagggacgcgccgtgccgcactgcatgcagcgtgacacgcttgaccagactgcaataaatgctgttaggtgagcacagctgtgctcacttatcccatatacgtggcgcagacttcctaaagggggtcggggtgccccngccctcnnngccncngcaagcgcaacccgacccccccctcgggggaaatcaggaggagggcggacacctcaccctcgggcccgacgtccccgaaggtgccaggccacgtgggcgattgtgtctgcctcaagcctctagtcatgatactcccggtcccatatcaccgacagtagcccccggcgttatgccagagcaatttcccttcccaagggaagcggtcaggtgtgacgccactcctaaagcctggtgacaggtgggaccggtctgcatagttgggcaaaatccccaacggtcccagtccatgcacattggtattggtaactttggttgtccataatgggcggtctattcaagactgccacatcacttgagcagcgcgcgaatctgggtgagcagatttgtctcgcccggagatacggtaacgccgcttcggttggcgagcgtaattaacgcgcgcacgatacaatccgtttcgattgccacaaccgcatatccacttcaagcgccgtaagtgggcgaatgggattagtggaagcgtgggcacgggaaacgagggagcaagatagcgagatacgagggagcgaggtagtgggcgcgagaaacgaggagccaggcccagcgatggcaagggtataaaagcatcgagaaaaggatttgctcccttcctttcgccattgttcctcttgccttcgctgcctgagctctaactctttctctaccacgccctactttcgccacacgcgctcgttcccaatcatctcttcctccaccgccatggcacggggctctgctctgctcgacggcagtgtactgccgccttcccgcatcgtgaatgagaggcacgccggactgccgcgccgcttcatgccggagtccgccaccggtcgggagattgtgatgctgggcgaggggcgcccggcaccagactacccggggcggtccatcttcttcctccccttcgcaatggctgggctggtcccgccattttctcatttcttcatggatgtcctggagttctacgatctccagatggcgcacctcacccccaatgcggtgatgacattggccatcttcgcacacctgtgcgagatgttcattggggtgcgcccctctcttcagctgttccggtggttcttcaccgtgcagtcggtgtcaccgccatcggtggttggcggctgctacttccagccacgggggccggtgttgaaccgctacatcccctgcgtcctccgcaagaagtgggacgactggaagagcgactggttctacacccccctcgccgacgaagcgcgcctccgacttccgagccagcccccggcgcaggtctccagctggcgggcgccggtagatctgggggaggagtacgacgccgtcctcgaccgcctggcgggcctgcgatcccaggggctcaccggggccatggtgtacggcgattacctccgtcggcggattgcgccgctccaacggcgcgcccggagcgcctgggagtacactgggcctgaagactacatgcggacccaccagggagccagatgtgattgggctcctgaggacttcaagatcgtagtccaaagggtgctgaatcttagctccgcggaggcgtctcgccttcctcaggagatcctccccctctgcatcgatcccgaccgcgtctccattctaaccattatgctgggggtcggggcctcagaggagagagcccctaagggccacgacggcgcgggcgagagccgcccggggaaaaaatctgccccaggagggggtcgtgcttctgggccccgcgtcgggggctcggggagcagccgccctgccgacgccccggggaagaggaagctgggaggaatacctcccccatctcctccccgagggggcggggcagtgcgtaccagcggtcggcgcccggagggggctgcgccgacgtcacagcccgagggggagcgcaagaagaagcggctccgcaagatgggggagacggaaccagcccggggaaacctaatttcccctccaaggtggtcattcaaccgaccccctcgcaggttcgtctcattctcattgcgaccacctttctcccaaagagaagttttttcttactcattttgttcgtcttttggttttttcttctgcttcagcgatgtcccgtcgcattcctcccgccgccccaagtccggccagtccgaggtcgaagatccagcggccgcagaggagcggaggcgggagtctgaccggcgtgaagccgcagcccgccttcgggaagctgaagaggccgcccgggaggccgcccgggttcgccaagcggaggaggctgctcgggaggaggccgcccgggctcgccaagccgaagaagctgcccaggaggaggccgcccgggctcgccaggctgaagcggcagctgctgctggcgcgtcactcgggcccactccctcgggcggccctcaggcgacatcctccgaggcggctcgcgacgaggccgcgggcgcgtcgcctgggcctacctcaccgggcgacgcccaggaccaaacgggcccgggggacatccccgagcccagcgcatcctccggggggccaagccgcgtcgccttttctccaaggcggcttttctcctcttctctcgtcgccccagtgagcgccgagcccattatgcaggccttggccgccgcaaacaccgcggtgctagatggatttagcgcccaggtggaggccttgcgagcggaacgagcggagctcgaggccgcatgggcgcgtgtcgaggaggggcggcgctcggtggacgccatggtggaggtgggccgtaaggcccaccgccgccacatctcggagctcgaagcccgcaaggcggcgctggcggagatcgcccgggaggtggaggaggagcgagaggccgccctcgtcgccaccaccgcgatggtcgaggtgcaagacaccctccgtcttcagcacgcaagctgggaggcggagctgaagagcaagctcgacgccgcccaaggggttctcgactccgccgctgcccgagagcggcgggcaacggaagccgaagcggcgtcccggcggcgcgaggaggcccttgaggcccgtgccatggcgctggaagaacatgccggcgccgtggagaggggcttgatggaccgcgaggccaccactgctctccgggaggcgacgctggcggcgcacgaggccgcctgcgccgaggaggagtccgcgctccgccttcgcgaggatgcactcgccgagcgggagcgggctctcgaggaggccgaggccacgacgcgacggctggcggacagcctctccctccgcgaggcggcgcaagaggagcaggcgcgccgcaaccttgaaagcgtccgcgccgagagagccgcgctggagcagcgggctgctaacctcgaggcacgggagaaagagctggccgcgggggcgcgcatcggtggggcggctgcgggcgaaagcgacttagccgctcgcctcgcggctgccgaacacaccgtcgctgacatgcagcgcgcgctggactcctccaccggggaggccgaggcccttcgcttggcgggcgagattgggcccggcatgctttgggacgcggtctcccgcatgaagcgcgccggtcggcaagcaggcctctggggaggccagacgacggtgccccccaccaatctggaaggcctcgcaccgcacctcaacaggatggcttgggttctcgagcgactccccgaggagctcgagaagaccattaaggcatcctcgagggacctcgcccggggggcggtcgaactcgtgctggcgagttaccaggcccgggatcccaacttctccccatggatggcgctggaggagttccctcccgggaccgaggacgaggcgcgcgcgcgggtcggggatgctgctgaccacatcgtcaacggcttcgagggctcggcccctcggcttgcgttcgcccccagctccgacgaggaaggcgacaccagcagcgaggacggcggtggcgacgaggccggcgacccgggcgcatatgaatgagcccccaggcccccgccactcttatcttttttcttgttctttcttctaaggccttcatgcctcttttttgtacaattttaacttaatctgcaatgagaaatgatgaaaaatttttgtgttagttttattttgctatatatatgagttgaggatgatctgtgccatggtccttttgcgacttagcttggaataagggctcgcgcccaagtcccggtcctcgaatggctcgggtcggggctagtgcctggggagatccgcatgtcgagactggccaggccgggaacgtggtgaccgaggggtatgggtgacccgattgtgggtttttgccgattcccccccggagttcaccacgccccggggcacggctcggttctgggccccgtttggcgattttagccgaccgaaccgagcccccgagggcaaggttgagcacgagtgacattatttcaagtcaagattcttcaaaaggaaaaaacggcacagacacaacctttaggaaattgaaactgcttctattgaaatgctgaaaggaatatatatgcatgtgtggtagcccccggctaaccctgcacacccgaggggggggtgcggggttagcccgagccaaaacctgacacccgaccccccccttcaggggtagaagcgacgaaggtgttcgatgttccatgggtttggcagctccgtgccgtcgcccgtggccagccgtaccgagcccggccgggggacaccgatcactcgatacggaccctcccacattggtgagagtttgctcaatccagcacgcgtttggacgcggcgtaggacgaggtcgtcgacgcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggctcggtgtggttcggttcgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagctcactagtgaattgggtgccattatccgtaataatacggttaggcactccaaaacgggccgtgatgcccttaataaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatgaatttgcttggcgtggaactgacacgctctgcatcgccggaccagatcgactgcgtcattgagagctgtcggccaataaaatccttgacgaaaggccttgccaaccagggtgcgcgaggcagaatgggctccgcactcgccctcatggatgtcagcaagaagctcaacgccttgttcctgaggaatgcacttcaggaggattccattagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggaacgctctcttcgggtcccgaggcctggactccgacgggcctcgggtgccggtcaggcgcatccgtctcccctaaggggtcgggtcgcgccgacggctgggtaagcctttcttcaaaggcgcctggtggggtctgggctcgcgaggacgcgagccttgagagttcatcggcaatcatattatcccgtctgggcacatgccgaagctctatcccgtcaaaatggcgctccatacgccgcacttggcgtacgtaggcgtccatctgtgggtcagagcaccggtactccttacagacctggttaacgactagctgggagtcgcctaataccaagaggcggcggatccccagtccagccgccactctgagtccggcaaggagtccctcgtactctgccatattgttagtcgctcgaaagtcgagacggaccaaatatctgaggacgtctccgttcggagaggtcaacgtgacccctgcaccggcgccctgaagagacagagaaccgtcgaattgcatcacccagtgggcggcgtgaggcagctgtgaggggttcgcgctggcctcgggcattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttccttgaggccatcagaatagcgtaaagcatcttctgggcctgtgggtatcgggtcttggcgtcccggagggcctcactaacaaagtagacaggccgctgcacctttcggcggggccgatcctcctcgttaggggccgtacccccggggcgttcttcgtccaagtggcccctcggggcgcactcgtcttctgcgctgatgacctcggggtcggaggatgacaggagcggccctcccacagtggcctcggggccgtcctgggggtcggggactcctggcatcgtcggacaagcgggcaaagggccaactccggtcgtcaggggcctctggcctccgttcggctcgggggcctcttctccctgctctttcccgggttgagtcagcacagggttagcctcggggccaaagggctttaagtgcagccttccctcagtggcctcggggccttcctgagggtcgggggcacccagcaccgtttgacaagcgggtggagggccgactccggtcgtcgggggccttaggccaccgttcgactcgggggcctctcctccctgcctgctctcgggccaagtcggcacagagcgggggtgcgcagaatgaggattgtcctcatcgcgctccacaaccaacgctgcactaactacttggggggtcgccgctaagtaaagtagcagggactcatttggctccggggcgactagaaccggaggagagctaagatacgccttcaactgggcgagggcattttcagcttcctccgtccaagtgaacggccccgagcgcttgaggagcttaaacaagggtagcgccttctctcccagccttgatatgaaacgacttagggcggccatgcaaccggtgacgcattgcacgtccctaagtttgctgggggggcgcatccgctcgatagctcgaatcttctcggggttggcctcaatgcctcgggcagagaccaagaacccgagaagcttacccgcaggtacaccaaacacacacttatcggggttcagttttatgcgggcggagcggagattctcaaaagtttccgctagatctgaaagtaagatctcttggttgcgcgtttttacaaccaagtcatcgacatacgcctcaacattacgtcctatttgactacccaaagaaattcgagtagtacgctgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccgggtggatgacctcacgaatgaacccggcctccaaaagtctagccacctcctcgcggatgaaagcttgacgttccggggcttgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaaaaccaccgatccgtgtggtcttggatgggccgtcgcccaaggcaacctccttgaccgggacctcgtcgcaagtggccatccgctgcctcggggcggtgggggcagaagggccaagcctctcgtcaccaccctcgggcttggacgcagcagcgaggcggtccgcgcgctgctcaatgcaagcaagcgcgactttaaggtcgccacggacagagatggggccaccggggcccgacatcttcatctggaggtaggcgtagtggaccgccgccatgaacttcaccaacgcgggtctccctaggaccgcgttgtagggcagactgaggtccgccacatcgaagctcacccgctccgtgcggaagttggcgggtccaccgaaggtgaccggtaggtcaatgtgacctaatggccacgtgtgccccggcgtcacaccgatgatcggttgagacggctggagcaccatccccggggccttgatagcatcaaaggccgcgggggaaaggatgttgagagccgctcctccatctatgaggacacgtcccaacttcacgttgcagatggtgggggaaaccaccatcgcaacctgccctccccgggcaatgcacggtgggtggtcagtctggtcgaaagtgagagcgacctccgaccaccgcgcccgacgcatcgcctcatgggtaggggccatggccagaagctctcttttcatagccttgaagctccggcgagagacgtgagcacacgctcctccatcgacggtggcaatggtggccccaggttcttggaaacctaggtcatcatcaccatcatcgatgtcaacagcgggggccttctgcttggcctcacctcgccgtttgccggatggaaccaccggggacttgccctcacggcgttcctgcctcctgtcctcctcccacttcctcgttcgctcagccaggtttttgactgcacgacagtccgcgagatcgtggagggaggtgttgtggacggagcaccacctgccggcggggcgctccctgccgggagttccggcctctttctttttgtcgctcgcaggcctcccctttcgggtggcccgcggagcgccctcgacggcgaggacatgaccctcgtcgccggaacggttcgacctcttcttcctcctcctatcacgccgccctgtctgagcggcggatccgggggcggccgaagctgccactccggaaccggaggagttccaggtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcaatcccggtcgtatagacctggagaaactcggtggggttgacgctcccatcgtacttctcggtgatggtgggccggaaccttgggggccaacggacgttccgaagactcgccacaaaggctctacagccaacaccaccggccgggggcacggagggctgatcttcacgtccatgtcggggtgacactctggacgaggaggctccctccgttgcacggggagtacgccggctattacaccggcgcccgatgttgaggcgggcatccggctccccatgctgatcctcccgagtcgacggtgtagacgagggagtggcagccgaatgacgtgcagccgccgccgctcgccgcgccctccgccttgatgacacggagccggtggtagcggcgccggaggtcttggtggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcttgaagcgcaccctgaggcgtgctgccgtcgccgtagacgaggaggcgacgctccccgtctcgccgttctcctgcatcacctgcggccggtgacgctgcggacttgtcgaccctctcaagcgcctccccctgcttagggctttggcgcggagggggtggaggagtacgagctcgacggcgtggattcggctccccgtcgtcgccgctcacactcggcgagaggtcgtgcgtttttccttgctcggccattaggctgaacaagaaaaacttggggcacacggaagagtctgagagctctgaaagcacacgctgagccccctacctggcgcgccagatgacggagctcgtggctcctcaccgggagaccgcgcaggcccccctttgccagttcggccgggggcttagggtgaaatctcaagctctcactctctctgtatgtggaaatatcgtatgccagccagaaaacacgagacaccgacgatctatacaggttcgggccgctgagaagcgtaataccctactcctgtgttttggtggatctgcgtatgaatgagctacaagtgtgagctgacttcacccccgttctaagctcataatctgggaaagaatcaaccccctctctatgggcaaggtcctccttttatacttcaaggggataccacatgcacccttctctttccaaactggactgttctttttctcttgaatgggcggagatcagcacggttgctgtccgaatgacgctccgatgggacagcccacacctacctccacttccgccgggggtgagcgcgtcgtgggaacatggctgtgcgcgacggatagggtaagtgtcaggaccgggtccacaaatcgggtcccattctgtgtcccccggcggtggtaatctgtggcaagcggtggcatggtttggcccttcttccacacaacatcttgcctgtaatggttaagatgaagcctggcatatatcgaccgggtctaacctggcattttttaaaaaaaacccccctaaaccccggttggaaacaagggactagaggctttcgtcttgacgggatggggcatggcgtgcgtcagaccgccagtcgccacctaacccgtgatctgaccggtctgtgactggtcacagaccggataaagggacgcgccgtgccgcactgcatgcagcgtgacacgcttgaccagactgcaataaatgctgttaggtgagcacagctgtgctcacttatcccatatacgtggcgcagacttcctaaagggggtcggggtgccccggccctcggggccagggcaagcgcaacccgaccccccccccccctcgggggaaatcaggaggagggcggacacctcaccctcgggcccgacgtccccgaaggtgccaggccacgtgggcgattgtgtctgcctcaagcctctagtcatgatactcccggtcccatatcaccgacaacacccttagaacaaatacaataaaaatgtttaagctaacgataaaactatccagctcagcattatctcatgtggaggatagagaggagatgtgagagagaggagcaggtagttatgcaagagactgtattggcacaaactcctactccctccataaaaaaagccaacctagaacttgaatgggacataatctagtacaacgaatctgaacagacctcttttatcctccagtcccacagtcgattttcttaacatttctatttctattttaaaaataaactgttctaaaatttatttttatatctaagtcttttggtcacaccagtacaccaattggactagcatgacaaaacaatgcttctaccttgtccaacataaaattgtcacgtctctttatttttgtcatgccctctatgatatggtgcggtcgaaaagttaatatgttttggagggcttattttacaaataaaatattagaaacgttgaaacaatataataaaagttccgcacaatcccacatatccgatgatgcaggcagcaatagtgtgggtcagggtttaccaaacagattagggtgagggtgaggttatcgctacctcgcggtttggtggttaccacggtaaccatacggttatcacgagatataccgtggtttcaaaactgaaaaagttaccacacgtaataaccgtgcaataaccatacagtctggtaaaccctagtgtgggcgcgattgaccggtcgagcagagctgtaaacagacgtcatctacttctaatagcctgtttgcttgcttgttgtttaccgttgcgttatgatgttgttggttgcagctgtggcagcttatctgcattgatatgtgggttttgatgtatgactatcactaactttatcatcacacagaagtgcccttttgatacacgttgggggacaatgtttagtggatttaaaggagtaatttaaaatagaaattgaggtaacttcgttctttcttatgctattatagaagtaacttatagttaacaagttttcaataactttttcttcatatgaaagtagtaacatttaattcaactgatttggaactaaggcctggtttagttcctaattttttttccaaaaacaatagacatatgtatggagcattaaatatagattacaaacgctaattgcagagttagggaggaaatcgtgagacgaatctttggaatctaattagtccatgattagtcataagtggtatagtaatccacatgtgctaatgacagattaattaggctcaaaagatttatctcgcgatttccaggcgagttatgaaattagtttttttattcatgttcaaaaaccccttccggcatctgatcaaacatccgatgtgacaccctaaaaaaaattttcgtgaactaaactgggcctaactagacacaaacttgacgaatcgcaatttctgcagcttcacaatttcccaatgttcagggctataaatgcaagtttcagttcatgggagtaaattttagaaataagacaaacttcacaagttgaaattcctgcacaaactatttgatgtgccccagcccccgtcacatgatgatgagcacatcccttgctacaattgacgtaaacaagggtgatggtttacgtcatacatcacatgaagaaaatgaagatgacgtaaaccaacttgatggattacgtctcagtaagaacgatcaagcatctcatggtccaattatgcgcagccgtgctaggaagatacaataagaggtgaactcgctctttgcttaacttaacctaaattttagtgagaattttatactacataaatgctctacatttgtattgctaaggtttacgcccgaggacatcatcactacgcaaagaaggatgtgttacgttgaagactacaagggttacgtcgagcaggaatcagcccatgcccaaccagtagctgtctacgccagcaagaagattgtttacgctgcaaaaggctcaacttccaaggcttgtgcgacccaaccaatcatatttctccatgcttaatatatatggttggaaagataatcaagtctagtttcaccttcaacaaatggcttatcatttcgacttcctaataaggagttatggacaaatcattgagtactgctcagaagccaaacagacgcataagtcttctcgggaattcatttattgtgaccttcgagctagcctatatactgtaaactcccaagacctttcattctcatctagaagggttgttcctagtataaatatctcctatgttttatcatttgaaagacttttgacaatgaaaatatgaaccccttttgtttagttgtgtgctaataaattcaaagagagatctatacccctttgctcttgtgatttccttgtgagattacagaagcggcattcaacgcctcccaattgatgctcctggtcccttcgaggtttttccttggttgattgcaggttgtgttggttggtaacttaaagtgtggttaggcgaaccctcgattcaggttgccgtaatagagatggtggttggcttcgagtacgatcgccagctgacactattatcttggctgcttgcagctagttatcttggtctctttgaggctagttatcggttcttgatcctacgccgtgaagatcgtgacatcacccctaccaggatcgtatcactattttttcagactgaccgtagacagaccgaagtacaaaacttcaaaacatgaacgcagttagactgaagtaaaaataaaaaacaaaaacaattctttcagtagatttaatgtaaacatgaatgtagtcctgaagtaccaaaaagaatcaaaataaaattttaaacattgaaataaatctttgctgctcaaaacatgaactcagtcggagtgactgaatgaaaaaaaattaaaaaaatagtagatttaatgaaaacttgtgaagtaaaaaaataaaaaaaaatattcaaaagtttgactgaatgaaaaaaaattaaaaaaaagtagatttattgtaaacatgaatatagtcctgaagtaccaaaaagaatcaaaataaaattttaaacattgaaataaatctttgctgctcaaaacatgaactcagtcggagtgactgaatgaaaaaaaaaatagtagatttaatgaaaacttgtgaagtaaaaaaataaaaaaaatattcaaaagtttgactgaatgaaaaaaaataaaaaatagtagatttaatgaaaactcgtgaagtaaaaaatattaaaaaatattcaaaagtaaaaaaaaaataaaaacatttttttttgctggctgtggggttcgaacccacgcgcactcatgtgcagaagatcttaagtcttcccccttaaccactcgggcaaaccagctgaatgcttattaatttcggttgttgagtataatcctatataaaaatccaagccacagtcgacacatcactagtttacatttcagccatatgctgtattccactttcttcgatcggtaccttatcatatcgtattgcaaagaagaaactgttgttcctcaagaaaagaataattatatcacatgatatttttttatctggaaggaagaaagatcattttcattgcaaaaatgattcggccttttctgatatcacataataataataattgtacacctcagtttaataatcctaaagaattttgaaccctataatatttacgaaccagaacacccccaggccccaccccaaaaaaaggtttcataattatttgttttaaaactgaacaatatacaagattgaaatgataaaaaagccctcctataaaaatacatgtggcgtggctaacccttctaagctaactcattcttttggctattgttcttgatactcacttatttttaagattaatttgatctataccattataaatatgtcataatagaaaaataccattacaattcgcgatatcaactgttgtgtgccattgaaattttctataattggaaccatgccactcccgatactctttgtcatcctctctctcgtcgccattcttaccgttgcctcccaacaccgaagtcgaagctctcgtccccaccatcggagtcgaagctctcgtcgctggaaccctataccgccatcgtcgctagagctctcattgtcgatgcctccgtcagcggggaaggaggaggatgcagttgcagctccatcggcaaggagtggggtggtgctagtgcatgaagttgaggggagaccaacctgaggtcgccgtcggaggtgaagcagcttcgaggctcggttgtcgtgttctccaccctcctctccatgcgtcgtaagccgcctaacttgaggtcgtcgcgcggaggtaaagatctgggacggccaagctccaactcctccctctgcttcgatggccggccgtcatctccttcgttctcctttctgtgcgtcggaagccgtctcctctaaagtggatccggtaagccaggggatgatggtgacacacggcaaccagatcctcccgccttgaccctgagggcagtggatctagccacccccgtccatgacgctagctacctccttgtctccctctccgccccaagtgccaaccatcgactttgtcccccgacaccgccttcacccatgagcactcgccggtgctgtctccgtcctcgacgatgaggatggcgatgagtaggagcaggagtaggaggcacacagccgtacggagcctaacctcgtggtgctcacctttgcattcgaccccgctcgccccatcctccgctccaccctgcaacagctcaatatagaagaaaaagaaaagaaggaagaagaggcaggatgacagggagaacaaatgggagttgacgacagtaacagaaaattagatgagagtggacgggagtggcatgatttcaattttaaaaaattttagtggcatccagccgataacacgaaatataatgaatttttcaatatggtatatttgtaatagcatatgatctaattaagagtttggattatttttatggccctctgtcattttcaatgtatttataagtgcaagatttttttaaaagaaattatagagatgttggaagtaacatatatgtcttgctttgaagagtacatgaatattacggttgattatttatctaatcatatatatagaaccacgatcatatacattatcttcctagcaacatgtgacgcgttttttttataatggaatagaacatcctgacctttgctcaaagagttacagtaaattattacaatctcgcactcaaaatgagaggagtttaaagtgtggggattatggataccccatatctatacggcatatatagtccgactgggtacggggtaccagatataaatagaatatctttaagaggactcgggttaggttctaaacttgtatgtcaaggaaatatccgggatcctagtcggttacgattgtattttatctgtaatcacatattccgttagggatatggactgtattttgtaatacggaccccttcccctatataaggaggggtccgggtccctctggggacacgattttctcccagatcatacgatcaataatacactcggcggatcaatccccggacaggagtagggtattacttcttgattaagaaggcctgaacctgtataaaattccttgtctccaaacccatccacttttctagcttgatagccaccctcttttagtattgccgaaatcttgtttcaacataaagaaatttaaaagacgaaaccaaccatcaagaagaaacaaactaaagactgttaaccccaaataaagagtacacaattattgaattctgtttgtgagcctccatccaaaattgacaaaaagttacataaccgttgactcaagaatatgacatgcatcctacatgtgacgtatttgccacatcacatgccttgtcatgtttgtaatcaccaatagaaaataatacatgtgccacttagaactctactccctccatcccaaaataagacaacctactctgtccaaaaaagacaacttagtaataggatgtccagattcattgtcacaagctagtactaggtagcttttttttttgacggaggtgttcatttgaccatttcatagcttatatgacttggggcctgtttagatcccaccctaaaattttacaccctgtcacatcaaacgtttgaacacttgcatgaagtattaaatataggttttaaaaaataactgattgcacagattgcgattactttgtgttaatgaccaaatttggtaatatcagtatcggggatgaagattagatcgaagcggaatcgaagatgaagatcgtttcagaaacagagtaagaatcggctggagtccaaatcggctacgaccagggtcggttgagttcgagtcagactggataagccgatacagccgattccgacaatatgactcggtatatatcatcgggttgagttaatgtgcttcacgtggattgccacacatggattgagtcctaagaaggcaattgtatctattaattaagatattttatgtaatttccttagagataagtgtgggcaaaagtctgccgcaaagacttatggtatttagagttttttagagataatagtcgtgtccgatatggacatatcttgtaatcctcgggtataaatagacccgaacctcatgtaatcaaactaacacacgttcaatacaatctcggcggatcgccacccttttcatacttatagctgcatcagttgagtttgatcttatgagtcgtaattagaatctcaatctctagtctgccttttggttgccgattagggtagcgtcggagtttcagccgatcttacctgatttaaccatatttatttcatatgcttgattgacacgttaaaatctgccctttatgctaagatcttgccgcaattaagtatattaggcttttgtttagtatattctacttgctttaacatcttagtatagagtggtatcggagtattagccgatacatgctagatctatctgatcggctatgctatgaacgtgtatagcctcgttattaatatatatttcgatctaagtgatttatactgtctcggcatgacgatcgatctatcccaatcacttgatttaagtatatatcgatatagggattatatattgttaatatctacagccgatcgagtagatttagttcgttcatatttaataatgactgtcgatcgatgtagatatgacatcggctcaaagataaatgatatgtcatcggcacttagccgatcggctatcgtttattgatttaatcgcagtttctttgtctttgtttcttgttgattgcaggatcaaatcaactggcacgctagcatacctgaaggcgagttttggacctgcactagagttaagaagatctcccaggcctcgtgttttacatcaacactttgtgagaaatcttttaagcctaattgctccatgatttgataatatggtgctacagtaaatatatactaatgatagataattaggcttaataaattcgtcctgcggtttagttttttttataagggtccgaacaccccatgcaacaccctatataatacccgatgcgacacaccaaaactttacacccctaaatctaaatacccccttagactactatag

SEQ ID NO: 43321 - DNA, 21224 bp, Oryza sativa
taaaacttattcccgtcccggatgacacctatcagtgacgggccgtagttaggcccgattgagataacatttcatttctcaaacgggcctaaagttgcggcccgtcaagatgaccatcaactgtgacgggcaccaactttaggcccgattgagataacattgtatatcttaaacgggcctcaagttgtggcccgtcacagatgaccatcatccgtgacgtgcaccaacttgaggcccgtttgagatagcaactaggcccgtcacagatgactcatcagtgacgggctatatacttaatctctatcgggtattaactaaagcccgtcaccgatgactatttttttcatttttcatatgaaatgtttatatttgtaagttgaactatagcaaaataattaaatgcagtataataattcattttatgagtcaaaataattttacgggtagtaaatgatttcaaatggaaaaaatgtcaacaacaaagttgtataacttatcaagatttacaacttttagtttcgtcatttttctatataaaattttttttgaacactttgaatttgaatttgaaaatataacaaattcaacaacattttcaaatactaaacgatttcaattgaaaaagtcatcaacaacaaagttgaataactcatcaagatctaaaacttttatttttgttatttcttcatccgacgaaatgttagtaatattattcacaaattttacatatatgtgttatagttttataaaaccagataagagatatgtcaattttgtgaacaatgttactatcactttgtcgtatgaagaaatgaccaaaataaaagttttagatcttgatgagttatcaactttgttgttgatgactttttcagttgatataattaatatttgaaaatgttgtttgaagttgccatatttttaaattcaaatttaaacggttcaaaaaatgttatatagaacaatgaccaaaataaaagttatagatcttgatgagttatacaactttgttgttgatgaatttttcagttgaagtcgttcactgatctaaaattctatttaaacttttcaaactttgaatttcaaatttcaaattgtttaaatagagtcatatggagaaatgaccaaaataaaaattttgcacctcgatgagttctacaactttggttttggtaactttttcatttgaaatcatttaataaccccaatttgacatcctggcttagggcttaataagattaatagaataatcataccaacaagttacaactatttttccggaagccaatctccaaagaaacttgatgttaagcgtgcttggcttggagcaatttcacagtgaccgaccgggaagtttgaacttcaagtgaggacaaaaaaagactagcctaggaggcctgagactagccaaaaaataaaatttatttttttaattatactcatatgtgacgggcattaacttaggcccgattgagatgatggtcatctgtgacgggtaatgcccgttacagataagggtcatctgtgacgggcgctagttgtggcctgattgagataggtcatctgtgacgggctataatttgactggtcgtctgggtcaaagctatcggtgacgggctttaattaggacctgattgagatagatttatccgtgacggccgtttgcccgattgagataactcttcacatctgtgacttctagcctgtgacggacgccgtgcccgattaagatggggtttaccgtccaattgagatgatggtatcccttctagtgttagtttgaagcactcctgaatcctgaacttaaagcgcttatcccgtctcaaatcacaagaagttggaccagctacttccggtcttccactttattaagcacgtgaagtcgaacaaagaaagagtccatggcattattacaattatatattatataggacaatttaaaccatgccacacaaaatttgtaaaattttacaaaatttatgatatgccaccctgatccatatgtcattgactcatgtggattctacatgacattgggaacgtgtggcatatcttaaattttgtaaatatagggtggcatggttccaacaaacccttatattaatacaaactttaatatgatacatagtacagataagatgatctatgtcaccgatagctaaatttttctggtgaacgtaaagggacctagaaagtaccaaattaatatgatatcgtggtatagacatattgtgtacctgaaatgaaatgaacatatcttatatatacagctcagagcgcaaagaaaaactattatttctacaataaaaataaataattatatcactgaacaactactctctccggggccataaaaaaacaaatctagaatatgatatgatattttctagtacaataaatttagaacaccgcatctcgtttatattgttcttttaacatcatatctcgtctgagattggttttttatgggacaagggagtacacctcagtttcttaagacgtgtttagatctagtggtgaaaagtttcggcgtgtcacatcggatatacggacacatatttaaagtattaaacgtagattaataacaaaacaaattacatattccgcttgtaaactgcaagacgaatttattaagtctaaagaatccgtcattagcaaatgtttactgtagcaccacattatcaaatcatgtagcaattaagcttaaaagattcgtctcacaatttacatgtaatctatataattagtttttttctatatttaatattttatatattgtccaatcattcaatgtgacatggtaaaaaaaaattttcgtgggaattgaacagtgccttaatccgaaatctgaaacctccatcatttaccaaccaaatcttattaccgaaccccaaaaaagaagtctcctaatcattttcttcaaaaagtaaatagtacaaggatgaaatgacaaaaagcgccgcagcataaaagtataaaaccgcgcgagcacgcaaagcgcagctcactttcgcggcatttcttacatctcgccccctccaattcctcccaattcacgactcgcccccctccccttccccaccttatctccggcgatctcctcgccgtctccggcggcgggggagagatgcggggggccgacctgatcaacctcctcctcccggacgagatcctcgacgaggtgctccgccgcgtggccgtgtccggggccaagcgggacctcgacgcgtgcgccctcgtctgccgccgctggcgccgccacgaccgcgccacccgccgctccgccaagctcgccgcgtccggggcccgcgccgacgaggtgctccgcctcgtcgccgagcggttcccggcgctcgtcgaggtgtcggtggacgagcgcatcagcgtcgaggccgccgcggccgggccctcctgtgccgccgctagatcgcgccgccgcccggtgggttccctccatccctatccttgcttttgtggctccgtacgcgaattgcaggaaatgtagaggatcgtagagatgttttccgaatcgggattatgaggagatttagaattttgggagaaggttcgcatctgtcgaaggttttgtaggggaattgggggcaaactatcgatttcttatcctgttttgaaggtagtttgatcgatttggaccttacaaatccgcatttctcttggttggatgcagaatcgtgataactgataattctcctggggattgagttgtggtatccatttgtacatagttgtatgagatctgcatttccatgacttgtacaacagctgcatgcaaataagtaatgtgtgagttttgcatatgatcagtttgaaaaaccattgctatgtgtccaccagcttagtagtgattaatgattattatacggcaatatatatgaactgatgtgcctcgatgtcgtcctattacctgccgctagattctttaatgaaaactttctccttgcagtagattaacatagccttgtactgatgcactgatgcgatacagatgtatgatgttagtccttccgggcgccgtaggaggatgtcccgcagctcaaatttcggagcccacatgtccccatttccattggaccagccgggcagtgataatgagacagagcgcacttgcttgactgatgttggattaactagtcttgccaggggttgcaaagggctcgaaaaactaagtctggtatggtgttcttccataacttcgacaggcttagtaagaatatcagagaattgtaagaacttgagttcgttggatcttcaggtaatgtcatgctacccgttcctttgcttttttctcagttatttacttcatcatctctgaattctttcatgttttttttttcttgaagacttctatgcctctgtattaactgtgagtgtccaatgtaatatttacttgtaatacggtatatgaaacctcacaatacttggaacaagcattattcctggtgattagcagcagtcttctctaattatgaggaaatggtgtatctgcatgccaaatatgctgttaatgtagagactaattatgcacacaaatttttgacctgtctaaatcacaattttttttctgcaggcttgctatattggagatccaggacttattgctattggtgaaggctgcaagttacttcgtaatttgaacttgcgttttgttgaaggcacttcagatgaaggcttgattggactaataaagaactgtggacaatcacttgtctctcttggcgttgccacttgtgcttggatgactgatgcatccttgcatgctgttggatcacactgccctaacctggaattcctgtcactggaatcagatcatattaaaaatgagggagtagtatccgttgctaaaggatgccgcttgttgaaaactttgaagctgcaatgcatgggtgctggtgatgaggccctagacgctattggtttattttgttcattcttagagagtctgtcactcaacaacttcgaaaaattcacggacaggtactaagtagaattgtaaatcaatgccacaatattttatagaggcatattatccgactttgtttcacattcttgttttgcatagttctgtcaaatcattatgtgctggccagaaaggaagggtactaccaagttatatggaattagatataggatacaaaatgttggactagttattgcaccagcctgctgccctgctggaatgctaaaagttaggtgcttatcctaaggtgggaggtctgttggtccaacactcttaactatgttcaataacatgggaacatttatcaactaactggactgttgactgattaaacacactagcccattaactaacatccattgtttgcagttgtgatgtttttgttgctgcaccaacttaggaattaatttgcctttaagataagtttcgaatctactagtttgacaatttccagagtatagatattcctttatcttgacataattctcctttgctgtacattacattcttggaattgctgaacttcatcaggacattagtacattacaaatccatacctgttttctgttgaatcatttctcttgtactgtaggtgtttgtcacacattaattcttactgcttccaccttgtgctgcttcattaacttttaagttcattcaattattcacttacattttcctttggaattgcaggagcctttcttctattgcaaaagggtgcaagaatctcacagatcttattctcaatgactgccatttactaactgatagaagccttgaatttgtagctcgtagctgcaaaaaattagcacgcctgaagatcaatggttgtcagaatatggaaactgctgcactggagcacattggacgttggtgcccgtatgtttcttgctgacaactcaatatattaaaagttcctttcttcacttaaaatctatatattgcctttcctgttttaatttatttctctatagttcacataagtgagcagtattttagaatgaagggtaattcaagaaaaggttttagatgcttgatccataaataaactacaatatggtttctgattacattggcacattggcaagagtgtgggttaccctaccttttacttcagaaaaaaaaaagtagttgttgcactctggcattgttatttaattatcttacctgcatttttagagctatgtcatattgatattttgttgcactaacagtagatgatttgctttctgtcaaaacaggggtcttttggaattatctctaatttattgtccaaggatccaggacagtgcatttctggaggttggtagaggttgctcccttctcaggtctctttatttggtcgactgttccagaataagtgatgatgccttgtgctacatagctcaaggttgcaagaacttgactgaactttctattcggcgtggttatgaggtacttttgacatttgcatagatattctgcaactagcatacatggtgaaatatgtcaaatataagatttgacatgttttacaattaaagtgttagatggaatgacatgatttggttattaccatctttattcttttaccatatgcagcaatgagaaaaaaattcaaatatctttagttgattgaagttcattttgtatgcagataggagacaaagcattgatatcttttgctgagaactgtaaatcgcttagagagttaacactccaattttgtgagaggtaaatattatcatgcatttaaccatccaatttatctatcttgtccattactccatgcacatcatccccttaccgaagctcattataattcttgttacactttgttgaatgattggtattaggaaacaacttagattcatagattgattaatcatatcttagcctattaggagtgacattgaccacgttgttatgcaagacaacctaacatttgatagttgggataaggactggcctctacagtatcaaatattcgacagcatttctacagctccatcctatgcatgctgttcgaactagcacccttgggggattgtatgttctgaatgcatcactagacatatcagtttctaaattttgttgcaacttcctttccagggtatctgatgcagggctgactgcaattgctgaaggctgtcctcttcgaaagttaaacttgtgtggatgccaactaatcactgataatgggctcactgcaattgcaagaggatgccctgatctggtctacttggatataagtgttctccgggtacatcacttgtcacactgaatttcttttatgaaaaattatctgaaaattgtggtatcaatgaataaggcttactatggtccgcgcagttaggattcaggactaaaatcagctcatttcaaccaaggaacacgtaaagaacatatgatgatacaatactagatacagctgtaggttttggtatgcagagaacttcaaaattttataatttgaatagtctgtgttttagtagttgtagatcaaagagttaatactagaaatagatggtcataaagaagacgaacaaaaaggattatctctgtaagatacagcaaataacaggcctatgaataagtttttatctgcactaatatgaagttcgtcatgatatcttctccattaaccagcactcaaattattcctttgtttagttgtctggtgccttatacataaggtaccaggagtattgcggtacatatatgtgttcaaaatttatggctccagacaaaatttgcttagtgcttgtgtggcgcgtgtgcttgtcacagactctgctccaacaatcgataaatgatgtttactttacaggatttacagctatttcttagacaatcctcttatatacccatctgtcattatgcgagagcagtgtgattattttaccttattttctgatgccttgttctcttcaaccaacagtccataggagacatggcgcttgcggagatcggtgaaggttgctcgcagcttaaagatatcgcgctgtcccactgtccagaggtcactgatgttggtctaggccaccttgtcaggggctgcctgccgctgcagtcatgccagatggtgtactgcaggcgagtgagcagcacaggaatagcgactatcgtctcgggctgccccaagttgaagaagctcctcgttgaggagtggaaggtgagcgagaggacgcggcgcagagcaggatcagtcttgtcgttcctctgcaccgggctttaacctgaaaatggaaaaaaaaatctgtgttttaacaactctgttgttggtcagaaatcgtgctcatgagttgctgcaccctgtgccatagcttgtttagctgaaaaaaaggttgtattaactgcaaataaaatggtgttctatgtatgttactatgatataaaaattatgaaccaaataaacagggttcagtcaaactcaagtgaatgaattgtcgcaagttcaattatatgaacaaatgtacatttgcattacttaaccttgttgtcctgcctgtcactctaaagtagagcatgatttttttactcattctttaagtgtattagaagatgagactgattgtcacatttgggattgctttaacctgcaacattctaagcaggttgcctcctccggcatctggaatcgcttggtatcccctcatcaaacaaggatcttttttttttttttttgcttctgatcatgcaaagcaccttttagcatctgattcatgttttctcagcttcaagaaacgaatgaattctttgctcctgcataccctctgcttccttcctacgctactgtctttcttcttcttcttgagataccttatccactccaacccaaaaacatcaagttgaagcatctataaaagttcatcatcctccatttctacaccgagaatcgaaccacgaaaaacactcacacacccacgaatgcgccgctaaaaaagcgcaaataggcagcttccaatggagaaaggcactgtaggtggcattggcatgtgtgaccgtctcttgacgttcctcgccaagaacctgtccatgaaccggcagaagaccatcaccgatggcccaagaaatgacagcagcaacaacaatggcggccatgaagaggaaagaggagaagaagacgacgacgagttcaccattgagatcgagaaggccgaggtgttgctagtcgacgagaaagacgacgacgacgaccacaagagcatcacggccaccattcttgaagagaaaagcactgaagtggcgacgagcaatggaggagcaagtgtgcagaaggaggacgaagaaggtggccgtcgtaatgatcctccggtggctgcagaagctgcgacggtggcggaggcggcgccggtgaaggaggagaagaaggtgaagaagacggtggcgatcaaggaggaatccggcgcggcggcggcggcggggtcggcgtcgtcggcggtgaagaggttgctgtccaagaagaggcaggcgtcgtcgagccagctcggaggggatcacgacggcggccagcagacgaagccgccggcgaggcggccggggctccggccgaggatgccgtcgatcctgagggtgccgtccaacatcaacgagaagtcgtcgagcttcatagaggagcgcaagaagagcttcggcggcggcggtgccggcgccggcggcaagccggagaagtgaaggatgcatgtgcacgtgtgacgtgtcagctagcgtgaagtgcttgtgtgcgcgcgcgtgttggttaattaattaatttggataatcgattgttcgttctttacttctgtccaaggggcttgcttgatcatgaaattaaattcgttattgtgaaaaaaaatataaaatttataccgttgttatataccttttgctctatgtttttcttttgcctcaatatattgcttgtcgttcctggatttattttaacgacccacacaagacgtggaatttcctatatgttaatacagtaccaaaaaaatattataacattgaaagattgtaatcagaaaaaaaaatcaccatcacgtgctagcagcttctcacacaaattcaagcaacccacaagattggaacttagttccccacaaaaaaaaatattttgttgaaaaatccaaatataaagctttgttaaaaatacaggtgggtatgataatttcttaaaaaaccttttgaaacttttttttaacttgtcatgctgtaagcagaggtgctagcagacagtagtaacttgccttgagttaccgtgctaatgtccgtttacatataccatgcatggacaaaagatttgtttgtaaaaaaaataaattgtacagagagaacatgttttcttataaaggaaaaaaatattttgaaattttaaattaaagtttcaaaaataaaataaataatccaaggttcacctttctgattgagcgaccaccggcaatacgactgtttttgccaaatttgcataaatgcttatcaaattttagttaaatttattgttttaaatttgaattcggaaaagatatactaaaatttacttggaatatactttcattcatcccatactgaaacatcaaaatttcgcagttttcgatcaataactcagaccactaagagcatcaccaacagtctatctattccattcctaatcctattttttttggattttggttaaaaaaaactgatccaacagattcccaaaagaactccggacgttttggagtttccatctccaattttctcggtacgtgtatttgagggcgagagaacgactcccaatcccctccttccacatttcacctctccttcctgcgtcggggcgatctccttctgcgcacgggaaaggaaaaaaactagattttctgttggtagtttaacagaagggcccacttttagtttttgtgattgaatttaggctatctcttggaggaatgggttttttcaccacctattttcagtttaggaaacacaaaaattaaattttagagtaatgctccggtgcaatctacttgcagtattctactccaagtagaattaatcttgaccttttattttgaagggcgggtaagtaatctcctaatatcatttaggggtaattttgtcatgggatgttttcttcggttcgcatcgcattaggtccggactccatcacacgcagtcacctcgctattcctcccccggcctcgccgccttgtccgcccccaccgtcgccgtccgtatctcccgccgtcgccgccttgtccgcctcctcagtcgcatcgtccatatgggagcggacgagtgtggcggcgtccgagcgaggatcttgagcaggagttctggcggtagtaaaaattccgacgtgggcttcggcggcggcggcgtcacgcacgcacgcaacgtcatttgcgtggcggcatcgtgtcggctcattcgtcttcttgccgttccgatcactgcgttgtttcatggattatatggatcaattaagatcttgcacgaccaactccgacgaggatgacatggtgttcgatctatggattgtaaaatgataatacccctacgcgaattatttttcctagacgaaaacacctctccacatttctacttccactaattctggtgggagtagaactagatcttaaccctacaattaaatatgatcgagggtccagattactttctactccgagtagaaagcaccggagtgggactgtaaattttagggatagattattggtagactgttggtgatgctctaacacaacgatatcacatcagttatcaaatatggaaaccgaacatgagccacagcaagtgcaacccactctcttggaccttcatgtctggcaccaatatttcaactaggcacctacaaattgggcgcaatcgggcgctatttcaccaagtagattgaacatgtttcactaaatatatcgaaaatatttcagtcttttaaaaagctgaaacataatcaaatcaccttatgaaacattttgctacaatgtatgaaacagcggtttcgaaaaaaaatcagacgttgttcatcctatataaaacaatatttcagcaaatagcgaaagaatgtttcaattctttaaaaaaagtgaaagacgatcaaattgctagatgaaataatttggttcaatatatgcaacaaaagatttgaagctattgcaacacttaaaccctgtgtacatcaacaacccacgtatctatcaagatgaaattattaaacagtatcaaaactcactgcaacatttgattcatacatagttaaatatcacgagtacactagctgaaatattattggtagaaaaaaaaatgaaacagattccccttaattatagaacgtttctgttatatccgggtaaccgttgcaacggggcacactgtggtggagacacgtggtgagcgcgggtgcgcgtggtggcggcatgttggcggcggacgcgcgggtgcccgacttatattggcgcgcatcgggcacccgacgcaaaggattttccatatttcagtacgcggagaaccgctggcggcgatggatcgatcaacaacgtcgacggcgtcgtcaaatgttattggcaaacgtgacactcttcttgattttctcttttaattattttgtcccgtacattgcacaattaacatatgacgtgtccatatcagaagcgtcctcttaatctttcacatgtatttaaaaacatctgtgtcaaaggtactactttgtcaagttttatttaggaccattcggtgcatgcatgcgtgatgactgatcgacacgcaaatccatcgtcgacgatctttgtttactgttttgcatagaaatagacgatattaattagtcatcggcgtgttatgacttttaagagtcaatgtggtactaagatctttacactggtggagaaaccctttgtagtcccggttcgtaacccccctttagtcccggtttccaaaccgggagtaccaatccgggactaaagatcgctatctttagtcccgggtgaaataaccgggagtaaagatcgatctttagtcccggttggtaacaccaaccgggactaaagatcgagctgactttttttttgcatgcccctgttgctgcatggtttatatatatatatatatatctagatctagaactacttaaaaagtaaaacctgcttccttcgtccgtgagaaaaaaaaatgccgagaaaaaaacaaacaaaaaaaaagaagtccgactcccttggaaattccctaaaaaaaaggaaagaaagatttctgtatggaaaaaaatcaagcgcgaataaaagtgcgaaaattttgttctgtccgataaaaaaaggtgcgacaaaacggtttccgtcttcctaaaaaagtagaataatagtgaaaaaaatatttttgtccgattaaaaaaaatctcgtcgtccgtcaaaaaaaagcgtgaacatttttttctgtccgattccaaaaagaaaagttgcgaaaaaatatttttcgtttctctttctctatctctatctcttctctactacttatatataaaaaataaaaaaataaaagtgtttccgtcgtccgtccgtgaaaaaaagcgtgaaaaagaaatcgggcgaaaaaaaatcgaatccgattatatatgacgcggtaaaaaaaattaaagacatttccgacgtccgtagtaaccaaaaaaagggcgaaaaaacatgaaaaaaagaaagtccgattctatatatacctaattaaaaaatttgtatggcttccaggttatagttttcgtccatcaaaaaaaaattccatcgcacgtgcgatcaatcccgctttaatccctctccgatggccaaaaaaaaaaagaaaagaaagaaaaaaaataatgagaggccgcatcaaaatttggacctaaattctagagaaaacactactacaagaatacaagatcagattcaacaatactaagaaaacactgacgcgtggaaggggagggtgttgccgtcgctgccgaacagccatcgccgtcgcagggatgtaggtatgccgggccgccgccatgttgttttgagagagagggggggaggagaaatgattttagggttagggtttgggatgttgaacttttatataggtcgggatcaatcaggaccatctatcacatcggacagcttcagcttctcccacgttaggctgaacgccattcccaggtcgcccacatggaataagttcactttaggtcgcttaagttgttcctccccgattctattcccatgccgcccacactattgggccacctcatggaccgcgtgtacgctctgtgtggaataagttcactttaggtcccttcagctgaacttttttttatttcattatgaatatattttcttaaagagctcatatcatgtaaaactaaaccttaatcatataatatttttatatttgttataattgcaacgcacagtcattttttctatgtaaaaaatttaccacgatgtacgagtgagaaatatatgccacacgcacccgccggctcatgtttaaacaagctggcaacagatttttcaattacagttctaattgttttatttaggtgattaaaattgtttttatttacataattagtttgttctatttaagctttttgaaaattgctaaaattcaagaataacttttcctacttcatattatattatttttagctaatggaattaacggaaaatcaattatatatttttatctttttgaccaaaggtcactgcaattttatttcattaatattattattatgattatgattcctttatcttttttcccaccagtatgcatgattaaaattaccttcacccgttgcaacgcacgggcattattgctagtatatatatatatataaaccatgcatatatatgtttcaatacatatatatgcatacatatatatatgtatatatatatatatatattatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttatacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaacgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagtggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttgtcggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggaggagtcgatgctggagcctgcggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatagcatggcatatgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatgttacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctaaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataaactaagtctaggtgacgtatattatacaaccctagctagtaaataattatatactaaatctaattacaaataaaataatcttatattaaaactcaaataatattacatgctaagactaaaatagtcatgtatatgctaagtgtttcgtgcgtatatgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaaaatgtattaggataaatgcgaagtaacatatatatatatatatatacatatatacatatatatacatatatatacatatatatatatatacatacatatatatatatatatatatatatatatatatatatatatatatatatatatatatatatatatatatatatattgcatttcacgttaacgttcgtcctcgttcgttcgctcgttcacgttccctagctcgttcacgttcgttcgctcgttctcattcacgttcgttcgcttgttctcattcacgttcgttccctcgttctcgcttgtcttcgttcgatcgttctcgttctcgctctcgttcgttcgatcgttctcgttctcgttcacgttgtcgcggcaacgtacgttgacgtgttcgttctcgctctcgttcgttcgatcgttctcgttctcgttcgtaaacggcggtgtgacggcatcggggcggcggttggcccgccggcgtgccgacggcggcggcggcgtggcgttgtggggccgtggtggcgccggcgtggcgtgacgacggtggcgtggcgtggcgtggcggcggcggcgtggcgtggcggcggcggcattgcgcgcgcggcggcgaaggcggcggcggcgtggcgacggcggcggcggcgtggcgttggcatgcggcggcggcgttgcgcggcgtcgaaggcggcggcgtggcgcgtcgtcgtcgtggcgcggcgtctcgtggcgggcggcgcgacggagagagatcgagatcggagagatcgagatgcatgaagggagatctggcggcggcggctctcaccccagagatgcggcggcagcggaggaggcggaggcggcggcgaggacgacgagctcgagacgacggcgagatacggcggcgtcggcgcggggatttgccctaggcagtggcggcgaaggagagaggccgagagagatcgatcggccgaaaacgtttaagtgttggtgaagaagacgagggcgcaccgggaatatatatacccctggatctttactcccggttgttctcaacaaccgggactaaatatcttttcccgctatttcgaaattctttttaaacccggttagggttaagaaccgggactaaagattatagcactacatatgattttcgcttacatatgtgtgtataaaatagaagttaatgcattaacattatttaaagtacaaagattaatgaaaattacttcgaaaaattatttttggctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgattttaaccttttaaaaattcgaatagtcatatataagtagcatatgaaagatagtaaattaaattgtgaaaaactctaatatatgaatgatagttttaaaaatatattaaatttgata

SEQ ID NO: 43322 - DNA, 26092 bp, Oryza sativa
ccgtgaaagggggttgcccatccaactgatcgtaatcctcgtcagtcttgtcctcaactccgatgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggtgcgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgagagacattgcaccacttcattctgaagggcttctaatctatccggatcgatgaccttctgcgaaattgcgttcatgaatgcacatagctttgttattgttgcccggacattgtctggaaagataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccataccgggtggtttgctgcaaggaatcgacgatgacccatgtatacaaccttcctacagtgcttaaggtacgtactttctgtttcatccatacagtgagtgcaagccttgtaccccttgttggactgtccggataggttgctaagtgcagaccaatcgttgatggttacgtacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattatgccatccgtactcaaaccaaaccgtatgtttcgtgcgtcatttccaaattctttaaattttctgtccatgtttccccactgccaaccatccgcggggtgtctcaacatcccgtcctgttgaccctcttcagcgtgccatcccaacattctagcattcccctcttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttctcgacgagtttcaataaatcgccaaatgccttgtcactaaccctattttttgccttccattgcaacaactccagagtggtatccaactttttgtcgcctgctcgcaacctgggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcgtctgccacttcatcttcttccatttcaacaccttgctctccgtgggatgtccaacaattatagcttggcatgaaccctgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattaccgatccatctacatgagtcaaaaaaaccgcacacaaataattattcttacaataatgacagtcatacaataattataagatatctttattcatacaaaaatcataaaatattacaccaaataattcttaaaaactagttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagtaattttgaagcttgctcgggcagctggaggaggaagaagacatatatataggggtgggactttagtcccggttggtagcaccaacccgggctaaagatcccgggggggcctgacaggtcctgacagcattcgaaccgggactaaagatgatctttagtcccggttggtaacacaaaccgggactaaagatcaaatatgcccgttacccttttgaactgggactaaagatcatctttagccccggtttttattgcatccgggactattgtggaaatcggccgaccgacgaaagatggtttctccaccggtgttaatttgttgatggctactagcttgttggatctaaatactgatccttgtttcaaacatgggtcgttttatagcgtatactcactttgttttgttttattgtataagacgtttacgtttattataagttaaacttctttaaatttataaaaaatagtgtaataagtacaatactaaattagtttcattaaattaaccattaaatacatatatttatagtctaagtaatttgttttttgttagaaactgtagtacatttttctataaattattgcttgatcaaatttgaaaaggagaaaaattagaaacattttatgatatagaacggtggaagcattaatcaataagaaaattgtgttgccatgcaattattacttactattatctccgttccaaagaggctaaagctgtagcattgtaaagataaattaataggaaaggaaaggactgagatgtccccggcctcatgaatttagagatggttgagagtgaggaggttgaggttaaaatgggaagatatataaattctagaggtaattggagtggaagaatattagagtagaagttatattttgaaataaattctagaggttagaagttagcttttagttaagtgtatattctttgcaccacgtggtacgaaatattcgagtattctttactggagttccccttgactgttactactagtagactgttttatagctgatgttattttgatatgcagtagaaattgtctgccattccacggacaggtgggcccatgaaattgaagtcaaaggtcaagcaaatatgttttgggggcaaatgttcatgcaattttccttgtctatttcgtgtcccctcgacaattattcttgcatatggtacgtatactcttccacatcttcaattaattaattcaacacatacatataattacgcaggaataatatacgacctcttaaacattactaagtctaactaatatataaaaataacattatattcagtcaattttccagtacatatgttcttgataattatggacttgtcggcggcatctgtaacaaaccaatatttcctccgtttcatattataagactttctagtattgtctatatgtgcctagattcactaacatctatatgaatgtggacaatgctagaaagtttagtatgtgttaaacaattaagcatagaatttgtcatttgatattgttccagctgggttttgaattattcaacattaacatggacaggttaatataggatcgaatcataagaactaagccaaccagagaggggtgaatggttgatataccccaaaacccaaacttttagcggaaataaaagttactctcaaattcgatgtagatcagtctgaccgaggttgatccgccggtctgaccgagctcgtgccgccggtctgaccggtgttgatccgccggtccaaccgcctgaagattgcttgctgcgtgtgaagtcaccgccggtctgaccgcctttcctccgttggtctgaccgctgcctgccgccgctctgaccgccggtatgtcgccggttagactgccgaacccgatgaaacacaaatcgaagaactcttaaagtagatgacaactttattgcttctctctgtgtttacaaagtgcaccaacaatactccttacaaaaatctcgactaaactcgaaaccctaactaaactagcaactcaattgctctcaaaagcgataccgggaagcctcacgctccccctctatttatacataaggtaggcagcctaaagccacgaaccaaactcatactaagagtcctaaataccttaggaaaccctctagtacaagacacaaactttacataaccaatcgtatcaaatttggactccttccaaattcgactccgcatcccatacgcacacaatacctccatcgtatgccatatggaatcttcaccaaccacgtgcatcaactctagccttagtatcccgcatgatatctgaccaccacggacatcgtcttaccaccaaaccgactcccggtccatcaccgcaaatactctcccgatgtatcgagtcacctacacatgaaacaaacaaagaaaccatattccgagaccaagctatccccaacttgactcattagtagcaaacaatagtattacatacgtatagtatccatctagaagccataaccatgaaacaatcacggatatccaaagaaacaacccgaaaccgaaaccgacacagcgtcggccggtcagaccacgggccggctggtctgaccgctcaacacaagccggtctgaccggcaacctccgcctagtctgactggtcccgacaaaacaacaaactctgttcatcacctgaaaattaattatctccaaaaccacttcgtgaataaattccaaatatcaaaaaccaataatcacagatgctaattattcatcacagaataagaatcaaaacacacattgatcttactgttaattctgagtttatctcaaggtagacgccgtgagtagcccgggctttgctagctgattgaactattcagttacatacagtgttacagacaataatgatcacaaaaagtttgtcctctccgagtgtttttctttgaaaaaattacaccaactagaaggcatcttcccagaaaggaagctgtcaatgatatatttccttgaccaaatcggcattagaaagatcattactgcgtacttgttgcatattatatagacagaaggaagtttactcctttgttcttgcatgctgtcctctaaataatactactagtctcattgtctcagttgtcacaaatacattatcaaagtcaattagggacaagaggatgtatggaattgtagatactggtgtactctcttcactgtaattacagtagaaccatgtgcagattaagactgattgctttgacgttcagacaaaattttgtcatatgcaacaaatttcaccaccatctgaatggtttgaagccaaaatttcctcttaattttggtgtgctctgtttaaaccttgatgtccatgatataacgtgcacatattttttagtgcagaggccaaaagctatacttccatattttttttaaaaaaaattgtcttaattagtagctgctgttaattaccaattccatagatgcgtaatatatgcggaggtgcttgcgcagcaagaactagcgatattgggaaaaggtaaaggttaattattttgaccaaagtaattaggtgattacgtagacaacatcgactttgaccgatttttacttctcacgtttgatttgtgctgccgccgctagcttagatcgagttatagcaataaatatctaattaattgtatcaatcacgtagtcgatcgttcaacatacagtttgtgcttgtaactaaagagtttctggtcgtattttctgctacgaatgcgtcctactaccttcgtttctaaatatttaacgccactaacttttttaaatatgtttgaccatttatcttattaaaaaaattaagtaattattaattatttttctatcatttgattcattgttaaatatacttatatgtatacatatatttttacatatttcacaaaagtttttgaataaaatgaacggtcaaacgtgtgttaaaagttaacggtgtcaaatattagaaacggaaggagtatatattcagcgatgtgacctattgatctaatccgtttagctaaattaattaactacgcatgtacgaatgaagggatttaatttgtgaagtctcgtatagttcataattttgtggtaattaaaacattgatgtcattcacagagaagaactacttgatcatttctgtggcgaaccaaaatatctttcggaaagaaaccactacaatgtcacaatatttatatacttgatatatgtatatacttttagagtaaatttccgatgttttactttggactatcctttaaccaatttttactttggaccaggtatttttacctttgagacactttggaccaccctcgattcttttatctatctatatccaacttgttatatgtcaaataaatgatcttacatacatatagctataagagctatttgacaagtaggagccgacatactcgagatcattcatatgcttttagaagagagtcgagtggtccagagtgaaataaatgtaagattacccaattcaaaatgaaaagattggttagaaggtgatctaaagtgaaacataggaaataaaatatatatggtacaaagtgaattttactcttactttttatgcagtagtatatgatgaaaaaagaccatacttggtagatatttttgcatatatatagatttatttagatgttatcaacagcttattaattactgcatatggttttgactgtcggctacaataggacaaaaataaatgttcttcagttcttgatagtccaagatatgtcattgggttgaaactagttttccaagaagaagtcccatctcatggccgactcgataatatcagcctcagacatatatgagacatgtcaaaatgcatcaaattccacatttccttatctcccgtgtgataatttttatcatttgtttagtgctggtcaattgctagtgcctggtctttgcatccgtctgccactctgttgaatagtgccatgcaatgcatgttttttttcccaaaaccaaaccatacaactttcagttataaagggaaaccagaatggtagaccatgcaattcatttatttttctgaattgaactttcagttgtaaagggaatcatgcatgcagagatagcatgtcaaaattgcatgtcaaaattacctctgcctttttatgcttgatatgcaaggccagcaagattcagaaagaaatatcttaccaatgtaaatgtcaaaatctaccagctgcatgcatattatatgtgtctgatctattctcccttcaaataatcaaccaaaatgtatatacatgtgaccaatctgaagtctgaactctcactatgtggctagattctactgcataaattctgagaagactgaaagaagggtcaaaaaaaattactgtagtatacatgaatatccatttggacttccccagcttcactgctgcagcaagaacaactaaaattgaaccacaagtcaaagcagctgatcttataaaatctcccaattgtactcatctgaatgtattaaaatcttcctaacaacacgcgacatcgatatgatctacacgtccatgtcgaagaaaatttttgcttctccctccaggctgataatacttatcgttttagataagggtgaggtcaaactttagaatctttgattatgaattatttttaaaatatttgtctttcaaatatggtgactacgtatatagattagtcttaaaagtactttaataaaatcatatatttgatatacatattataataaaaaataatggtcaaagttattttttatttttaaaatatttgtctttcaaatatggtgactacgtatatagattagtcttaaaagtactttaataaaatcatatgtttgatatatatattataataaaaaataatggtaaagttattttttttaagatcgtgttcttgtttaaaataataagtattaccaatccggacgagtattagctatcacgagcgtattattcagagtttcagacaacctctactgtacggtactatctgtcgtatggaaagacttacaaacgtagccaagagaatcagagtcagactaatgctgggttggtaggggttggtgagacgaagaagtctttgcttctatctaactagaattaatatgacttaatcctaattaattacttccatattttaatgtatgacaccgttgactttttatccaacgtttgaccgttcgtcttattcaaaaaatttatgtaattatcatttattttattgtgacttgattcattatcaaatattctttaagcataacataaacattttcatattttcaaaaaaaaattgaataaaacgaatggtcaaatattactaaaaagtcaacgacgttatacattaaaatacggagggagtatattactactacatgtcaacctcttcagggttaacaagtcaatcaaccccaggattaagctggggttgaccaacctaattggttactactccaagacaaaagttatctctgccaatgatataatattaatctccagttactctgctatgatatattgtctgatctttgatctttccatgaagtagctagctagctagctattttagcttgcgtctgcgaggcaactgggttgcgtgcctttgttgtgttggaaaagtatagcaaattagcaatgcagtgcaaatgcagcctaattttttctatctagtgttcctcgttttacccttttttccattgtgctgatctctaccgtccattttgtcatctggtctgcagcgattggcttggtcaaccattgcaaacggccatccggttcagcaaatgtacttctgtgccaactatatgcgtatggctgcatcatcagccaccttgcttctatctataaatatgaccccaaaactgtcctggaagaagcatcacttcatcacaaaacctaccaagctaattcagcatttcagcttggttctataggtaggagctggtaagatcaccatggagaagctctccatggtgacctctctcctctgcgccatcactgtcgcggttctcgccgtggcggtggtcagcggcgaggcggctgtggtggagcacaccttcgtggtgcacgagatgaacgcgacgcacctgtgcaacacgaccaagatctacgtggtgaacggacagttcccgggccccacggtggacgtgacggagggcgacacggtggttgtccatgtcatcaacaagctgccatttgggcttaccatccattggcatggtgtccgccagatgaggagctgctgggctgatggggctggttttgtcaccgagtgtcctatcccacccggaaacgagcacacctaccgcttcaacgtcaccggccaggtcggcacgctgtggtggcacgcccacgtcacctgcctccgggccaccatcaatggtgccttcatcgttcgccctcgtgatgggaagtaccccttcccgacaccggccaaggacgtgccgatcatcataggtaatgaacggtccagatcgatcgttgacctatgcaccggttgatcttgaccgttgattaattgaatttgtttggttggaataatttcggtacttacgaatccacttacttaagaaatatgtatcatcccatttgtaggagaatggtgggagcttgacctcatcgagctagatagaaggatgatggatggcaacttcgacgacaacccgttgtctgcgacgatcaatgggaagctcggcgacctcagcaactgctctcgcatggtggaggaaagcttcatcctcgacgttaagcacggggagagctaccttctccgggtcatcaacactgcactcttctctgaatactacttcagggtcgccggccacacgttcacggtggtcggcgccgatggcaactacctgacgccatttaagacggacatggtcaccgtcgcccctggcgaggccatcgacgtgatcatggtcgccgacgcgccaccggcgcactaccacatgatcgcgctggctaaccaacctccggagccggacccgcagatcccggtgttcacctctcgtggccttgtccgctacgccggcaccaccgccaacaacaacggcctcccggtaccgatgccgatcatgcccaaccaacacaacaccatgccgtcctactacttccacgccaacctcaccggccttgcccacccagagcgccatcgtgtccctatgcatgtcgacgagcgcctcttcgtcaccttggggctcggctccatatgccgtggccagaacaccacctgcaagcggcggcgcagcccggagaccatcgtggtggccaccatgaacaacgtctccttcgcccacccgaaaaccaccgcgctcctcgagcgctactacgacggcacatcgaagggcgtgtacacggaggacttccccatccggccgccgcggcctttcaactacaccaaccgtgatctcatccctcccggcccgctcgaggaggcgttggagccgacgttcaaggcgaccaagctgaagcggttcaagtacaacacatcggtggagatcatcttccagagcaccacgctgatgcagagcgactccaaccccatgcacctccatggctatgatgtcttcctccttgcacaggggctcggcaactttaacgccaagagggatgtcaggaagttcaactaccacaacccgcagcttaggaacaccgtgcaggttccacgtggcgggtgggccgccattcgcttcgtcacagacaatccaggtaaattttcggtggcatataaggaatttatgaccgcgttataagatatgatattattttttgttgttctatgttggtaggcattaaaattgggtgaaaagagaggttgatgtgtcattgttggttgtgttcttgtttgcagggatgtggtacctacactgtcactttgagttccacatcattatgggcatggcgacggcgttcatcgtggaggatgggccgacaccagagacgagcctgcctccaccaccaccggagttcaagagatgtggcaacaatggtctgagtcaaccatgagggttttgaagagaaagtccaaattttttactgctacgagtaataaaaaataaaaaatgcatggatttgtagtatgcattgtattggtgatgattattcttactgtaaaagagatttactattcttttttggtattcattgttgtaaggtggcaaagtgtaagtaaatccatttggatttaatttatgaagaagagaacaattatttatgaagaaagtcacctgtcaattctggggtacttcagaggtcagagttaactctgaactttcagacttcagagtttaaggccatgtttagattccaacttttttttttcaaacttccgacttttctgtcacatcgaactttcctacacatataaacttttaatttttccatcacatcgtttcaatttcttcaaacttctaattttggcgtggaactaaacacagcctaagactctgaacttgtgaaatctctctgaatttttctccttttggcgtgaatcggcaacccatcttccaaccctgcgattcatgtgcttgcacatttactgattcccatcatcaacgttaatctcttcaagaaccatggcgttttcggcgaagaagttggcaagctgcgatccaaagcagttggtcttcgatctccattcggaattgcaagctcactcgtttcagagtgctctgcaagcactcgaacgattggccactcaagacagcaatgtcagaaacctcttcttcttcttcatcatcgtcatccaaagaaagcttcggcttcgaactccggtgcacgaagagatcgacggacttgtcgaaatcgagtttatatctgaattgtagtagaagagatcgtgatgagtagtctctcttgtacaggtttgccatcgccacggcgctgcgctttctggaacacggtgcattgtgccgtaggtccagctcgaggcgatcgaggttgacgagagccgccaccgccgccgcgccgaggctctcctcgccggcgattgcgatggcgttgtgggtgagctgccagaacgccgtcgcgacgcgtcggctccgattgtcgacgaggcgcaggtctacctcgcgccgccatgtccggagctcacgatcgcagcgagaggtggaggacgaagccctgtagacgaagtgtcgtagcgccggcgcgtcgaggtccagggctcggagccgtcacgccgacgccgggcgttcttcatcttccagcggcagttcgccatggcgagcttggtcaccgacgccgggcagcggagacggagagacggacgcccatggcgcggcatggcgcccttggcgccgccgggttgcggggcgacccttgcggtaacaggaggaagacggagacgagagatcctgcgatctccgtcgtcttcggattcggaggacatggtggtgaggtcgttgtcgtcgtcgtcatcgatcgtcgtcgctgccgttgtccgggcaggatatgtgtgttgcgccgacgcccatgccgacgaacgctcgtcatcgagacggtgtggacgctggcgaacacgtcgcgccaccgcgtcgagagcgcggcccgcctccgtggaagccactgagatcgctgagacggtcgacgccgtcccctcgtccgtcgccggcatccatcgcggcggcggcggcggccggcggaggcgtgatggcaagttgtcatctgggctgggctcattatgtagctgggctgcatgggatgcgacaatgcagaatgaggcccacctagctaccgacgacaaacccaatgcaagttgcagtctcacaggcccagcgacggacctgcgctcatgaattgcttggtagcctttgcgttatttttacacttttgtttttcaacaaaatttcagaatttcgattgccaccaaaatttcaggaattttggaacttttttcgacgaaattattgaaaaattttaataaatttaattaaattttgactaaattcagaaaaattaaaaaaattaaaaaaaaattggacgagatatgtgctcgttggtggggggcgaaaaatttcctaattcggaaattgcaaaatcccttacgcaggtcaacttgatagggggtgacgaaccgaagtgcaccaatcgagcaggctctcgtcatcgccgctgcactgcgctggttagggccagggctgtaaatttcggaacgaaatttctgaaatttcggtcattttagacctctccgatacaatattatttcggccgaatttttttttaattttggtaatatttgtttaaattcaactaaattttgtttaaaattttggaaatttcggaccgaattggtgaggtccaatcaaatcggctaaacctggcggtggctggaacccttgtgccgtaggtccagtccagctcgaggttgacgagagccgccgcgccgaggctcttctcgccggcgatggcgttgagccggtggtcaagcctcagctagcgtcgatgtgccttctcgcgttgctgaactttgtggatgagctgccagatcgaacgccttcgcgacgcgtgcgtgtttgctcgccgcgcgtgtcgcctgtgattgtctccaaccgccggaaggaggcggtggcggtgccggcgccggcgagcggttgacatgggacatgggtggtctttggcgcagttcatgacgtgcagggcaggagattcgaaacggatgttcagtggaggagcattccgaatttgatctccaggaagagaacaccattcttctgtgctccgtcaaagttggcacggttcagggctaagcacacgggactagctatatatatttatcgacaaatttactcggaaaaaaattatcagatgtaaatgtaaaataattataatgtagttatagtgtaacctgcatgtagctacaatgtattttgtgtataactttcaaaagtcctacaacaacacgttatttgcatgaagcgaaagtcgcgagaccaaatttcctcacccgctcgcactgtgtatgatctttttctttccaacatgcacgaatcttaaattaaatctaatggtttagaactgtatgaaaagttatattcaaattaaattgtagttatatgcaacgcaacaattatattgtatttacatttaacattttttgggagaaaacttagtataatttatagcaaaatcgaaacacaacatacttgcgtcagtctccaattcagtatttctccccatatataccagcatctgaagcaaacttgaaggcctggaggcaggtctctgcctctgcctctgcctgagacggttcagaaacattttgcaggttgcccgaccccgctgagactgcgatggctatctctgatgatgaagccccagccaccagattctgtgctattcctgaaaaggctccatcaacatttatcttcaggtatccctctcccggtttcttccatctaggttgactgccaccaacattagcaaggggtgatggagaaaccgtaccaacatccatcccaaaatctgcaaattcgccaacaggcatggctggccctgattgatatctcccatatgtgaagaaatcatgaccttcggggatgcagtaggtaataaatagcgtatagcgggttgttagcggattagtgtccgtgcagcggattgcggatagtgggcgctattgcggacgctaagttccaatagcaaatataagaaaataaccataaatatatcaatattatcatcaatttcacttaaatattagaatttataatacatttttaattactcatatatttcataacataaaaatatgaaataacatatagatatataagataaataaaataaacaatgtaaagttttacaattcatatatccatatatgaagaacaacatttaagcgttataacggtccaataaagtcaatagcgatcgcgaagcgctataacgggctgctatagcggtaacgaagtgctatatcgggcgctaagttacaacatgctatcttcagtccgctaccgctattgcgggcgctacgaacgctatttattaccttgataacagtgttgctaacgccatccgatgataggggcgtaccccatatcatttttttaaaaagaaaatttatatatagtactctctccatatcaaaatatatgacgacatgttttatcatataagaaactacagccttaaagtatttatactaaatttaagaataaaatgaatggtcaaacattatgaaaaagtcaacagtatcatacattttaaaataaaatatagtatgttgcttatgtacatactctgttgtgtctaatactttcttctcatgtttcttttttcttagtaattgggcttcctttgttatttttgtaatgtgtttaaattattgagattcatataatatgaactatttctttttccacaggaaagaggtccctgttttcgggcaatgaacagttgaacctgaatctatcccgtaatcactgcttccatcatcgatgcaaaccttacatgatttgacactgacatcccttttcaaattaatcaaggtagtgtttggttgctgggatgagatgggatgggatgggacgaacccacttttaggggtgtttggttgaggggtgggtaggatggattggtccctggagaggaatattcctctcagatccgggaccaatcgatccgggaaaaagagccggacgaactcgtcccacctgggacgagcgcacggcgtcagctcatccgcgactgccgccactcgtctgcgaccgacgccgcctcatccgcgcccgccgccgccttgcccccacgaccgccgccgcctccaggaccagccgccgcttcgtctgcgaccgcctccgtctccgcgaccggccgccgcctcgtctgcaaccgcctccgcctccacgaccgactgccgccgctcgtctgcgcctctcctcgcatctgcctccgtgcgcggcctccgcctcatccgcgaccgccgccgcctccgcgtccggccgccgcctcgtccgcgaccgcctccgcctccgcgaccgactgccgccgctcgtccgcgcctctcctggcctccgcctccgtgcgcggccgccgccgcctccacgtccgacgccgcctcgtccgcaaccgcctccgcctccgcggccgactgccgccgctcatccgcgcctctcctcgcctccgcctccgtgagcggctgccgcctcgtccgcgaccgccgccacctccgcgtccggccgccgcctcgtcctcaaccgcctccgcctccgcctccgcgaccgaccgccgccgctcgtctgggcctcgcctcgcctccgcgaccgcctccgcctccgtgcgcagccgccgcctcgtccgcgaccgccgccgcgcgcgcctccgcgtccagccgccgcctcgtctgcaacctcctccgcctccgtgaacgaccgccgccgctcgtctgcgaggtagccgctgggagccagacggccctaacggtccgtgaaagttctccatcccatcccacctcaatcccttctaccaaacaaaaaactataaccatcccataccacaaaccaaacagacaactggaactatcccatcctaaaaaactgggataggtctaacccatcccactttgtccccaaaccaaacacacgccaaaatgcctgccaggctacactgtcatccatatatattatcgcacaggggaatacaatagagaggattaaattagcatcagccgtttggaaggttaattttcctaaccatctctgcatcccaatttgccgttactggatcaataagctcacatatatgctcctggtttatggatttaaggacgagggtttgaagggatcagttgcagctaaattagcttaagtgggccacaattttatcaccaggcccaactgtccgcaattggtccctctgttggattatgtgacctacctaaacatgaatattacagcgatttcatcttatatgctatttaaattactagaaaactgaaaattctaggaacatagaattatgatatatcctatataatcgagtacccacgcagcagaatttcagcacgggctatatattccgagaaaattcaacgaaatcaagtaatgatgcttattgatgttcattttataattatatagcacaccccacttcacacgcatatcaagctgaaaaaaataattgatggagactaggtacagtccgcctactgagcagcccccttccagatgaccaacatgtggacaacagactaatcaaataatgaccagctcaatcgactctaggagccgtgatttcaggaaactattttgatccctcgaggaaccatggctcttccgctcgatcgctccggctcgccatgactgcctatgtggacctgcctctgcctatcgcactcctgaatcagcgacgcaccacaatacggacgcattcatgacacgtacctgcactagaattccccttcccaaccttactaatcaatcggatgcatatatatgggcttggttgttttgcattgcaacaagaaaatgggtcacgacaggtcaggagcgccatcatgggatccactgccatcacagtgactattcacccaccaggaatacagtggcctagttgtgtctataaatatggccccaaaacctgtcctcaaagaagcatggcttcatcagaaaatccatgaagataattgagcttggttctaacagctaatagctgatcagaccaccatggtggcctctctcctttgcaccgtcgccgttgcggttctcgccgtggcagcggtcggcggcgaggcgggggtggtggagcacaccttcgtggtgcacgagatgaacgtgacgcacttgtgcaacacgaccaagatctttgtggtgaatgggcagttaccgggcccgacggtggacgtgacagagggtgacacagtggtcatccacgtcgtcaacaaaataccacatgggcttaccatccactggcacggtgttcgccaattgaggagctgctgggccgatggggcaggcttcatcaccgagtgccccatcccgcctggcagtgagcgcacctaccgcttcaatgttaccgaccaagtcggcacgctgtggtggcacgcccacgtcacctgcctccgctccaccatcaacggcgcattcatcatccgtccccgcgatgggaagtaccccttcccgacacccgtcaaggatgtaccgatcatcataggtaacggacagtcctgattgaccgttgaagtatgcatcggtcaatcttgaaagttgattgatcaaacctgtttggttggatggatggcacaactttgtgaacctactgactaaggaataccatgttattgtaggtgaatggtgggagctcgacctcgttgagctggacaggaggatgagggatggcaacttcgacgacaacccgttgtcggctacgatcaacgggaagcttggcgaccttagcaactgctccggcatagtggaggagagctttgttctcaacgtgaagcatggggagagctaccttctccgggtcatcaacactgcattcttctccgaatactatttcaaggtcgccggccacacgttcacggtggttggcgctgatggcaactacctgacgccgttcaagacagacatggtcaccgttgcccccggcgaggccattgacgtgctcatggtcgccgacgccccaccagcccactatcacatgatcgcgttggctaaccaaccaccggagccagacccacagatcccgaagtacatctctcgtggcctcgtccgctacaccggtgtcgatgccaacaacaatggcctaccggtcccaatgccgatcatgcctaaccaacacaacaccatgccatcctactacttccatgccaatcttactggcctcatgcatccgaagcatcgtcgtgtgcccatgcacgtcgacgagcgtatcttcatcatccttgggcttggtaccatctgtcgtggtcggaacaccacctgcaagcggcagcgcagcctggagaccatcgaggtggccaccatgaacaatgtctccttcacccacccaaacaccactgcgctcctcgagcgctactacgacggcactccagaaggcgtttacacggaggacttccccgttcggccaccacggccatacaactacaccaaccctgctctcatccctcctggccctctcgaagaggtgctggagccaacattcaaggcgaccaagctgaaacggttcaagtataacacatcagtggagatcatcttccaaagcagcacgttgttgatgagtgactccaaccccatgcacctccatggctatgacgtcttcctccttgcgcaggggcttggcagcttcaacgccaagagggacatcaggaagttcaactaccacaaccctcagctcaggaacaccatattggttccccgcggtggttgggccgccgtccgcttcatcacagacaatccaggtaaacgttcaatggcatataaggaattcactattatgttatataacatgatattattttgtcgttttaagttggtaggtataagaattgggtgaaaagagtggctgatgtgtcattgtttgttttgttcttgttaacagggatgtggtacttgcactgtcactttgagttccacatcattatgggcatggcgacggcgttcatcgtggaggatgggccaacaccggagacgagcctgcctccaccgccgccggagttcaagagatgtgatgcctcttgaaacaacttatcctaacaactatggcaaggaccttcctcctctttgccagtattcactagataatggcattgcctttggggcattttattcttgtattgcattagttaagacgtacatgttaaattccagcgtgcacaagccggtccaggccatgtggtcatcagcttcaggccaaggtcacgaaaagcacaacttgatcatctgcatcttgttatgtactccctccgttttttgtttgatttttttttcttgtcaaacttctttaatttaaccaaatttatagaaaaatatattagtatttccaacacaaaataaacatattatgaaaatatattaaatgttaaatttaattatactaattttatattttagatgttgttaaatttttctataaacttaatcaaacttaataaagtttgactagcattttataacatgaaatggagggagtatttattaaaaactcccttgcaaataatacaaacttcaaaatatcatagtcctctagtaattgaattaactgattgcactatttatcagatgcaaatcttatattcatcgttactaccatcaatgggtaacaattgcacgatcatcatcgtctttcaaggggtaacaccttaaagcttgttgcattcctctcgaactctggtgccgaatctggatgaattcttgaaaactcccatgaactccctgttaaattcttgtctttcaaacgaatcttggacgaatcaactccaacccatctttcaacattgagattcatgtgctcacagagttttctgttaccactgtcgatgcacatttcttccaaaaccatcgcattttgagcgaagaatctgataagccggactccaaaacagttggaggccgaacccaactgaaactgcagatttactcttctgagacttctattcaagcaggcgaatgattttccactcaatccagagatgttagaaaacttatcatcatggtgttcatcgatcaaggatgatgaaaccgctgtcatcttcgatttgtgacgcatgaacagaccaacggatttgtcgaaatctggcttgaatttcgcatgaaatgaactcaagtacatactattattcttcgaccatgcgtagttgagcatcttgagcttcagactgaggtcgaccagagcagggcagcaatggagtaggttggcgatcgccaccgccggcggcggcgccggcgccttcgtcttcgtcggcttcctcactgcttccagctcgaggcgctcgaggttgccgaacttgcagaggagctcggctcgcctcgccttgccggcgacggcgaggtggccgagctcctgcaccgtcaacttgaggatcttgacgttggtgaagttgcccaagaatcgccaaagtctgtcggcgaatctgtggtcgccgtcgatgaagtgaatgttcaccgccgtcatctccggcgccggcgactcgaggtagaatcgccggggatgccccgtgtacctgaaggagcgcagcttcggggcgtcgatgccgatgccgccgtcgaggtgggagttgatgtagctactagagccgcagaattccatggcgagctcggtggccgccgggcagcggaggaggaggcgcgattctacggcgacgaggccgccgtagaccccgtagtagtcgaggtatatgttgaactcgaagtagacggactcgaggtgcacggtggcgagcgccggcgcggcgtcgatgaggcgctgcaggtgcgccaacctcacggcgcagagccgcaggcgcagcgtgtcgagacgcgggaacgcgacgccagcgtccggcagagcgagcttgctgtcgctgaagttgcactcggtgatgtcgagcacccggagtgtcgccgacggcagggaggcgaagctgagggtgtaggtgtagatgtcgtcgctcctccatcgtctggcctcctgccaggggcgctgctcggcgccgtcggtgcggtacatgggacccgcgacgcctacgcggagctcctcgacatggcgcgccgccgggtgggagaccacggcgtcgacaatgccgatctcctcgccgccgccgccgccgccgtagttcaggaacttgtctaccccggagaggcagcgtcccgccacgttgagggtgagcctggtgacgccggcgccggcggcggcggccgcaagcgccgcctgggaggcgcggacgaaggcgtcgcggcgggatgagaaggcctcgtcgtcgccggagacatcgtcgtagacgacgcgcacggcgaggttgacggtgccggtggagcgccagagcgagccccaccgccgcgagagcaagctggtggacgcggcctccctggaggggacgaagtggaggatgcggcggaggaggtcgtcggagaggacggacaggcggtcgtcggcggccatcgtaattagtttaggtagcaattggtgtcgatctgttctaagctatgggattaacgaaccgtcaatcgtcattagtttgggcttaatggccttatacgtatgagaattggacttcaccgtcgtctacaagatctcttacaaatttctactggtacttcaccgtcgtctataagatctcttacaaatttccaaattcttttttcacggatacgttcttcttttatatgtgaacacgcaaacaaattgcacgtcgatatgttaggagaaagcaaagatttaattacacaacgcaacaggccagatggatggccatggacattgccagggaaaaaaacaaattcaaatccacaaattgaaatttcaggaaaaaaatataagtttattaaataatttcataatatcaatatctagctgtccctaaatctgtataagaactgatgcatgcttttcccccttctagaatagtttttttttcaacccaagtgtgtgatcacttgtgtatctgacctgtttgctacacaccacaaatatcaaactaatatttattagaaattataaactaaattgacaatattgatacaatgatcatatatcatctcgtaaaatttcgattccgatgtagatttacactatgacatcaacaaaatctacttctactctctctctctctctctctctttatatatatatatatatatatatagcaaaagtgcccgtgcgttgcaccgggtgattacagagtgtgtatattgaccaaaagtgttgtttggtttagcaaaagtgcccgtgcgttgcaccgggaagtttacagatcagaaaaatatgcaattaattaaaatacaaattcgctgaaatatttggtatttttaagtaggtatgtgtataattaaataaatttacaagtaaaattctccattctccatggttaaataaaatgacatggttaaatttaattttattaaattctccataattagttacgctctttggaattttattggaattttcagagcttaattgctaattttattaatacaaacatcatttaacaattatttaattggaaaaagaaagaaaatactttcttataggtttgcttcgaaataaacatattcaatagaactataattgtaatgcttctgaaaaaatgagcactaaaaatgtacttattctctttttttcggctcgagggaccaacaatagacttatttccgacctatgccggtcggcccacggccttttgcgcatgcgcgggcgcacttttcctcccccaggccgcaacctgggcttgggccggaaaagaggcctcactctcgatccctcttgggccgatttcggcccggacgacaccggccgtccgatctctagggttttgatcggacgaccgagcgtcaatagtggggaaacaaaacccactccctctcagccgcggaaccctagcccatttccccccctcccatctcacttcgccgccctctcctccgcgcccccgagcggcggcggcgacgacggcgcccctcccccaccaccgatggcggcggcgggggcacccccaccacccacggcggcgtcgggggcatcctcccccaccaccggcggcggatctagcgggaggggaggcgccccgcgaccggggcgaggggacggcgcccttcttccgcgagcggggggggcagcaccctcccccaccaccggcggcggatctagcgggtggggaggcgccccgcgagcggcggcgacggcgcccctcctcccgcgagcggcggcggcggtggagtcctcccccaccaccgacggtggcggcggcgctctcccccaccaccggagagtgcctctgccgccgccgctggcggatctagcgggaggggaggcggcggcggcggtgctctcccctccaccggatccacagcgacggcgacggcggcggttcggcaacgacggcgacggcgacggcggcagcggcggcgacccccttcgatctaattttttgtttttatttggatatatgtgtgctggcggcgacccccttcgatctaattttttgtttttttgcaaagtgctataaggctgcatgtgattctttgttatgtgctatgattttttatactatgtatgtatatatgcacttgttctccttgtgatgctaaccgaataggacttggtataattcaaaccaagtcctattcgcccaaacaaaaacaaagtcctaatcagctcaaacgaaaacagatgggagtttgtttcctatttttgtggaatcggacatattcttttaccgcgttgatgaatcggattcgttccggtttttttcacccggtttttttgacggacga

SEQ ID NO: 43323 - DNA, 6304 bp, Oryza sativa
tcgtccgtctaaataaaaaaatagaagaaaaaacctaaaataaaaaagtccgattccccataagaaagtggcgaaaataaaaaaaactaccgtatccgattcccatctaattttgttcgttttcttttttttctgtttttttccgttttattttcttttcctgtttcttttttttctttcaccttttttccggttttctttgtccgttttcttttcctcctttttgcgtattttcttttcgccgttttttctttcaccaatttttctatttatttcttttaacgctatatttttttgcggttttttcatcggaacaaacccagtgccgccgccacgttgattttcctcctcatatgcttcctcctcctatttactgcaataaccgattctccactactctctcattatttttccccatgaattcccctttcgattcagctttaatttaccagattgaatctccttttaatcatggttattttttatcccaagttttgcagattgctttgattttgatgaaccatttaatcgtcgtcattttttatcccgagttttgctgattgctttaattttgataaaaaaagggaaaagggagatcaagtggataaaaatccctcaataattttggatatggagaaagattcgaccaaatttgatggagaggatcggcttcgttagtcatcgtacgggtacggaactatgtgagctcgagcggattaccgtatttgatgggaggatcggctccgtcatggtataagactatgggagctcgagtggattactggatttgatgggaggatcggctttgtaatggtacggacacgatactgttcgacttaggcctacaactccatttgtggactgagccaaagagaggtagaccgagcagagggagatagaggactgtactaggactagagctgaaaaggacggaaggaatgtgcgttcatttggtccaaaacgcacgggcattaaagggagtatagtgcgtaggataaaaaaatatttttacccgttgcaacgcacgggcattttttctagtaattacatatattcggctactgctcatcaccaaatttgtgccttttgttctcgcttatataaacttatatgtgccacttatgaatttactattccataatgtgaagaaatatttatggtactatgatatatgttgttagatatttatagaatttttaagacttacttacttgaatatatacaacagaaatgcactaattaccttgtaatgaattttcaattttcatataccaactcaaacacatgaacaattttgtggtatttaagaaggtatatattgtgaggtactacaattttaaatgttactttgtgtaactcctatgagatcaaaaaagtttgcactaaaatgcacggggtatctcctttaaaaaccatataaaatcaccaaacacgtatagtttatttataaaaattctgatcttacaagcacaaatacaattatttgtagccctttagctatcatgcattattttcagaagcattacaaataatccatcctctgtcacctttcaaggggtaagactataaagcttgttgtactcgtctcaagctccggtgtcgaatctggacaagttctcgaaaactcccatgtactattcgcaaaattcttgcgtttcagagaaattttggtggaatcagccccaacccatctttcaacattcagattcatatggtcgcacagttttctgtcgccactgtcgatccgcatttcttcaagaaccattgcattttgagcgaagaatttgacaagctggactccaaagcaatcgtccccgctccacttaaacttcaggctaacttttttcagacttctctgcaagcaggtgaacgatcgtcggctcaatgcagggatatcagggacctcatcgacatggcgatcaccatctccttttctactatcgatcgaggaaatcgccgtcgtcgtgttcgatttgcggcgcatgaagtgatcaacggaatcgtagaaatctggctggaatctgccacggtggtttggccaatatctatcagtgcacgttgtggcggagttgagcttcatggtgaactcactgagaaccgggcagcaacggaggagattggcgatcgccaccgccgatttcttggtgttcatcttggtgttcatcagctgcgccgcttcaagttcgacggagacgaggttcggcagcacgcagaggagcttcgatcggctcgccttgtcggcgacggcgagatgatcgaggttatccactttcagcttgagcgtcttggcgttggtgaagttgccgatgaaacgccaggagtggacacgtgctgtgtcttccttgagataatagtcggagttgaagtggaggctcaccgccgtcgtcgtcgtcgtcgtctccggcgccggcgacttgaggtggaatggccgggggaggcctttgtacctgaaggagcgcagcttcggcgcgtcgatggcgatgctgccgccgcagctgtcgtcgtcgtcgctgtatctgctgtgtgcgtagtagaacttgtagtcagtagagccgcaccattccagcgcgagcgaggtcgccgccgggcagcggaggctgatgctgctgcacgcgccggtgtcgcggtggttgtagctctggttgtcgttgttgtcgtcggtgttgaagacgacggactcgaggtgcgcggtggcgagccccggcgcggcgtcgatgaggcgctgcaggtgcgtcaccttcgcggcgcaccgccgcagccgcagcgtctgcagccgcgggaacgccgcggcggcggcggcggcggcgggcggtggcggcagggagaggttgttgcacccggcgatgtccagcacgcggagcttctcgaacggcaggaatgcgaggctgaggccgtagacacctaagtcggtactgggctcctcctccttgtcgcggcggcggcggtggacgccatagctgtcggactcggaggcgacgcggaggcagagctcttcgacgaggcgcgccgccgggtgggagaccacggtgtggagcacgtccatgcccgtgaagatgtcgtacgccgccgccgactcgtcgcagtccaggaaattcgtgatacagtagccgtcggggccgtccacgtcgacgctcagcctcgtgacgtggtcgcatgagatgtcgccgtcggcggccgtgagcgccgcgccggcggcgcggaggaaggcgtcgcggcggcgggccgaaggttcctccgccgtgacctcgtcgtcgtcctcctcgtcgcctaagtcgaagtcctcctcatcctcgacgtgttcgacgaggttgacgtcctcctcctcctcgtcctcgacgtgttcgacgaggttgacggcgccggaggaacgccagagcgagccccaccgccgggagagcaggctggtcgacgcggcctccctgaaggggacgaagtggaggatgcggcggaggaggtcgtcggggaggtcggacaggcggtcgtcctcgccgccggcggccatctcgtcgtgggcgcgcgccggcgaggctatgcgatgcgatctggctattagacgatggaacgagtaaacgatcggtggctttattcaggacttcgtggacgtgtcggtttggtatcataccagatatcacccgttccttttgtttttcaccttatatctgtcccgtcaaaattatgctatgagattcgtgcgtggcaaatatattacgaatagggtttcggaccacgatacgaaactgtttcgtctaaaatttccagaattgttcatgtgctttgaatttagcacggtttattcacatttttatcgaaatttgttaattcaaattatttcggaccagaatattatgaaattctgcaattttgaaattccggttctatctgcgccggtaaaagggataaaccgaaattttgaaccctgactataagttatattatgaccatggaaataaatatattatctaagtgcccggctatatatgcctaatattggtctcaaaattgttcatattgttgtagcagggggctaacaccatactccctattcggtcaaaacactaaagagaaggaggtcttgagatttctaagtgtttaaatggtaaaatactactcgaaaggtaaaacattattcgagtggaattaacgttctattcgagtggttttgtgctactgaagcaactcgtctcgtttgagtaggtttctgattagtgataggtaagttccgagagccaggcagatgagaaggagtattcaaactctcaatatggaaaagacaacccaagataaaaaagacaactcaagatggaaaagacactcaacctaatgactcaaggggaaaacactactcgaacaagaaagatggcaaaagattccatggggaccactctcaaccactcctcccagctggtaccaaaagaccataatgacctccaaaatataccaaaatgtggtgacttcgtcaatctctccaggatttgccggcctagtcttcaaagatgctcataggggtagggtttgcgtacgtgcgttcataggggtgagtgcgcgtgcgttgtgagtgtctgtgttgtactgtgtaattctcaaaaaaaaatacccctaaggttactgacatggcaagggtataattgtaaactcataaggacccatagggcaaaattgtaatatcacatgtacggctgtgggctatataagctggccaaaatcctgtagcaggacaagacataatttaatagaggaatatcaaccaccaaagttgcttttgtgttcgagctcatttatcaggataggctggaaaaaggaatttttccgtttatccccgaacttgtccggtcaagacacatacgtattcacgcatactgatactgaaagccttttgtagttctgttcaaaacaattttatataataactaatttagtttgattctgaaggggatgcccctcgcttttttacacgtctcctaaataacaaaaaaaattaaaagcatttgacaagaaaaatcaatgtgatacaacgcttaaaaataaaagtttaaatccagcctctacaaaatattaaaaataataaactgaaatgtgtattatatatggtaatatattattgaactgaatttaaattgcatgtttatgttgtagtacatattgataaatcttatcaaacttcctctaaaaagtcattactatttggataatatgaaaaacaaatgtaacgctccgcttttcgtgagtcgttaaaaactatttcggcaaaatccttattgcgaaaattttcgttctttgtgtgcgagtctaagttgtgccaaggatctcaattcaaatcccgttgttccctcccatcgccatcaaaatcgtccacctcaagattccaattccgactcaagtctccgaaattcaatcacatcccttgaatccccgccaaatacctatccacatttccgaaaatatcaaatccccatctcgaatcatttccttgagtctcccttgattcatccctaaaccctcgagtttgaatatcaaatttgaattcgaatccaaaccctaaatctctccacttctctccagatcaatctcctccgaaaaagtctattttgcctccctcggacttttgtgggccgttttctcctcggcccatctcctctcagccgctcctcctcctccccctcgcacgtgcattgcgcgtgtgcgctcactctctctctgtttctctcgctctctcgtctttttcctctctctctctcgtcgaactcctcacctcggcgccgattcccgccgccgccgtttgaattcgccggccgcccctcccgcgcgcgcctcgcctgcccgccgcccaaaacggaagggaaaggcttccctttccaccgtcctccctcacttttcccttctaaacccggcctctctcctctcgcccttgtcttcttgcgcgcggaggcagaggacgccgacaacgtcctgccgcgcctgtgccccaccttgaccgcgccagcctgcgctcccgtggttcgaaatcggccgtccgatccaccgccttcgccgcccaaagcatccacgccgtcgccgctttcgcatcgcccacgaaaccgcagctgccgctagccgagcgcttgaccgccaaggtcggttctcccccccccccccaaaccgacatcgcctcaccccgcgcctataaaacccaaagccgagctccccttcccatctcaatccctcccacttcacactcctactccaccgcgccattgtcgcccttcctctgctctcgccgtcgccgtccgccgccgagcaccgggagaccggtgcggggctgcaggaa

SEQ ID NO: 43324 - DNA, 12540 bp, Oryza sativa
ccgctcgtcactgcgcccatctcggcttggtaatgccaccctccgttctcccttcttgctcgtccactccctccctagctcgtgtggtagctcggctagcccccccgaacacgcatggacactgccccaggtctcgccgccaaaccgccgctcgtcgcccttgcaccgcacgctagctcgccggtcgccatgctctgtcccggaggccgtctctcgtcgccagccaacctcggtgccgctccgtccaatccgacgccgggaacggattccttgaaccccggagatgctcccatccctttgaatcgaaccctcgtcgtctcgtcgtgttttcccctttttgctctccggtgattgccgccgccgcaatccgccatcgtcggcttctctcgcgtcgattcctctcgccgccacgcccccggggatccccttgacctccccctggctgccccaaggccgtcggccttctcctttgtctccgcgccgtgtcgccgcttccgccgccgcataacgccgccgtgcgtgcgccgccggtgaccatcgggtcccgcgtcaccgcgtgcgcgacgcaacaccataccggttcggctaaacccgagcccgcgcacccttcgctctcctcgcgcgcggccacgtcggcatgccggcgagattggccgccgccgccggccgtcgtcgcgcgtcctcttcctgatccgagccgtggaatgagttccccttctcctcctcctgccgccagtgctagccgccccttccggctcgccgccgttcgccggatcccgccgcatgccgtgagccgtcggatcagcctgcccggcctcctctgcctccccatctgacgtgacttccacgtggacgccacctcagtcccgggcccgcttgactgggtcaagtcgcgcccagtcagcctcctctctccgtcttccctcccgtgcgcgctgtccacggcaagccgtgcggctgcacgtgggcccgccgccatccgtccacccggcgcgccacgcctgaaccgcgtgcatccgaaaccctagcgcccacctccgcgtgcaccctccccaccgtgaacccaaccactgccatgtgggtcccgcgcggtggaccgcgcccaccccgacgggccaccttctctccccgcgcgccccttgggccgccctcctcgcggccgtgccggcccattaggctcgcccgagctgcgcaagtccctcgggccgcgccaatgccacccgagacaagtctgattgacatccctccatccttttctttttccagggatttaataaatcctttttcctttgtcccataaatcaattccttattccaaaattccacaaatcatttcctttggtcccgcgcgtcagtgactgtcaataatattcttgagaatattatttctataaaattccataaaccatttctcctattccagaaactccaattaaacttccaaaattcatatcttctcaaccgctcatccgattgactccgttccacttccagtaattccgtaaaattgagatctatttaatggcactactaattagtctaaataggatctttcttttggtcttttgtttaggttttcgattgtttgcgtatagttgcggttatcggattttcgtcgatcgcgggttttctcgaagattcgtgaagcttcgtgaagaccttgagcaaggcaagtcaccctttgatcaattgctcctataattgaaaagtcattattattttgtttgcaacttgcattattagaatcacacacttaacttgcttggcctcggtttgcatgccaaatcgacggacctacccagtagtcgcactaatttccgtaggtcgtactaccctgattccttgtcgctccacccttgtggtacctcggtattcgtgctctctgagcgcgtataccaaatatcccacatacaccgttgtttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataaccaaagtgcaaccacaaggtggaatgggacaccctggctaagtaactagacggttcagggaaacctcgcatgccaatagttgggaacgccggggcggggtcggacaaaccgggttcctggtaaggcaaggacgagaagcttgctcacttaccgatcaaggtggttggagtttgatttgtgcacgcctaaaatggcctatgtttatgtgaggatttgatccttctatgtggcatgaggtaaccctgggtcggctggggaaaggctttgttgcgaacctccgataccgacgggtgttcggaataagttcgtatcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctatgtggcagatggatgacctgagtggtcagaaacaaatctgtgtgattcgggatgtctgcgggcatcatagactaggcttcccgagtggaagcggattgttgtgctgctgggcagctggactctgggagtccgagaaaatgaaaaaggctctgggagccgattaatcaagtggaatggctctgggagccgagaagtaatgatctgacccgggaggtcggtacattactaaatgagctgttgaaaagcatctcctaaagtcgaatcgagacgcaagtctcttttcggcccaaacttagaaagaaataaatcacttagtgatttcaaaatgtcttcaaataaaagatttgcaaaacaaccttgcctctcttccaagcttgcattaaacacctaagttcccgtgacttgttgagtacgaaagtactcacccttgctctatataaatatatatatatagttcctccgccctgaagagaagataaagtaaagtgaagattagggtttcgtcctggttcccagccgtcgcctgtggtgttgggtgttagaccgttggttccgctgctgctgctgctgttggtgtttcctcgtccgcgtcgtcggttgtattctcgggctgtctgagcttgtcacgcccggaatttctatccaaaattccaaacgcttacatgtgtgtgaaccctcgtccaggagtcagccgaggcacacaacaacaaattgataatagagtacaattattactctaattaataagcgaataaaatgtcattacagaggtagatagttcctctcaatcaaaaaagatctaagcagcggaaaataaaataaacggcgcagacgactccactccacaggcagcttgaccaaggctacacctactcctccacaccatcagcctcattgaagaactcttcctctgatgaatgattgcaaggtgagtatatgacatactcagcaagccacgcagcaaatatgcaagtgcacaggataacaaaggatggcataatagggttccatttgcaaaagcagcatttagcaaacatttcagaatttaataaaacagttaagtaataattaaacaatattaaaccaacactatacaacataccctgttgtataggcccaaccattctgaacaaccatcccggctgcacagttctatctccaaaccaggaatgtaccattccattccaaaccaggagctaatcaaattgttaccaattatagcatcatttactatggtgagaagtgtgaaactaatcacgaaagacattgttcgacccgcccataaccgcgggcacggctattcgaatagttttactctgatcagaggtgtaccactgtacccacaagacacaaccccacatcatgtcaccatgtgcctcaataccaccacgatatctcggaaaggagttgtgacaatacccctcgcataacacaatccattgcagcgcaccttcctggatcataatcacccccttataaacaaggcatggactcccagcgacccccgtgggcttatctccgccacttctcagtctggtgccccgcaatgaaccacgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattatcaggttttagttggcacattaattaattaaccaatcacgattgaccatcgtgaactatcattaagccatcattaaataatagtgaatcataagttatcccaatagtgagctaatgtttctaagcagggctaagcaattatacctaatatctagttgaaccaatatataaagctcaactagtcaaattataataacccaaggtatcaaggaataaggtaaacaagaacaaaagggctataacaaacaataggttaattccacccaatgacattcgaaaataaatgcaatagttgaatagaaataatagctttaaataggatcaatatgctcaaagggttgtttgggatctgtgtgacttgccttgctggccttggaactcttcaaactcttctccggcgaaaacgaactctccggaaacgacggaatctaagcagaaaagagcaaaatcaccaaaacagcacataaacaagcatgaacagtacatgtggatatttttaatatgtagatctcaattttagaaaaatttagagacttgaaccaactaaatcggagctaagatgaattagttatgaatttttaaagattaaatcggattaaaacacttaaatcggtttaatttgaattatgacgcaataatgaattatttttgaaaaggaaaaagggatttattgcgtcagcgggctagggttttggtggaccgggcgcacgggcggcggttcacgcgaacggacggccgagatcgatccaatccaaaacggacggccgagatcgaacggtccacgaccggctcacggcggacgaccccgatgacgtcagcggtgacgtcaccgacagcggcggcggctcggcggagcggacggctcgggcggcgcacgctcgccggtgaacggcggcactaggacgcaaacggagggcaccagcacgtagaggacgacgcggcgaacacaccggtgaccaaaacggcggcggacgaacaacggacgacgacggcgacgagaaggaagcggcggaaaccttcgggttgtcgacggcgacgctgctccggtgatctccggcgacggcgaaggggcgaacgaggacggcgacgcgacggcgaccacgatgacgtccttcccgagcgacggcgacgtctggaacggcggcggcgcacggctggagcggcggcgacgacggcaaagctagggcacacggcgctagagctcttccggcgacgagaggcaaaggcgaaggtggcgacgggtagaggagactccgggggtccttttaaaggggctcggaggcggcgacgaaggcccacggcgaccggcgacggcgaaggaaacctcgggcttggagagaaagaaaccgatccgaatcgaactcgattccacgagcttccaaaacgttttagccgatgattccaaaggagaaaaggtagaggagatcccggagattgtttcccctcttttgattcggccggagaaggaaagggacggccggatttggaagggaaacggcggcggcgcgaactagggttttcggcggtggcggccgaaggaggacgaagaacctgacaggtgggacccacctgtcagcgaccgacgcgcgcgcgcagctgcggactgggccggctgggccgaggagagagaaaagagattttgggccgactttcggcccaaagccaaaagaagactttttaaaactttttcaatttaaattatttcttaaatgcaattcgatttattaaaaacactttcttagctcaaataaatcctagaaaaatctaggaattatagaattaagcaaagtatttaatgaaattttatctggccccattttatattggaatttattaattaaacttagattttcttttcaagacttttaaaataaattctagaaattccatttaaacaacaatttatatattttgaattttcagggtgtgacaaacctaccccccttaaacagaatctcgtcctcgagattcggaagaactggcgaacaaaagcggatgagctgacttcaattcatcttctcgttcccaagttgattcttcttccgagtgattactccattgaactttgcaaaaacggataactcgattcctggttcttctctcatttgtttccaagatacggattggtttctccacataggtcagatcctcttggacttctatctgttcaatattagcttcttcggtaggtacccttaaacactttttcaattgcgaaacatggaacacattatggactcctgccaaagattgaggtaactccaactgataagcaacctctcctcttctactgacaatcttataaggtcccacaaaacgcggtgccaattttcctttggtgtgaaaacgatgaacccctcgaagaggcgtgacacgaagatacacatactctccttcttcaaaactcaaatctctacggcgattgtcggcataactcttatgacgagactgagccactcgcaatctttcttgaatgacctttaccttttcttctgcttcccttaggatatccgtcccgaaaacctgacgttctcccgtttgatcccacaaaagcggagtgcggcacttccgaccatacagtgcttcgtacggagccatctgaagactagcttgataactgttgttgtatgaaaattctgcataaggtagattcttatcccaacttccaccgaaatctaaagcacaagctctcaacatgtcttccaaaatctgattcaccctttcggtttgtccgtctgtctgcggatgataagcaatgctaaagttcaacttagaacccatctcttcctgaagtttcttccaaaaatttgaagtaaactgactgcctcgatcagacactattttcttagggacgccatgcaaacacacaatccttgccatatacaattctgctaagcgacttccggaataggttgtttttaccggaatgaaatgagccactttggtaagtctgtcgactattacccaaatagagtcatggcctgatgacgttctgggtaaaccagtgataaaatccataccgatttcttcccacttccattcaggaatcttcaaaggctgcaacaaaccggcaggtttctgatgttctgccttgactcgctgacaaacatcacatactgctacgtattctgcgatttcacgcttcatacttgcccaccaaaatctttccttgagatcctggtacatcttagtactaccagggtgaatggagtataaagtatcatgagcttctttcagaattgcatcttttaaatctttgttgtcgggaacacagattctctcgcccagccatacagttccttgctcatcctccaagaaaccgatagcttttcctcttctcatattcttcttgatttcttgaatatcaggatcattaatttgggcttctctaacttgatcaattagagtgggcttcgcttctaaggctgcaacgaaacctctactgacaattcctaaatttaatctttcaaattccttgcataattccagtggcaactgtcgtccttccgtagcattgcaatagccttttctactaagagcgtctgctacaacattagcctttcccgggtgataatgaattcccatgtcataatccttaattaattccaaccatctccgttgtctcatattcagatccggctgagtaaagatatactttaaactcttgtgatcggtgtatacctctgtacgagtaccgaaaagataatgacgccaaattttcaacgcatgaactactgcagctaactcaagatcatgagtagggtagttcttctcatgcggacgtaactgacgagatgcataggcaaccaccttcccatcttgcatcagaacacaacctaacccaagtttggatgcatcgcaatacacctggaaacccttctttggattaggcaaaatcaaaataggagctgatactaagcgacttttcaactcttgaaaactctgctcacattcttctgaccacttgtacttcacatctttctgaagcagtcgtgtcatgggcttagcaatcttggaaaaattctctataaatctccgataatatcctgcaaggcctagaaaactgcggatctctgaaactgtcttcggttgtttccaattggttacggattccacattactaggatcgacggcaactcctcctgcagagatgacgtgaccaaggaacttcacttcagacaaccaaaattcacacttgctaaacttagcatacagttgatgttctcgtagcttctccaatgcaaggcgaagatgttcttcatgctcttctttggttcgagagtagataagaatatcatcaataaagaccaccacaaacttgtctaggtattccataaacaccttattcatcaagttcatgaagaaagcaggggcattggtaagtccaaaagacataacagtacattcgaacaatccatacctagtggtaaaagctgtcttaggtatatcttcctctttgattctcaactggtgatatcctgatcgaagatctatcttggagaaaacagtggcacctttaagctgatcaaacaaatcatcaattctgggtagtggatacttattcttgatagtcacatcatttaatgcacgatagtccacacacatcctctgggtatgatctttcttttccacaaaaataaccggagctccccatggtgatgaactcggtctgatgtatcctttctgaagcaaatcgtctacttgcctcttaacttctgccaactcattggctgccattctataaggtctcttatggatcggagttgttccaggtaccaaatctattctgaactctatatcccttttaggcggcataccaggtaaatcatctgggaacacatcggaatactcccggactataggaatctcttccaaagttatctggttcagtcttgaccttaaagactcagatgacagtgcatgaacagttacaacttgaccatcattgctggtgagagttacttttctgttggcacagtctatcacacctttatgtctggctaaccagtccatccctaggatgacatcaaggtctttggattctaacaagataagattggccagaaatggtactcctttaatttctattctgacagaggggctacgttgcaaagagagtgcttgattacttggggtactaaccatcaaaggacgtctaagatcttctacttccatcccatgatttcccgcaaaactcatagataagaatgaatgtgtagcaccagaatcgaaaagtactgttgcaggaactaagttaacagggaacgtacccaaaatcacatctggagcatcttgagcttctgcagcagcaacatgattgacacgggcctttgatgctggtgcggtagagttgctctgggcagggacaaccttcacgcgtcggggcttcggacacttgtcagcgtaatgtcctgggtctccacagttgaaacacaccacgggcttgctgccttgctccctcttgacaggttgttgctgtgctggagctgcaacaggacgtggagcttgattgcggatgttgttgccagcattgttgttgaagaactgacgctgcggacgaacaacagacgaagaacctccctgtggcatagactgggatcctaaagtaagacgcggcttctgattattcccctgttgtgccttgaagtgagcaatccggcatttcttctgttccatgcgattatacttgtcctcctgacgaatagccttatccactaacttctggaaatcagaataatctccagtcatgagtgggtaagaaagctcatcattaagtccttccaagaacttctcttgacgctcttcatcattgcgcacatcttccggagcataacgagcaagacgattgaactcgtgcagatactccgtaacagagcgagatccctgcgtaagcgacctgaactccttcttcttgagagacaccactcccgatggtatatgcgtcttccggaaagcagcggtgaactcaagccaagtgataggttcagcagtagtcctattaaggcggaaatgatcccaccattcagaggcagggccatgcaactgatgcgatgcaaatgagaccttctcctgatcagtgcactgaagcaaatccaacttcttctctatggcatgcaaccaatcaccagcttcaacaggattagtggtactagagaaaacaggcggccttacatgaagaaattctgctaacttattctgaggaggtacatggttatttccttggttctgctggttctgaagttgctgcatcatcatgttcattagctgtgtctgttgagcaagaacttgagcaagagtgggattctctccattgttattgttattggggttgttgggaccattcccgttgctgcgagtgttcaccatctggcatggacaggataagaagagaaaccgggggaaactacttaggacagagaattactttaacttttattgatcttaactgagttttattataacaaactgaagactctcacaccactaaactcaccaacttcctaacactcaaaagcaagcaaacgcatgcacttacatcccaccactgatgtaaatcacatgcaagacccacacacacaaccaaacttaaagcaagcaaactaacacaacgatctaagacaacgacttaacaagtcactctagttcttccaagcatcggaggtcgattgaaggctcattcggctcgtcttcatcatcttgggttgctacccactcaatcttggaatggttgcgctcggattcttcttcttcatcactacttatgatgatgactggaggatctgctggggcaacttctttctccaccacacgaacctttggcgccaattgatagcgagggacaaatagagctctcttccttgcggtaagacgaatcctggccttctgcggtggtgcttctccctttaatgcggctagttccttctccaaacgatccaccttgtcttctagcttgcaaatcttaccacgattccgatcttcacgatcttgagctgctaacacagtctccgcacgactttcatccatagcccacagcatctcaaccaaatgccttgtggtagcatcattctcaattccttcagtctcaagatagctgccacggtcacttccctggggttggcgaggatggtagcgatactcagtgtctgccaactgatcactgtagcgatcacggagctctcctatggcgatccttgccacctcctgacatgcatggatgtagtttcttcctccagcttcgaacatcactgagggaatatcttcactattactgttcaaggtgactttgactcggcacttctcttcatgacgatcatgacgaatctgggcataaaaaggggcagtcccaaatccaatgacaaaggacatcgtacgcaactcctggacaaaaccctcaacaccaaacagatactcaggcttgtagcgcggcatctaaagacaagtgaaaggagggagttaagacatttatccaattaatagcacaagtttttggattaatttgaataaagtttagaaaatccaagtaaaaggtaagtaaataaaataaaccaagcttgcaagatgagttgaaatagttgaaaacgaggtcacaagttttgtacttttgaataacaggtttcaaaagaaataaaatcaagttataaaatcatcatgctaaatttattatattgcagcaagactaaataaaacaatattgaaaacttttgctgataaatgagccattagtacagtaatagatgtacagtactaataacactggaataaattttgagtgagagccattaaaagggattatgaagtgcatgtgccattagtttggtttaattaaaagagaaagggaggagaacagttctacttttccaatatttttagagggcttctatgggtaaccatttggcataacctagggtcaaggggctctgataccaacttgtcacgcccggaatttctatccaaaattccaaacgcttacatgtgtgtgaaccctcgtccaggaatcagccgaggcacacaacaacaaattggtaatagagtacaattattactctaattaataagcgaataaaatgtcattacagaggtagatagttcctctcaatcaaaaaagatctaagcagcggaaaataaaataaacggcgcagacgactccactccacaggcagcttgaccaaggctacacctactcctccacaccatcagcctcattgaagaactcttcctctgatgaatgattgcaaggtgagtatatgacatactcagcaagccacgcagcaaatatgcaagt

SEQ ID NO: 43325 - DNA, 3182 bp, Oryza sativa
ccgaggagaaagaaaagagattttgggccgactttgggcccaaagccaaaagaagactttttaaaactttttcaatttaaattatttcttaaatgcaattccatttattaaaaacactttcttagctcaaataaatcccagaaaaatctaggaattatagaattaagcaaagtatttaatgaaattttatctggccccattttatattggaatttattaattaaacttagattttcttttcaagacttttaaaataaattctagaaattccatttaaacaacaatttatatattttgaattttcagggtgtgacagagctgcaacctaagttaaggtaaataagtcctctatttattttaaggattgctatgattcatatttgtcaccgtgggtaccagcactatatcctgggactggtaccgagatcgcggtttcgtaggaagcggttcacgccgttttccctacgacacgctcctgtcaggtgccgttgtacggcggtatcagattggggtgtgacaacaaataagggtgcatgcatacaaagaaaaggaagataatctttttctactgcttttttgtggtcgataatattttctattaatacttattgcagttcatcatatcaagtatacaaatccatcttcagtgagcaaaaatttaaatccaactatcttgatagttcttctttcaagatgagactacaaatccagatagatgtactaatactcctactacaaaaccaggtgaacttttcagaaattccagacaaactctgtgcagaattcctagtactcttggatgattaatttgggcatcatccatccttcaacgttcagattgttctactctctcaggtttcagtttccactgtcaatacgcgcaattcttcgagaaccattgcgttttcagcgaagaattttaccagacgaactccaaaattctcagaattctcatccaacctgaattgcaggctaactcttctcagattgtactgcaagcaggtgaaggagcaggcagtcaatccagggatgaatccagaaacctcatcgccgttatggcgatgatcaccacgctttgatatgctgtttcgcatgaaatcatcgatcgacctgtcgaaatcaagctgggattttctttgaaagaaatgctgaacttgcttcgagttcttgaaatagtcaggtgacaccgtgctgatgagattcaggttgaggtcgcagagcactgggcagcaatggagcatgctcgcgatcgcggcggccttcgccgtcttgctccaacggttgaaacctccgtcgagctcgaggcgagcaatgttggggaagaatacgccatggacagccatgctccgcctttagcttgagcaccttgaccttggtgaagttatggatgaaacgaaggtaatcacgttgatggaagtagtggttgaagtggaggtgcaccatcttcatgtccggcgccggcgaggttagctcgaactgcgacctcgccgcccccttgtatgtcaaggatcgtagcctcggcgcgtcgataacgctgccgctcatgccgccgttggtgaggcagttgatcagcgtgagcgcggtggcagccgggaagcggaggcgggtggtggaggacattgccagctgcaccaggaagtggacatcgcggatgttggatatgagatggacgaactcgaggcgcacggcggcgagctccggcgcggcgtcgatgatgcggtggagatcgtcgatgttcgtcgtgcagtgtcgcagccgcagcgtctccagccgcgggaacgcggcggcggcggcggcggccgccgacggcgcgaggctgcggcagttggtgaggtccagaacgcggagggtgttcgacggaaggttggcgggattgatgctgtagatcccgacgccgtggctgctcacgatgttgcccttgtcgccccagtgagggtggacggcggcgacgctgagctcctcgacgcggcgcgccgccgggtgggagaggacggcgtcgaacacgtcgcggtggccgcggcgctcgtcgttctcgctgctgaggaggaagctggcgatcgagcctttgtcctccttgtcgcactcgatgtggacggtgagcctcgtgacgcggtggtcggcggcggcggcggcggagagcgccgcctcggccgcacggacgaaggcgtcgcggcgggcgatcagagccgctcttccgatgtatctgctgccgcaggggacgcgcgcggcgaggttgacggcgccggaggagcgccagagcgcgccgaacggccgcgagagcaagctggtggacgcggcctccttggcgttcgcgaagtggaggatgcggaggacgagttcgtcggggaggtcagacaggcggtcatcgccggtggccatcggtcgtcgacgtcggcggcggcggcgatcggttgttgagatcgatcttggttcgggttatagatagtctctgtagcgaggcggcgttgggccaaatcgggctgggcccattaggctaaaatgggctaggccgtaatttttatgaaaaaaaaggttaagatggactgtaatttcagttttaatttaaaagaaaaaatgagaaggttaagaaggactgtaatttcagttttaatttaaaagaaaaaaacgagatttgaagagagagacatcctcaaaatatttttttaagacgaaattatgagggtgatgggtttgttttttttttaaaaaaaacaactcacatcacacggtgtgaagtttatattgatagagcaggaaaaaaaattgcaaacaagtttatatttaaaccacacacgccttgccacaagttgattgccacaagtttactgatatttaatttgaattactaaacactgcaccttttttttcaaaaaatggagctagtatgacagtcaaaaggttgattgtcataggtttactcatatttaatttgaattcccaaacactgcactttattttatttttttacaaaaccacgtgtttccactttccacaagatgctaaaaatataaccgcaacaataaccgtaaattagccatcaaatccacatgagaacactacattaatccaacttcagtgagcaaacatgcaatccatacgtatcttgatcattcacctttcacacgttgtgtgaggcacacacaaatccagatgtactcaataccctacaaaaatattacctg

SEQ ID NO: 43326 - DNA, 16344 bp, Oryza sativa
  unsure (1)..(16344): unsure at all n locations
ttacaaaagattgatacattgtaagggggaggagaagatctgtttccaaacagagattacaaatcgatcatcttccgttaagttctctgcccaaagagttgcctcggtaatgcatcgttgtaggcaggctcttaggagactccagtgtgtttttctttaatttgtgctagcgtcatccatcctttcaacatccagattattgtcctagctcagctttctgttaatttcccactgtcaatatgcgtaattcctctagaacaactgcgttttcagcgaagaatttgaccagacgaactccaaaagacttggagttatcattggccaacttgaattgcaggctaactctcctcaaactgttcttcaagcatgcgaatgagtagtaactcaatccagggaggaatccatcgtcgtcatcgcaatgatctcgcaagaaatgatcgataaacgagtcaaaaaccaacctgagaatttcttcgaaagaaatgctgcactcgtttggagttcttggaggtgccgacgagattcagcttgagctcgcgaagcaccgggcagcaatggaggatgctcgcgaccgccgccgccgtcttgttccaggtgtcgtaagctccgtcgagctcgaggtgctcgatgttggggaacactctcacgaacgccatgtcgctgaggtggcgcgacgccggcgccttcagcttgagcaccttgatcgccatggtgaagttgtggatgaagtgtaggtagtcgtgtcgacagaaggcgtgggtgaagtggaggttcaccaatgccatgtccggcggcggcgccggcgagatctgcaggtcgaacggctgaacggcatcccccttgtatgtgaaggatcgcagcctcggcgcgtagatctccatggcgccggtggtgtcgcagttgatcagcacgagcacggtggccgccgggaagcggaggcgggtggaccagactgtccagacatcggagctgtggccatcggacacgaggtagacggactcgaggtgcacggtggcgagcactggcgcggcgtcgatgacgcggtggagatcgtcgatgttcgccgtacaatgcaatgccgcagccgtagcgtgtccagccacgggaaggcggtggcggcggcggcggcggaggccggcgtgaggttgcggcagttggtgaggtccagcacgcggagggttttcgacggaagggaggcgagcttgatgtcgtagatcctgacgctgccgctactgatcatggtattaatcttgtcgtgcccgaaagggtgcacggcgacggcgacgcggagctcctcgacgcggcgcgccgccgggtgggagaccacggcgtcgaccacgtcgtgatctctgagcaagttgtacatggaggtgcagtagccgctgtgatctccgtcgtcgacgtgtaaggtgagcctcgtgacgacgcggccggcggcggcgagcgccgcatcagcggcacggacgaaggcgtctctgccgccggcgccggggacgcgcgcggcgaggttgaccgcgccggatgagcgccagagcgcgccgaaccgccgcgagagcaagctggtggacgcggcctccacggcgttcgcgaagtggaggacgcggaggaggaggtcgtcggggagggcggacaggcggtcgccgccagcgccgattgccatgggtgtcgtcacctcgtcggcatgcaccgccggcgattctacacgacgcggcgacggagatcagatcgatcttgctgtcgaagatgacatgtatcgatcgggtaagtattgtggcggcgaatcggccgaataaatcgtccgcgtctacgttcagatcgctcgatcaccagatcgagctctggcacatctttcgcatccctaggtccacatatcgctcatgctcgcacttcgcggatcagaattaacaccagctgctttattaaagcggagctagcaccaaaacaagagtggtgcactatttttttcggacgcgcaaaaagattacatgttaatatattagaagaatagaggttttgttacaacgcaatcggccagacagacctatgctgtgagggagaaaaccactctaacaaccagctgcgaaaagagaaaaggactactacagaaagaaaaactactccaacaaacaaaagggagggggggagggggggtggtgccacactatgctctcagcaaatccccagaaacggcaatgcctgtggcagagcacggacagccttccgagtggatggaatcaatgacaacggggactgaggagagagcagagtcgaaaaccctggagttctgctccttttcacagcagccaaagagactaggaggaccaaggagttaaagctagagcgaagatactcgggccctagaagacagccaccagtccagaagcaaactgccgtgggaaggggagagggcagtccaaccatgaggcgacaacaaacggtgtcaagtctgctgagcgaacacgcaatcgaggaggatatggttcgctgtctcaagctcttaagcgcaaaaggggcaaagcagagtgactatcgatgcctcgcttatggagaagatgtaacatcctgatttttcgtttattttaaaaacctattttaaatacaatctttgaaagtcctaatacaacgaaatgactattcaataaattttaaaaagaattatgtgtaaaactagataattttgtggatgctagccgcgtaattacgtgggtcacccagctagtttgtttatgacttgagttttccatttaaagatgagagtgtatcatagcatgttcctccaacgagtagcagatctgctcgaaagcttgtgcgtgatcgtcggccaatgcgacgaacaggtcgacgccgccgccgtcgccgcccaccggcacgaggatcatcagcccctcgatgggcaggtccggcgacaggacggcggccggcggcccggtgccgaggtccatctcgtggaacctgaacccgagccagctgtccacctccaggtccgggcacagcgtctcccccggctccgccgccgtcgcggcgagctcctcgccgcgcgcgtccgccacctcgacgtagtcgacgaacgactggatgtactcggcgtcgacgcgcgccacggcggcgcggatggcgccgaccacgtcgcggtagctcgagctgagcaggcgccggacctggagcctcgggaacgcccagagcaccatgttgccgaacaggtccgccggcgccggcgggttggccctgcgcctgcagttgacggccaccctcacccgcgtgaactcctccggcttcaggccgcgcgccgccgtgatcttcttccacgcgtgcgcgagaacgcactcgaacgtgctgcaccggccgccgacgcgggccttgagctcggcgacgaacttggccgtgaagcgcacgccgatgtttgcgatcttctccacggcggcggcggcggcggcgccagacgaatcgctggatttattacctaccttgaactcgattgaccggtggtcgaacaccggcgccggcgggctgcgtggcacgccggtgatggcgcggtcgagggatggagacgggacgatgaatgcctcgctgtcgcgcaccgccctcgcccacgtggcgcagaaggtgctcatggagtgtccgtcgaagacgtggtggtggccgatgaggccgacgacgaggccgccgcacccgaagcgggtgagctgtacctgcagaagcgccgccccgaagctatgctccggtagtgcggggtacaggtcggtggcgacgttggcggcgagcacggcgtccaggtcgacctcgacggtcgcatcgaggaccagcacgccctcgttgttgacgtgcaggacacgacgacggcgccggcgcccctggccgtcgacggcgatgcggccagacacgagagggtacgcggcgacggccacccggaggccctccttgaccgcctcgctggacggcgccggcgcgcggtaggcgaacaccaaggggacgaagacgtcgaaggccgcgcggtcgaaggcggagaggggaaccttctcgccggcgagcgggtgcggcggcgtcgtcgtcgtcttcagcatcgcgctgctcgtgatctccattagtgaactgtacgttctcttgatcttttgcttgttggtgctcttcgagaggcaccaatggcatcacatatatagagagcggaggtaggtagctagctagctagcttcgagagatgataagaattaatcgattcccatttttaaaagtgttaaattatcgaatctctcgtagaaggctaggggcttggaaaaccattgccagttatcagcggaaactagtggaaattagacaaattttggtaaaaccttaaaaacgagacattaataagaaactactatatattaagagagtcgtaggtgaagaaataaaagtaagatgattatgattggttgagataagactctaaatagagaagttagtatattgtgagagttatatcttgtgacggtgcatgaggtagtatttcaaaacttttcgtaaggacaaatctagctaaagcatttttcaatagtttaatttaaatactaaaagacattttatgaggcacagtataaaataattgactacatctatgtatatacacaaaacataaaatttcttgcgtgcctatgattttttctcaatcccttttatgtttttgaattttgtcttatctccttcgtattcttgagttttcattttaataccccatatacccccttcatttgttgaatgtgagttggttcttagatttttttccctaaaataaaacgaagcacgtattattgcatgattaattaagtattaactattttttttgaaaaattagattaatataatttttttaaacaactttcatataaactttttttttacaaaaaaaacacaccgactaacagtttgaaaaccgtccatacagaaaacgagagaggtgggttgagaaaactggggaagaacacagcctatattgcctctctcatacttatgtgctagattacagagaaaatacgtacaattctcaatgtgatttttttaacaaactcaaatgggacggaattatttgaacccatacctgaataacaaaatttaaattctcaaacataacttttaaacaaatgatgagttccatacgaaagtttcaccggaattgaaaatcaaaattattttatatttgggcttaattttcgttgaaaatgttatatgaatatcattgaatatgatttgaaatttcattttaaaatattaaattttagttttaaaattgtgctcaaataaatataatccctttattttctttttataaatgaatcttatcgcattgagaattttgttcttctcaataaattagcacagaagctagtatgagagaagaacacgtacataacattttttgaagatactagctatcaattcatggtcaacaactcaggacataaaagatgcggaaaaatgcagaggcataggagggatacagcgaaaactcataggtacgtaagaattttcttctatacaaaatgtaattttttcaaccggaggtacgtatcgtgtgtatatttttacagctcagaaaagtcaactatgtagaacttaactaagcctgatcgatgcttgacttttacactagggacatgaggttgtcaatttggtgctccctaggtgcaagttggtagggttgggtacgacgtacgtacgtgctgcatgcttccagtagacttggcatgtggaccctgtgcctgtactagtcttatactcccttcgtactcgtaaaagaagtcgttgaggacagcgacacggtcttcaaaacacaattttgacttcttgtatctataaaaatatttatgtaaaagtaatatatgtatatacttttatgaaagtatttttcaagacaaatctattcatataatttttaccttttcaaaggtttgacttaaatattgccctaaacgacttcctttacgagtatggagggagtacgattcaatttagtatggattaattgcttcaagtcttgttcattcttcacaggcatatatgtacaaactcaattcaacggtctaatattattcgacttttgagtattacaaaaatttcggctgttgaattgtggaagttttttctgaattcgcacgcgggcatctgctaattattagcacgtggcgtggcgtttcagttataccctattactatgcatgtgttaatgtgaatgcacgtatggcaagactaactaacggctaacggaagaattttgttacttttcattccgagtacgtctccaaattaagaccaacctagctagaatatcttagacttatactacctccggtttttaatagatgacgccggcgactttttctcacatgtttgaccattcatcttattcaaaaattttatgtaaatgtatatgatataaatcacacttaaagtactatgagtgataaaacaactcataacaaaataaattataattatgtaaattttttgaataagacgaatagtcaaacatgtgagaaaaagtcaacggcgtcatctattaaaaaacggagggagtatatgtttgtgcacgtctgaactttctttcaaatccggataatgaaattgcctgttctcttgaaagagagtctcttctctaaactacctgagttttttttttctcccgtgatcccatcccaacataacattgatcatagactgcacatatagaacatcttatgtcacatgcatgacacattacttagaatataatgttgtagagttgaacatataagtatatgtgtttgcaattccatgttctcacctcatctccctcatttttcacgcacacgctttttaaactattaaatggtgtgtgttttacaaaaaaaattctatatgaaagttatttaaaaaatcatattgatcctttttttaaaaaaaagcaaatacttaattaatcacgcgctaatagaccgctctgttttccgtgcggggagtttagttcccaacttcccatatctgaacacagcccaaacaaatcatctttctcatattattttcacaaaatttcaaaattcattatttctataatatttaacgtatattcatctattaatttcgcaacaattgcagagtgaacttttacaacctactactccgtccccaacgctgccgcgacaaggcgtcgaccacgtcgtgaacgggctccgccgccgccgcctgcccgtacgttctccctgccgtggacgaaacctgtacatcaggtattggccaaatggccatcatgatcatgttcgtcgctctcgacgtggaagctaagccgcgtgacgcggtcgtcggcggcggcagcggcacgggcgaaggcgtcgcggcggggcgagcagagctgtggttccgatgtacggagtatatgctgccgtaagggacgcgcgcggcgaggttgacggcgcccgtggagcgccagagccagtgtttgaaatttcagttcgaaattttcgccccccaccaaaatgttcatatctcatccgaaactttcggttttttacaattttcttgtgaatttagtcaaattttattcaaatccattcaaaatcagtcaaaattttaaaaaatttcgtacgaaaaaaattccgaaatttcggttctatcgctccccctcggcagaaacctaatttcgaaatttgaaaccctggccggagcgcgccgaacgcgccgcaagagcacgctgtggtggtggcggcctccacggcggaggaggaggtcgtcggggagttcggacaggccgggcggtcgtcgccggtcgccatcggtcgtcgatgccggcggccggggggaggctatagataattaaatcgaatcggcgaaagataattaaatcgacctttgattcgctgataatttggatcgggacgtttaagcgctgataattagttgcggcaaataggctgtgttttttctcccgccggaaaaaaaacacggattacggcaaaccgtagtctcggttttaattatatttttttcggttaagcatagattttaggtgcatgcttttcgatcgcattacagtcaattttttttcgatcgcagaaggattatttaaatatagtataaacacggacactcacttatttctataaaagtacaaacgtatatttatctctctataagtatctctaaaatactaggttaggtttgtagtggtattttatatgagtgtcttagttctactgatagagtaggaaaaaattacaagattaagggttgtaaccaggaaaaaggaaaaaaaatataccaccaccgacacaccgacagcgccaacacacaaatacgggagaaggctatcaccggaccggccgccgttaagcgtgaccgaccgctgctagaccaaaaaaggaacacaggcgagatcgcccccgaggggatgccaaaacgacgtcttcaagaagagaaacgacggaaaaactgccgccgccgtccgtcggggctcaataaagccatgattgggcttacgcccggcaaacacccttgaggggtggaacagcatgacaacgcctttaagagggggaacgaaccatcgttgtcggtccgggcaaagccgggctgggttttcacctgctgctcaacatctgtgaatccacgactgacgctccgatgctccaccaccgctcaagctctgccgacatgtgggacccctgcaccggcgccccccgccggccagccttcgtgcgccgaagaccacgccacacccaccggcagctccaggtcgcctcctccaccgccggctgcgcctctcgcgccaagccagcctcctccaccggacgcgcctctcgcgccagtccgacctccctccatcgaccgcgcctctcgcgccaagccggcctccatctttgccactcgggcctctcgcgtcgagccggcctccgcggccatcggctgcgcttctctgcgccaagccgatctccaacccctcctccaaacgatgccgcaccggccaattgcagccgtctaccacgccctcggctagccgtccgagaccgtcatgcctcctgtggccgcagtcatggtcaccgccaccgcagccgctgctgctgaacgcccagccacctcgtcgtcgccatcctcaattactcgacctcctcagccgccgccaccattgccaccgtcgtcgtcgcgcctttgccgccgacgccgacgccgcgggctccgcagcgctaccactgccacgaggtcgccccgcaccagatccactgtccagggggccggatctgcccccggcgcgaccgggtcctgcccgccgtcgccctcctagccgctgccttccatccccgccgccgctggcctgcaccccgccgcctccaccaccattcgccgccgccgccgcccctcaaccccgccgtcgtcacctcgtctgcctcttccgcctgcgctgcaaccacctccgctggcgtcacgacctcctccaccggtagctcgacctcctctaccggccttcgaaacgacgcggccggttctgctccctcccgacctggccacgcgggggggccagatccgcctgcgtcagatccatcgcctccggccgccagcggcaccgaagacccccgcctccgtccctccatctgttccccttcagagctccatctgtcaggtagaggcgcgagggagaaagaaggccccgccgctgctgtccttaccgccgcccggctttgccggcggcgaggcagagaaggcaagggaggggggctggcggcggtggctggcgtcgccgccctagttgccctagagcgaggcgacacgggcacaggattcactccaccattatatacacgtaaacttgtagaggtaaaaaatctcattggcatatggatattcttggtctatcatttgttattttggactgatcgatgtacaatagatgtgttattgtggacttttgtgtgacgccgatgaatccaaactacagaattgtgccaatgaatccatgtattcctgatcatttaccttttaagagatgagactataaatcgggacgaactattacaacaaccaggcatatataattttcgaaactaaattcccataaactttcttcaagtatgtgctccgaagtccaaaccaataatcttggtctcttggatgatttgggcgcaatccatcattcaacattcagatctatgtactttcactgatttcggtttccgctgtcaaaacgtgcagttcttcgagaaacattgcgttttcagcgaagaatttgatcagacgaactccaaaacaatcggaatcctctcccaacctgaactgcagactgactcttctcaaactactcttcaagcatgcgaaggagcaatcactcagtccacggatatccaatctctgattcgattcgaatttgatgaggcgcatgaaatcatcgatcgacttcccgaaatccgcatcacatttcttctgaaacaaatgcttcacttgcttggagttcttgcaggaatcaggtggcaaatcgctgatgaaattgagctcgagttgacgaagcaccgggcagcaatggagcaggctggcgatcgtcgccgccgccgtctccgccgccatgctccagccgctgtaagctccgtcgagctcgaggcggaggtgttccagttcggggaacacctcggcgacggccatgtcgtcgaggtggttcgccttgagcctgagcaccttggcgttggtgaagttgtggatgaaatgcgagtagtcgacgcatcgccccatgccatgggtgaagtggaggtcggcggcgaccaccgtcgtcgtgtccggcgacggcggcgaggttaggtcgaacagcaccgcttctcccttgtacgtgaaggatcgcagcctcagcgcggtgatctccattgatctgcccggtgcgccttcttcgccgcggcagtggatcagcgcgagcacggtggccgacgggaagcggaggccggtgttccatgttacggggccgaagcggcgatggcgatcggacgagaggaggacgaactcgaggtgcacggtggcgagctccggcgcggcgtcgacgatgccgtggaggtgtttgacgctatacgtgcagtgtcgcagccgtagcgtcgttagcctcgggaaggcgacggcggcggaggcggtgcgcggcggcggcggcggcgagaagttgtggcacctggtgaggtccagcacgcggagggtgttcgacgggagggaggagaacctgaggatgtagaggaagacgtcgtcgtccatcacggcgtcgtcgtgttcgtccggctggccacggtggacggcggcgacgcggagctcctcgacgcggcgcgccgccgggtgggcgaccacggcgtcgagcacgtcgtgatctccgactctgagcgagttgtacgtggagcactcgtcgtctccctcgacgtgcagggtgagcctcgtgacggcgcggtccgcggcggcgagagccgcctcggcggcacggacgaaggcgtccctgccgtcggggacgcacgcggcgaggttgacggcgccggaggagcgccagagcgcgccgaaccgccgcgacagcaagctggtggacgcggcctccttggcgggcgcgaagtggaggacgcgaatgaggaggtcgtcggggagggcggacaggcggtcgtctccggccgacatcggtcgtggacgacggtggcggccgcggcggcggcggcgagacgtgacgatgatgggggagatcgatcttggttcgggctaaggtatggatcggagtcggtggcgaggcgggctttggaccaaatggggcttggcccatcaggctaaatgggctgggcagtagtttttttcaaaggaaatagtgggtcgtaattttaggtctaatttaaatttcatcaatcaatcagagattttccagacgatggcaaatcagaatctggtttcctaccattaatgtcactatgaatggttcgattttgaagagttaaaaacagattataattaaacattggtcaaattacagataaaaattgatccaatgagcctatatatatttttaaagtgtttcctaaggccattcacagtgcggtgaggtgacgttcaacctcacctcacgagcgcatagattctaaaccacgtcagcatggagggaggagcagccaagaacggggagcttcatttggccatccgaacctcctcaaaatttgtaagagaaagctagaatttatcaggagaaagcagggaggagagaaggagggattgatgaaaagtgacttgtgacctgtgacgggacccgctaaaaatagtctgcacaggatctcgaatcttgtgacttgtgaagtttctcatcctatctagctagcagttgtgacttactacgtacctagcagcctagaaccagcaaaattatccggcacattgtaaacgccctaaggaatttgacttttcgaactgcaggcttactcctgcaatgtcagaaacctcgctcgtcgtgatcattgccttcatcatcatccaagaaccccttgctctcctctctctctccacggcaataatccaagctcgattatcacattcacaccgatagagcatcaaaatctaaatcttagttatatgaaaaaaaaaactctcaagataaatccacatgtttaatcttcgtagatgagattagacattaaaaatgcaattgctcaactttgaaaggtttgatgatgtttaatgacgagaaacgtacacgggtcctctgtctagctccatcagtctaggttcgaagacttaacctttctatttactccctccgtctaagaatatagtaatctaggaccggatgtgacgtccaattcagtcctaagttgctatattctggtacggagggagtattcgatattaggtcatttcttaatattcgtgtttttttatgttcaatgataatttttcatgactgaagagagctttttttttttaatttggaagtattataaattagatagaattatgtatgagtcgaaaatgtcaaaaatattgcatctaatacaagtctactaaaatcaattatactataattattatatacttcatcagcgaaagcatgttttggccgacttattcatcaaccatcctcttagctcttgcttcagctgttccagcatgaacaatggcccctcggcggacacgcagaacagctcggcgatcgccggcgcgttgcagagcaagaacttggccagcgaccgctgcgccatgccgccctggtagtgcaccaggttgatctccctcaccgtgctcctcaggcaaggcaccaccatggcgcccgccgccgcggcgagcacggcgtgcgggttgtacctgagctggtgcgcgtcgcggagctcattctgcgagtacgagtcgccgtcgccgttgccgtgcgggtggaacaccagcgacagggcctccagccccggcgtgctgttgaggatcgtggtgaccgtggtcaccgcggcggcggcgtcgtcgtcgggaaggcttccccagagctcgaggtggcggaggttggggaaggtggggaagctggccagcgcgtccttgtcggcgccggcgccgaggcgggcggattggaggtggaggtgcgtggcgtcgtcggcgaacagctgcaggaaccgcctcaggccggtgagctcctcctccgaggtcgcctccttgccgcagatgtcgacgtggcagcacgcgatgccgcgccgccgtctggcgtccgcgtcgccgtggtggagcgtgaggaagtcgcggctgcgcggcacggcgcccctgtactcgaaggtgtggagctccgacgcgtcgacggcgacggcggcgaggcggtggcagcagcggatggccagcctgcggaggcgcgcgccgccgaggatggtgaccgcggtcaccgcgccgcaggcctcgagcgtcaggtcggcgaggcgcgggcagccggagaccagccgctgcacgtcgctcgctgggcccttgacgtgggagaggaccagcgtctcgacggaagggagggcgacggtggccgggagcgcgaagccgcaggagccgagggtgagcgaccgcagcacggcgcaggagaagagcatgctcgggatggtgtgcaccggccgccatggacgaaagacaggagtgtagccacggaccttcttgtcgtcggaggaggcgacgtcgtcgtcgtagtccgagctagaggggctatgactaggagcccgtctcgccggcgacggcgagcgatctctcgcttcttgtttctcgtcgtcgtcgtcggcggcgttgtcatgttgctcgtcctcggcattgtcatcgtcgtcgtcgtcgtcgtcgtcctcggcgatgttctcgccgtcgcggagagagtaggcgcggtcgcagatcgcggggcggccgaggcggagatcgatctcgaggccgtggtcggcggccgcctgctgcacggcgtaggagacccactgatcgacggcggcggagtcggcgcgcacgtagcccatcatgtcgacgcggagcgcgcgcagcgggacggggcggcggtggaggcggcggtggcgcgagaggagcgcggtggtgacgacggcggagaagaccggcggcgcgagggggtcgaggccgcggcggtacgacgggctgacgtagccgcggatcgcggggtggtcggcgtcggtctcggccatggacaccgtgtgcacggcggcgaacacgtggcgccaccgcgacgagagcgacgacgcgcgcgccgcctccctagccgggaggaaggagaggatgtggccgagcacctcgtcctccagcttgctcaggcgatcgccgccggcggccatctccagcggcggcggcggcggcgcgtggcgatccatggcgcgatcggtgtacggatcgatgtagtggaggtttatatcgcggcggcgattgcgggaatacaagtcggtttaagattggagagcacaactgggccaaattcgtgccaaactgttaaaattgggcataatttattctctttttgataaaagcccattagtgcccgactcttttttttatcatatcttattaagcctgttgtatttggtgcaacaatgtttacctcgatactaaaaataataagaattattatgatatttcatagtattaaagttaactaatgagcaaatggcaggaactattgcctctcatgaagttgtgttatgcaactcatacataaattttacataacttttgtgctggaaattgtccaacaagtaaatcagctaatttctttcagtcatagatgatgtaatgctcataatctttcagtgatagatgaatagatgatgttcgtaagaatgagaatgcgcacgtgtatacatgaatatgcgtctgtattatgttaaaaaaacataattttcaggcacaaatagattaccctctcaagggtgccattttatgactattaatgaacaaacataacacatattcctattttcttgggctatgctgatccacacgtttctttttcgcgggtggacaaataaaagagtggtgcgctatgagactgacttccaagctttacgagtagaactatcggataagctcaattagcttttgtaaggcatgattgaccctactcttaaaacattgccggacatgtatgaccataggaaagaaattaagtgtcgaccataacactgcgatgacatgagatcgactcactggattaaatatcagtgtggagattatggataccccatatctacacggcgatgatatttggactgaatataggataccgaatatagatagaatatcttatttgtatctcgggtttgtttctcaacttgtacatcaaggaaacaccttgagacttagtcggttacgactgtattttatctgtatctgcatattccgttagggatatagattatcttttgtaacacggactccttcccatatataaggggggtccgggtgcctctaggggcagatgttgattttctccaaatcatacaattaataatacaatcggcggattcatccccggacaggagtagggtattacttcttgaataagaaggcctgaacctgtataaatcctttgtctccaaacccatacactttttcagcttgatagccaccccttttattattgccgaaatctagtttcgacagttggcgcgccaggtaggggtagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 43327 - DNA, 1049 bp, Oryza sativa
gcagtactgaatgaggagaaggctgaggaaaattctcaactatcctgcagaaatcatgaaagcaatcagacatgctatcaaaatggagatcgagaccttgagggcacatctcaatcaggatggatcgccgggctggagccttggagggatgcaacacggaggagcgagatcgaaggcatggctggccggtggagctcgatttttcgcgtcgtcttcggttcaggcgtggattaagctgcgtttgggattttctcgggatgcggtgctagggttttgatgttgggtggcatggcaaactcatcagcgacgccgtggcggcggcggcgcagcgccggagcggaagccgggagcccgaaggagtttaaggcccaccaaaggacacgaatgaacgccgactaaattcctgtcaatgaattcggcctgcatacattcagccctcgaattccactcagcgaattcgtcccacctaattcggaaaaagtacaccgaaggtccctcaatttgtcatcgggataaaaaacgtccttgaaccgtaaaaccagatatgtggggtccctcaactatacaaaaccggtcactcgagatccctcggtggttttcaccccggttttagcctacgtagcagctgtcagcgtgagacccatgtggccccacatgtcaggtgtctacgtcagcctcctctccctctttccctttttctctcccttccttgtctctctctctctctctcacttctgacttctctgcaatgggcggccaccggcgaggaggatggcgcgacgggcggccgcggccgcgtcgggatcctcgtcaacgtcgcggcgaacccgtggctcggcgaggccgcgctccggcgggtcggcacgtcagcggcgatggtggaccggctggtggagatgcccacctggaaccagtggcgaacgcagctttaaaatatagatgggacggagaacggcgatgttaactcgataagagcaatcgaacacaacacatatcgtattaatagttcattcgtataagtgtctcaatttgttagatgtttatacctt

SEQ ID NO: 43328 - DNA, 9750 bp, Oryza sativa
gatcgagtgccgccgcatcctcccgtccgcccctctgccaactccctcctcgccgcatcctcttcgatggagagccagacgaggccaacgggcgcgaggcgggagaggagatccggccgacgacgcggtgacggccgcgccccgctgctcccccgccggccgccgctcgtgcagctgctgcccctccacctgcgcccacccgcacgccgctccgccgtccgccgcccatggagaagagagagggagaggtgaagaggagaggagaagaagaggctgacacgtggggcccacggggtcccacgctgactcagccaccaacgaccgtggtcaaagcgcaacgtaggataaaaccgggacgaaaaccgctgagggatctcgggtgactggttttatatagttaagggacctcgtatatctggttttatggttcgaggacgttttcgtatctcgctgacaagttgagggacctttagtgtactttttccacctaattcatgtcctcgaattcgtctcaagaataaatatggcccatcaaggaattcagcccaccatataacttgacacagtttactcattaatacttcatccgttttaggttataaaatgtttcgactttattcaaagtcaaattgttttaagttttattaagtttgtagaaaaaagtagtaacattttcaacccaagacaaatttattataaaaatgtattcgattattgatttgatgaaactaatttattattataaatattactatatttatcaataaacttagtcaaacttgaatcagattgactttgtctaaagccaaaatgtcttataacctaaaatggagggagtaatttggaccgccagcaaacttggcccacttattcccatcaacaatttcagcccacctatgaattaggcccgcttgctgcttccgtccctacagcgctcgtcgctctgctgctgcagccggcctccgccccccgccgtgctcgtcgctttactactgcatccggccgctgcccctaccgcgttgctgctgtggccggactctgcccttgcctcgccggcctccgtccccgctcccggcgtggcacggttcagggatggaggctcgggactgactaagggagacctattcctaggtctaggggtcaaagcgacccctttcccatgtctcacgacggtagaggcatcgatggcaaggttggtggcggtgggcagaagtaggcggcgatggtgctcgtggtggcagcgctccagcgagtttaggcaggggcatgatggcttgggagttcgaggagatcacggaggagctcgatgtaatagtggttgggcacaaagatgcactgggggcaacgtgtcgtgcggtccacagtggctaagtagaacagcgacggtggtatagggatggaaactgaggggttttggtgtacttgggacatggattttattcttaccattaattttgaacaaggacggtttggtggggggtgaattttgaggtttggacactgacgagtcgagttaggattcggcttcctagctccaatgacggtgattggcgctgctgagagcagagcagcttcagggagcaaggagagcatgctgtggcgtttctgtttgttggtggtggcgaccgatgaggcagtcgggagagggagaacaacggtgaggacaagagagcggcaaaggagagctcacgtatgcgggcacgtttgtgaaaaaaaaaagatgggagaacaagaatgagttgattggtaggtcgtatattttttttttcacttacatggggtcttgtgtaaacacgttagcgagtcaactatggttaacctatcatattagtaaaaaccgctttctaaaccaccaaaaaagttaaaatgcactggttttcaaagttggaggatatgatttacacggtttgttttgctgttaaaagatgcgattcgaacaggggcaagagggaggcattatagattttagtccatttccctttagtatatttgatccacaactgaaattggccttgttaattcccgtcaactatttgggtctctaatgaatttggcctacctactgtccaatcaacgaaattgggcaactacggccacgaaagaatttaggaaaaagtacaccaaagatccctcaacttgttagccagatataaaatcgtcccccaaccataaaaccggacatctaacgtcccctaacttacaaaaccggtcacaatagatctcttggcgttttttgacctcggttttgtcccacatggcggctgactcaacgttgatctatgtgggccccacatgtcagatagaccacgtcaccaccaaggttgttaggatcgggatactaggcagtatcgttttgctcaaagtaatatcgtatcgtagaatcgtatcttagtatcgggatactatgagattttctttttttaagtttaattaatatttatattaattatatatagccattatctactactacttaaaaaataagaggtgcttctatcgtccgtcaaaaaaaccgagcgaaaaaaccaggtttgtccgataaaaaaactgggcaaaaaaaagtgcgaaaaaaagaaaagaaaaaccaaaactgtccaatccagaaaaaaaaagggcgaaaaagaaccgggccaaaaaaccaaagttgtccgatccaaaaggaatcgggcgaacaaaaacaaaccggacgaaaaaatgtgcgaaaaaaagaaaaatcaaaaaaaattccgattcctatggcaaggcggaaaaaaaatgtccgattcttatgaaaaaaagtggcgaaaaaaacacagtagatccgattcccttaaaagttggaaaaaaatcatattcctatattatcctatttcccgtacgggtgtttttttttcttcttttttttccgtttcttttccctttttttctttctttttctttcttttttttatttcttaatactatgtatgtatataaaatttatatacacgtatacaaactttatatattgtatattttttcttttttatacgtatgtatatgagctatgtatacttctctatctctactattaaaaaatttaaaacatttccttcgtccgtccctacttaaaaaattcatattaaaaaaggtctgtccgatttataagaaagtgggaaaaaaaggttcgtaaaaaataaaaaaacaaaggagaaaaaaagtacaaagggcgaaaaaaagcacggcaaaaaaaaagtccgatttctattcgtttttagtccctatatatctcttctctatctctaatctaatctaatctaactatttaaaaagaaaagttttcatagaacaactaaaaagaaaaaatgcgcgagaaaataaaaacggttaaaaaaagcatgagaaaaaaaaagcaaaaaaacgcgtgagaataaaagtcagaacagaaaagctaaaaaaggtttctgccgtctgtaaaaaataaaaaaacatgcgaggaaaaaactgttagaaaaagcacgccatttctaaaaaaatggtttgaaaaaacctcacataaaaaacaccgtttacaaaaaaaacaagcagctctgaaaaaactattagagaaaaaacgttaaattgatagacgcatgagtcggatagtatcaatcatttttttcatctcttaaacggcttttgtttcgtcatctatagaaattatattaaaaaacaaacatatttttaattattatttagagaagagtgcacatgtagcaaagtgattctattttgtgtagacttgattatacgaggcaatgtaggatttgattgatcctattattggttgcaagaatgagatcgaaaaagtattttagattatatgtatgttgtcgcgtgaataatccaattattttaggtaaagcaagcatcggtaaggttgtgatcgtttatgttgggccattacattaaagatgttccaattttcacccgttgcaacgcacgggtattttgctagtatattaaaaaatgtagtaatgatatatgtcatacaaatagagacatttatcaaaagaaaccacgttggtttgatatatttaactgatttttatataaatttgagcatatttattcacattattttcaaaccatgttttcttaaataatattttgtagtatcgtagggatcgtcgaatcgggataccacctaagatttcgtaggatcgtgtaggatcatgtagtaatgaatagtagaatcgagatactatgaaaattaggatactaggtgggatcggtatcgtttcggcttggtagcatcgtagtattgtaagatactaggatacgaatcgggatactgataagcttggtcaccaccctttctatttttcccctcttctctcccttcctctctcctttttcctctgggcgtggatggcggcagcgtcttcgacgcggcgtggaggagggccggcgtggccggcggctgacggggaaggagcagcgcggacaggagggccgatgggacgggcggcgccgccaatggctgccgtcgcgcgaggaggagcgcggcggtcgtcgtcggggtgaggcggcagaggaaggggagattgaagacgacggcgccgccgatgtggctgccgtttggtggggcggagcggcgggagaccggggcggcggagctagagccacacgtgcgacggctccctggtcaacttgcgcagccgcgaacaagtagagcctcgccttcaccgccgcctcgcgatgacgatggcgatgagttcgatctccggccgccgccccgccgcatgcatgagctagaggaggtgcccggcgagtttcggcagtgagtttcgtctgtgcttggaggggtggtggcgtgagtttcggcacttgcttgcgacggcgcgagcttctccttggcttggagctggcagcggaggtcgtgccacacatccatgctccactcgatccactaccagctgcatgcacaaagctaaccaaccgatagacttgctccactagctcatgcaacacatgcacgtactagcatagcacaaagccttagctaactaactaattaatcatgcatgcagcgttggcgatgccgtcgtgcgagcgcagcggccggcgaagcggaggcggcgtgcgagcgcggcggccggcgaagcggagtggagcggtggcggcaagcgggcgagcgcgcggcggccggcgaagcagagtggagcgaaggcggcctcgggtcacgctcccggcctccgccagcgttgtcgccacacgagccacgttctcgacgcacagtgcgaatccgcccgagccacttgaccagcgtcgtcgccacatcaccacggttcagaagccttagcacgcgaagctgaggagtctccagccgcgagatcgacgccatcttcctcctctccggctgctagtcctcgccgttgatttctctttccttggtgagctagaactcgattcctcgcgaatacaccttcctggggacattgctaagcccctggacatcttcttttagcagcgcatcgatcggagtgggccgccgccgtgaagctgacgccatccgccgtcgccaagccgatcccgaggtcgccgtcgtcgtccaagcttcaccaagtcacgagctatctcgactctcgagtaagcacctaagaacgccgaccctcttccccaccgcgtcagtgacgccgtcgccgccgcatcggccctcctctccgcatcggtgatgatggctgtagccgcgcgccgccaatgccgaccgcacgagggggacggggaggccggcgagctcgcgctgccctaagcccgcgcgccgccacccgggagctgccgtcgccagccacaccaccctctggccgcgcgcgccgccgcctgtgcgagagcagagagcgaaaggaaggagagaaacagagaaagagagagggtgctgacatggtctccatgacatgtggggcctacgtgggtcccacgctgagtcagccgccatgtgggataaaaccatggtcaaaatcgctgaaggaactattgtgatcggttttataagttgggggacgccggatatccggttttgtggttgggggacgattttgtatgtgggtaacaaattgagggaccttgcgtgtactttttccaagaatttttagcccagctctttcgtctacgaattcggcccatctatgtcctagtgtcccgtttcggtttcgggcctctacagatggacaatgggccatgcgaggtgtatggtccacaatggtccggaccacaggagccatgccaagcgaaatctctgcgtctaagacatacttcgtacttccttttgtcacgaaggaagaaattaattcatccgcatgtagcaaacactagggaactatacgaatgcatctaaccaatgagtattaacatgttggctcaggttttgatcaataatttaatttagcatcatacaacgataatccctttacataacatttaaaatatgcgtagtttattataaaatactaataaataaaatatgtatttttggattaagaagcatcaaaaccagataatagaaaatacaggcgcgaccacgatgccatgactcggaggttgcgaccgggtggtgccagaactcgccgagttcgcaccggacagatcgatgcacttcattgtcaataaggtccctacacgtgctttttgctttgaacatagcattatatgcctaatcaactaactatgttataaacttataattcttttttgcttttgcttttatctctaataatttctgttgcaacacacgagcctttagctagtccttaaataaaaggcaataaagaagtcacactaccaaaactttctaacgattttgttatatacatctcaacaaatttctcttaaaaatttatcaaatataaatataatattattatagtgtactttaatataattttgaactgttaaatttgttttaaaattcatattagcaaggaagaaaaaatcacaacatgcttacatgtgaggagattctattccgagaggtccgcttcgagaggtccgcttcgtggaaatagcatgttactgcgagatttaggaacattacatataagttgtatcgtagttacatgcaagttataatataattacactataattgtattatatttgcttctgtcaaatttttgtaattaaatttttttcaataaaatatatagaaagactcattttctaactgaaaagcacaacaaacacatgttataactagctagatttttaataatgtagtcattttaaaaaataatatacaaatagacccataaaacacatcttacatatggaccctacctcagcagtgatatgttggtgccgagatgggatatctcagggctaaatactccggcgctgagggtctgatggcgccagtgaattcagcgtcgatgaattcggtgccaacctctcccatctagacctgcaagtccaattaatttgctgtcaaatttttggaagaattgataataatatatcttaattcattatctctaatatatttttgtctataaaatcttgatatggaggagaatgtgcatcctttcctccttataactaaatcctattgatttgctgtgaaatcttggacaaaaacaaattacaatcatgtgccacaattcaatttccctatattttttcttcaaaatttgacacaatacaatacgggctaaaatgaattaggatacattgattttattggttagttttcttttcaaaatttgatagcaaatcagtagagtttgaagcaaaaggagttgttcttaggtgagcgtcaaaatgactggtgttgaggtatggtgtcggcgctagttgtttggtgccgagagatagatccatatctgaaataagttttttagtggtctgtttgtaaaatatgttttaaaaagtctaaaatgtcaaaaatccagttataactggatgtgaatctgtttcatagaaaaaaaaggatgtgaaattgtgaatcttgacagtaactaggaggcaggcaccaaactggcagatcagacttcagagagttaggctgtgctaaaccaagactggggtaggagttaactgtggaaaagaagaacaggaaaagattaaaagatacactaggggatcaggttaacactaacgtgacgtgtcttacttgaggaggagacagttggacacaacattttccctgcagtttcatctcaacaagcaagcactgccaagagctcaagaccaatggtgtcacgtccaaatcagccaatttttagcaagaaaaaggccggaatgactgtggaagcttacaagaaagtgctattgcacacgtcgcaggataagataaccatcactggaaaataggcaccaaaactgatcaaagttcagaggattattcatctgttccatgctgtctggttcctcataggaaaacaagatatgtctgatttgtttgtgtggtgggtaaagataccctggaatttaacctcaaccaagatctgaatggcctgagaattcagttgaaaaattgaccaaagcatgtgaagaatgaacattgtttggcaatcaatttagagtagaaacaatgtgcatgatttcatttgtcccttattttaaaatgtcacagaaatgtttaagcaaacaagtaaatagagattaatagggttgtttcagtaggctgatgcagaaattcacggtttggtattcacacttataaataaccgtttcatacaaaataaaattgttaaggataatacacatctagttgcaatactgacataaattcagtagaaataattcatattatagaaatctaaagaatttgagtacactacaaaatctatatccctattaaaaaaagtagtggtggtgacagttaatctgctaccccgcctactctcattgtaaattttataagttatccctaaacttcttaaaaaaaactagattgatatgtaaaaggatgggtaatgcattaatatattttttattagtagcaaatcacggacatttagctactaattaaagaagcctaatgttgagaaacaactggaatttttttttattcctgaaaatacccagagctccatggattccgcccctgggttgtttattgtgtgattcttttttctgtttgtcaaaacaaactccaattacacatggcaaaagagtgttaattctaaatcggtcactaaaacatcttacactgcattctttacttacatttaatcaacttctacggcatattttgcaatacgagttacattcaaaaatcatatcaatttatatattttaagttttttaactaatacaatcatacaataattcgtcgctccattatttgtgccatgaaaggggtttccaatcccccaaacaaacaccttagattgtaaattctcaacctcgccatttacttagcacagagtatatatcacgtagtaaacttaccgtaagattgtgtgactaggcacaggaaaaaaaagcaataaacgataatccatatcagttacatatcaccatcactaacaataaacttaaaaatcaaaactaatataaatcagaaagccattacacaatctctcctctctctcgcctctcgctctctccaaatctgtgcgcggttgtgtgcggtgatccggggtgtcccgaccgcgatcagggccgtcggcttcgggtcggacggacggatgccggtggacgtcggccgcgccgcggcccgcgaggcggcgatgccggcggcgtgcagctcgtcctcgattgggaaggacagcgacgagtgctcgccgccggggaaggaggaggaggaggggg

SEQ ID NO: 43329 - DNA, 7716 bp, Oryza sativa
gatgatatgtaccgtggactacctgtattgtttgaggactattttcgggcactgattgtgttgttaattcacagagacgaaatcgaatttgaggtgatgttagtttactggatatattatgccattagatttagaattgagtagcttttaattagtctgtccacgatatcatacagattatgctgttataggttgtgtgttggtcaaaatgccaacttttgctggtgctggagtgctggtgaggtgtttgtgttatatgcttcatctccggacctaacagagcattagcttgactctacagtatagggtgaacagaaatgttttttctggataagtaaagacaagtcgatgtcgaatggaaaatcagttcgttttgtgttaaattcatgtggttgttgagtgctcttccttttcatgcatgattcaagaagagacgattgtgattgtgatatatattttttttgtaggagttggtagctgttgaaagttctagtgaaacttaaactttttacttaaaccttgtcaaaagtctcaaagtttaccgttaattaagatcactttatccaccaaaattttcaatttaaaatgcataccatcgaaattaattaagctagtatatcttctttaagatatgtaaagctagaggaatttctagcatggagaaatgcatgctgtcaaacaatcatggcatatttggttgaattattcattaactgaaaaggacctgcttcatgtggtagtgaccagtgttatgaagcaactttcaaatgagaaggactgcagtggattaacaggtacaaaacatcaattattgtctaattgaggacccattggtgccagtatcatcactacagtgaagtatataagtgcaattttttaacaagcatggacaaaggttgtacaagcaactcctttgctcccctgggtacagaagttgtgatgtttatcgtagtgttttaattctttatatgcagtgatgttttgttatcatgctgttttcctgatacaatcatacaagtagaatgtccttaagcatcttttggttgtttcattctatccatttttaattgtttggttataactaatattagctttatgtgggctatagtgatggcacttattggttcaatcatcattttattagcttttgcagtgtggatgttcacactgcagacatgatatgacatttttctatatttcacctctctaagatccacatgttttcatgaacagacgtagcatctccaaattctacaatggaaaatcaaaatctttcgcgtgtctcaaggaagctgtttcatcttgtggctctgcaaaggacatcgcgaaggcagagagcgcatattcgagaaaacggaagaatctccttgcatacagcatcatgtatgaaacttcacaggagacagcagcagaagtttatgaaactggaccccctaagaggcttgccagtctgagcagaaactctttggtgaccttggctagtagcagttccaggagcagcagtagtatcagcatcgaagaaaccgagctcactgagcagcttcattctcctccgtcgcttgctaatgatgaaaattctgcggtttataatgctccagcactacaattaggatcctgtgatcctaaaacatcatctgtgcctgtgaggtcattttcaatgatggatttgcgccgtctgcataggccaagatcctcatgtcgtctcaaagatcagaaaacgacagagtagcgtagtattcttgatgttttactggggctgctagtgtctttctgtattgtgaataaataaggggggagtttgatggtgttgtctgtgcctgcaagatgattggggctactgtgttgtatgtaaattagcatactacatactgatatcgatggcctaagccctaaggtgtatgtctgtatcatgcaaattaacatttgtaaattaactaaatcctctagtaccttatattatacattcttctggacccgctgactgtatctttatggtgttgctcttttggttaggaacatggaccctctgggccgctacgaaaccagtaagttcagtgcagcctgtagaatctacacaacatgagtaatttggataatgtacattgatttttgcggttaacaaacttacagtgcagatgatcacattgatttatactagactaacttaatatctaatttgatgcttgagtcttgaatggttttcaatgaactcattgatatgaattgaaggaagaatttgcacttttcagtgcttagtaataagaaaatagatgcaacgtttgtttttatgggaccaaactaactctaatttgaaaatgtaggaactattggactcttcaatagcattatatatactaaggctctcctaaaaatcctcacattaatctagtgaaggaaaaaaaaatctagaaattcccatattgatcgaaaaagaaagaaatactcagattaaatcaggaaaaagaaaaaaaaaatcttggccatctattcatggactacctctctgtcccaaaacaattattgtaacatttaaatcttgtctcaaaaaagcaatcctagaatactatttttcccttcaatcacctcatttaaatttcttcccaaccaccctttaatctatgtcagttattttgaaacgaggagtatgtaagcaacatacggttggatggcttcatttggtatgtctgagatcagacgcttgaatttatgtcctattcagttttcatactttgaggtagctaggaccgatgtagtgcatgcgcacggaacaaaaattaaacaacagtacatgtttgcatgctgcacaatcgcacagctagctcaaatataagcatttttaggattcagaatttatacacattataagcattactaaaatagtactacttatcgcatcaaccaccctcccactcacaagggatactacagtctttcatctcaaatcttaatatatatccactaaacatgattatatttcatattataattttacaaggttgcatgctgccgaatcgaattgcttcatctgctatgtatatcatatttagtctacggttggtacatgcatgtttaacagaaattttgcgttcttatacatttagatgataaatgaggcaaaagagagtaagagactataaaattgatatattatcttacttcaaaaataataattggtatattattctcttcacaaaatagctaaagtgatttgaatgatatgtactatttattgttaaaatacaaaggttataccgtgatccaaaaaagataaatacattcatcctaaaataggaagtgctaagcatatgctcgggttgtctcaaattttaactgataagagaaactagaccaaggataaccctggagatggcatgctttagacatgagtttaaggtttagggtttagtccacaacatagatcaaggcaacataaacattagttcaattattcaacataacgtatactcctcccaatataaattaacctagtatgagatgacatatcgtagtgttgtacagattcgtagtattagaatatgtgtcaccccgtacgtaataggttaaattaatattaatttgggatgaagggaatacatcctcgtctagagtagcatgcaacaccacgttctttttatcttactagctaaatacctatgctttgccagaatgaaatgtatttttcgtgaaatgttttacccgttgtttaattctatatgccgctatacatttagattgattggtttttaatataacgaagtttaggagttactcaaaatttacgatgaaagtagttgtgatgacgtattcactaaaacaaccactaaagcctcactagagccttttaaagtaatatagtacataagttcagggggtgatttgtaaaatttacaataaaagtagttggggttggcagattcactgtcaccactactagatccttttaaactagtatagatttgtgggattactgccgtagattatttatctccgtgcttctaaaatacaatttcttaaaaataaaactttattctggtccatttctaaaaagaattatgatttctagacaacttgttctatggtatttgttttatttttaaaatatttacatatgtaataaaacagaaaattcatgtcaacaggaactaatttatatgagagagttcacctctcatctatatctctagtctaacctattttattagccatgctaggtcatcgacttacttaccagccagccgttgctaaaatttaaaatttagttttaaagctgattttgaattctttttcatcgtagtttatttttcaacgttaacttttaaatgtgtaagaataaaaaaaacttttccttataaattatatttcaagctgtcaagagaaccccatccgtttcaaacaaaaccattaaaaatatatgtacacatatattttgtccagttttgaaagtcaaaggcgtaagaaaaacctgctttgtagttcaaggtaaaaggtagactttgagcaaagtttaagggctaaagattttaattttataattatatatttggatagcatgcattcatagatgagttcttaagggaggggcgagatttaaatagccgtgcatatatacttagcttaggacaaccggtgcataattacaaagtaaaatattgcaataaattatttgttgataaatatcaagtttttttttgaaaaacattctttttgaggggatttaaaaagtattttggcacaaagcgaagagatatttaactgtttgaatctcagtcaaacggttgaaccaaggaagaggatggtttctaagaaagaaaaagtgagaccggttgtttaaataattgatcagattttatttagataataggtcgaaatggtttacatctccgtcctctgccaatgagcacatagctaaaaggttttaggagtaaaaaaataagaagaactgaataaggtgatggagcaaaaccccaacttctgttaataaaaaataaactaaaataacatttgtaaaatcacgcaaattctagcacaaaattttgtaggtaccacgcaatccaaaatagaataaaagattcatggttaccagttccatgtgtgtaacaccattgtgtgcagtatcatgttattcctgtgatagcatcatagatcaagagttgaattagttggaacacatgaccataaactgttagatattttttattgtcaaaaaactacatcattatggcaacaccaaattgatcaacataaagcactagttccatatatatatatatttttaaaatctaggcacttctcttcgcaagttaccaaaaataaattttacattacatggagggaaaatattaaagaaaaaatgacacatatccaagcaaagcgtgcaacatgacagtccagtcaaagaaaggatgctcttgtgaattagaaaacaagattgtttgttaccctcaattttctccttgtcaggttatctttagttagaattttctctttaaggaaccacgtaaagactttgatttttattggtacctttaactcctataaaatcttcttacaatcttcttacagattcttacattgaagttcacgattgcattgtacaaggatttgaagaaaaatggttcgttttatgttgcgaccaaataaaggacatctcatttagttattgcaaacaaaaacatgtggaatcatcatagaaaggacatcaaacatcatgttaaaagaataggtatgcagtgttcgacccacatagacaatgacaattgttgaaaaatcagaaagtgtacttgacatttttgcatctcaaataagggctcaacacatttagaagaaaaatcatatcagacgccgagagctgcaaacataataatcaagagcacaaatatatgcacaaacggcaaaactttgtttcccaaaacattgtcaaatcaagaagaaaaatgagaaaaaccaatcctacacataacacatataacctcacaacatgtttgcatattgtacacacataatctacagacatatagtgcacaaaaactaaacttgctgaatcaaaagacacatagaaaaaaagctagcaaagcaaatatacctaggtagtgtagggtggacaacgtcgcggttgcggttctcatggccttcttgccatcatcaacaagaattacatggaggccatcagggaagaatgacaacatctccttttccattgccacaaccaatagagatttacacaatcacacactgctagctatgtactactctcttttcaccgatgagtgattagaccgctctcttctcacggtcttcatgtcatcatcgacaagcatgacacggaggccactagggaagaacatcatcatctcttccttcattgccatagccaatagagatgtacacaatcacacactgctagctatatactactctcttttcactaatgagtgattataaccgatgtgttctcatggcattcgtgtcatcatcaacaagcattacacggaggccaccagggaagaatgacatcatctcttcctccattgcctcaaccaatagagatgtacacaatcacacactgctagctatgtactactctcttttcactgatgagtgattagaaccactctcttctcatggcatttatgtctcatcaacaagcatgacatggaggccaccagggaatagaaggagagcatctcttcttccaccgccacaaccaatagagatgtacacaatcacacattgctagctatgcactactctcttttcattgatgagtggttcgaaccgttctcttctcacggcctttgtgtcattgtcaacaagcatgacatggaggcatcaatgaatagaaggagaacatctgttcctccattctcacacaagtctacacacggtgttactactcacttgttcactgatgaagtgattagaagaggggaccgaagtcactgaccaaggagaaggtagtgaggaaggtccagtatgggtgatgtgttgtgccaatattttttttcttttttttttggagtaaactggcgttgccacatttgaggatcaaaggttggctaacctatgttacggtgtgagcacgtgatatgtgttcttccaattgttcattttagccaagaaattacgagtggcatttctgcacaaagttgataaacttgcttagttctatagctatactttatgcatgcatgctgcttttaaaagtgtatgttacatatacatgatgcacacttggaaccatgtaaaaaagccattatgtgcccatggaaaaatgtactgtacacaattcaaaaaaagtagtacactcatggtactagcaactttctccctctttctctcttcaatatggatattttcaactatctcttgtgatgactagtggctaccctttcgttcatatttgctcgaaatatgtctgatcattcccaatcaagtagactcatccgtgactaaaagtgcatctagtcccttgtgtcggttttggctaattctgatcaaacaattaatggaatattaatgtggttaaagaaacattgtgccttgcaagtgcccatcagcaatacaatgatgtccttcaacgatgttgctgctagtgactgtgcaggctctggtgatggggcaacaactctcttgtggtgtctagttggatgcttccaggtggtatctttggcccttctcctaccaaggctctctgccacctactatgcgtaaccacat

SEQ ID NO: 43330 - DNA, 703 bp, Oryza sativa
ggaccttaaactctgctaaagaacatagaatgatccattataattatggacatagggagtaatcggtgttagattgatgggtagaaggcattgtggttgatgacgtatcgtatttagtaataggaaatagggtgaaggattgcaacattactacctgattggatgtccgctcaatcataactagtgtaagagtcaaagatgattgttgggataggagtaacaccaatggataatctttatcggtatacaagggacacattctaacaacatatgtctttcgagattctttctttgactgcattatccacttgtcataataggatcaatggccatatatatagtggtggaggtaaaaacaaatatacgattgtttcatcggatacaaatgatctttacattttagaaagaaaatgttcttttttacataaaaccaagataatgggtctttcacatatcctccaatatactagcccgctcgcccaccctactacccccgcacacacaccctacccctcaccgcatgcgcagatagaactgtacccctatacatggaaatggctataaatgactatgaactaaatcctaatgcctgcgaatattgtgtacatgtgagtgtgctttcaatatgagttctgtgaggtaagaatatattttccactggcctccatctcgttaagcttgagtattctatagtgtcacctaa

SEQ ID NO: 43331 - DNA, 3149 bp, Oryza sativa
cccccctcctgaatcttgggaggatctgaatttctagtacagatttgatcagcttgtaaactgtttactgttatagacagctttggatcagaacactgaacacctaactccacacctttgacaattcagctgggggtgttcatttggctctctcctgcaagaattagtatctgggatatatacaaggaagcaaatggaggttgagggcattgtacaacaggaggttaacatggtagtcgtgacaccgtcagcttgccggaccgtcccgggtggtggcgagggcaaacccgcctcgttcatacatgcgctggatctcttcccgatactcagttagcgacttgtgtgggagcgcaggcgtcagctccaccacatctcccatgcacagtttccggttagggtcacttatgggcttgtggttaaccctcgggcgcaattcctctttcagtgggaagctgtaagggctgcatcttggactattggcccccactctctccatcagatcgactacagttgagttcgcaggaagctcttggacagacatctaaagtcaaaaatataattttgtcagacaattgaaatggccagttatatcatcacagaatattactattttcgacatgacaagttgggaagaaatcaaaaggagaggcataccttatcatgttcaagcataatcacaaagatgggtccatcgtggttgcactggcgagtgtaagaataagggcagtcctccgaatgcgagggaaatggacatggtggcctaatggcatcagagcggcctaaacctgaggaccgctctttgctcattgcttcgcattgccatgtgagcacccatcttgcccattccaccatttggagtacaaaagagtgcttgcaaccaccttccttgtatctccagtgtgcagcaaatccatactctgcttgtagatgcatttcttttgttcggatctgaacttcaaatgggtgtatgccctcacacatgatgacagtgtgcaatgaccgatacctgcaactagtaaattagcagggattcttgtagagattttaacaaattgatcaaacattattctacatacccattcaattttggatgcaggatatagtccttaaatcgtccagcaactcggggccagagcttatggacaatgtcaagagcttggtaacaatcctgctctgtatcaaccacaagacgtagaccatgaatgtcatgaacatcatccatcgttaagttcttcctggagggccacatgcattgcatggtaagttgctgtgcatacccatttgtgacaataatattcagttttcaataatttaaattaagaattcgacatactttatcatcttggagtatatgctgtacaggctcttgtgcctcccagaaagactgtgatacgaaataccttcatctcttagacctttatcaagtttatccagagtagatgtaagaagtgcttcgtcaaaagatatgacaagtttggaggaaagctccttgtgctcctctgggttcaaatgcttaaagcaaatattttccagctggtctttccagctagcgattcctaaccgattagccaacggcacaaatatctccatagtctccttagcgaatctttgttgtttgaccaaaggcaaagcttctattgtcttcatgttgtgtagacgatctgctagctttatcagaactgctcttgcatcagccattgcaagaaacattgtatgcaggcggtctgcttcaacggttctgcttgcagtattgttgtcccgagcaagtttgctcaagtggcttaacttggagacctgaataaagcataaattgcaatacaaagacttttacatttggactaggtgtaatcaaaattagttagaagatggttcaggtaatgcattgctaccaaaaaaaaatcatttttcaacaaggaaatgtatttaaagacataatcaaattccttcagatgagagcaggaaataagcagttcaaccaaactccactgttgtttaacatttcccaagaatggccatatacagtattaaaaaacaaagaagaaacaacaccaccacacaggggagtacaaaatatggttaaagttgtgtcactaattggttgctacaagtaatagatcaaatctgcagcatgccaaaaaagaggtgggcgacatcctgagcaagcacttcagccagctaaacatttcgtttacttagcagtaaagctatccatatgattgaaagctttagtagtgaagttatccatatggttgaaagcttaagcaagatgagcacatggcctgttgactttgaataatcaacaatgataacatagataattcaatcatagccgtggaaccagcccttcatctactaaactgggagagctcctaaactattatgaatttatgatccatctaaaaatcaagtaaacaaaactcataccccttcaactagatcagccacgccggcaccaaacatccggaaaatctgatcataatccatgaagctatcatcaatggtgtcatgcaggagtccggcagagacgacggtcgcgtttgcgcctatcttggctagaagcacggcggtctccacacaatgctgcaagtacggatcaccactcgcccgcgtctgatcacacaggcaaagcacaaagggcactagatttaaggacatagataattacaccttgcaaaaaagaaaaagcaagaagttaacattggagtttcgtccaagttcttgggaattgggattccacctggcctcggtgcgccctctcagcctcgaagaaggccttgacgacgagctcgtcgtggaagatgcggtggcgagcctgggcgccggcgaggaggtcgcgagcgtacggctcgcacgacggctccgcctcggagaggtgctcgtcgagctcgaacgcgagctcgccggcaccgacaccgacagcagccgagacgccgagcggcagcgcggcgaccggcgcgtaatcgacgcaggagccgagcgcgttgcgcacgaagctggagaagagccgctcgcgctcgcggccggcgagccaggacgccgaggggctccgtgacgccggcgaggaggccgggctgtggaacagcggcacggggctgtggtggagcatgtcccgccacttgaacggcgacgacggctgcgggtaggagtag

SEQ ID NO: 43332 - DNA, 6693 bp, Oryza sativa
  unsure (1)..(6693): unsure at all n locations
gaaattcggatttcgcgctaccaccaatccaaccaacttaaatcgactgaccacccgccaatcaatcaatcaatcaaatccgagcagctagaaggccgcactaaacttaagctgcagagcacgaatcccgcgcgaaacacttcgatcttcgggcgatcaaaccgagcgaattcgcggcgggaggggagattttgcgcgtgtttcttgtgggttcgctcgcgtgggcgtaaggggcgttgtgaggtgtggatttcgggggcgagaggttggagaagaatctgggtgactcctcgctaacaataggccgcagctgggaaagaggaggtgaaatgtcggaactgccccgttccgggaaagaatcttcgcgggaatttagcgggtgtttttttttttagctcatatccgtttcaggcattgcgatagtgtctgcttcttattaccggcgggaataacctctcttgtttattcgtatccagcgtggaccgaccaagctgtgctttcgtcagctgtaaattatggtaaatttggaaagtattttgtattttaactttgatttaaaaattttacatggtcctttttttacttgtcttgcatcatgctccctccgttttcactattgtatcaaattttaccactcataactctcaaatgattagactacaataaatttatatttaagggtaattcgatccatggtattgcaaatatatcatttcaaataaatatcattacaattcgtctactcgtagccatgacactgaaattttacaaaattgtaaccgtgccactatcgttacgttttccatccatttactcatctgcacatgggaccaatcatgttagaatcatcttcttcctttcaccctctcttatcttattccatctctgcaattttcaacactgcctcctgtgccagccacgagcgtcctggctaactccatcggcgtccgccccctacctgttgggggcctccagcttgacgtccagttgcagcgcgtgtatggccatcatgtatctatatctgaccttatcgctgctacttagtgccaccggcgaacctgcgttgcgcctagttgccgtcccggagctcgccgcaatggatctgttcgtgccattaccatcctcgacctggtctctgctagtaccatcggcgaacccacgcctcattgccttccccgagcttgctcgtgttgttcgcatcgccaaactcaccgctactgctagcaccattggtagacccgcaactcattgccttcctcaagctcgtcatcatggatctactcgcattgttcccatccccaatcttatcgctactgctagtgctaccggtggatcagcacctcgttgccgtccttgagatgagctcactgccacggatctgcgccgtagagtcgagctcgtcgacatcaatgggcctcgctgatgccctcgcacctatcaacctaccaaagatggatgaacctcatctcagatatatgcatccggtttacacttgcctgcatatattttattttaccctaacgaacaaccataatttaacagggcacaaaattgtatcgcacatatcgcacctaaaattgcgatttcaattatgtaatcactattttataattaattttttattaaaatagtgctatttaaaaaattcgggatgcgatcaggtggagagagcggagaggaggtttaatagtatagccaattactagcttcaatttatctatagccaatctaatagctcattcatataatagttacatactaaactattaataactggtctcacctgtcatacacacactgcgtcttgtagtttatactgtagctggttataaatctgtagcccgttgctctttgctctcataatttatagcctgctacctgctctgagagcaggccccctcggtcagctcgacacgctgcctcgacccgtcgaccgggcgcaccgtacaccagctaaattatattgcgtcgccccttcgccaacgttacgtggctggcttgctggccgcgccgcccgagctcgcgccggtttcgcgacgcgcgtgccgttagctagctagcgatcgagccagaaagagggagtctccgtggcgcgcgtctccgtcgatctcgtgccttccggaagcggccgccccgggtgccacgtcgcggtggcagctagagccacatcggtgagcaggacgcctacactttgagccacgcatcacctgtgtacagtacactactactagtagtacagtacgtctacagtaaactaattgaggataggagtagtactctctactagtcgttcaaaaaaaccaatcataaagctagatacgcatgtgttagtattgaatatgacgtgtttgtattgagtattttacagatgaaaaaagtataaattatctctctaaactgtaacgagattcaattataccttaaactacaaaaccagacattctttgcccttaaccccagtttaatccgcggtggttttgatactacgtggtagtcccgtcataaatttttttcccctcatcctctctctcgggcgtcattgggcattggtcaagcagcggcgcgggcggtcgacgcgcacgatagcacacagaggcaggcggcgggcgtggcgcgggacgcaaaggtgggagtggcgaactccgggagggagctagagaggcaacaatgagctcaacagcgccccggtactcaacagctgcggcctctccccaatctgatgttgccggctatctatctgacggggacgacaccttgaggagaaggccagggaataggaggactgggagaggcgcggctgactgccggaggaggtggtggagcctgcctgtgaggacgggtctctattggagcgacgttgttgatctggatcctcgccaccggtcggtgggtatgggtctccaccctcgccaggtcgccgtttggttctagaaccgcgccgtgaggtggaaggcgaagcaaattgagcaccaacttcgcagtgcacctctcctgcacgatgccctccgcagcgacaaagatgcgctcgctagggacggagaaagcgtggggcaaggggggtctttagaccctcctagcccctaatataccattagagcccctataataccccctctaaaattttaatccatatatttatagatgaggggttattatagattttgtttgaggttgttagaagggccaaaaggctaagaaggcccaaaaaaatcctaacccaaccctatatctctctttggtgctcttggttattttggtttagccccgctataattntattctggcttcggcactagcgctcgctgacgtgacaggcagagttggcggcggtgcggcagtaggggggcacgtgcattgccccttctgctaatgcaatggccggtggcggcaagaggtagagaaagaggatagggagagaggtagaaagtgggccccactgtttttttaaacaaatgctgactagactgccagtaggaataaaaccaccgcggattgaaccagagggattatttatacggtttgcatatttaggggtgaagaatatttaattttatagtttagggatgtaattcggtggacttaaggggactaattcgtattttttttcctcggcggaatggagaggtactccttaacctatcgtcatacagtatcgtttagtcttctggaaacaaccgtacgcttgacgaaatctatcagtgttctttcccagatcacatgtgaagtactcgtacagtcgtactactactcccgatatcatatcacccatagatcgctaaccgtttgctgctcctgggatcgatcttgcttgcatcggcgaattcattattgacaccggaggtttcgacacacgcaaagcgcttgggttggatcggatcgcacagcacgtgaggattattagtgtaagatactatcctatctgcccataagctgattgtttaggctgtgtgtagttcacatgaaaattaaaagtttggttagaactgaaacgatgtgacgaaaaaattgaaagtttgtgtgtaggaaaattttgatgtaatgaaaaagttaaaaatttgaagaaaagtttggaactaaactcggccttaactgacaagtcctctctggtaaacacggccgatgcctcaaaaactagctatgtctttgtcgacaaatccttgggtcaaaatcacccagattttttcctaccgttagattaagatccagaggacacaaaaaatgctacatatttttttctctgactagtcagatcacaaaactatatgggctcgaattctagcccatagaacaatacaaaaaattatacaggccataactgcaaatacatcatggcccataatgatcaacttcacatccaataaaggttagaaaaaaacaaaataacacagggagaccacaccagttcgcacaaatcccctagatcgagcaaaacaaatcgagcacgccatagacagtgaggagaacgagaaaaagaagaagaagcaaattcttaccaagaacattgaggtcaagaagttgaaatcaacaagacataatcttccaggtaacaaattacctagcacaaaatccacctttacctttccccattgacttcaccatattctgccagtcatcttttaaatcaaacaaaaacaactcagttctgtaaaaatattggagaaaagcacttggaatagtgaatttcttttggagaaaagtgcttggaataggaaatttctttagatcaagtagttaaaagtatgtaactttttcagaaaaactcgtaacaaaaactatcaatctatagtcagttacagttacaaataacaaaagttacagatgtaactactgtacatcaaactgtaactgggttgtaaatggaatcattcttaaatttctttaaaaatttagtattcatgcagcaacattaaaacactttcccctagtataacaagctctaaattatgttacaaatatataaagaactatttatctacggtcagttacagtaagaaataacaaaagttacagatgtaactacagtacatttgaacagtaactgggttataactggaatcatcctttgatttttttttaaaaaaaattcagtactcatgcactaactttttttttgcctatgacaaaatgttctaaattatattacaaataacctaatcatgtagggtcaggtatattgcaatctcaaaaatcaggagatacacaatcagatggatatgaaatgagaagcaaaattgtgtctgaagaaatgagaagcaagaagacagttaaaggtgagaatcattctcacctagcattatggaccattttttatcttgtcagaaaatgtcatgtagcaaaaatttatatacaacaaattagagatagtagcatgataaatttttaaagaactatatatctatatccagttacagtgagaaataacagaaattacatatgtaactacagtacatattgactgtaattgggctttaactgcaatcatgcttgaatttcttcaaaaaattcagtactcatgcaatagcattaacatttttttactattatgacttgttctaaattgtactacaaatgattgaaacatgcaacgcctgatagattagaagctcaagcaacagtgaatacagagtcaaatagatgtcaaagtgacaaaattttctcagaaaaattaataagcaagaagacacttgaaggtcagaacaatggacagatagcattatgcaccaaatttgatcttgtcagtcataaaatctagcacaattttgtatacatgaaagcatgatttttttttgaaaaactatctatctccagttacagtgagaagtaacagaagttacatatgtaactacagtacatattgactgtaactgggatgtaactacaatcatgcttgaatttcttcaaaaaaattttgtctaatatacattatctaaattatattacaaataacctatctatgcaggttctgttacaattcgatctcaagtaacagtggatacataatcagagagatctgaaagagataacattaatttcgtctgatgaaaaaagaagcaagaagacaactaaaggtcataatcatgataacctagcattatggtccatatttgaccttgacagacaatttaatctagcacatatattagagatggcggctttgaaaaatctaaagacctatctatctatagtcagttacagtgagaaataagaaaagttacatatgtaactacattacatctgaactgtaactaggctataacagctttcatgcttgaatttcttcaaaaaaattcagtactcatgcagcagcattaaatattttcccctattataacaagttctaaattatgttacaaataatataaacatgcagggtctgatgggttacagtctgaaaaatcaggggatatgcaatcggagagatatgaaagtgacaaaattttgtccagagaaataagaagcaagaaaacattgaaaggtcagttatcatgctcacctagcattatgcaccataaaatgatcttggcagacaatataatctagcataaaattatatacaacaaattagagattgtagcgtgataaattttcaaggactatatatctatagttagctacagtgagaaataacaaaagccacatatgcaactacaatacatatagactgtaactgggctaaaactgcaagcatgcttg

SEQ ID NO: 43333 - DNA, 6976 bp, Oryza sativa
ttgctgaagtgtgagattttaaaaagctcatgtcgactgaaactgtgcaatagcctgctccaagattcaaaaaatactgacaattcaaatagatttacgagcgtgctatcccctgttcccaattcagaaatagtgccaattatgttcccaagttcagaaatagcgccaattcaaacagatttacgatttacgagcgattgacaatgaacaaaagttcagaagagaagaaagagcagatgcaaccaatagcccataatttctcaaagcaacagggaccaagttcaggtattggcttgctgctaactcatttagatcagcactgaaaagttcagaacatgtacaggaattttataaaccaaatagtacagtagaatacaatctgaagaaagcagaacgcatgtaggggtttgggtttaatttaaccaagcaactcagcatactgggaaatcaaaccgtacatctctgaaacgaaatgattcatatgctgcagaaggcaacacaaaacatacttggggttcagttagcatgcatatgtaaaacgaaattcttcagatgcataagaattcagatatatgcagggagttgacagataaatcatctctgaaacgaaatgcttcacatgcagaaaaattcagacttatgcaaggagtttaacagatcagtcaactaatcactgaaagtgaaatgcaacattcagataaagttgcaatgatgcttccctactatattcaaatcacacataaatcaaagcaaaaataatcaactcatgaatctgaccccctccctgaagaaaattcatgcagggatccaaaaaatgatcaactatctgggtgattagaaaaaacccctaaatccacctcgaattaaacctttaactccatcaaatacccctgaatccaacccccaacatgaacacccctgaagaaaaatcgaaccaaaaatacaaaaaccctcgtggattagaaaaaaaaacatagaacaccatcgaatctggtcgtttgcaaacaatggactagtaacaaaacaccctagactgaactgaatcaaactataactaaaaacttagggaatccaaaacctaaacggattccaaaactaaaacaagtgattatgaatcagatccatacgttgggagcaaaaaaaatcgtcatgtattgacccgaatcttctaaacctagccctattgacattgaaaaaaccaaaacacaagctaatgatgccagcaaatcagggaagaaactcaaaaaacactctctctcgagttgtctcccccagcgagcgcgcgcgctctctctctcccgccggggagctgctcgtgctctctctcgccggcgagctctctctctctcgacggagaaaacgagaagagaaaagaaagaggagaaagagatgtagagaaagagcgagaataaagaaagagagcgaggaaacaaccaacggttacggacataatagcgcggaatccaaaatttaacatgggttggcccacattgactcctaggccatctgctcacaggccacacggtctcatccacacagggaaatgcacgaatcatggcgcaaatcctacggatagaaaaacgacaaatattgggggtgaaaatctgttgacaaagatctagcaaaatcgtttgcgttttgattgacgaagatggattagttacgggcctgctgctgcggaggctgaaattttattcggccctggactaatacctatcagcccaagtaaattacctggaaattgggcctacataatactggaagtgggcccttggtgtttgtgctctaggagctgcaggcccatatataatttctcaatccttttaggcaattaatttcctccatttgtagcacataactacatgagaagatatgtcacgtgaactctatatttagcataaacctgaaaactaccactgaaaaaaagtaaacgtttaagttttatttatctaggatttaaaagttttactcatagtgacgtgaatacattttagacgttcatttctgtcttctaatataagggattttgacattctgcttgtactgcttgaccacacgttttatttaaaaaaattgtgcaaatataaaaaacaaaaaaaatatgcttaaagtactttggataataaagtaagtcacaaataaaataaataataatttcaaaattttttgaataagacgaatggttaaacaatgcaaggaaaataccaaaatctcttatattaaggagcggagggagtagtagttttcaagtttgcgggacatatgaagtctgcactacatattttcccttgctacattggtgcatatcctgaacacacatcttctttgtttatggcttattagattaatctgaaaaaaatttggaagggattatttccacgtgtaccattatttttctccaaactctttcaatctcgtcagcaatctctttaggaacgggattaaccgagcaaagctcagtaggatacattctgcctagcctagctattgagattgactatgtccgttttcaccaataagagtgttcgatcctataattgcctaccataatatctttacaaagcttgattaaattaaagagagtgcagtgatgcaaggccataaaacccaaaatgtgacccggcgaaaaataaaacccaaaatgtacataggctgcaaaaccatggaaaggggagggcacccggattaaatttactcaaaaagaaatatctgtcaccataggatgactgtcccataccttttcattccatgatgctaattaagcaactagctagttgctatctcgatatgtcttggtagttggttatccatgcatccaacatcacctctgctagcagaggcaacttttgaacataagactgctttcatcactcatcacaattatacaatgatggcaaaacaaaatgtttacgtagcaaaggtcgtaggagtctagaagacatggacagttctctcatgatctccttggataattttcaccgccaccaacttgtacttttaataagccctagagttgatgccatatctgattatctgatgccccttgagagtgatttactcggaaattaaggccaacccatagcaaacctactctatagaccaatttgcaattatttatagcctgttatcaagatgaaggtgttgacacctcatagttaattaattagcttgtgcagaagatcaacagcacctcaatttttttcagctaagttgctgtttcagaacgttccctgtgctatcagctcttctaaaaataatcatcatttagcattattggcttattgccgcagaacatttttcacgatctcatcctctctgtacgttccacatacactagctactaatcgctgtccacagatcatttagaccataattaaccatcatttgataaaacatgcaacccagcatttctctatcaacgattattatgcatttctaacagacggcacaggagacatgcctgtctggatattgtctgaaaaattatcaccccctgattttgtctgacaattatcaccactgattatcattctcacactccattatttggattgatagatacggatcctaataactacaatctactgagcatattagctgttcctgttggtcaggaaactgcacgtgtaactgcataagctaagtacgtgtgtacgtctgtctgttccaacctgcaaatcagcagcttgctgaattattaactgcaggtgtatctgcataaacaaagtgtacatttatctgattcattaaccgtttcagttgcacgggacgctgcaatgtcgggcaaaacacaggcaaagcagaggtagcaggcttgccggccatcatggtcagagctcggaattctgaagtctgaagataaataagcatgtacgtgtctgcaattaactcttcgagcgtgtgaccatgactttttttttaagtacttgtattttccattcagaagattaactaacctgcctcctgctgaaatgtcaaaggcagcagctagctagatatagattaattactcgctgctttgcttgcgtgctactcatttccaaaccagattaacatacagaatagtatatacaagtaagcaacagatgcgtacgtgctcattataacctgtaattaaccaagcaaattgtgaacttcgaatatcggtatgaagctgtacgtgagagtatgataatctaagcgtgtaagtggtggcagccaactaactcgccgagctctcagctgcgtacgatttgacatgaaaaccacggccacttatgctccaaacaaaccgcagcacacatgcaaaacgagcagcgtgtacaagacactacgatgcatatgctgatcagctgatatgtgtaaaatgtgttcgtatttaaatttggcaatttggtctgaatatttctttttggcaagttggcagtataacttggagatatgttacttcttcagttctgaaaaaacaaagagatgtgtacttcagtgtactgcttcgtatacatcattttttagggtctgtagttgttggtgaccaagttgcacaaaactctgaaacaaaagcaaacaattcttaatgggttatccatgctatggaacaacgctaaaaccagccgagaataagaatgagccatactgattcatataaaattctgcttaatctgaaaggggagaagccgtacatgcgtgtcccacacagaataacttgaggatggaagaactttagccataagtttcacatacataatgcattgccattcttaatttcaaactggtttcagattcgtatggtcgtccagtacagttctctatcgcatggccctggcgaaagcatgaggtatagtttcaaaaaagaaagcatgaggtaagtatgaccgtcagaatgagagataaaaagataagtaaaatcatggactccattgaccactcccatccagtagttcatctactccctccgtcccttaatataaagaatattcactagtattatttctcttaatataaagaatattcactagtattattgtaatgtttgactactcatcatattaaaaaaatagtgcaaatataaaaaacaaaacgttgtgcttaaaatacttttagataataaagtaagtcacaaataaaataaataataattttaattttttttaataagacgaattgtcaaacaatcgagcattacaaaatcttttatatatctttatatcatagagacggagagagtatctcgaacgtgttgcgttgccagtttacgtagcattacaaaaggctgacatgcatttttgttgcaaaattacttgaacaagaagaataaaaaatgctgtcaaatcttacgtcagaaatgatgcataggtgacctcccttaatactacttttcagtagtttttggacggttatgttcaggtcattgatgacataattcacgtatcaatgccattttttttatgaaccagcataagtcgatgttaattttattgaatagagtagaattaaatacaatggcctatacaaaactcagaaaaactatacagggattttaaaggatattttaaaggataagctctgagagacgcttagcgcttgtaagaccgtcgatgatattttgttgtgctcaaaagactatggtttctcttccgccaaatctccaatgatatcatgaggatgattaagcgtgctctagcttggataagccttgacaggtggctagcacttcccaccacattgatgaaatacgcgtaggctacgatagtataaataaaaattttctatcgcgtaaaccaggaaccatgcaagtattagatcatagatcgttaccactcgacgcgctgcgcagcggaagaaggcgctaagaagtcgaatgaactctcacgaagtagcgcgcgtcgatgtagaggaagtagtcgatcgcaccggctcgaccttctcctcctcgtgcattcttctcgccgtattcccacaccgattagcaccgcaaagcagcggcgcctctaccagtatccacacgtacagagacgaaacgccacgcgcagatgtgctagcacccgcgcgcggctagggttttgctcggggaggggagtgacggctagggtttctcacgtaatgcgattccttagccaatcacacccctcacgaatatataggatccatgactcgggcctccaaggtccataggactcctatttggatccctatccgaattaagctcatattggatctccatccaatccccttattccggcccattaaacgtgcgaccctgtagattcatgtacactctgctgtaacccgaaaactaccttttgttccacgagtcaacagcggcccctagcagaacgtattgacccaccgggcatacataaatatcaaatcggttgaacctctagagtatacttgtatgaacccctttgtctcacgatatcgattaagctcaaagctatatatgtgccatcctctaatagctcaatcattcactcgaacctgtgatagttatataacttgtgattgactcctcaatcacctttggtatggccatgcacttccataacctacaatatcgaagggcccagagatatctctccataggaggagcaaatcatatcttgattattcatatcccactacatgttttatagcatacccgaaaactacttttataactacccaattacgaagtagcgtttatctgtccctaagtaagctactacacatattgggaaccataataatctcagatgtaaggattcaacaccaacactaaatgagatcactgatgacacaacacatatggctcttgcagtgtctcatgttgggtctatccaacaacatgtgtccacattattaatttggtatctctatactatgatccatgagacatgatcatcaattaatacatgtgttcatcacttaaatatatttattccacatatgatatttgatcgcggacactttaaaaatagtaacaaacaacataaagagtctcatgaaagagtcatat

SEQ ID NO: 43334 - DNA, 1509 bp, Oryza sativa
  unsure (1)..(1509): unsure at all n locations
gcgtttcgggttacaaatatatctagttattcttgatgattgttctcacttgtgtgaacctttcccctgcgcttcaagtctgacatgtttaccacgctatcacacttctttgcctatgtcaaaacccaattctccaccaacatttgcagcatccagtgcgacaacggccgcgagttcttcaacatttcggcccgcacnnnnnnnnnnnnnnnnnnnnnnaccatgcggatgtcttgcccccacatgtctccccaaaacggtaaagccgagcgcatccttcgttccattaacaacattgtgcgctccctcctttttcaggctagccttcccggcaccttttaggttgaggcccttcacacagccacctaccttatcaacagacaccccaccaagacgcttcaacaccacaccccattgtttgccctctatggtgtacacccctcctatgcacatcttcgcgtattcggttgcaagtgctatcctcacctttccgccatagccccacataagctctcgccccgatccaccatgtgcatctttcttggctatccactacaccataaaggatatcggtgtcttgacccttccaccaatagggtcatcatttcacatcatgttgtatttgatgagcattcttttgcatatgctaacatttcttctccaagcagtgctgatgagctcgactttttggaggattttctgctcctacacaggcaccaattggaagaagacacgctgtgcctggcgctggcgccagctcccctgctgcaccatcctcaccggccgccagcccactcacgacagcttccggcccgtcaagcatcgccaggccgcctcccccaacccgtcagcacaaagcgggttggccgactcccctgggttggtccactgtcgcgtcccaaagcgaccctaaaatatatcctttaaattatgcttagaataattaaaatccgtgtgaaagcctccaacaattaaaatgtgcaaagttaaaagccaaataaggcttagaggatttttgtaaatttcctaaaatcctaaaatgcgtaaataaattttagtggaattttcagagcacaaataataattattaagaaataaacaaagttgaaaaggttttataaaaagaaaaaccctaaaaatcccccttccctctcttgggccgaatccggcccatctccctccccctctctcctctcccccgcggcccatccggcctctctccgcgcgcgcgccgctgacgggcgggcccgctcaccaccctcgctgacgggtggggcccacccgtcatccccttcctcccgccgctcccgccgcctcccccgcgccctagcgccgccgccgccgcgaatcccgccgcctcccgccgtccccgcgtgcaataaagtgggggaaatcactccccgtgatcccctctccctttccccccatttttccctctctctctagcgttcaaacgggcggatttgcccccgcaaatctcgccgcgccattgatggtggccgaacctcc

SEQ ID NO: 43335 - DNA, 5385 bp, Oryza sativa
tatggagtttattggagtaaaagcacttttattttccgttggtcgtgtatacgttgcagcttcggaagatccactcttcgtggaggttgaagccaatgtttgggaaagcgagcaaggcaagtcacatcatccttgaacatattgcatcccagtttataaaattattttgatttaaattattgcattatcgctttacttaaatgcccgcgttatcactgttttatttagccatgcctatttacctttgttatgaccttattattattgttattgatattattaccttgttcaccctagattaaacaaaaccccaactagtggacactctactcatggtaccactagtatgattttaggtagatgcttcgctggttagttaggcaacattaggtggttttacaactctagactgtgggaatattctcatcacctggacactatggaatggttggattattgtggaatcggattcacacctccccctctattcaaaaccctaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaaggcaaatgaacgctacacgagctgcggcccggtagtcgagatgtcatggcacagggccggtgtcctgctgctaggggctcagtcctgcctacctgtcccgggggttccggccgtaggtgcggttgggtcgttactcttgtttatggctaggatgggttggaaactatgtcatgtcttctgtccgtataccgtggtggtatgtggcacgtggttacacgtgaggaagatgtgtcttgtgggtaaagatgtacacctctgatcagagtataatctattcgaatagtcgcgccctcggttatgggcaagccgagcaatgtacccaagttagtgtttttaattcttaaaacctgcttaacaactaaaatgtggaatggttggcctgggttggcttgggacgagttaggacccagggttgggttgccagttcggtctgaatcatcgtgggccttgggttaaggcaggttcgtgtgggttcacggccttgattaataatcttgtatagctctaggaccgtgtttacaaagtagctttgagcaactaagtgacttttaatgctgtttactgcaaaccctaaccccccctatattatggctcccttgtactcccttgcatttattctgcacttgtgggtgtgtcttgttgagtacggtggttgtactcagtcttgctcaatttttcccaaacccagaagaggagcccctggatgatgaaggctttggtgtctagctcgtgcctgccgtcaagcgcatgtggtcgtcgccctagtcttccgctgtttcccatttgtctttgtgtgtgctgggccttcgccgcccatgtaataaagtaactatttacgcttccgcttgataaactctgaaatgtatcaacttttggtgtaccttgcctcctgggacaaggaataatacacgcacgtaaggaacgcccgttgggttatttccggtcgtgacatccactcatccggttcggcccactcacctgggtcgacccactcgcctaggccggcctcttcccccggctcggcctcctcacctgcgacggctcgctcgacaactacggcaatcccatcgccaccagtgccatggtttgctgcggtgcccacccgaccccggtcggtgcgcgtgcaaatcgctcctccaccgccctccactacggcaccgctcgtgatcaatgatcacaccatgaccacaagtggcaaagccggtctgcgcaagcctgtccagcgactgaaccttcatgcctcgatgctatctccagtcccacacacctaccgagctgccctcgccgacccatactggcaaacagccatggaagaggagttcactgctctcaccgccaaccgcacatgggacttggtgccccgaccatccagcgccaatgtcgtcaccggcaagtggatcttcaagcacaagttccaatttgacggcacacttgacagatacaaggctcggtgggttcttcgcggtttcattcagcgccccggcatctgtcacatcctgattttcgtttcaggatttataaattatttaataaattaataatagaatttatattaaatgatctttaatttacaagtgaagttaaatgtgggaaataaaatttcctaaatataaagcatggatggatttaatttttattaaattctccatgattaagtcaactctctgaaattttctcggatttttcagagctcaattcctaaatgatacaaagaatagttcagtaattatttgatcaataatgatttaattatatttgttaagagcttttcttatttaaaaatccttaaattataaattgttgtttaaaaggaattattagaaatgatcttaaaagcctaaaagagaagatctaattttaatttgtgaaatctcaatataaaatggggccagataaaatttcattaaatactttgcttaattctataattcctagatttttctgggatttatttgagctaaggaagtatttttaataaatggaattgcatttcatgaataatttaaattgaaaaaggttttaaaagtctcttttggctttgggccgaaagtcggcccaaaacccctctctttctctctctctccggcccagtcggcccagccagtccgagctgccgctctcctctctctctcgctgtcgctgacaggtgggccccacctgtcggacttgtcttcctcctccggccgccgccgcccgaaccctagccgagccgcgtccgagccgccgccgtctccttccaaatccgatcgattctttccttctccggtgaaatcttttgaggggaaatgatcttctcgatctcctcttccttttctcttttggaatcatcgtctcaatcgctttggaagttcgtggattcgaggtcgaatcggatcggtttctttcctccgaaccccgagctttccatcccgtcgccggtcgccgtgggccttcgccgctgccttccaacccctttaaaaggatccccggtgtctcctctacccgccgcctccctcgccttcgtctctcgccgtcggaagcgccctagcgccgtgtgacctagcgccgccgtcgtcgccgccgcttcagccgtgcgccgccgccgttccggtcgtcgtcgtcgctcggggaggtcgccatcgtggtcgccggcgccatccgttgctcttccgccgttgttttggtcaccggtgagttcgccgcgtcgccctctacccgttggtgtcctccgtttgcatcgtcacgccgtcgttcgccggcgagcttgcgctcccgagccgccgccggtgctgacgtcatcgctgacgtcgttgctgacgttatcgttgctgttccccgtggcccggtcgtggaccgatcgatctcggccatccgttttggataagatcgatctcggccgtccgttcccgtgaaccgctgccgtgcacccggtccaccgcaaacccgacccgctgacgcaataattccctttttcttttcaaaaataattcattattgcgtcataattcaattaaaatctatataagtgttttaatccgatttaatctttaaaaattcataactaattcattgtaactcagtttaatgtggttcaagttgcaaaagttgtataaaataaagatctacatattaaaattgtccataaattgaattaaatttatttaattctttttaaatgggctttaattagatttaatcttgtaaaattcataataaattcatatgaagtcagaatgaggccgttcaagtctcataattcatctaaaattatgatctacatgtttgtttactttatatgtattgtttatttggtttttattagtctttttcttcgttttgcgtgttagcttgtcgtttccgtcgttgcgaaggttcgtgagtgcgtcaggagtgttcagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctcttcctttgttatggccaatttgcattgattactttattccttgataccttgggttattataattggactagttgagctttatatatattggttcaactagatattagatataattgcttagccatgcttagaaacattagcacactattgggataacttatgactcactattatttaatgatggcttaatgatagttcacgatggtcaatcgtgattggttaattaattacttgccaactaaaatatgattaatggtgggttgtgagcacatggttttgagagtcgtgctcatgacaattaaggaccggttcgcgagctactgttgtgaaacattaaccgtgccaaccacaagccagcatgggcaacggctttaccttttgtataacatagttcattgcggagcaccagactgagaagtggcggagataagcccacgggggtcgctggggagtccatgcctctggtttttgagggggtgattatgatccaggaatggtgcactgtggtgagttgtgttgtgcgaagggtattgtcacgatttccccctttgcagtgccgtggtggtacttcggggcatggcaacatgtgtgaaatcgtgtcttgtgggtacagtggtacacctctggccagagtaaaactattcgaatagccgtgcccgcggttatgggcgggttgagcaatgtttttcgtgattagtctcacacctctcacaataattatggatgttataactggtaataatttgtttagctcctggtttggagttagatctgtacagccgggtatggttgttcaggatggttgggcctgtacagcatgggtgtgctgttcagtgttgattaaaatttctgattaattactctactgttttactactcttaactctttgctaagtgctgctttcgcaaatgagcctatattatgccatcctttgttatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttatttttccgctgcagttttcttcatgatgaggactaagtgcctcataagtaa

SEQ ID NO: 43336 - DNA, 9437 bp, Oryza sativa
aatttccgggcgtgacagcatcgactttgatgagacgtttagtccggttgtcaaaccggccaccgtccgcactgtacttagcctagcagtctctcacgattggccaatacaccagcttgatgtcaagaatgctttccttcatggcaccctccaggagacagtctactgcattcagcctcccggcttcgtcgaccccacacgacttgacatggtttgccgcctgaacaaatcgctctatggtctcaagcaggcacctcgggcatggtacagcagatttgctacttttttgctgtccattggcttcactgaggccaagtccgacacatccctgtttgtccttcatcgcgactctggcacaatatacctgcttctctatatcgatgacatcgtgctcactacctcctctgctcagctcctccagtggaccatctcatccctgcagtccgagttctccatgaaggatcttggtgctctcttggtgctcttcatcacttccttggtgtcaccgtcgctcgcagggacaccggcttgtttttgcatcagcggcagtacagtcttgatatcctggagcgtgctggcatgacagattgcaagccgtgcgccactcctgtggatacatgtgccaagttatcttcgaccaacggtccactagtggcagatcctacagattatcgcagtcttgcaggagcacttcagtacctcactttcaccagaccagatatttcgtatgcggtccagcaggtgtgcttacacatgcatgatcctcgcgaggtctatctcaccgctctcaaaaggattttgcgatatgtccgaggtacaattgatcttggtctccatattcagcgttctcaggccactgaccttgttgtctattctgacgctgattggaccggctgtccaaacactcgcaagtccacatccggttatgcagtttttctcggtgacaaccttgtgtcatggtcatccaagcgccagaacactgtctctcgctcgagtgctgaagctgagtatcgcgctgtggcaaatgcggttgccaaagccagctggttgcgccaacttctccatgagctgcattccccgccgtctaaagccaacttggtgtattgtgataatgtgagcgcagtttatctctcctccaatccagtacagcatcaacgaacgaagcatgtcaagatcgatctacacttcgtgcgtgacaaggttgctctaggtgttgtccaggtgttgcatgttccaacttcatcacagtatgcggacatcttcaccaaaggtcttccctctcttgtcttcatcgagtttcgctccagtctcaacgttcgctccatcgacgttgcgactgcggggggtgttagacaatatggtttagatatgcatggttgagttttatctctctaagcctagatccttatcctcccgattctgttgctataaatcggtagagtggttatggacaggcatatatatgtacgcactacgtgattaatccaatctacgttgagttcctccatctcacaaagaactcaatggtcgttgcgatgttgatgaacttgtcaaatacgactcgcagcaacttcttgatgacggattgagatcctctacaatcaaatgcagagtgcttttatcactgacatgtgagaccgcgtgccagtgacgcatgacttcaactgcagagcattctgatcccttgacgacatacttttgtatgtatatgatgccttgggtttgggacacgagttattttcgttctcgattcgcccttgcatataccatatgagttttactcaaatccaatgttctaacaagcacaaaaagaatagtacaaaaccatactgtagtttaacgatctacttcagcataagcatccgccggcacagcacggattgccaccgacgggcggctgcacccatctttgcacctcgggcaggagcacgagcagccgcaggagcactcggggcacgacggcgccggcgtcgcgcctccgaggcagcaaggcctgccgcagcagcacgccgacgatcccttcccgccgccgcagcagcagcagcaggaaggctccccctcgcagcacgacgactggcacttgcagcaggacggctgccccttgcagcacgacgaccggcagctcagccaccgccggagcagagccaggcagccgacgcacggcgccgcgcaggacgagcacttggggcagcagccgccgccgcaggacgagcaccccgtgccgcagccgctgcagctcggcttgcagccgccggcgcagctgctacagcaccgcgtgcaggacgagcacgagcacttgcagctggagcagcagtcgctgggcggacagcagccgccgccgccgccacacaacggtcggcagtggccgcagcctgtgcagccgcagctgggaaggctgcaggtgcagcaatcgctgctgcagcagctgcagttggatttgcagcagcacgaagaaggggccttgaggcagccgcagctcggtctacagcacgatgtgtcgcagcaggagcagcaagaacaactgaagcagctcggtttcttgggctttgggaggcaccggcaccaacagcagaggcataacaagcagttgcacaatttcgatctgataaaaaacaacaggtttaagatcttttagtctttccaagggagcgttgaaacagcatgtcatttgcaagaagttcagaacgaaaaaaaaggcggtatttgtcgtgtaaatagcgctgcagttctgggaacagtattggctccacaaaaagactgcgaaaattgctttgatgccaccataactgatgtcagatatcctgacttttttcatcaaaagaaggcagtactccgagttatcatgtagtattaaagtgtgacatttctgacaaatcactttgttggtgtattgaggttctacaaattgagtgagcatttgataaaatgggctaataaggtgaaattcagttcgggcatttgacaggaacagaaacaagtaggagtatgagtcttaacagtgttgactgttgaactagtttattcagcaacaaactgaaaccagcatattgtcatactttgccctatgagtgttacctacttattcactaatggcttgaatttaataaactctcaaattataaacaacaatatattccctcggtttaaacagcaaagcttttagaatgtttttatccgtacacccaaaagcatggacaagggaagagtaagggacctgatccaccgatagaggctgcaagatctgtgtttccttttgtttctggaataaataaggcacagggagaacactgatcagcaaactttgaaaaaagaaactctgaaatgcaaaacataaatcaatatattcatacattggtataagcggatccgactttgcaccaacaaattcgttgacactgccaaatgtgataatatagcattagtatctttgtaatcgacaatggcatttgaacgttacatagtacagttccaaaaggagcaaaattgaaatgtaggtcatgcatgaacagttcacatgttgactgttggaccaccaggtcagaagttactagcagagattattattggcattcaagaaaatcgaaaagtatagtaaatgtcgcaattcatgtgggccactttcttttttttcaaaaaaaaaataagtttgaggaatgtgtcaggattcagcaaataaaaagaacacaatggaaaaaattctaatttttagtgctctcctcggaaaaagaattgtcttgtttatcaataagaccactacaaatcaaagaaacaacaacactaatgactcaaacactactgacattcagagtagctgtgattaaatggcatttgagcctgaaaggctgagactagatcactagaatgaacaagaacttgctagttgcccatccgagcgaaacaccagcactgccggcgacaagatttgcagagagaagcgaggctaatgaggaaagcagaaaggagaggatagggcgcatactctttgcaacacctcgagaccggctgaatccgttcaagtccctgtagctcttgctgcaaaaagggagcccccagtcaggccgaggcacatgcacatggcttccacagacctatacacagtcctgctccatgtgccatgaatggaagcagtaaagaacacgagcaatgcgcagcagcagcagcagcgtctctacctactgattgccattgccaggtgatgtcacgctcaagagaagcagaaatctgaaagtagagttctttttatttttaattatcaattgcaggtactcccccatacccctatagttccagaattcatcagactttacgcatgatgcaatgtaatgaggagacttcggaagtactactcctatactgcacttgctttgcaattctgaaatgcctgatgttgcagggggaaaaaatacatattgcagtagaactctactactactactactccagaagtaaaatggcattggttcatggctgcccattgttcttgttctctctgcaagaagacggcagtaggggcagccatgacagccgcacgtactgctagtacaacatgggagcctgtcgcgcatcggttgtcgcgacagagcgagctctcgcctcgcttccgtcgcgaaaccccaaaccgatgagctctccacatcaacttttttccccggagatttcctctctctctctctctctctctctctgtctctccactccataggaagaacaaaaaaaaatgcacgcttttcttcatcactgtgaaagaaagcgaggtgacatgacggggaagtgaagtgaggtcacctcgaggaagccgacctcccggttgaggatctgcatctccagctgcagccgccgccggccgcacaggtccgggtacctcggcggcgacttgggcctcggcgcctcccccatctcaacccaacttatccaccggagacgcaagacaaccaccctcagcgccgcgagcgagcgagcgagagagctagctaccctgcaggctacagctgcgtagctaaggtgggcgaggagagcggcgaccgacggcccgcgctacggtgagctcggctgcagggccacgtacgtacgtacgtacgtacgcacgctcgccaccggcagggggcgggggcgggggcgtcggctcggcgaatggtgtggatggtggtggcgacgcgcgcggcgttgggttgggggtttaaatgctggcgcagtggctcatcgcgcgcgcgcgcacgggaggaggacgcggaaggcgaggcgctgcgagtgcacgttgttgcgtacgcccactctgctctgctctggtgtggtggtgtgtgtggctcggggttgggcgccgcagactctctcgcgggcgcgcggtgggcgtgggtttttctgcgtgcgcgggggcgcgggggtgcgggtgcggggggagatgggatgtgcggccgtgtcgcggttggcagtcgtacgagacaatgttcagtcgtgtcatcatcgctacgcagaatcgcagacgggtggcccccgcccgggcggacgcgtcacggcgtcagctatagggggaagggaaagtagtaggacggggacggaacgacgattgatccagccgtagcggctttttcaccgattgattcatcactgctctaagttcctttttatttttcactcaggtcctttctgtccggtatgttatgtgtttattctttaatactttttataaggattgttaggctgtgttctttttttttcccaactccaccccactcatttacagtgtacgtgttttttaaacggctaaaagacgtgtgttttgaaaaaaaatgatttaaaataccatattaatccatttttcaagtttattttgttaatacttaattaatcatgtgctgatgaactgctccgttttctgtgtaggaggaaaacgttcccaacacacccaacgaacacaaccttaatcatcaactacttcaagagttctacgaatatcaccctctttttgggatttgtgtttgaattcatattagagcaagtttaatagtatagctaactgctgtctccaaatcatctataatcaacttaatagccaattcatacaatagttacatataaatatataccacgcaattaatatctggtcccacatgtcatacacacatgcatcttggagtccatgctacagctgcatacaaatctgtagcccgctgctcttatctctcatcttttatctcctcgaaatatgtttgtagctggtttatagtctgctattgtatctactctttatcattcacattgtttgatactttgagggaagcccgcataagatggtgttgtttctaggctagggaaagccaatatgtacgagagttgttagagctaaaaaatcaatctagatttggtaatacaattggatgttaatggtattaaggatggttagtaggaaaaatcatcggagacgatgaagaaagaaggttgaagcagaacattgtgtgaacttattcatcaacagtgacacggaatgatactactgatgctagcaaaggttagtgggatttgtgtgccgacaagttcatgactaattaggcaaccagtgttttggcttccaaggaacacggatcctctgaggctctgacttctataatctaagtcaaagccatacaatacccgctcactcatcacccgtttcaatccaagtgttgatgctttatttcctttcttcccttaattctctatgggtatgaggtgaagtgagaataaggccgtgacagttgaggcaccaagtaggacgaaatcagtggcaacgagagaagccaaggcacgcacaagatgttctcgggacagaatgggaatggttaggatatggatctagcctaaaacgtttcaaatgagtttattgaaccatggtttaatagggtcaatccatcatgagtctattatataaataggttatccatggatatcaaaatggatcatctacgctcctaatagataaaaaaaaactcttattgcatgcatgtaaaactcgggtccaaaatttttaaactcgcgttcacattataaagccttatcaaatttaattgaattttatagagatgatttattatatggagaagcaactttgttcaaattttaagtcatttagacatgtgaggcccacgatacattactaagattcaaaaattatagttaccatcctcctaacatcaattgaggagatccaacgatgccatacgccgtaggatggtccgaatagaggtgacagaggcgccgacaaagatctaggtggtagtaccgctcgtctatcgcccgccgccggccgctcgtctgctcccgcctccggccgcccgtcggcgccgcatcgtccactcccgccgctcccaccgttcccgagtccgcgcgggaggagaagcgagcggcgcggtcgacggcgaggcgcacggcggcggcgtccccggcgcggtcgccggatccgcctcggccactagagggaggggaaggaggcgcaagggagaagcggagcggtggcacgggaggagaagcgaagcggcgcgggaggagaagaaggcgatggcgatggagtagaggaagagaaagtcgttaggggtaggtggggaataaatttcgtcccgtaccccgtgtccacacgcttgggtaatgctgcactgtgggtccggttttcttcacctgtggctccatccaattaagccacacatagtatgggtgcttgcactgtggggtgggtgtctttaggccaactttttttgctagagctacgggccccataacttgcactgtgagaggcttaatagccttgagcacgaatgtcaaaggaagacgaggccaaccgttgacgaagctggcaacaacgtagagggctatgaaacagtggtctggcagtcgcaaaaatgggtggcccagagttgcacaggtaggggcgagctggaggcagcgacgatggttgcgcttgaccttgacgaggagaccattctcctgagcggtggtagcctgaggaagggatcatagatgggatgaccgaagaagaaagactacgagcgatggagaggagaggaagagggcaatactgaccggtgggccctaccattttttatatttttcgttgatatgattgccatgtcaaccaaaattctgctaaacgtgtgacatgtaggaccaacaccgctccggattgggccaaagggataattcattcgggttgaagagcttagggttcaagatgtttagttttgtagtttgaaaggattatttgaattgctgtaatagttcagggatagttaggatttctttgtagattgaaacgaacagtgtataagatggtattgcacacatctgtcttagcttaagtaggtcagaggatccatatcacatcaaataccatggatagtcttcgatcgttgtcaattgtgcttgttcaacaattggaacgccactcaacaattggaacgccactaagtgagcccacccacttagggccctttgaatcataggaatgaaaaaacggaggaataggaaaacataggattctaatatgaatgcaagtgcaaaacagagtactgcaaaacgtagaaaaaacacagggatgaccgtttgattgaaccgcacgaaaaacacaggaatcggatgagagagagattcaaatgaaagtttccaagatgttagagttcttgctaaatttcctccaaaatctctatagaattgtccattccataggaattttaaaggatagcatatgattcaatcatttgtttcaaagggcttcatagaaaattttcactatagaattggaatccttcaaaaattcatatgtttgtcgtaagtccagggatcatcgagggctatttggagtttgggcagaggaaaatcaagtcgtcgtggtcttcttttaattctacctttactaggaagcatcgatgcacggctacaacttctgtaaggaaaaagtacgaattacccccccccccgaactatcgcggtcgaccgaattaccccctaaccatagaaccggatatttttcacccccaactttgcaaaccgaacgaattacccccctcgacccaatccgcggtggttttggtctatgtggcgtacacatggcaatccagtcagcattctatttatgaaaaaaaaatgtgggacctacctgtcatacactactctctcttctctctctcacacacacactctctctcactcttcctctctctctcaccatctcacgggtcagcggcggcaggggacacggagcactggcggcggcggcggcgggggatgaggaggcggccgctcggctcagtggcatgcgcgcggggaggacgaggacgcggcttccccctcccccctccctctcagcggcgtgcgggcggacggagctcgccgcggcttcccccctccctctcggtggcgtgtgcgcggggaggacgagggcggcgggggcagacggagcttggcgcatctgg

SEQ ID NO: 43337 - DNA, 2484 bp, Oryza sativa
tatagttgggggtgaagaatatccgattttgctgttcggagagtaatagttcggagggtaattcataatttttttccttttgtaatcagttgcaccaccagctgcctgcctcccccaaaacgggccaagattttccgacggtggtcggagccgcacgcgcagcacggcagcagcagcgtcgtacttgacttcagtttcagccagctttaccaccaccgccgcggcgccagtgcgccacctttcccccgtctaccaccactccagtatgagtagtacagtgtatagtagtagtagtatccctcgatctgccgcgcggcgattgggcatcctgcggcccttctgacttgtgggagcggcacggcacagcacaggcacaaaaattgcgcaaaagcggcagcagcgccacgtgaccaggggggggggggggggggggctctgcctgcctgcgcgtgtcgtgtgcggtgcgtctgtgggcatcgccgcgtcggtcccccgcgcgctcctgccgagcggtgccaatgctcgtcgccaagtcacgagttccgattgacggcagcgcggccccgcgtgcggcgtgccatgctcctcggatgccaatgctcgtcgcgggcgggcgcacccgtgcgtgcgatgcaagggaagaccgatggttttcaacgcgcgcgtgcgtgcgagcgtgcatcggtctggcggctctgctccgctgctgccgtccctctgataggccagggccagcccaggggttgggtggtgggtgggcttctcatcgatgataatttccttgttgggctgacgcacctcggctctggtgaattgaagcagcaataagtctatcatgcctcccaattcccgcttctgattgaatcgtctccctcaaccgcaaaaccgggtataacatctcccccatcttcgaaaatcggtataaatcgactcctttagtcgtttgagaacatgtttatgttgatgtagcaatttacaaacctaccagtagaaaccgctttaattccaaaccactgactgagtcgatttacaccagttttcgaagatggggaggcgttttaaccagttttacgattgagagaggtgattcaaccagaagtaagaggtaaatgaggtagaatagacttattccgtttaagcacaacctaatggattgcgtggctgacacatttttagataatggaatggaacatcccaacctttgctcaagagctatagctaattattgacaaaaaagcaaacgcatggtgttgggtttatgttttgtgttgaaaggctggaagcctggaatgttggagattttttttaattttttattaaaatatttgtaaaactaattttgtgtttcaaaattttacaactagtcgcccgtcgccctttggaagggcgataaaaatcgccctcccaaagagcgattttcgtgacgtggcagatggccattggctcatgcctaacggccggctatagggggctgccattttgcaggcgacccccttgccgcacttagggaggacggtttaacactgtgcggggccgctccccttctcctccccctcacccctccctctttcttttttttcggattttgagtgaatataaagcaaaatcatagagcggcaaggaggctgcccttttgcaggccgcccccccgcacagtgttaaaccgccctccttaagggcggcaagagggccgcctgttaaaaaaaagccaggtcgctatcgctgcccttttgcaggcagcaccccgcacagtgttaaaccgccctccctaagggcgggaaggggaccgcttgcaaaaaagctaggccgtcctcaccgtccttttgcagccccccccggcacagtgttaaaccgccctccctaagggcgatatgggggctgcctgcaaaatagcaggccccctttgccggccgttacttgtgaggcgatagccgtctgccacgttattaaaatcgccctctgggagggcggtgggcgactacttttgtaaatttttgaaacacaaaattagtttcataaatattttaataaaaaaattccaatgttggatgggtaataggagacggtccaatagcccatttgtgttcaggagctgaaggcccatgcgaactttagttacatctcgagcttgcatcttttgcctaattacatgaaagaggatcgattacataaaataaaagatagactttttcaagttcttttagcctaaaaaataaaaaaaaatcattttcataggcggctccaaaagaccacctgtgaaaatgtttcttggcggctgattttgagcctatataaatggtcgattttcataggcccttagctacatgcggattgaaaagcgctcgtgtaacgggttatgaaccgctcacacaaacggttttttaacacaacctcaaagagataaaataggtgatataattatgatctcataaaaattccttcaatatgatcttgggcttatatcttatatatgtagtttgagag

SEQ ID NO: 43338 - DNA, 8477 bp, Oryza sativa
aaaaaccaatctaatactgaatgtgacacatcctagtaatacgaatctgaacatacctatatccaaattcattgtactataatatatcacatccagtactagatttgtttttttcgggacggaaggagtatacttaagtttaaaaaaagtttatttttctaagaacaggcacacaacacaaaggacagcaggggtgaactttcaatacggacttctcacccaaccagtgatctttgttaactctactcaaaacagtgaaccattatcagattattctcagcatgacttgcagcacaacgaataataaatcttctactagtgagcatccaattgggcacttggctctatagatcagttcagcgtgttaggtagcaaccatttgattgtttagaacttgcaagacttgcgaatcgtcgagtcgtgtctttatttatgtatatcagtctgctatatacatgcatatgaacttgcacagctaaccgcacagggacctctgcttacgaactgtatgatgctctgcgtcgcgtatgaattttccgtagatacgtatcatgttcactcccagcgtaggaaaaataagaaatgacgatgtcatgtggaagtctttcttaggcagcccggcgaagacgcaagctagctagcaccaactccacttggctgttcttctattgaaatttgcgaaggtttgcgttcagccgccagcaggttgtgacgatcaagcgatccgcaaccatgagcggctgagcgcacattacatacacatcagcttcatataagcaaagcaacagtgttaagagtctggttacaaatcacaaagatcattaatactcccaacgtcatatatacactaaaacacacatgaccggaggggagtacttatttttttaaaattttgatcttaccgagagagtacttgactgtcgcatatatggtcgatatgattgatcgtttcccctttccttttaatgatttgtgagctcacgaagtatgaaaagaaagagtgaaagaccattcagtagtagttactactctttcctctttctgtactaaaatataaggatttttagttataaatttgaacaactgtgtttctaaattcatagccaaaagttactatattttgggatgaaggtagtacctccacctctcgacgatatcaaatgatgacagttcccacaaacacatgtgaaaaccaaataaattttgtcaaaaattatattttctttgaactggatcgatccaccgagtgaatttatttccgtacctggtgatgggcacaattaccatggtaaccgcgcggtaagagaaaccatacttattcattgtctttcgttttcatttcaattggttacaatgaattttttaatatctaagtttttattcattttcttgttttattgtaaacttctaatttacggctccctttgattcaaagaaaaatcatacaaattttggaggattttatttctataaaaaaatatttttcctatataatcatttgaatcaaaggaataaatcctatgaaatgtctcactccatgcaagttttataagaaatttaatatgggttagaacctcatgggacgtttcttttgagtctttatctctcttaaaatttttgtgttttttctgcggtctaatcaaatgactattcttgtgtttttttctatgtttaatcctatgttttataattgcatttatgtcagaatcctatattttttttattcctccttttttatttctaatatttaaaggggtcctacataagattgtgtgacaaaaagaaaaatgagttttccttttttttaaaatcttttcttgaaggtttttatgtctcccaaagggtatttctgttgtagtgtctcgaagcaaatgtttccaatctgtattgttgatactttttgtgataagatgctttagagtctcctcaagtgaaagttgattgacctaagatttcacgagtttgactgcaactgtttgaagttattagaactgttttcgtttgataatgagctactagaactagcaaagggattataatagatcacccgagtaaacatcccctcatttactaggcaactaaattattatgattcttttctaaaagattgatacgacatatcaatatataacatatcattatatattactgtataaatatataagtataaattcgacttctccaagttataaaaaaaataacaaaatggatgccaactcaagtgactaaaaagagtttctcgatcaacataatctatcaattttcaattagaaaattgactctgacttggcagcataattgagactaacacatgcacatccaccataccaaagtacaattactgaaccgtccccgtccactacactgttgtacgatcgattaccagtagtagctcactcctaatctcctacaaatacgtagcgtcactcgcttgcattgcatcgcatctccaacccaaacccaataaatcctctcccattgcccatggagccatcagcattggccaccttgctatccatggcgctcgccgccttcctgctactcgggctgatcaaacgcaagggcagccgccgtggctacaacctgccgccgggtccgacgccgtggcccgtcatcggcaacttcaacctcatcggcgcgctgccgcaccgctccatccatgagctctccaggaagtacggcgagctcatgctcctccgcttcggctccttccccgtcgtcgtcggctcgtcggtcgccatggccaggctcgtcctcaagacccacgacgcggtgttcatcgaccgccccaggacggcgtccaggaagcacaccacctacggctacgccgacatcacgtggtcgccgtacggcgcgtactggcgccaggcgcggcggatctgcgtcaccgagctgttcagcgcccgccgcgtcgcgtcgttcgagcacatccgcgccgacgaggtgcgcgcgctggtgcgcggcctcttcgccgcggcgtcgtcgggacgcagcggcgccgtgcacctcaacagggatcacctgtccacgctgagcatgaacgtgatcacgcggatggtgctcgggaagcggttcttcggcgagggcgcggacgcggcggaggggcccgtgtcgacgctgtcggagttcaagtggatgctggacgagctcctcctgctcaacggcgtcctcaacgtcggcgactggatcccgtgggtggactggatggacctgcaggggtacgtgcggcggatgaagaaggtgggcaagatgttcgacgcgttcatggagcacgtcctcgacgagcacagcgagcggcggcggcgcgagggcgaggcgttcgtggcgagggacatggtggacgtgctcatggacctcgccgacgacccctccctcgagatcaagctcggccgcgtcggcgtcaaggcgttcacgcaggacctcatcgccgggggcacggagagctcgtcggtgactgtggagtgggcgctctcggagctcttcaaaaaccccgccatcttcgccacggccaccgacgagctcgaccgcgtcgtcggccgctgccgctgggtcacggagaaggacatcccgaacctcccctacctagacgccatcatgaaagagaccatgcggatgcaccccatcgtgccgctcctcatcccgcgcgtcgcccgcgacgacgccgccgtcgcgggctacgacatccccaagggcgcgcgcgtgctcatcaacgtgtggaccatcggccgggacccggagctgtgggacgcggcggaggagtttatgccggagaggttcatcgggagcaggatcgacgtgaaggggcaggacttcgagctgctgccgttcgggtccgggcggcgcatgtgccccggctacaacctcgggctcaaggtgatgcagctgagcttggccaacctgctgcacgggttcgcgtggaggttgccggaggggatgaaggaggaggagctgagcatggacgaggtgtttgggctgtcgaccacgcgcaagtacccgctccaggtggtcgtcgagcctaggcttcccgttcaactctactccttatgaatctgtgggtcagtgtgtgttgatgagtgggacgtacgtgattgtgcactgctgtactagcttacttgctttcaagtttcaaggtttcaagttgcgagttgcaaatagccgttggtgcagtccgtttataggtggccaaattggccccctgacccgacctacatgtcgggtcgtgctgtgccaaccaacgggctgcacacacggcccaataagattcgggtcgtgctgggccagcccgaaggaatgacagtatattgtgcttctccatagaataagtctactttttcatccctcaactctttggggtgtcttgtatggctagaaatatgtctattttgtattcctcttctctttgggccttgccttatatggttgattaagtctattttggatcccactactattttctttgatcatgccatgccggccggccgactgtgtcaaggcatcggccccggcacagcccactgttgggccatgtcatgcttgggccgggccaaatggccgttccttgggtcgggccgttgggcctcgggccatatggccaagtccgtcctctcctccatcccggtgcacctctcccttgccatcgggttgccgaatgggtcttgaaaaccgttgacaaatggcaggaatccttcctttggaatggattggactcagtctatggtaggagttgccttgtcgcttaacccaagatgtattagatcaagtagctcggggccctggaaatcatgaacctacggatcataggatgggtcctgcaaatgcaatgcgatggacttggctccagcgcattagagacccctgctaggccaacattaacctaccacaagtgcagtgtgtgtcggagattttccatgcgtcagtcaatctgtcatggtcgtcatcggagatggatgtcgctcgttgttctggttggacaactggatcgacagacagttgattcaactgatcgccccagatctgttccttgtcgtccctgtgcgtcgtcaagactccacttcggttgttgctggcctagccggcaatactaggatatatgacatcaccagcgccctgactgtgtgcatgctctcccaattccttacgctatgaaatagagtatagaacttcctgactctatccaaaatgagttcatctagcgttggatggatgatgggtacaacattgcctcgacctacaacgcgttctttgagggattgatctccttccttcctttggcgcaacgcttgtcccgcaaagtgtagcttttttctcgggcttgcactttagttacagagttggacggctgataaaatgcacaaccgagggatggacagtcataccatgtgtcctatgtgtgcgtaggagctggaaacgctattgtatcttggtagagtgtgtcttcatgtgacaagtttggctcaagttgctacctaagattgagttgacctccctctcaccctgccgacaatatttgcttcatatttggtggagtcttctcgccagcggctactggatcataataggaaggggttcgattccctcatccttttgattacctggcacctgggctggaaaggaacactcgcgtctttgaggggatactttccacagtagagacaatggttgattgtattgtgcaagaaggaaagctttgtgtgggttacggcgatgcatagtcccctaggagtttttctcggtgcttagacacaaactctttctccttttcccttgttgttttcaggaatctagttgtctttcctagttagttttagaggcggatggccccatacggtagggtgggccggctggcccagcttgctaccagcccataccccatcccctcccctcccgggtcccgacgggagcattgagccacgcgctaggtcgttgagttgggctaggcccttgagtgcattgaggctgatcgaagtacaactactcaacgcctcgactccatgaacgcacgtagccacgcaccgccgtatgtagaaccctatccgctagtgctgccacaccagcaccacattgtgaacctgggagccgttcactgccgccttgttctctgccaccttattctgcatcattggcctcggttgtcctcaatttttttctcaatctacatcattagcctatgttgattgcagcagcaaaggaaaaaagaacattttttgggtgcgtatctccatccatacgtgatttgctcttctgggatttgtgttgttaaattttggtgggtgttgtcatgagctcaatcattgcttggtctctgtgtctctgaattattggtagtgttcgtgtgtgagagaatattagtggattgaaaacttttgatgatgctaattgggttggtttatggataaacaggtatggtatttctgcaattttgttgatgttctttgaaaccctcatcattttcagttcaatagacactccctcatcattaatatctcatggtgtgacccacctaattttgtcagtttgatgtatcctccttacccctcatgatcagcaagtcacggtcataaaatctcgttttttttcttgctaatatatttttgatgaaaatttcttgctaatatatagatgcgcaagattttaagcaaataaggacagtgccgattattataagttgatgcctcgcgcgtggcagttttattgattactatcatggccttgctttagttaacctcgctaaagaatactacaacctccatcctacaataagggtatttttgaaattcaaatttgttccataaagtgtatatttctagagttgtagttgtccattcaattcttccatttcaaacaataagatgttttgactttttatcaagttaaactatttttaagtttgactaagtttataaaaaatagtaatatttttaacacaaaataaacaaaataaacatgctaccaaaatttatccgatgttagatttaatgagactaatttggtgttttagatgctatatttttttataaaattgaacaaacttaatagaaatttaaaaaaaatccaaaacatcttgtaatataaaaaattacaaaacgaagatagtacctttcatttagattattactttcatttagattattactagttcctcctcgattataaaacatcttgtaatatactactgcctcctagttccaaccaactcctaatttagtaaggagcatttacattttttttcttccctaataatttttctttcaagtgctaaaaatgcacatataatgagatgaaggtggtaagagagaagattggcattgggaagaagagaaatagaaggaacagagcagctagcaatggaggtcggacaaacgacatgaagaaagggatatggaaattacatttatactgctttgaaaattaggtttaatgcatccgtggcaaagatcttgaattgggacttgagaaattatggaaggaaaaagtacaccgaaggtccctcgacttgtcatcgagttacaaaatcgtcctataaccacaaaaccagatatccaacgtcccttaactaatcgaaaccggtcacgataggtcctttggtgtttttgactccggttttatcctacgtggcagttgagtcagcgtggaacccacgtggaccccacatgtcagcgtggccacatcagcctcctctctcttttcccctcttctctctcttcctcatctctctcccttctctgccaccgtcgactgtcccaccagcatgaaggacagctggagggcgcaccggcgcgtcgcgtacgacggcgaggccaagaacctcaccgtcgcgctctcctacggcgacgcggcggcggcccaacagatcccgtgctctggtacgccgtcgatctgatggagtacctccccaatgccgtcgccgtcggcttcttcgccgttacgggcgaggccgccgagctgcagcaagtgtagtacttggagttcaccaccagcatcgaccccaaggacgtgtgggtggtgttgggactctacagcttgcttctcgtgctcgttgccataggggtgctctggttcgtgtcgcaatggaggaaagccggagagctcgccgatggcgacatctttgacgagatggggtacgacgagcttgccgacgaggagttcttcgtggagagcgggccgtggcggttccggtacagcgacgcgcgtccgcatccaacgcgcgcgccggccgccgccacaccttcctcctcccccgcgcgccggtcaccgccacaccttcctcctcccccgcactccggtcgccgccacaccttcctcgtcccctccgtctcgccgccgcccgaaacggcgtcggctggggcacccggcgcccatggtggaggcggctagatccggattcgccgtagcctctccgccatcgacggtggccggcggcggcgccgtgctcacgctcgtcctcctcgccgcggctgagtggtggcggcggcggcggt

SEQ ID NO: 43339 - DNA, 2979 bp, Oryza sativa
  unsure (1)..(2979): unsure at all n locations
cgcctacctcgtgttccgctgctccccaccactctacgcctccgccgtctccatctccaacctcctcaacatcaccgccaccgccgtcaccgaatccaacgccgtcgaccccggtcacccccgtcgccgccgaccccctcgtcctcgcgcccgttgtcggcgacctcatccccacccgccggctagcctgcccgagaggagagaaccgagagagggagagagaggaggaagggagaggaggggaaagacatggagggtgatgacgtggcattctgacacgtagatcccacgctgactcagctgccacgtgggacaaaaccggcgtcaaaaccaccgagggacctgtaaacggttttataagttaagggacgtcttgcgttttggggacgattttgtaactcgatgacaagttgagggaccttcggtatactttttccaattatggaatcccaagtccctggcctgacccaataatatgccaacatttgggcttgcagataaggggctttagacagggagaaagatatgggctttgtttagattccaaaaaaattttagccaaaaacgtcgcattaaatgtttgaacacatacatgaaacattaaatgtggacaaaaaaaaccaattgcacagtttacatgtaaattgcgagacgaatcttttgagtctaattacgccataatttgacaatgtggtgctacagtaaacatttgctaatgatggattaattaggcttaataaattcatctcgcagtttacaggcggaatatgtaatttgttttgttattagtctacgtttaatacttcaaatgtgtgtccgtatacttcaaaaactttacacctaaaaaactaatcacacccatgatagcctggtacttgtagcatcccaagaaacaataggcctgtttggattgacgccatactaaaactttggcaggtctacggagagttaaaaatgtttatttggattgaagccaaaatatgtctataagagataagttcaccaaaaaccaattttttttagtaaaggtattgttttaataaagatggttggtttttcctaccgtaccaaaattttgatagggtaaaattcgatagggtagcaatccaaaatgtcccgatatcttttctcaattacacacgagagattcacaagcatgcacatctctatgcacacatatcatacgcacatataggtgagtctgctacctaccacacgttcaaatcaacaccatcacatttctaacatcaacaaatttctattaaaaatgtacctacatggtttttaatatttatgggcattagatctaaatcaaaatggtcataaattttgtatgcagaggccggattcaatacgggtgctaggggggacttacccacattagatccccatagagagaaagagagagggaatggggaagaagagtagggggctggagcaagaagaagatatgtcctccctcccattcaatcctagatccgcccccgttagtatgtatatgtacctaataatggaaataccaatacatacttcctagacaccttgtatgagaaattgcacgggcaaactttatgcctacttgattagtacatgaaaacgaatgccaatgacacaattcgtcaaattgcaagtatacacatgatttgaatttacatcaagtatacaacgcacaaacggcacgaagtttaatttgaagaggctacacacactgatacacagattgatagctgcaggaagccaacaccaagagctagaagaagctgatataaaaggggcaagagtcagccgtaccatgtccatgtctagctccatggcacgtacgtagcaccatgaaaaccatccctacgcgcaggcgcaggggctctcgagctcgtcgtcccccacgccgccgtcggcctcgtccgcgccgccgcggaacgccaggtgcccggcggcgagccccgccacgacggccaggaacaccccgccgttgaacgacatgacggccagcatcaggaggtacccgaccgcggcgctcaggccgaacagcgccgccgccgccgcggaagcagcagcccggggctccttcatccaccgcctgccgaggccgaggccgaggccgaggcggccccccgcggcggacagcagggcgcgcgcgtcggacgcggcgggcacgacgggaccggcggcggaggaggcggcgccgccgccgccgccggcgcggtgacgacgacccgccctgaggcggacgcggcgggcctcgaggtgctggtagagcgcggcggcgaggaagagcgcgaggagggaggcgaggtaccccggccaccccgacgtgcgccagccgtcgaagaggatggtgacggacgtgccccagtagaagctcatgtgcatcatcgcggcggcgcggcgaggtcgagcagcaagctctctctctttctctctccgatctgtgggtggtggctaggcttgccggcggcggcgcgacgtggtcggggtttaatacgactacgagcacacacacactgacgatcgagtccaggcccctgatcttacgcgtttattacggcccggatgccattggatcatcaatcaggcagattttctctccaccgtccatcccaaaatataagcattttttaagtatagcgacaagtcaaacatttttaattttaattattaatagaaaaagaaaataaaaataatcagtaaaattaaagttactagatttatcattaaacaaactattataatatataagtctttttatttaaaatatcttactttttatagataacgttggtcaaattagcatctcgaagaccatgtcaggatttaaaaatgcttatattttaggacagtatgagtactaattttaattagtatgtgtgtcgtacggttcttgcaatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 43340 - DNA, 2399 bp, Oryza sativa
  unsure (1)..(2399): unsure at all n locations
ggatagcccaggtcgccgagagtgtccgccatggccttcatcttgcagcaatagtctgtgatgnagaggtcgccttgatgtagcatgcganactcggtctcgagggtgagagcacggcgttcgctgttgcccaggaattggagctcgagagcgcgcgacaccgaccgggcagtggcgacgtgggtcatcacctcttgaaggagatcagcggagatggagctgtagagccacccaagtacgacacaatccatctggagccagtcggcgcgatcgggaaagtagttgtcggagataacgtgatccgtcaaggcgtatttgccaagggccacgaggaagaggccgcgccatcttgtgaagttggtggcgccgacgtcaagggtgatggggacgagcgccttgacgttcagtacaccaacagcctgcgcgtgcagggcgttgcgggcctcgttgttgagaggtggtgcggcgggacgagttggcgcgatagggatgaagtcaccggggaagccgggaagatgggcgccgtgtcgtcgtagttgccgcaggcgcctagtccagtagcgagacgtgccgcggtgaagagttgttccagcgccggtggtatagatggagcgccggggggaacagagaaaggagcggtggacgccggggcggtagtggccggcgcggtggaggcagggatgcgcggggcaccatccgaggttgacatggccgacgaagacgtggtggagaggaaggacgcgagggcagtggagagcgcgtcgtgggcggccttggatgcgcgccgagcagcggcggcgacgaccgcttattcagtggtggggtcgacgtcagagccggaggagggggtgaaggagttactcacggcgtcggcgacggctttgacagcctcgtcgatcgcagcggaggttgcatcgggaatgggcaccgtcgatgtgttttcgggcgccatagggaagcagtgatagggtttaggtgtggagcggaagcgataccgtatctgataccatatgaaacgaaggaactcaacgtagattggattaatcacggagtgcgtacatatatatgcctgtccataaccactctaccgagttatagcaacagaatcgggaggataaggatctaggtttagagagataaaactcaaccatgcatatctaaaccatattgtctaacattctttgggagcatgaacacaagcgccacggaggaggtcattggttcactcaaggcttacgaagataagaaaagatagcgaagaaaaatgttcttgttcttgtacaccgtgtttctttgtgcgttgagatgtttaagagaaacaccaaaacagtgagctaagagatttggctccatcggtctctttaacatgaacaaggccgacaaatctctctttaacaaattcttgtttgtctacatatcgcataaccattgccattttttctttgcaagatacatcctccaactcatcaactagcaagcaaaatacatcatgcccaattttatcaagaatagaacatttcagctccaaaacagtgaactatattgtttgagtctctaaagacaccatcagattattaccaggagcattatgtgttgtcagttgtcaccatactagtgctagattgcgttgagctgtatagtcgtgaaattccttgaaattccctttattcatggatgatacagattcgtcgtgacctgaaaaggcaacccttgcttcaataacaatcgagcaacattgaatcttgtcagtatcacattgtcttttcagtgcaacataaatgtgctggtcttgtgacaacaaggcatcacaatctctcgtttgattggttatgagcactattgacatcccccacatgattatttgatccaaactttttgttccaactagaccatccagtagtaacaaatgcatcataccccggtgccttcttgttaggatcctaaacaagaaacaacaaaagcaatatgctttattttggactcactgcactcaagccaaatcccaaattcttcaaagagtaaattgcacacacggtgcatcaacttggcaagtgggtgtaatttgatacaagaacttaagaaatgagcgttctggtgtaacaacttgataggtaagtgcaatttagtacaagaactttataagtgatcgcataaatgcaataacttacaagatatatacgattttaatacaataagttaagaagttatgtgacaacttaattatttggagcactttttttatacatattcaattttaagtacttattttgacaatatactagcgtggatttgcatataagtatatttatatttttaccaccgaaagtcaattaaactggatgtagaaattattatattttggttgagattttgggaaggtgaagaaaacaaaaattctt

SEQ ID NO: 43341 - DNA, 752 bp, Oryza sativa
tcctctcatccagatcccaattccgaaatctaagtcaaattccaagttcaaattctcttcgaattaatctcctccgaaaaagtctattttgcctccctcgaatttttgtgggccgttttctcctcggcccatctcctctcagccgctcctcctcctccccctcgcacgtgcgttgcgcgtgtgcgctcgctctctccttcttcctcgctctctctcaccctctatctctctctctctctctcattgactcccgccgacgccgcccaaaatcccaaccgcgctgccgtttctcgcgcgcatggccgactggcaaggacgccgctcccacgcgcctcgcctgcccgcggcccaaaacggaagggagaggcttccctttccaccgtcctccctcactttttcccttctaaacccggcctctctcctctcgcccttgtcttcttgcgcgcggaagcagaggacgccgacaacgtcctgccacgcctgtgcccccaccttgaccgcgccacgccgatgctcccgcgcccgtgattcaattcccgccgcacgatccaccgcctccaccgcccctttgcatcctcgccgtcgccacgtttcgcgcagcccacgaaaacgccgctcccgctcgtgaccgcccgccgagcgccagccgagcgctcaaccgccaaggtcggtttccctcctctaaaccgacctctcctcctcacctataaaacccaagcccgagctccccctcttttcttcccgttttactt

SEQ ID NO: 43342 - DNA, 8495 bp, Oryza sativa
catatctcccgatccgtaattctgattaaccccgttccacttccagtattcccgtaaaatcgagatctatttaatggcactattatttagtctaaataggatccttttcttggtcttttgtttaggttttgattgtttgcgtatagttgcggttaccggatttttgtcgatcgtgggatttctcgaagattcgtgaagcttcgtgaagaccttgagcaaggcaagtcaccgtttgatcatttgctcctataattggaaactcattattgttttgttttcaacttgcattagtagaatcacacacttaacttgcttggcctcggtttgcgtgccaatccgatggacctacccagtagtcgcacaaattcctgtaggctgtactaccctaattctttgtcgctccactcttgtggtacctcggtatccgtgctctctgagcgcgtatacctaatacctcatatacaccgttgattgtcgaaaaattgggaaatgggtttgagaagccttgaaaacccgacatatggtgtcggtgtgtttaaaaataaaatgaattgtgaaaactcgcgatgcgggggtggtgcctgcgtggcgctgtcccgtattcgcatataaggaccgattcctgtgtgaaactcatcaagcataacaaagtgcaaccacaaggtggtatgggacaccctagctaagtaactagtcggttcagggaaacctcgcatgccaatagttgggaacgccggggcggggtcagttggagccaacccgggttcctggtaaggcaagaacgcgaagcttgccagattaccgatcaaggtggttggagtttgatttgtgaaaactaaaatggcctatatttatgtgaggatttgattcttctatgtggcatgaggtaaccctgggtcggcttgggaaaggctttgttgcgaacctccgataccgatgggtgtttggaataagttcgtatcttatgggtaaagtgtacccctctgcagaggttaacttactgttcgaacagccgtgcccacggtaatgggcggatgtaaggtggttcccgttgcgtagatttgtttgcttgtgcttggtgaaaagttgttgtggtgtgggaatcgtaaccagaatcagcctatgtggcagatggatgacctgagtggtcagaaacgaatctatgtgattcgggatgtctgcgggcatcatagactaggcttcccgagtggaagcggattgttgtgctgctgggcagctggactctgggagtccaagaaaatgaaaaaggctctgggagccgatttaatcaagtgaaatggctctgggagccgagaagtaatgatctgacccgggaggttggtacattatcaattgagttgttgaaatttgatacgcaagtctcttttcgacccgaacttaaaaagaaataaatcacttagtgatttcaaaatgatttcaaacaaaagatttaccaaaacaaccttgcctctcttccaagcttgcatcaaacacctaaattcccgtgacttgctgagtacgaaagtactcacccttgctctatataaatatatatagttcctccgccctgaagagaagataaagtgaagtgaagattagggtttcgtcctggttcccagccgtcgcctgtggtgttgggtgttagtccgttggttccgctgctgctgctgttgttggtgttttcctcgtccgcgtcgtcggttgcattctcgggctgttctgagctgcaacctaagttaaggtaaataagtcctttatttattttaaggattgcaatgattcatatttttcatcgtgggtaccagcactatgtcctgggactggtactgtaatcgcggattcgtaagaagcggttcacgccgttttttctacgacacgctcctgtcaggtgccgttgtatggcagtgccgaattggggtgtgacaataatctactgaacagtctatcaaatggacatgatctttgcaccaccaaacctactatgtggcatccacaattcgacatgccacctcccctccaagcggccgtactcgattcatttttgcttaatatcatatcacacattaaatattctctctatcaaaaaaaagtcgaactctagggatgaatttaaacatggtaatgcatccctagagttggactcatttcgagatatagggagtagtttggaagtaagttggaataatatacttaatttaaagtgcgatgtgcaggcttagtccatggcgtgcactaattgaggcccaatcatttatcctcttcagattgcatcatgtactgtgacgagttctttaacttcatccgcgttacgttgagagtcaactgtcgaggtcaacgctcgattcaccatttagcaaatcgcattcaagtcaatttgctgtttcagtcgtatatagtgtgacaaatcagatgcaacgcaacattaattaattagcaattactgataattaatcacagtaactttttcagcagcaaaaaaagtttcaaagcatagtctacactgtacaccatattatatgacaccaaccaaaccggcgagcttgctgcgaggctgcatgccacagatgaaagctccatcgcggcgacgacgacgacgaccgtgtccaagtccactcatgcctcgccatctcttctaccctacgcgattgcatcttgcatcaagaactcgatcgatctgatatatattactatgagctaagctgctaattaagttctagatttaattagcaacaatcaatggacgtgccgttcttcctcgccttcgcaatcatcgcgctcctgtccaggtacgtccccttcgcgctgccgccgatggcgcgggacctcctcgccgacaactccgccgagccggcgcgcgccgccaagtgcgcggtgtcggtggccgtcgccgggctgatgctgctggtgtcgctgcagtgcggcgccggcggcgagcagtactgccccgacgtcagggtggaggggagggcgctgtggctcaactgcgcggcgctcttcctcggcatggtcgtcggcggcgtcgcggtggtggtgatgccgccgctcgccgccgtgtcgccgcttgtccaggtgatggtcgaacacctgaccaggttcacggagaccatcgcggtgaccgcgttcgcgcatgacttctgcatctttatcaagctcgtgaggctgaaacaatgaggcgaggaaccgaaggccatttctcctttgtttttcttgaggcttttttattcacgttgtaaaaagattgatgaacttcaatgcgagaatggcattcaatgttcatttgcgtatattaattaaaatttaatttattatttttatataacttgaagaaatcgatttctataatcgaatttaataactatgttaacatgtaatacatccattttgatgattagaatccctcttcggaaccaggaaaccgtgcgcacggcgtccatgtctcgggaatgctaatgtgggagcgaacgcttgtggcgcgttcctgtcagcgaacactttcgcctttcggacaatataagtttcgctgttagctttccactttttctcagggcaaattatcggtttttctattcgatgattgaagtatatgctccatgatatgacaggtagaatatgacatgtaggttagaagggaatggcaaacaaaaagcaatatttgcacagcaatgtaaaactatgaatttaaaaacaatatgtaaatccacatattttaaaggttaaatcatgccatagttatcctagtaaaacttctaaaatatacgttgtttggcaaataaaattagtgctaaatttgccgctttgttatattatggctaaatatgtagttctatgctaactccgttataaattatgggagtgtctagattttaagcacatggaaaattttcaaaaactttaatcacaattctcacctcttagatataatccactggttgttatcaatacctacttatgcaaacaaaatctgtttctactaaaagattgacaaaattacataaaccaccccataacctattttgtcgcaaaagcccacccatcaaatattgtgaggccaaaattacccaaatgcttaagtcggactcaccacaaaccacactacctagcttggcttagttgatatggtccgccgggattcaagtaaaaaatggaccgaatcagttactcatgtgtcagggagagggcgagggtagagtggtttttccaacacaatgggttatgcgatggaatctcaaaacagggtgacaattataatgatttatgcaatttctcctaaaagattaaacaataaactattctaacctataaaaagaattacaaaactgcatgagataaacttataactaataaaaacttactaaattacatgaaaaaaaatgtttgaacttagataaaaataaaactctaccaaataccttacatgacagtttcatagtattgtagcctaaggctgctttcatttgaagcaccgtgagaaaaaatagtgcatcgtttttcgcgtgcgcagatattgaacggttaaaaggtatttttttaaaaaaatatataggaaagtggatttaaatatggtattatccatttttcacttttgaaataattaatactcaattaattatactctaatgactcatattgttttacgtattttcttaatcttctacttttcccttcctttagtgtttttagaaggagtaattctacggttcttgagaaggtaccaagatgtaccaaaaatttagtgcaaaatttaccaaatttacaattgaaaaagtggtacctcatggtacattctcaaggaccgtaaaattgctctttagaagtagctaggcttattccttttcatggttttgaacggttgattttgtgcttaaaatttcctctctcttaaaaagaagagtaaaattcacaaaactacatgttttattgtccaacttgtataacaatgtacatattttaacacttatcacttaactacatatattttagtattgaagtttcacaaaactatactatcaacgaacgaatccacctgcaagacgacgtgattgtttatctacatatatttacaatgcggacgtggcatcgtgaatgttcgacctcggatgaagcactcaagttcgcatcctaggtgaaacaaccgcacatcatctcgcgggtggatccattctctaatagtgtagttttatgaaactttaatatcaaaatatatgtagttaagtgttaagtgttaaaatatatgtaattttctacaacttgaacaactgaaaatgtagtcatgtgaaatttacttagaaaaggttctgcatgaaaaaaaaagaggttctacacgatttttgtgtggttaacgtgcgattaccgcggtaatcgtcctacggcaggggtgcagtaaccccggtcaaaacgaatgggaaaccctgcccttaagaacccggggtcttcagtacaacccagcaccggcgattgaacaggtccagaatccagaatggtgcgattgattgctcccggtgcgtgggacgcgccaacacacaaactggaaaaaaacccaaataagtggctacgagcgagcgtctccaaaacgaaccaagtactagcgactaaacgaaactttttgctcccgcgactcccgactcggctctcccgggcaccgcgggacggaaacttagccgcgttccgacgaccccagtgaaccagaacgaccggttccagctgctacacgcgagcaacaagttgaagcagagagtacggttcagagtgcccgaatgtccgattacactgtggacctggtcacctggacttcatcttggccggggccgctgaccaagatgggcgacccacccaccggtggcgcggctggagcaactggcgaggatcacaagattcagggcccgtctagttccccaaaaatttttcccaaaaatatcacatcaaatctttagatatatgcatgaagtattaaatatagataaaaagaaaaactaattgcacagttatgggggaaatcgcgagacgaaccttttaagcctaattagtctatgattagctataagtgtaacccacatgtgctaatgacggcttaattagtatcaaaagattcgtcaaacggtttccaggcgagttctgaaattagttttttcatccgtatccgaaaaccccttccgacatccggtcaaacgttcgatgtgacacccaaaaatttctttttccccaactaaacacacgcacaatggatctcctgagaaattaacacactgacagataacatggcaaaatctgcaagacaatttcccagccatgctcagttgttctaatatttccccatgtatatcaaaagtttggctgtcctgttaaaaaaggacttgttattattcccgagggagatgtaatcatagctcatcatgcattgtgtttcttgactttttattctataaataaattttcatgagtctaatggtgtgtttggttaggtaaatgggactagatgggagatggctatccattttattggggtgtttagttagagggcaggtagtagcggattaggaagatatagcgggagagtctaaacaaactagataaagttatagcctttctttccatctacatatagctaaaaaatttagtgggggttcccatagtattcgagccagtagtgggggctcgagacccgttaaccccatgctagatccaccctaagaacagtgtggatggggcggtctagaaaaggaaatatttactcaacatactggatgaagggatccggttttttgggcggatgaagccatccaccttctttaggatgttgattagtacatgattagtgagttgattagaatatgattaatgatattagcatgttttgctattaattagtaattaaaatggtaagattagttgttgacaagtgctattaattagtaactagaatgctattattatgtttaggtatgtatgttatatggagcatcataattatatgtattttttaactactttaaaagcataaccatactcttccttcttaaaaaaacgctcactctcattttaaatgaaccgcttaaagaaaatctcccaaaatccaacccatggtgcaacgcacgggtaacctccctccaattttttttatgaactaagggtgtccttcatatggtaataggagatattatattttctagtgtaaaatttggtatcttcagttattagttatctcgaagtaccaaaatttttagtctaaaatcttagtacctttagctaatttctcaagaattataaaatttttcatgaactaaatagtgttatatattaaataaacctaatattaaattttacactcattcgtaaatttgtagtactagaatagaatgcggaagtttgtttaactcactcgccggtgcgatgacacacagccacagagatggaaacctgtagcgcataacgagggcctctccaaacatttacatacgcgacgacctgacacgaaccaccgcgcaacggatcggcacccgttccacgcgtctacgcgggcaggaaaactcgccgattcccaactcccaagcgaaccaaaaccctacatatgtgatgcatataaacgagcgcctccgctgccacttcacaagcaacttaactcgacagccaacaatttgaagctttgaacagatagcagatcgtacactccgttggtgtagaagccgggttttacaacttttcattattaaaagaagtagagcagagtagtctccgttcctggccgatccaccatggcctccttcttctggcctgggccgccgggagcgcagccggtgggcgacctgcaggtggcgaagttggcgctgctcgtcgccggcaacgggttcatctcgccgtcgtcctacctccgccgctgctgcgacgacgacggcccgtgcttcgtcgacggcgctggggagaggtgcttgcacctggccaacctcgtcaccgccatgctcgggctggccctcgtgctcggccagatggcattcttctcggcggcggcgttccggccgcaggtggcctcggtcactgttgctgcgcggtggattgtcagcctcgccaagctcgccacggttgggaccctccagctttgggtctatgttttctgcttgtgcctgaaaatgttgtgcatcagatactaattagcttctcgtccttgcaactctcttctgtcgtgctgatatgatgtgattctttcattctttgcgtccaaaaaccaaaaccactatgtatttcagtgactggatcagatggatattaacatgaggtggtgtactgtgtacacctgtacaatgaatattgcatattacagtctctgtacaaacaattatttagttgctggtgggctaatcggctcataatgttaacgaaagcacttgtactgcttgtaacgactacgctatattatggaaacggaggttagagggagcaacttataagccgttggatgaaataacgacgccagtcatagctatgtcttatggtggcggtattct

SEQ ID NO: 43343 - DNA, 18004 bp, Oryza sativa
tagttcatcaatggtcaaagacacgttgatctaatggctgagatgattctgatgacgtggctagctgagagatcttctttatagcaatcattgcacttagtgggttccaattatataggaagaatggatttgtaatcaagttgttgtaatcaagttgtaattttatagttagcagttatttgtcctctaaattttatgataattggtttaatcttatttagagtaaaggtgggaacggattctattattaccttaaaaatattgttacttactataaaaaatgcatgtgcgttagaacggaaaaaaactaatgttatggtaatgatctatctatctattaacctattaacttaataaagtaatagaaaaaattagcctccacgttagctctccaagaactagaaattctcatattaattagagtataataaaaaaataaggagaactcatttaagacaaggactctttttttcctttttttaaaaaaatcatgttatatatgtgtagtgtccgatcgaatacctgcatagaacaaatcttttgcaaggaaaaaattacctgagctggatagactaatctctctatgtaagtaatacaacataatacaaagtattcctattttttattttttttgttgaatacaatttaagaaaagaaattaaattcggaatttaaaaataagaaatattgatagatgagattagagttcatatagaaatacaattaggaataataaaatttcagaattaaaaaaataggaatactggaagaagaatctagagtccatacagaattaaaaaataattaatattattaatttttagtttaaatttaaattatatatcatgacaaataaataattacatttttttactccatttagctataaatagtttaatttggagaagaaaaaactatttcaaattttagcaatttttaatgcagaaacagtttaaatcgattgagaataaataaaacgtaattaggcccatatttagaaggacggctcaaatatctctttttcacatcatggcatgttaagtgaacagggcccaagtggccatggcccaagtcggcgtaggagcgctgagagccaccggattcgatcgaacggttaggatcactcgtgatttagataaagcattgcactgttgaatcctaaaccctaattcattctccttcctctcagtggcacattcctccaccgtgagcggccgtggcggcgcccttccctaccacgtgttgccgcagtgccctcctccctgtgagtagcggcattgccttcccccaccgcgaccgcgtggggcagcgcccttccctaccgcgagcggcggtggtggcggtgccctcccgcggcttcccacgagtggatccggcggcgacggcggcttcccgcgggagaatcaggcgatgacgaagatttaagataaaatttgtgcgtttttttattattcttcatattccttttctcttttgatgaattgtccgattggattttgtatttatttttgaatttgtgctttatccacccttacacgatgtgttactcgcgtgtgtggaacggaggtcatcgttggatcggacttacggaccaaaaaatgagtgatgaacgaaaagttgtgttaacgtcaacttttggtaaaattatttagtggattcggttaaggaaagagcacaatcaactgatggaaagcttatccagaagagtatgagttcaagaaagaatcatgaagactatgccgtggcagtttaattctatctattaattacgtaggatttagtaaatttcctttatctttagaaagttttatctagtatccgattagtacttgtatattttcttttgtatttaggaaacatgcgtcgtgtccaatatggactagtatctacccatgagtataaatatgtatatacagggtcattgtgatctatcctcgatcaatataactactcccggcgtatcgccaccctcttttccaatgtatttatttattatcactgacggaacttagcacctgacgcgggctgcattgacttcgatctccggcgaaggggtaagccctatgttccgttggccctggtgaatatatcggctacattggtgttgttcaaggctacatcgcttcgatctcttagatcgttctagttcggtcgatatatttgcctacctgatgtttcgattctattttaatagcattgtgtttagagacacatcggtttagttgggactgtctcgattaggtctgattttatgtcttagcctatatatctctacaatcacaatgttgttttaaatagatttgttagatccatcatattagacaaatttatcggctcattgagtattagattattatatgcaatctcgtgttgcatcgattaggttctacctactaaattgttgttaataatcaaagtcttgtcaagctgatatgttcatgctaatgtttcattggagggttagccgcttatataatatgttaaatttattgttgatggttttattgtcttagttaaatttaagacatgaccactctgaaaaacaatgaaaggcttggttgtttagatcttatactttcttttatacttagtactgcattagtcgtacttggaattgtaagaactaacttgctctttggttgacgataaaggtagcatcagggttttcagccgatgagttgtctcaatattgcactggcttataaggattatatacaagttgattttagccgattggatcattacttcattatatcatcatcgactcttggattatttgttcaagttctttcattgcttatctaagcatcggaatatacattgaacatatagccgattatttaaagccttatcgacatcggctaagtaccattacatcggcttgtcaaccaatcggttatttgatcataactatatatatattgttgttacataatcaaattgactagcacatctgcatgtaatcaaagtttaggatatgcactagagttaagcatttctttcattcattcgttttttttcacatcaataagttgtaaatttgttaagtagttaagattttcattgctcgagagtgaacggtctttacttgggcctcgccggtgcgatgccacagagacggaaacttagccgcgtcatgacgacccgacacgaaccaccgaatccaacggatcgacacccgttccacgcgtctactcagccaggaaaactccccgatccccatcccaagcggaaccaaaccgttcatggcgatgcttataaatgagcgcctccacagctcctctgccacttcacaaagcaactcatcaacagccaacaattcgagcagagcagatattagggaaggagaagaggtgagacttgaaacccatatcgtctagcccacttcattgtggagctagcccgaaaacctctagttgtttctcccctgtccgccgatccaccatggcgttcatctggccggggccgccgggagcgcagccggtgggcgacctacgggtggcgcagctggcgctgctcgtcgccggcaacgggctgatcgtctcgccgtcctacctcagcagctgcccctgcgacgacggcggccggtgcttcttccaggacggcgtggcggagcagaggtgcttcgacctggccaacctcgtcaccgccgtgctcgggctggccctcctcgtcggagacatggcattctcgacggcagtgcccggccggtcgacgcagtcgcaggccctggccaccgttgctaggtggctcgtcgggctcgccaaggtcgccacggttgggaccttccagcattggatcaatgccttttacctttgcctcaaaacgtggtccatcacgtcttatattatccacccgtctttgcatgataaccctgtcctcgtctttgcataactctttgtcgtgctgttgtgatgtgattaggctcaaattgtttcattttgaacattaatttatgttcaaactatgaggaaattgattatatttgtatacgaatggattaatgttctttacaacgttggtatatttattttaaccatgtttggtatgttcacttcctgggttgttctttacaactgaagcaaatttatgattggagctacatttggagtcacttttttttccttgtttcatagtagtataaaagttactccaatgtagtttattttctttgcaaattgtttgtccgaaacgtcatctaattatacatgtcatgcgaaaactacaagttacttaaataaaatctatttttcaggtttaaataattataactcaattaatcatacgttattttcttattttatctgcacgcagttacatcttcagcagattcaaaagggacatctagtagcataaacactcacatactcagagaaaaccattgacctgagtaatgacccggttagtcactaaccgcgtccccgtaggaccgtaacgaaccaaatggagcagcgtcccacgcggataaaccacgtcgtccccgtcgatctccacgcgcggctgccagagtcgatcgtcacctcggctagctcggtctcgccggtgacctcaccgtagacgacgacttgacctgacgaaactggaaccaacccaacccaaccaacatatacgagctcaccccgcgctgtgtgtgccgccaattcacaaatcacaagcaagaacacaccaagaacccgaactgtcctacctcgatcgatcaccagcagccagccatggcggccgtcatcgacttcctccagttggagccgccgcgcgagccgcggccgcagccggccgtgcaggcggccctccccgtggcgaagtcggcgctgttcgtcgccatcaacggcctcgtcgcgccgtcctacctgtggtggtgcctggcctgcgacgacggcggcggcggcggcggcggcctccgccggcgctgcttccgcggcgaggccggcggcgacgtggagcagatgtggtaccagatggccagcttcgccaccgccgtcctcggcgtggcgctcctggcttttcacgtggcctcctcctcggcgccggcggcgatggcggcgtggctggtctggctcaccaaggtcttcacctgtgggactctccagtttggcctcaatattgtccacttttgtatcaaaataatttacttcaagttgatacgggggttggattctaatctttcgaggggataattataacacattttttttactgcttggatgcaatgccgatagctgtaaatggatttgaatcgatttgagtacataataatgtacgaaggtagattcaattttgtcagagctgcggcgtgctaatgtagactccatcgtggctaattgacggaataaacgaaacggtatatttgcaaacggaaaataatttgtaaataaaacttttatatacgtgttcttagcgattcaaaacaaaggctgtaaaataaactacgatgaaaaaaaatcccaaaatcaactctaaatttaaggttgaaaatttaaattttggtttataagcataagccaaaagatagagccgatggttcttgagatattttgtctgctctttgtgagaatttcttctattagaatcgtgatcagcttctcgatcaatggcgttgaccgatcgacatacaacggctttaggtcatcagaaaaagaaaaagaaaaagaaaaagaagaagaagaagaacacgtcagtagagggtccttgacggaaaatgatcttatcaagtcaaccatcgattctgggccgccgaatagtgatcggacgggtacgaagatgttatccaagactcccaattatgggagggttgaaacgatgaatcatcctcatgaaggggtctctaacgtaaaatcattgcctggctggcataacatacttttcctagtcgatcaggattgcagaagcattatcggacggtgctggagaacccatgttttgatcgaacctgtgagttaggcccattaagaattaggcccatgcaaatcaccctcggttgaagcccaaagcagtggctgtggcggccgcaggtacaaagatctaattaagttaagagattatgctgtccaaggcaaggcacacctttttattcctttttattaccatgccagtaagaccaaacaaggttttcaaggcaaaatagcaggcaaccattggccaattctatcttcgctcttgattaaccacgatgaaaaatccacaatcaggattctcatcacattattggcacattacggccaataacagaacactatcaataaaatgaataaatcccacacaaaaaaccaatgtggtgttgtgtgtcttgtatcacaacacctctaagatctagcttagttatgtacagatccttttgtttcccctaattaatattactcctatatcttcccctcttaggtctgaccatgaaattctaggcacccctctccttgagatagctcggtgtccttctgtgccgcctgagcgaggtggtgtacgatccgatggagccgtcgcgttgcagcacgatgtcagcatggattgcagagtttgggttcttctgccggtatcgatcatggtgactctggtgcttctcttccactgtcgcctcgatcctcatgtcaaccttgttctcaccatctacttgcttggttttggtcacatcgtccttcttgttatcttccacaacgacggtgaacacaaatgtaccaatttggaggtagtcattcatgtccaatatgggctctagggccttgaccacctccctcatgctgggcctggactttggtgatgggctcaagcacttgtaggctaccaaagcagcctcttgggcccctttgtaggagtattggccctccatggctgggtccatgacgacccggtgcaactggtcgggcttcttgaggtactttcttgtccaatccaccagactttgctccctatggcgacgagagcggtccaccgagtgccgacccgataatagctccagtagtaccacaccaaaactatacacatcgctcttgtcggtcaggtgccctgtcatgatgtactcgggcgctgcatacccgtttgtccccatgacacgcgtcgtgacatgggtcgcgtcgccctgcggcccatccttggcaagcccaaagtcggaaagcttggtgttgaagtcctgaaatcaaatgaatcagagatcgggttaggcagggatcacagttgacaattacaatgacatgcaggagacagacgacaatgtttctgtcagtatcatgctagtaatcacgccagtcggccagtgccattaactggcataatgattctgtacggatatgatgctagggatggatttttattaggtgctgtgtagccatctattcctagagaagacagcatgagctgggatctctgaaccctgaaggttgggccatccaagaaccttccaagttgcaatcatgtctaacgaacccacacacccagccaacgattttggaacgtgtggcacgcagactttgacagtcaaatctagacttgataacttgacaagtggtatcccatcaaaattttcagaaataagaagcgaaaaatggtctgaaagttagtaaaatttttcacggcagtttgaattttcgctctcaggacatggtagttttttttttcctttaacgactgaaatttctactgcactcgagtgaaatgactgcgaaaagtacacagtggaatcaagaacgggatggtgctcaccgagtcgaggaggatgttggatgccttgaagtcacggtagatgaccggcgtgtcggcgtcgtggaggaaggcgagccccttcgccgcgccgacggcggtctgcatcctcctcatccatggcatggcgccatcgagacctgcacggacaggaggacggttcagcgtcagctaaagtcttccccggaattttttcagagctgaaacttcagcgatggcgtaagcgcgctctaagcgcaaatgattcggttaaccactcgcgtataaacaccagtaatctcccggattctattgacgattgcgacgggggtaaaaaaaaagaagaaaagattcaacagttggtaattattctcgtgtgcttacttttgaagagatgcttctccaagctcccgttgctcatgtactcgtacaccagcatccggtgttcgtcctcgtagcagtagccgatcagcttgacgagattcttgtgcctcaactgaccaaggaagaacacctcagcctgcaagaaagaaaggttcgtagattaattagcacggtgagctaaagctcgagctagcccaacaatggcggaaggaacgcatgaggtggagagtgacgtaccagccactccctgtggccctgcgtgccgcagtcgaggtcgaggtacttgacggcgacggcctgcgcggcgaggccggggcggaggccgtcgtcggcgcggcccttgtacacggggccgaacccgccggagccgaggtagttggcgcgggagaagccgccggtgacggccctcatctcggcgtaggtgaaggcgtacaggttcgagcccgacagcgtcagcgacaggtcctccggcgtgagggtccccgtcgagctcaggctcgacagcgacaccctcgacgccgacgacgccgacgacgacgacgacagcagccgctggtggtgaccaccccctctgaccctcctcctctccggcggcacgtcgtcctcaacgccggccaccccgccgccgccgacgcagcagagcatcgacttccacgacgtccgcaactcagccatcgaatcgatcaaatccaagatgaacaagaagccaagaaaaaccaatcgcccacgaacacgaagcagcagagagccagagaccgaaatgcagagacggagacagcgagtaccagagcttgtaaagaagaagaagaagagaggacagagttgaggaagcgtctgcaccggcaatggcgagatatgtaggcgctgtggctgtggcttgtgccttgaccgtgtcgcgcggcacgaaaccacgcacggacggcgacgccgagggctgcggaaaactgcgtcaaatccggccacgaaacgactcaaaaaaagcggagtgggtgagtcccccgcagcatcttggtaagttggcagagagtactattactgtttccgctgctgcattgatggttgaatttttttttctttgaactttttaatttttagttttaaaaataaacatttttcaaaacgtattttcaagatattaaccttttgggctacgctagccgaactggtgtaaaaaaacaacattgtcactccgcgttatttggtcacgccgatttgacgggcgtggccacgccatccttgctggcatgacagaataaaactatcatgtccactgcgtgtagcgtgtcagtattgttttgccatatcacgtcgattggttcggattatagaaagaagttttgaaaaggtctatttttaaaattgaaaaaaataaaagttcaaaagattaaaaaaaatcctcgctggttccatgtagaaacgatgaaaaatcattctctcttttttttctttttgaattttgaaaattcattctttcagacctgtagaacggtgaaaaatcattcttttattagaccgatctcgtacagtctcggctgcttttcaccgcatgtactggcactgtgggtttggtcatttcttccttgccacggaaggtagcaatttttctgttctatttttggggttggaatggaattctctgcgtgcgtcactgtttcttactctctgcttaaacgtgacgctgacatacttgtaaaacaagtgagttcttgggagggttgcttatagcggaattaatccagcgtgctccatgctgatactaaactgattataacagattaagcaattccaagtgcttggatcatgtgaaaaatttcgtgcaaagtatttcattctttatatgttgcttctagttgggtgtttctgcttttctttttttccttttaggctaactgggagtggtcagactggggatgctaaaaccagagttgttttgggaggcaaagcagcggatgcaaaggaggtgaagccatgagctgcatctggttgctacctgaagcaggtagatctgcagcaaaaggaatctgattccagccgcagttcctcccacaatgttctggctcaccattctcgttttaatttaatctccatgatccttccacgcacgagtgaaatgcaattatgcaattgcagtcgatcgagatgagatgatactgtgataggcagttctgaactgaaactgaaccgcacgctccgaacaaccgtacaggatgcagacaaaatctctgctggaatttacaggagatgggaaccatcctgtcctgcgctgcagatcaaggcgcataaattatgatagttttgtaatttaaaccctgcttaggaaaatacgcaagctggaaggaagcatcaatctgagctgtttgctaacccggtgttcagcctagctgtcgtgtttaaattcagttgagcttcttttctgtttcctgatcgatttgtttatccgcgacacagcctcgcacgttcgccgataaagaatgttcctctcaggcttggattagattattcccggaccgtgccgtcctgttcttggaccgtaagattagtttactctcctggttcctaaactctgacagaatgagatcagcagctccgataaaaaaggaagcagcagagcatgttgttcttacggggcaagaaagaggattaggagaaaatgagcgaagaaacactccgcgtatatagctaatgctccttttctgtttgtctcgttaggactgcatggaaatttctcagcatttcagctctgttttctttttatcacagttatctctctcgttttcattttttcagaaaagatgataatagtgaatattattccctcatttcttgacggcagcattaacgcattggatgcggtaagcggattgacctgccaccgtcctaatacttttcttctactactactatttctctgcaaaaatggatggattatactgtgactctgtgagccgtagcagctggcacaacgactttgaaccgaccttggatagtggatgcattgtaactgtacaatacaatttgtacaggaggagtgtatgcttgtaactgtacaatttgagctgcatgtctgaaaagatcgccgggcacgagagccatggccgccgcgtcgtcgatgggttcgagagatgggggggaaaagcagagcacgcctacgacgtggggtgcatggctcgatgcgtgggcgtcggcggcagcaaaagggaaaaaaggagagatccgtctctgctttcgcgaagaggaggaggtcacggccgtccgatgaggaacggatggctcagatatcaagcgcaaacggtgacgatgctgacaagaggggagagattccgtgcatctctccatttcgaattcggggcatgggggcggctcgctccatctcctacccacacctgagatctggcgagcgagtgacgacgtgccgaccaccggccaccacaataatattgctctgtttttcttttttttttgttatcttattattagccgcaacaatttgaaatctaatatttgagttgattttgaatttttttatcgaagtttaatttttatattggcttttaatcgttaaaaatataagtacaagagttgtttacacataaattgttttttactttatttgtttatgtggtgtttggattcaggggactaattttagtccctatcacgtcgaaagttggaacactaattataagtattaaacataggctaatgataaaatccattccataaccctatactaatttgcgagacgaatttattgagcctaattaatccatgattaacctatgtgatgctacagtaaatatgtgctacttatggattacttttgctttaaaaaaatcgtctcgcgaattagctctcatttatgcaattagctttattattattaatctatgtttaatattcctaattagcgtccaaatattgtaacgctccgcttttcgtgagtcgttaaaaactaactcggcaaaatcctaattgcgaaaattttcgttctttgtgtgagagtctaagttgtgccaaggatcccaatttaatctcgttgttccctctcatcgaaatcaaaatcctccccctcatccaaattccttttccgattcgagtctctgaaatcaaattctgaaattcaaatccttcctttgaatcctcgccaaatacttctacgaatccagaattattcaaatcctgcctcgaatcctttccttgactccaccctatgttcccgagaacaaatacccaagtattccttttgaatcttttccatgacttctccttgagtttcccttgatacatccctaaaccctcgagttcgaatatcaaatttgaattcgaatccaaaccctaaatcactccaattctatccaaatcagttttctctgtaaaagtctactttacctccctgtatttttggatggaccgattttcctccatcggcccatctcccctcccagcccatcatctttccccctcgcacgtgcgttgcacgcatgcgagccgagagagagccgtcgctcgctctctctgtttctctcgctctctcgtcttcctcctctctctctatgtttctctctctctcgttcgatctccctctcctcggtgccgatttcccgccgtcgccgcccaaaacctccaccgccttcgtccattcccgcgcgcacctcgcgaggtggccgactggccggtcgccgccgacgccatgcgctgccgccttgcccccgctccatgccaaaccgaccgccgccgtcatcgtcgacgtcatccatggcccccgccactccacgccgcacccgtccaagagtgggagaagcagctgctctccctctcctcctcctcctcactctcccgctcctcattatggcaagggaccaagcccctttttcccttctttttccctttcccgaccactgccggcgtcaccacctctgcgccgcttgaccgctcgcgccacccgcctcatctctttgaccgcgccagcccgcgctccagcagttcgatttccgccgctcgatccaccgccttcgccactcaacgcatccacgccgtcgccgctttcgcaccgcccacgaaaccgccgctaccgccagccgagcacttgaccgccaaggtcagttctcccctccccaaaccgacctcgcctccgctataaaaccaagccacccaaaccccttcctctctcgttttcactcgcctcagtcctcacacccaccgcgccattgccgccgaaccaccgtcgccgccttgttgctgctcgtcccgctctcgccgttgccgtccgttgccgagcaccggaggagccggtgcgtgcgtggacgcgtgacgaggagctccgggcaccacctctccctcccttcttccccggccgcgccctctcggtgtcgtgccgcctcggcgtcgcgaccacctcgccgtgacaccgaccgcgccgccaacgctacttcctcttcgttggtgagctccccaccataatcctcctcctgccgcgcgatgcgccgcgcccgccgccgctcgccatagctcgccacgcgctcttgctctgtcccggaggccgcctctcgtcgccagccaatctcggtgccgcttcgtccaatccgacgccggaaacggattccttgaaccccggagatgctcccacccctttgaatcgaaccctcgtcgtctcgtcgtgttttccccttttgctctctggtgattgccgcaccgcaatccaccgtcgtcggctcctctcgcgtcgattcctctcgccgccacgctcccggggatccccttgacctccccctggctgccccaaggccgtcggccttctcctttgtctccgcgccatgtcgccgcttccgccgccgcctaacgccgccgtgcgtgcgccgccggtgaccatcgggtcacgcgtcaccgcgtgcgcgtcgcaacaccataccggttcggctaagcccgagcccgcgcacccttcgctcttctcgcgcgcggccacgtcggcgtgccggcgagattggccgccgccgccggccgtcgtcgcgcgtcctcttcctgatccgagctgtggaatgagttccccttctcctcctcctgccgccagtgctagccgccccttccggctcgccgctgttcgccggatcccgccgcgcgccgcgggccgtccgatgagccgcccggcctcctctcccttccccatccgacgtgacgtccacgtggcagccacctcagccccgggcccgcttgactgggtcaagtcgcgcccagtcagcctcctccatccgtcttccctcccgtgcgcgcagtccacggcaagccgtgcggctgcacatgggcccgccgccatccgtctacccggcgcgccgcgcctgaaccgcgcgcacccgaaaccctagcgcccgcccccgcgtgcgccctccccaccgtgaacccaaccaccgccatgtgggtcccgcgcggtggaccgcgcccaccccgtcgggcctccctctctccccgcgcgccctaatgggccgcctccccgtggccgcgctcggcccaatggccggccaagccttgtgaatccctcgggccgcgcctaagtcgcccgaggaagtctaaatccgatccctccttccttttcttttccaagggaattaataattccttttccttgtccagaaaatccatttagacctccaaaattcatatccctcgatccgtagctccgattgactccgttcagcttccagtaattccgtaaaattgagatctatttaatggcactactaataggtctaaataggatctttcttttggtcttttgtttaggttttcgattatttgcatatagttgcggttatcggattttcgtcgatcgcgggttttctcgaagattcatgaagcttcgtgaagaccttgaacaaggcaagtcaccctttgatcaattgcccctataattaaaaagtcattattattttgtttgcaacttgcattactagaatcacacacttaacttgtttggcctcggtttgcgtgccaaaccgacggacctacccagtagtcgcactaatttccgtaggtcgtactaccctgattccttgtcgctccacccttgtggtacctcggtattcgtgctctctgagcgcgtataccaaatatcccacatacaccgttgcttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcgattcagggaaacctcgcatgccaatagttgggaacgccggggcggggtcggacaaaccgggttcctggtaaggcaaggacgagaagcttgctcacataccgatcaaggtggttggagttgatttgtgaatgcctaaaatggcctatacttacgtgaggatttgatccttctatgtggcatgaggtaaccctgggtcggcttgggaaatgctttgtcgcgaacctctgacaccggccagtgtctggagtaagttcgtgtcttgtgggtaaagtgtacccctctgcagaggttaactaactgttcgaacagccgtgcccacggtcatgggcggatgtgaggtggttcccgttgcgtagagttgtttgcctgtgctttgtgaaaagttgttgtggtgtgggaatcgtaaccagaatcagcctatgtggcagatggatgacctgagtggtcaagaaacgaatctgtgtgattcgggatgtctgcgggcatcatagactaggcttcccgagtggaagcggattgttgtgctgctaggcagctggactctgggagtccgagaaaatgaaaaaggctctgggagccgattaatcaagtggaatggctctgggagccgagaagtaatgatctgacccgggaggtcggtacattactaaatgagctgttgaaaaatatctcttaaagtcgaatcgagacgcaagtctcttttcggcccaaacttagaaagaaataaatcacttagtgatttcaaaatgtcttcaaataaaagatttgcaaaacaaccttgcccctcttcgaatcttgcaataaacacctaaattcccgtgacttgctgagtacgaaagtactcacccttgctctatataaatatatatatatatagttcctccgccctgaagttgaagatgaggtgaagtgaagattagggtttcgtcctggttcccagccgtcgcctgtggtgttgggtattagaccgttggttccgctgctgctgttgttgttggtgttcgcctcgtccgtgtcgtcggttgtattctcgggctgtctgagctgcaacctaagttaaggtaaataagtcctctatttattttaaagattgctacgattcatatttgtcaccgtgggtaccagcactatgtcctgggactggtaccgagatcgcggtttcgtaggaagcggttcgcgccgtttaccctacgacacgctcctgtcaggtgccgttgtacggcggtatcagattggggtgtgacaaatatccaaattgatagggctaaaattattccctcccatctaaacaccaccttatttttcatgtcttatccattgtggagcgcaaacaatacgagtgcatgactacttcgatctggtgtgttcttgtcaaatgttcagatatgctgacttcttgcgttgcttatgcgtcatgaatatacagatttttgcactatctgaagctcccaacatagtagtacatggctacctctgaaggtgtcaaactgtcaaggtgatcgaaaaggaatgctaggctgctaatttagcttcgacgcatgttcagttcgacagacatgctcaacgtgtgtacacatcgaacacactgttgtcaacgtgcatgaatccgaaaatcgcatgaatataatgcatccatcgttaagttggcagggcggcagggccctacgctcgtatgcatggctgcccttcctcagccgagacgaaggtgcatcacacacgcacgagaaccacgcgtctggtctgaccatggccgacctgacgaccatgcatgcgtgtgtacacgtactagcactctctgtattctctactctatctgaatctctgatatcatccaggtgatgggaatggttatatggattggattaacctggacgtcattttaatttggatctgtctgaccttttcccggccgtctcgtaatctcgttacagtgtcaacgtgcagacggctagcggcttgtttttgtccgagccgtttggaccatctgcagagcggcgttatgccttctgagtttgaccagcgtgtgtgtgtgagtgtgtccgtccacaccgattgtttcgagtcaaaattggctacagattcacatgctcttttcaactcctcggtatgtatatgtgtttttttgatacttgaattcgatttggtttttcgtattatcttgttattattactgttgattatgttaccccagttactgtggaggtataattgagtcgattgagaaatcatcaccgtaaagtcgtgaagacaaagttgtggaggcgcaggtaccttaccagctggtttcttcgatatgtatatgtgtttttggatacttgaattcgatttggtttttcgtattatcttgttattactgttggtttctgttactgtggaggtataattgagtcggttgagaaatcatcacgtgaactcgtcaggacaaagtgtggaggcgcaggtaccttacgagctgggttccttcagaaatctggtgttcggcagatgtgtccatatcttatccatcaacggatatggtagtcgtagtatgtgatgcatgcagaatggcaaacgtcaacgcctagttaggaatcccgtacacctaattactagatatcttgatatatgatt

SEQ ID NO: 43344 - DNA, 12393 bp, Oryza sativa
  unsure (1)..(12393): unsure at all n locations
cctccgcgacaccgtcaagtccccgcctactcctcccccaccactgatcttgcttgaaccaccatccgcaatgagcttactcatgtcgcgtaggataaggagagagaagttttggaaaagataatttttaggtggattttagttcaaactataatctaaacataattatagggcgttagcgtagatgttatctttcttaaaaatattgtgttctaaatgtctaaatattaatcttgccttcgcttttcaattctttgttttaacttacatttatgtgtgtttattttcatatgttttattgatgtgtgttatttcctctattcaaaacatgcccttaagtgattttgggaggaatcctaattggcgcgtacgcgccggcccacacgatccaataggcagattttttccatatatgtgtaaactttcaacctatatttgaaaactttcaactccgacttgaaaactttcaaattcgaatgaaaaatttcaactcatatttgaaaactttcaacttagatttaaaaattttcaactcgagattcaaaaactttcaactcgagatttgaaaactttcaagtacaaatttgaaaatttttaagttaagatttgaaaaaaatatgaaaacttttgactcagatttaaaaactttcgacttcgattcgaaaactttcgactcgagatttgaaaactttcaactcaaattcgaaaactttcaactcaagatttaaatactttcaaatcagatttaaaaatttttaagttaagatttaaaaactttcaactcaaaacattttttaaaaaataagtgtgctaaagattaaggaaatactgagaaaaaaggaaaaaaatgctaaaaaacaaaagaaaaaatcgtgaataaaagagaaaaaaaaggccgataggctttgtgagccgggggacagctggcgcgcgcacgccagttagtaacaccctgattttggttatgtgcttagagaagtagccaaaatccattatatttttggagggagagtaacttgctatgatcaattattttgaataggctctatatattataatgtgcaccatatccattacttaaaaaacacaaacacgaatgtggaattaaaggtcactagtgtctagtagagcaatatgagtcatcacacagggcttcgtacagcccgtacttgctcccatgaagaagatattgcaatctttgcatgtggtgtttatcaagtgggttcagcacaaaaacttcatcagaggaaagagctagcagaagtagagcactagagcgcatctcctatgtgacgcttgtcagctgacgattaccagaggcggagctgtgcacaaacacgggcatcattgggagcaccactggtagtagttgctgcttgtaccgctccaattctccatgttggataaatcggattataatgtcattttctgctgaaaagggtgagataaaataaaaacagcacgcgccattgacattgaggcatgctagaaactgtggcgtgttaggttttcaatgcagattctactggccagcccgcataacgcagggtggaaatgggtttccttttctcggtcgcgcaggtcgcaccttcagaaaacgaaagctcggaggctttcccggattcaggttgatacaccaccttatcaggccctgctggaaactccttgtgagtgagtgttactggttcttatccgtcttaatctcactgtcatgattctggccaaactgtttgaactttaaacgctaaaggaagctaattctgctattgctgaacattgctctttccaaattagttatggtttttatgagctattttagaaaagagcccaggttttgcaccactgaatactgatagaaagctcttgtgattagcatttaagaacacaaagagaatatatgagttccgagtatatattgtgtgataaagtttggcactaaattgagtgtataatttgtgggactgagtagtaataagtgtgacatgtcatagttaataatgaatcaagcactagataataaaatatgatgtgcataaggtttggcaaggctgactctagctatcaaaccaacataccctatctttctcagacaagcaatattaattaatattggtcatgtttagaaagtttctggtagctatagtttcttttaaaatatccagctcctaaaaattgttcagatctcattcaatttctagtttcttactagaatttgaagcttcccaagcaggagcaaaagcagaggagctactgccgcgacgctttttcccttggatgatttccaaccgtcgtatcaagaaagaacagctgcccatattatgtcacaacagataccgcaagtagggattatccgtttctctgacgatatcatctgccagtgcgcgctccttgatacggttcctggacaagaaggattcccaatgtggtcagtgctgctagctgcctagctgcttggtggagtgtcgagtgacaagtgtgcgcgcgtggagtcgtgtcgcgtccacccggccatccccatgcatgcacacatggctctgccccccaacccagtggtgccgcaacctcgtcgcgcccgctggattatcagctccgccgccgctcgaatccacacatttccacccggcgtctgtggacgggccgcgacactccatcattccgccgtggaaaagggcacgccggcggctaaataaaagatccctccttctcccttcgcccggtgtggccgctggggtcaaccgaacaacggagtgcgtgcgtgtcgtcgtgcctgcgtccgtgcgttcctgtcactcgacccgtcgatttgcctgcgccgttcggcacgacgacgggcgatgcattcgcgggggggccatctgcccatctcggcgatctcgcgaatccggctcgcgagcgtgacaggcggacagcatctgtgccgcgcactgctgcacgatggctaattttaggagacggcataaaggcagcagcagcgtatctctggtgtttcgttttcccggcggagcaaatcgggtgctgtgtactagcggtagaggaggggccagggggaccccgggaatttcttccctcatcagcagcacatctctcttttttaaggttcagtcggtcagacttcggagcggcagcctttgtgatgagagcatctgcagacgaatcgaaactttccgagatttcggttgttgttggctcacatcgcccacgctaaaagtcatcacaccactgtttttgaacacaagacatggctgtttaattatagtgatttaaatcggtccatcaaatgtacagcgtgtgtagtgtatagttgtctacactacacggtatccacaccaagaaaaatgggaaaaaaagacttactagttactaacagatacagatgcaattatgcacgtatccgtgatccaggccaagtccactgtccaccggctcgcgcacacgtacaccacacagactgtatgggttctcgtggatagataggggcgcacacatgctttttgccgcagttcgtggaaaaagaaaatccgagtgccaccgtgattgatccagccaccgtcttggcgtctttatcgacggcgagaaagaccacagctgcatgcaacgtacaacacagctagtgccgttgggcagtgattctgcctgtctgtgcatgcaccgcatccgccgctcgatcgaggaggctctggccgcgggtatagatggccataaggcccgcccggcacggcccggcccaggcacggataggcacggcccgagagcgatcgggccggcacggcccgattggaatttcgtgccgtgccgtgtctgcccatgggccgcacgtcaggcccaggcacggcccagtagcaatcgggtcgtgccgggccgacacgaaggcacgatcagcccattgggcctgggctagcccaggcacggcttaggaccagtggatcagtggaccagtaattcagtggattgacaaattcaatggatcaatggattgaacatgcaaaatttaaatttaaacatgccttagttaacaaattcaaatttcacaacttacttgacaaattcaaatttgaacatgccttagttaacaaatttaaattacacaacttagttgacaaatataaatttgaacatgccttggttaacaaattcaaataacacaacttacacaacttagttgacaaattcaaatttgaacatgccttagttgaattcacagttctagattcacatatcacctttacaaaaattcacagatcacagatcaaagattcacagatcacattgacaaaaattcatagatcacttgactaagatcacatatcacatggacaattcacagaagagtttcaaaaatcacagactcacagttgtagattcaaaaatttcaccaagtcaaattacccaaaatcacaaattttcacccaaactttcacccaaaaaacttgacttagatcacagatgacatggacaattcacagaaatcacagttctaagattcaaaagtttcactaagtcaaaaattacccaaaatcataaactttcacccaaaaacttgacacgagtatttcaatgaataaagtagctgtgtagtgcaatggctgcctcgttaaaaacctttctaggtaaaaactcacacctcgtgagaaaaccctagaaaggaaaaaagagtgcagcccacagcattaatcaaatattcataataaagtccaagtccaatacaatcatccagtcccaatggcagtggttacttcatcaagaaacaaattgtcaaaagagtttataagctctaaattctccatggtatgttgcatctttgcatctgcttgctcccaatctttgattagtgccaaagcttgcaccatgtcaggagctagacgccgtcgtcgctcctcgatgatcctgccagttaagctaaaagcagattccgatgatatagtagaaacaggaacagtcaaaacatccctagctaatatggaaagaataggataggtgtggttgtgctcatgccaccagttaaggatattgaagtcatcatcgtattggttgacagtgtcactgtcaagataggcaaacaactcagatgcactcagagtagttacggatctgatcgaatagagaaaataaactaaaaaaaaagcttgtacctgcgcatccggagcaccggagttgccgttgatgatagagatccacagatctacgagaagacaagaggagagactagatttggggggtggatgagtggatctgagtatctgacgaagagaaacgatgagggttgcaaaaaaaagtacagaatggagaggaaatcgacaatgcgaccgtcgatccggtgaccggagaggcggagacgaagagctcacggtcacagatcagccaaagagatgaaagaaaaggatagagaagagacgaccctcaagcccccagcgggagcccgctgaccctcggtgctagatccggcgaggcatccatcggagacgccgacgaagagggatggaggcgtggagggctgaggggtcggagcctggaggtggaggcggagcgggcgagcggcggatcggtcgagactccagactgatgtggctagggttagggtttgtcggtttgatgcggtttggggtatttatacccacccggcataacaggcctcggtcgggccgtgcctgccgttggaccgtgccgggccgtgccggcccaccgtgccgacctctttcgtgccgggccgtgccggcccaccgtgccgagggagcggcccaagcacggcccggttgttgggccgggccggcacgggcacgaccccagtcgggccgtgccgtgcctgggccgggccaatttgtcgtgccttgggccgggccgtcgggccccgggccttatggccatctatagccgcgggtcgatcgggggccgacgatggcgacgggccgcacgcgcgcgacggccgatgatgcggacgaggcgtgcgtgtcacgaccagatccagacggcgtagtaggcgagcgccgcgtgcttgagctggcgcagcatcagcaggaagcagtgcgtctgcgcgaatcccagcgcgaacccgagcgccgcgcccaccgcgtcccccgccgaccggacaccctcccccggcacggcccagaacagcgccccccacgaccacccgcacccgcccgacgccgcgcacgccacgaagaacgtcgccgccgccgcngngtacgcgccgcctcccccgtgcatctccatggccaccgggatcaccacctggtggcggtacagcaacgtgcatataacgccttagtcgaacacgtcgtaatataaggacacgtacacagatactccagtagctagttcacctggcagaacacgatgagcacgccgccgatgacgcacatgacctcgcggccgtacgtcctcgcggcgagcgccgacccgaggacgccgccggcgttcgccagcaccagcacggcgtgtccggccagcgccgccttgccgcagcctgtcgcctgggacagcatgggcaggaaaagcgtggtgacgttggccccggtcaggcgcaggaacagctgcagcgtcgccaccaccacggcgtacgttacgcaccactcgtacttcctcgccaccatgatccaccagaacgagcggccgaggccgtcccgccgactcggccgcttttccccggagacgtcatgcccctgcttcgcatgggcctccccacgtccacaaccgccgctgctgcaaacgcaccccagcaccaggacggcgtaaatccggtcgctgtcgaggaaatccggcgtcggagaatgctgccagtagtcgccgaggtcgcagttcgtgccgttgacgacgagctgttcaccgcaactagccctgtgaatcgcactggagttgtagagatcgtatacggaagagcagacagtatccaagaacggcgacgtgctacgccaggagaagtggagtgccatggcacggcaaatcaatttactctgccaaattgtacacttttttcagtttgtcttcatgaacataaatcaaatcgatacgttcattgatcatttcaacagagaaaaggaaacaggtagatatgatatgcaatcatgcatgcagtaatccaaaattcgactccaaagtcttccattaacaccgagagattcgcgttcattcataatgtgtgagagcaacaaacctggacaacatcaaacatgtgcagcatccagcacgcgacgagaattccatagttgatggcaataattgggatcgccccaccaataatgggaacggcgcggccaatcagcacgagaggcgcacgccccatcgcgtgggtgacgtggcagctcgtgcgcgcgatgcccgctgacctggacgccacgtgtgcgagcaccctgtacaagcgatgcatctctctcaccatgttggccttccaacgtttgagtatgttgttgcagactcctttgcagaagaaatcacgaacgcatcttttttttttttaacggaaaacagcactagattgccttttcattgaatagagcaggagaaaatacaaatccttaggggtaagaggaaaacggagaaccactatagctgtacactatacagagtgcgggattaactcacgcaaccgcttagctcctgctaaagcccaaaggctcgcctcctctttgattttcattagtaggaagttcgttgccacctctttgtgatcaaaaatccgccgattcctctctttccaaatttcctagacgactaacaacatgagcgatcgaagtccttttttcaggacactaggcgtgtttacaatgttctcccgccactgtttgactgactaggcttcctcccattccgttgggtccatctgctgatagcccacccatgcagagatgaggtgccagatcctcttggtgtatctacaagtggcaacgaggtgcaatgccgtctcagtctcgcggcggcaaagagggcaacaaccattgttctgccatcccctggtcgcaagccggtctgaagtccagactctattctgaatgatgagccaagcatgaaatttgcatttccccggcgcccaggctttccaaatcaaggaattgaagtttgtgctcggcaccccgcagcactgtgcatggtaagccgaggaggccgtgtagtgcccgttgtttgtgaacttccaagtaatctgatccggttctccaacgtctaagtgcacatttcggaccgcttcccacagtgcgactagctgttcgacgagatcgactgtgatagatgattgtgaatcaagcttcaaatcttgcacccaggcgtcgtcctcctttccttgccgaagggattttcctctgttttttgagatcgtatagacaagcggcatgaggtctttgggtcttcgcccaccaatccacgcggactcccaaaatcgcaccgtgtttccgtcccctattgttatgtttgttgaggcggcgaagaggttcctatctatttcatcacatggcgtctccagccccacccaaggtttggtctggtccttccattcatgccacagccatctcaacctcaaggccctcgtgaatttgtccagatttaggacccccaatcctccttggctggtcggcatgcacgtctttgtcaaattgaccttgcatttccctccggtaatatcacccgtgcctgcccagaggaagcggcgccgctgcttgtctagctgctcgagggattcctatgtgattttcagagcggtcagaaggtagattagttgcgccgttagcacagattttacgagcatagttcttccagccgctgccatgttttttactctccagcttgctacccttccgaaaattttgtcaaagacaggttgcaagtccaccttccgcagtcttcccagagctagggggaggcccaagtacttgatggggaaatttaccctcaccacagggacgccctcaagaacctcattcaactcgatgccgccgcatctgatggccgccatttgggatttctgaaaattggtgacgagcccagttgcagcgccgaagcgctacaggatgtccgtgaaggccgagaaggcaatttgcaaggtatcacaagtcatttgtgcaatggatatagtttgtgccgacgaatatatccaaaacgcaagtgctaaaatgaatccactgcttttttatccaaaaagatagcctacttttaacaagttatcgtttccaatagattcagtgttaagatactggtgattggacagtgataaggtgcttgtgtggttggttggctcaatttgctctggtgagatctgtatcaaatgcccctacctaatcaaacaagatgtacttggtagcattaagaaaaggatgaccacatctatctcagtagtatgtggcatctagcaagaaagttcacttgtctcattcgttaaagaaagttcactaatctcgccatgacaccataccttacctgacatgatctgagctgaagtgctgtggccatcaataatggcccaggaaaacagttactattaaactcagaattcacttaacaccagatctcttctatctaaattcttaatcctgacaattcgatcgtttactgagtattcctctgttttcatttcctgacaagatattgttcagtcttcagtgaaaaaaagcacacaagatagagctatatttgcggggaagctctgagaaactctgaaccgagtactaggccccgcttccatcaccaaactccacaatctagcctactcagaaaaattcaggcgcacgaattctatcgattcagaaaatacatactctgcttctgtatctacctactccaacaacgtttgcggagtaacttcggccaacaccaccaccagggggcatcaagcacatccagttcgctcacttaattgcagacagaaacacatgaacaacagaacaagtaactgtcactcaccgtagcggctcactccgtcggttcggccctgctccacgaacacgccggcgagacgtcggcggcggcgagcttgctcttctctaactgcagctcgcctgctgatcactcgagcagtccatcgctgtggtttgctgcatataaaaactgtacgaaacaccatcgccgtcaggacgtagactggattttctaatccacagtgcacatttcacgtgccaaattgatcacatggaggaggttgctcgatgaagccacctgctactcctacgtcccaaaatatatagacattttcaatattgacacggatattaaaaattagatgagaataattgaaaaatggttgtgattggttgggataaggtaggtggagaaatagtttcattttgagataatgtactgtgctagaaatagttagctactccatccgtctcaaaatataacaatttcagcccttatgatttgttccaaaatataacaatttctccaccaaatttctcttaccaaccaatgacaactctccaccattcatttttcctacataacttcactactcattcaatcacaatcctacactactcacttttacctattttcttaataaccgtatccaaactctaaaacttgttatattctggatggatggagtatattttgaagcggatgtagtacggactgttcaatcgacagatactccaaatttcgttgtggcccagtgctcgcaagatacaaaactgcgaaaagccccggtgatgcgacgcgatgtactccttcatgtacatgacgcgatcgaccgatcggcatgtgtgaggttgggtagcccatgcctccatttgataacgatcgaggccccgcaagcgttgaatgttcttccagctgctgtagaacacacgtgtccgtcagacagtggtgaacgcatccatcatacagtatcatacacactgcatttgagcagtttttgttatcagagtaggggagttccttttcttccccatatttaacttcgagagattttttcctgtctctctcgatcaatataagttcagtgcagaatattagttggacaggctagtgaccttgtaacaagtcaaacaggtgtagcacatgacatcatcttcatagtacattcatactctacatgactgaagttgtgtgtcactacggtaggtatcagaaactcaggatgaataacgtggcaagacttacaaattactagcaaaataattttgagcatgaagaaaatgaactatgtatcgatcggtggctaggtgatgcgctgtgcacccacttcggtggggttaaagttaaaatccttaaccatcgcactcatgttcatgtccaccaattttagcaaagatgcatgccaaatattcaatttttgtcttaaggtccaactgtcaaactcaatatctttgaacttgacgtttctcttacttagattttaaactacgaatcgtttattttaattttgattcatatttcaggtgtgcatttttacttccttttgcttgtctttgaactcagaaaattttggacatcccttcttttgtgatttgttatttcacttgcgacggatttttgagcttatatctttcacttttttatccatagaatcttccatcatgatttgtgttcttgtatatatccattacactcagttacataacacttatacttagttatagtgcatttcactacaattagaatttttttaacaattttttctctagttttacgtatttgacatgcttattttttttatttaatttaaaacaggctatatctattggttaaaaattatgtaagattcaaaactttaataggtagtctttttttttctagttttgttttctgaaagctctggtgggctgaggcctccactctggagccttgcccagtacagatagtacatgttaaaggaaaaagtccactttgactcccttaaaaatataccgaatctaatttgtacccttcaaccagaaaaccggatagaacgactctctgaactatagaaaccagtgcaatttgactccccaacggttttagaggacggttttgctaacgtggcggtgttgacctggtcttagtcccatgtggtgcttatgttgtattagaattaaaaaatatttgtgagacccgtctctcattcacacacacataattcatggggcccacatgacatcctctctctccaacttttctttatgtcgacggtccagtggcagcccgagccctgcgccgacgccggcgccggcgatggaggatgcgagcaaacactgggcgccgcgcggcgcggtgctgacggcgttcgtcgtcgggatcaacttgctcatggtcctcctcgtgttcttctacttctggcggttcttctccggtaagcgtgggccaccgtcgtcgtcgtccatggccggcggccccgatgacgaggaggcgtcgtcgtcggacatgtcgccagcggcctctccgagggcgtcgtggcggcggctgcggaagtggccggcggggctgcaggaa

SEQ ID NO: 43345 - DNA, 5001 bp, Oryza sativa
gttggggcccgcgtccgcaggtggtacgcgcactgggaggtgcacgcgccacgctggagctcgcgcagcgtcaggccttcgtggagcgcgtgttccacgtcgccgaggaggacaacgagcgcttgtcaagaagctccgcgcccccattgaccggtaaaaaaaaaaaaaaaccgaaccaacaaccacccgatcgagtgaaaatggccatggatggcacggctcgagtccggccagtgattgactagatgcgacgtgtccgacgacgacgcctcctcgtcatcggcgccgccggccatggacgacgacgacggtggcccacgcttaccggagaagaaccgccagaagtagaagaacacgaggaggaccatgagcaagttgatcccgacgacgaacgccgtcagcaccgcgccgtgcggcgcccagtgtttgttcgcatcctccaccgcggcgccggcgttggcgcagggctcgggctgccgctctggaccgtcgacataaagaagacttggagagagagagaggggatgacatgtaggccccacatgttagtgggtcctacactatatttttgtgtgtgtgaatgacagatggatcccacaaatattttcttaattctaatgccacataagcgccacatgggagtaagactaggtcaacacagccacatcagtgccacgtcagcaaaaccgtcctccaaaaccactggggagttaaattgtactggtttcaatagttcggagagtcgttctatccggtttcctggttgaggggtacatattagattcggtctactttaaggaagtcaaagtggagttttttcaacaaaaaaaagaaacctccatgacatagatgcacaagcccaataaatactttggtggtggctacaaaggaataagttcacttcacatcccttaatttgtcgacgaatctaaaattcgtccctaaaccgtaatgcatccctcagtttttaaaactagcgcaagtaaagtcccaatgttagagataatataatcacgtataaacaggataagagaaaaaccgaactagatagagataaggttgttgttgttacatgtaaatagggattcggttttcctctacctgtgcacacagctatatgtattactcccgcacgtttgagtgcgctaattaacacggatcgtcgtatcaacgacgttaacctagattagtttcttttcatggtatcagagccttcctagcatggctagctcatcttcttccacctcctccaatccagtctgcggcttcaccatcatggagaagctgaccaaactaaaccatgcagtctgggcggcacagatgctcgcggccatccgcggcgcacgccttgtggggcacatcgacggcaagaccgcggccccaagcaccaaagtcaatcaagagcaggcggacaagacggtgaagaaggtcccaaatccggtgtatgaagaatggtatgctgcagatcaacagctcctcggctacatcttctcctctctatcacgagagatcctcaaccaagtcgctgattcaaggacggcggcacaggcatggcgtgcgattgggaagctgttctgctcccagacgcgcacgcgctccctcaacaaccgcctcgctctccagacaaccctaaaaggtgccatgtccattactgaatattttgggaagatgaaggtgctctctgatgacatagctgcaacgggaaagcctctagatgaggaagatttgattgcttatattctgaacggcctagatggtgattatgattctgttgtttctgcaatcggcatgaaatctgaaccaatctctgttatggaagtatactctcagctgttaaattttgagaacagacttcagctcaaacaggaagggatcgctgctgcccatgcagcgagtcgcggccgcggtgggtttatcccacgcagcggcggcaatggtggtggcagcggcggctctgggcgtggtcgtagtgcaccgccagccaacaatggtggccgtggccgtggcaatatgccgcgcggccgcggacagcagcagcaacgcacagaccctcggccgatatgccaagtctgctataagcgggggcatgtcgcggctgagtgttggcaccgttttgatgaaaactatgtgccggatgacagacatgtagctgctgctgcccaagcttcctcctacgccattgacacaaattggtacattgactccggagcaaccaatcacatcacgagtgaacttgacaagcttgcagtccgggagaaatacaaggggcctgaatagatccacaccgcaaatggtgcaggtatgcgaattaaacatattggtcatgctttagttcatacccctcgtacattgcatcttaaaaatgtccttcatgttccacaagccaccaaaaacttagtttcagcatctcgtcttgccgaagataattatgcttttcttgagatttactctaagtattttttggttaaggatcttgcaacgaaggacataattcttaaagggcgatgccgcaaggggctctatcctctctctcctggaacctccaagcatgtctacagtgttgcgccgtcttttgcaagatggcacagtcgtctcggtcatccatctactcctattgtgtcaagggtagttagcaagaataaattgccatgtcaatcaaagtctcctagtgagtcgatttgtgatgcttgtcaaaaggctaaaagccatcaattaccatattctaagtctgttagtgtgtcctctcatcctttgaaacttattttttcagatgtttgggctccacctcctagttctgttggaggaaataaattctatgttagttttattgatgatttcagcaaatttacttggatatattcccttaaacacaaatatgatgtttttcaaaagttccatgagtttcaagctcttgttgagaggctccttggttataaaataattgctatgcaaactgactggggtggagaatatcagaaactccattcttttttttttactaaaataggcatctcgcactatgtttcttgtcctcatgcacatcaacagaacggctctgctgaacaaaaacatcgccatattgttgaggtcggccttgctcttttagctcatgcatctatgcccttaaaattttgggatgaagctttttatacagcatcctacctcattaatcgcactcctagcaaagtaatcaactttgaaacccccttggaacgattgtttcatcagccgcctaattactcctttcttcgggtgttcggatgtgcatgttggcctaatcttcgcccctataataaacataagatgcaattccggtccacacaatgtgtgttccttggctatagccaccttcactaaggcttcaagtgccttgatgtgcctactggccgtgtttacatctctcgagatgtcacatttgatgaaaatgtgtttccctttgctcaactacactgcaatgctgaagcacacctccgcaatgagatatccctcttaccctcctctctactgccaatcacttattcagggggagaacaaagtattacctctatgtttaattctgtaccaaatgctactaatttatcttgacggagcgtggggctcctcaccgggagaccgcgtaggcccccctttgccggttcggccgggggcgctgagtgagtttcttcaccctcgatctgtggaacgttcgcgagagagcaaatgcacaagacacgggcaatgtatacaggttcgggctgctgagaagcgtaataccctactcctgtgttctggtggatttgtgtgtgaaggaattacagagagccggagagcaagagagaagctggagaggaagagagttcaggctctagaaccctccttcctctttttcctcctctcctagttctcgttctggattttgatcttcttcccccccactctctttggtgggcaaggtcctccttttatatctcaaggggataccacatgcaccacttctacctactcttcttttaagtggggaccctccctattttgacccaaacttggcttgcttcttcacctggaaactaaatcacagcttgttcttgagtgaggcccagcgccatcactcgactgacacaggggatcaccctgtcattccttcattaatgggtggagatttgcaatggccgccgtccgaatgaccctccgatgggatgggtcatatctacctccactttgccggaagcagatgcaacgtgggggcacgttttgtctgccgatgacgtgaccggcgtcagaccagtcacagaccggtcattcttgtcctccacgtgtcagattagcatgcctcacgtctgtctttcttcatacaatgacttccttgcaatggttgcgatgaagcctgggatgtatctggccgggattggcgtgtcaactccaggagttaacacgccggctccggctagggacgagtgcctggaggctctcatcattccgatgggacggggcgaggcgcgtgacaggccgcctgttgccacctaacccgcgatctgaccggtctgtgaccggtcacatactgcgaccggtcacggaccggataagtgagcgcgctgcactgcattaaatgcggcgtggcgcgctcgtccaacccgcaataaacgcggttaggtgagccctgctgtgctcacctaactcacacacgtggtgccaacaccacagggggtcggggcgccccaaccctcggggccgaaacgggagtggcccgacccctcggggagacagagggaggggtggccacatcaccctcgggcccgacccccccagggggtcaaggcacgtgggtgagcgcggccgcccaagcctttagtcacgatactcccggtcccttgtcaccgacagtagcccccagcgttatgccagggcgatcgcccccctcgagggaagcgctcgggcgtaacgccactccttaggtctggtgacaggtggggccggtctctacaagcgggcagaaagccagcgatcgcaaatcgtgcacatcgg

SEQ ID NO: 43346 - DNA, 20143 bp, Oryza sativa
cccatctcggctgccacggctgcacatccgcctcgtgcgccgcaaacgggcgagcgggattagtggaggtgtgggcgcgagaaacgagggggcgagatagtgggcgcgggaaacgaggagtcgggcatagcgttggcaagggtataaagacgtcgaggaagagattcacttccttcctctcgccactattccccttgccttcgccacttgcgctctaactcttcgtttcttgtgccctaccctcgccgcacttgctcgctctcaagctcctcctccgccggcgtcatggcacagggctccgcaccgctcgacggtagcgtgctgccgccttcccgcatcgtgagcgagaggcaggccgggctgccgcgccgattcatgccggaatctgccaccggccgggaggtggtcgagctgggcgagggacgcccggcgccacactacccggggcggtccgtcttcttcctctctttcgcaatggcagggctggtcccgccattctcttctttcttcatggatgttctggagttttatgatctccagatggcgcacctcacccccaacgcggtaatgacgttggccatcttcgcgcacctgtgcgagatgtttatcggggtgcgcccatctcttcggctgttccggtggttcttcaccgtacagccggtgatgccgccgtcggtagttggtggctgctactttgtcacgcccggaaattcactaataatttccgaacttatttgtgcataaaatcctcgtccaggaatcagccgaggtacataaactgacaatttaatattcagattcatcaaattaactaaaacgataaatacttacttaagaggcacttagtcctcaccatgaagaaaactgcagcggaaaaataaaatctagcgaagctccggctccactcccacaggcagctcaactggggtataagccaaacgtcttctccttctggatccttttcttcaactgaggttgattgattattgcaagaatgagcatatgacatactcaacaagccacacagcaagtatgcaagtgcacaaggataccaaaggatggcataatataggctcatttgcgaaagcagcatttagcaaagagttaagagtagtaaaacagtagagtaattaatcagaaattttaatcaacactgaacagcacacccatgctgtacaggcccaaccatcctgaacaaccatacccggctgaacagatctaactccaaaccaggagctaagcaaattattaccagttaatcatcaataattattgtgagaggtgtgagactaatcacgaaaaacattgctcaactcgcccataaccgcgggcacggctattcgaatagttttactctggccagaggtgtaccactgtacccacaagacacgattccacacatgttgccatgccccgaaataccaccacggcattgcaaagggggaaatcgtgacaataccctttgcacaacacaactcaaaacagtgcaccgttcccggatcatagtcacccctttataaacaaggcatgaactccccagcgacccccgtggacttctcgccacttctcagtctggcgcactataatgaatcacgctatacaaaggataaagccgttgcccatgctggcttgtggttggcacgataaatgtttcacaaccgtagctcgcgaaccggtccttaattgccatgagcacgaccttcaaaaccatgtgctcacaacccaccattaatcatattttaattaccaattaattatcataacacgattaaccatcgtgagctaccattaaatataaccttaaataataatgtagtatatatgattcatcccattagtgagctaatgtttctaagcattgctaagcaattatatatatacataacatttagctgaaccaaaccaatacataaggttcaagctaatcaattttattaccccaaggtatcaaggaatagggcattcaatgcaaattggccataacaaaggaataggttcacaccacccgatgacattcgaaaataaatgcacagttgaaacaaatagagaatttaaatataggatcaacatgctcaaaggattgtgtttaggatctgtgtgacttgccttgcaataatcggtcttcaattaatcttcttgatcacttccgacgcactcacgaaccttcgcaacgacggaaacgacaagctaacacgcaaaacgaagaaaaagactaataaaaaccaaataaacagtatataaaaaataaacaaacatgtagatcataattttagatgaattatgagacttgaacggcctcattctgacttcaaatgaatttattatgaattttacaagattaaatctaattaaagcccatttaaaaagaattaaataaatttaattcaacttatggataattttaatatgtagatctttattttagaaaaatttagcaacttgaaccacctgaaacggatctacggttatttagttatgattttccgaagatttaatctacgggaaaaagataaaccgatgacgtcatgctgacatcacccatggccgaaccaagatggcgacctcgccggagatagagcggccggctgcggaaaaggagggcatgtacacgtagaggacgacgagacgaacccgatggtactcaccaacgcgacgaacgacgacggatgacggccggcgacgaagaagcgacggcggcggcggcttgcacggtggcgacggctctacgggtcacgggagaggacgggagagggggcaaatgaaagaggaggactagggggtcctatttatagccttggattgaagagatcggactcctcccgcaagaaatcgatccgggaaaatcaaaactcggttttggagataaactcgaaaacgagtttaattcggataaaatacccaacgatttgctccgattcttgggggaaaagatagaggaggatgagaggatcaaaacccctcaaaaatccggaagaaacggggtcggattggagcggatttggaggcggaaaggcgacgcggcgcgcggctcgggctcagctaggcagccggctggaggttagggacgacactgtagcagggaggcaaactagacttttctgtgtggtttcctatgctaggcccgattgaaggagggaccacaaacagactttgacagagagagagaagagggcggctcggctgcagctgggccgattgggccggttcggccgcgcggagagagaaagagttgggccaaaatcggcccaacgacttagggaaggatttaaaaactttttccaattaaaataatcacttaaatgatctttcaattgttaaaaatacttccaatgctcaaataatttcaagaaaaatcctgaaaatacttggacactcaaagtacttaacaaaattataattagaccatttaatgattaatttaatatttaaataattgctgaactgctctttgtaagataaaaattaataattgagctccgaaaaatccgagaaaattccagagagtataattaaccatggagaatttaataaaaattaaatccatccatgctttatatttaagaaattttatttcccacatttaacttcacttgtaaattaatgaacatttaatataaattctattaataatttattaaataatttataaatcctgaaacaaaaatcaggatgtgacatactttcagccgcgggggccggtgctgagccgctacattccctgcgtcctccgcaagaaatgggacgactggaagagcgactggtgctacaccaccctcgctgacgaagcgcgcctccgacttccgagccagcccccggcgcaggcctccaactggcgggcaccggtagatctgggagacggctacgacgccgttcttgaccgcctggcgggtctgcgatcccaggggctcacgggggccatggtgtacggcgactaccttcgtcgccggattgcgccgctccagcggcgcgcccggggcgcctgggagtacactgggtccgaggattacatgaggacccaccaggggggcagatgggactgggcccctgaggacttcaagatggtggtccaacgggtgctgaatctcagctccgtggaggcatccctcatcccccaaggagtcctccccctctgcagcgatccagatcgtgccaacatcctgaccatcatgcaggcggtcggggcatcggaggagcgggctcctcgaggccacgatggcgcgggcgggagccgcaggggaaaacaatctaccccgggagggggtcacgcttctgggccccgcgacgggggcccggggggcagccgccctgccgacgcccgggggaagaggaagcaggagggcacgcctcccccatctcctccccgagggggcggggcagtgcgtgccagcagcaagcgcccggagggtgccgtgccgacgccgcagcccgagggggagcgaaaaaagaagcggctccgcaaaatgggggggaccgagccatgccgggggaacctcatctcgcccccgcggtggtcatttagccgacctccccgcaggttcgtctctgcgcccaccgcggccgtgttcattctcccatctcccaagacgagttttcactcacccgtttctttttgtcctctggtttttcttctgccttagcgagatcccgtcacgcccctcccgccattccaagtccggccggtccgaggccgaggagacggcgaccgcggaggcccggaggcgggaggctgaccggcaagaagccgcagaccgcctccgggaagccgaggaagctgctcaggaggccgtccgggttcgccaggctgaggaagccgctcgggaggaggccagactccgccgggccgaggagtccgtccgggaggcggaggtggcgcgcgcacgctaggcggcctgccaagcccccgacctaactccgcccgaggcgacgacgacttccgaggccacccacgacgaggccgcgggcgcaccgctcgggctcgacccctcgagcgacgtttgggacgagccagcttcgagggacgcccctgggtccggcacgtcgatcagcgggccaagccgcgtggcgcccataccgaggcggttctcccctctgccttccgctgccccactgaacgcggagcccctcctgcaggccttagccgccgcgaacaccacggtgctggacgggctaagtgcccagatggaggtcctgcaggcagagcgggcggagctcgacgcggcgtgggcgcgcgtagaggaggggcggcgctcggtggaggccatggtggaggcgggccgcaaggcacaccaccggcacgcctccgagctcgaggcccatcgtaggaacctggcggagatcgcccgggaggtggaggaggagcgggagactgccctcatcgccaccgccgtgcttgacgaggtgcgggacgacctccacctccaatacgggagccgggcggcggagctagagaagaagctcgacgccgcccggggaatccttgacgccgccgctgcccgggaacggcgggcggctgaaatcgaggcggcgtcccggaaacgcgaagaggcccttgaggctcgcgccacggcgctggaggaacgcgcccgcgcgaaggagagggacctggcggatcgtgaggccgccgtcgctattcgggaggcaacactagcggcgcacgaggccgcctgcgccgaagaggagtccgcactccgcctccgcgaggatgcgctcgccgagcgggagcgagctctcaaggaggccgaggccgcggcgcagcggctggcggacagcctgttcctccgcgagacagcgcaggaggagcaggcgcgccgcaatctggagggcgcccgcgccgagagggccgcgctggatcagcgggccgctgagctcgaggcgcgggcgaaggagctggacgcgagagcgcacagcggcggggcggccgcgggccacggcgacctagtcgcccgcctgcagccgccgaacacaccatcgccgagatgcagggcgcgctggactcgtccgccggggaggtcgaggccctccgcctggcgaacaaggtagggcccggcatgcttcgggacgccgtctcccgtctagaccgtgccgggcggcaggcgggcctctggggcgagcggaccgcgaagtacgccgccaaccggggggcctcgcccagcgcttctcagagatggccgggaccctccagcggctccccgaggagctcgaggagacgatcaagtcatcctcgagggaccttgctcggggggcggtggagcttgtactggcaagctaccaagccagggaccctgacttctccccgtgggcagcgctggacgagttccctcccggagggacgagttccctcccggaaccgaggacggcgcgcgtgggtaggtccgggacgccgccgaccacatcgtccacagcttcgagggtacaacccctcggctcgcgttcgccctcgacgccgacgaggagggcggtgacgacggtgcggacgacaacgacgacgaggctggggacccgggcgcgtcggaatgagcccccaggcccctgccaatcttatatagttttttctttcttcttccgaggccttcgggcccccttcttgtatagactaacttaatctgcaatcaaataaagaggaaatttctgtgtcaattctatttgttgtgtgtatgagacgaggatggtctgtggcgcggtccttctgtgtcttggcttgaacaagggctcgtgcccgggtcccagcctcaaacggcgcgggtcggagctagtgcctggggagatccacatgtcgagactgaccaggccgggagcgtggtgaccgagggttatggatgacccgattgtgggcctttgccgattcccccccggagttcaccacgccccggggcacggctcggttctgggccccttttggcgattttagccggcccgggccaccgaggacaggatcgagcacgagcatgctaattcaagccaagattcttcaaaagaaaacaatggcacaaacacagtccttaggaaatcgaaaatgcttttattgaaatacggaagagaaaaaagacaattatctgtatgtggtatcccctggccaaccctgcacgcccggggggggtgcggggttggcccgagctcgagacctgacacccgacccccactaggggtagaagcgacgaaggtgttcgatgttccacgggttaggcagctctgtgccgtcgcccgtggccagccgaacggagcccggccgggggacgccgatcactcgatatggaccctcccacattggtgagagcttgctcagtccagcacgcgtttggacgcggcgtaggacgaggtcgtcgacgcagagtgatcgggtccggacgtggcgctgatggtagcgccgcaggctctgctggtagcacgcggctcggagggccgcgcgccgccttcgctcttccaagtagtcgaggtcgtctctgcgaagctgattttgatcagcctcgcaatacatggtggcccgaggggacctcagggtgagctcagatgggagaaccgcttccgcgccgtagacgaggaagaaaggcgtttccccagttgctcggcttggcgtggttcggtttgcccagagcaccgctggcagctcctcgatccacgagtcgccgtgcttcttgaggatgttgaaggtcttggttttaaggcccttgaggatttccgcattggcgcgctccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtacttatcgatcttgacgaccggataagcctcgggccacttagtgaacttgtcgatagcgacatatagatactcgaacccgcccggggcccgcctgaacggacccaggatatcgagcccccagacagcaaacggccacgaaagaggtatgatctgcagggcctgggccagctggtgggtttgcctggcgtggaactggcacgccctgcaccgccggaccaagtcgaccgcatcgttgagagccgtcggccaatagaaaccctggcgaaaggccttgccaaccaaggtgcgtgaggcggagtgggctccgtactcaccttcatggatatcggcgagaagcttgacgccttgttcccaagaaatgcacttcaggaggactccgttagccgcgcgccgatagagggtcccttccaccagcacgtagcgcttggagatgcgctggacgcgttcactcccttcgcggtcctcgggtagagtcttatctgtgaggtacgcctggatctcagcgatccaagcgatcaatctaagggagctgggagcgctcccctcgggtcccgaggcctggactccgacgggcctcgggggccgttcaggcgcgtccgtctcccctagggggtcgggtcgtgccgacggctgggcaagcctttcttcaaaggcgcccgggggggtctgggctcgcgaggaagcgagccttgagagctcgtcggcgaccgcgttatcccgtctgggcacgtgccgaagctctatcccgtcgaaatggcgctccatacgccgcacctggcgcacgtaagcgtccatctgcgggtcagagcaccggtactccttacagacctggttaacgaccagttgggagtcgcctaacaccaggaggcggaggatccccagtccagctgccaccctgagtcccgcaaggagtccctcgtactctgccatattgttggtcgcccgaaagtcgaggcggactaggtatctgaggacgtctccgctcggcgaggtcaatgtgacccccgcaccggccccctgaagagacagggacccgtcgaactgcatcacccagtaggcggtgtgaggcagatgcgaggggcccgagctggcctcggggacggagatgggctcgggagctggggtccactctgccacaaagtcggcgagggcctggctcttgatcgcgtggcgtggttcaaagtgcaaatcgaactcagagagttcgattgcccatttcaccacccgtccagtaccctctcggttatgcaagatttggccgagggggtaagacgtaaccactgtgacccgatgcgcctggaaataatggcgcaacttccttgaagccatcagaatagcgtaaagcatcttctgggcctgagggtatcgggtcttggcgtcccggagggcctcactaacgaagtagacgggccgctgcacctttcggcggggccgatcctcttcgccagccgcatctccagggcgcttttcgtccgagaggccgcgcggggcgcactcggcttctgtgtcgacgacctcggggtcggagggcgacaggcgtggccttcccgcagtgaccctggggccatcctgggggtcggggacgcctggcaccttcggactagcgggcagagggccagctccggtcgtcgggggcctcgggccgccgttcggctcgggggcctctcctccctgctctctcccgggtcgagtcgacacagggtgctcttcgtccgagaggccgcgcggggcgcactcggcttctgtgccgacgacatcggggtcagagggcgacaagcgcgaccttcccgtagtggccccggggccatcctgggggtcgggggcgcctggcaccgtcggacaagcgggcagagggccagctccggccgtcgggggcctcgggccgccgttcggctcgggggcctctcctccctgctctctcccgggtcgagtcgacacagagtgggggtgcgcggagcgagggttgtcctcgtcgcgctccacgaccaacgccgcgctgaccacctgcggggttgccgccaggtaaagtagcaacggttcatctggtttcggggcgaccaggaccgggggagaactgaggtacgccttcaactgagtgagggcccgttcagcctcctccgtccaggtaaacggcccggaacgtttgaggagcttaaataggggtagcgccttctctcccagcctcgatatgaaccgacttagggcggccatgcagccggtgacgcattgcacatccctaagtttgctgggggggcgcatccgctctatagctcgtatcttctcggggttggcctcgatgcctcgggcagtgaccaagaacccgagaagcttgcccgcaggcacgccgaatgtcacgcccggaatttctatccaaaattccaaacgcttacatgtgtgttaaaccctcgtccaggaatcaaccgaggcacacaataacaaattgataatagagtacaaataaataactatttaatgttcgcaaataataaattactacagaggtagatagttcctctcaaagaataaccttctacgcagcggaaatataaaactataacaaactacggaacagctatggcgactccactccataggcatcttaaccagaacaagctcaatccttcagatcatcaccttcgctgaaatactcctcttctgatgattaaatattgcaagaatgagcatatgacatactcaacaagccacacagcaaatatgcaagtgcacaggataacaaaggatggcataatatagctcatttgcataacagcatttaacaaatatttaagagaatagtaaaacagttgtataattaatcaatattaaataaacaccatacaacacacccatgttgcataggcccaaccatcctgaacaaccatacccggctgtacagatttaactccaaaccaggaactaagcaaattattaccaggtataacatctataattattgtgagaggtgtgagactaatcacgaaaaacattgctcaactcacccataaccgcgggtacggctattcgaatagattaaactctgatcagaggtgtaccactgtacccacaagacacaatcccacaacatgttaccatgcgccttagtaccaccacgatacctcgaaaaggaattgtgacaataccccttgcacaacacaactcaccacagtgcaccgttcctggatcataatctccccctcaaaaccagaggcaatggactccccagcgacccccacggacttctcgccgcttcacagtctggcgcactataatgaatcatgctatacaaaagataaagccgttgcccacgctggcttgtggttggcacgataaatgtttcacaacagtagctcgcgaaccggtccttaattgtcatgagcacaaccatcaaaaccatatgctcacaacccaccttaaccaggttttaattatcaattaattaacatcacacgattaaccatcgtgagctaccatttaatgtaaccataattaaaataataatgtaacatagtttataattaatccctttagttagctaatgtttctaagcatggctaagcaaacttacatatggcatttagctgaaccaatccaacatataaggttcatgctaatcaaattataacccataggaaaataagatcatcttcagccattaatcaattgggaaaggttcaccacccgatgacattcgaaaacaatgcatagttgaaattaaataatagctttaaatgggttcaacatgctcaaagggttgtttgggatctgtgtgacttgccttgggcttccgcaaacgcttcggaaccttcctcaatggaaacgctctcctccggaacgtcggaaactaaagcaattaaacaaaaattaacaaaacagtacaaaaacaagcataaacagtacatgtggatatttttaacatgtagatcttgattttagaaaaatttagcaacttgaaccacctgaaacggatctacggttatttagttatgattttctgaagttttaatctattagaaaaacgggaaaaagaaaaaaaccgatgatgtcatgatgacatcatcaatggtggccgaaccacgatggcgacctcgccggagatagagcggccggctgcggattaggaggacaagaacacgtggaggacgacgagacgaacccaacggtactcaccctcgagccaaacgacgaacgacgacggccggtgacgaggggatggcggcggcggctcggcttgcgcggtggtggcgggctacggcggccagcggcggaaaggagagggtggccgagcttccctacggcgtggtgaagcccacgacggtggcgacgaccgacggcgacggcggaggaggcgcggcggcgcggctggagatcgccggcggcgacggcgaggctaggcggcgtcggcgacgagctacggggcacgggaggtgtcacgcccagaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagatctaagcagcggaaaataaaataaacggcgcagacggctccactccacaggcaacttgaccaaggctacacctactcctccacaccatcagcttcactgaagaactcttcctctgatgaatgattgcaaggtgagtatatgacatactcagcaagtcacgcagcaattatgcaagtgcacaggataacaaaggatggcataatagggttccatttgcaaaagcagcatttagcaatcatttgagaatttaataaaacagttaagtattaattaaacaatattaatccaacactatacaacgtaccctgttgtataggcccaaccattctgaacaaccaccccggttgcacagttctatctccaaacaaggaatataccattccaaaccaggagctaatcaaattattaccaattaaagcatcttttactatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacatcggaaaagagttgtgacaatacccctcatacaacacaatccactgcagtgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcattaagccatcattaaataatagtgagtcataagttatcccaatagtgagctaatgtttctaagcagggctaagcaattatatctaatttctagttgaaccaatataaataaagctcaactagtcaaattataataacccaaggtatcaaggaataaggtaatcaagaacaaaagggctataacaaacaataggttaattccacccaatgacattcgaaaataaatgcaatagttgaaaagaaacaatagctttaaacaggatcaacatgctcaaagggttgtttgggatctgtgtgacttgccttgctggccttggaactcttcaaactcttctccggcgaaaacggactctctggaaacgacggaatctaagcagaaaagagcaaaatcactaaaacagcacataacaagcatgaacagtacatgtggatatttttaacatgtagatctcaattttagaaaaatttagagacttgaaccaactaaatcggagctaagatgaattagttatgaatttttgaagattaaatcggattaaaacacttatattgattttaattgaattatgacgcaataatgaattatttttgaaaaggaaaagaaggtttattgcgtcagcggctagggtttcggtggatcgggcgcacgggcggcggttcacgcgaacggacggccgagatcgacttgatccaaaacggacggccgagatcgaacggtccacgaccggctcacggcggacgaccccgatgacgtcggcaatgacgtcaccgacagcggcggcggctcggcggagcggacggctcgggcggcgcacgctcgccggcgaacggcggcactaggacgcaaacggaggccaccggcacgtagaggacaacgcggcgaacacaccggtgaccaaaacggcggcggaagaacaacggacgacgacggcgacgaggaggaaacggcggaaaccttcgggttgacgacgacgacgaagctccggcgatctccggcgatggcgaaggggcggacgaggacggcgacgcgacggcgaacactacggcggccttcccgagcgacggcgacggctgaaacgacggcggcgcacggctggagcggcggcggcgacggcaaagctagggcacacggcgctagagttcttccggcgacgagaggcgaaggcgagggtggctacgggtagaggagacaccggggaagcttttaaaggggctcggaggcggcggcgaaggcccacggcggcggcaacggcgaaggaaagctcgcggcttgaaggaaagaggccgatccgaatcgaactcgaatccatcgatttccgaaccgatctagccgaagcttccaaagaagaaaaggtagaggagatcccgaggatcatttcccctcttttgattcggccggagaaggaaaggagcggccgaatttggaaaggaacggcggcggtggcgcgctagggtttcggccgggcgacggcggctcggggaagacgaacctgacaagcgggacccacctgtcagcgacagcgagggcgcgcgcggctgcggactgggccgacttgggccgaggagagagagagcggttttgggccgactttcggcccaaagccaaaagaagacttttaaaacctttttcaatttaaattatttcttaaatgcaattccatttattaaaaatacttccttaggtcaaataaatcccagaaaaatctaggaattatagaattaagcaaagtatttaataaaattttatttggccccattttatattggaatttattaattaaaactagatcttctcttctaggcttttaaaataaattctaaaaattccatttaaacaacaatttatatatttatgattttcagggtgtgacaaacctaccccccttaaacagaatctcgtcctcgagattcggaagaactggcgaacagatgcggatgagctgacttcaattcatcttctcgttcccaagttgattcttcttccgagtgattactccactggactttacaaaaacagataactcgattcctggttcttctctcatttgtttccaagatacggattggtttctcaacataggtcagatcctcttggacttctgtcacgaccggaaataacccaacgggcgttcctgacgtgcgtgcattaatccttgtcccaggaggcaaggtacaccaaaagttgatacaattcagagtttaacaagcggaagcgtaaatagttaacttattacatgggcagcgaaggcccagcacacacaaagacaaacgggaaacagcggaagactagggcgacgaccacaggcgcttgacggcaggcacgagctagacaccaaagccttcatcttcaaggaactcctcttctggggttgggaaaaattgagcaagactgagtacaaccaccgtacttaacaagacacacccgcaactgcagaataaatgcaagggagtacaagggaattatactataaagggttagggttgcagtaaacagcatttaaagacatttagttgctcaaagctattttgtaaacacgattctagaactatacactattattcatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattgaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggcaggcaggactgagcccccagcagcaggacaccggccctgtgccatgacatctcgactaccgggccgcagctcgtgtagccttcatttgccctggagaatgtccatcgacccccgacttcatccatctccatccgtgtacttttgtttataaccagactgagccacaaactaagccttacccactagacatgtggaagtacggtagtgctttgcaacagaggcccgaagaccggtccttatacggtccttttgtccgtctgtctgcggatgataagcagtactaaagttcagcttagaacccatctcttcctgaagtttcttccaaaaatttgaagtaaactgactgcctcgatcagacactattttcttagggacgccatgcaaacacacaatccttgccatatacaattccgctaagcgacttccggaataggttgtctttaccggaatgaaatgagctactttggtaagtctgtcgactatcacccaaatagagtcatgacctgatgacgttctgggtaaaccagtgataaaatccataccgatttcttcccacttccattcaggaatcttcaaaggctgcaacaaaccggcgggtttctgatgttctgccttgactcgctgacaaacgtcacatactgctacgtattctgcgatttcacgcttcatacttgcccaccaaaatctttccttgagatcctggtacatcttagtactaccagggtgaatggagtataaagtatcatgagcttctttcagaattgcatcttttaaatctttgttgtcggggacacagattctctcacccaaccatacagttccgtgctcatcctccaagaaaccgatagcttttcctcttctcatattcttcttgatttcttgaatatcaggatcattaatttgggcttctctaacttgatcaattagagtgggcttcgcttctaaggctgcaacgaaacctctactgacaattcccaaatttaatctttcaaattccttgcataattccaatggcaactgtcgtccttccgtagcattgcaatagcctttcctgctaagagcgtctgctacaacattagcctttcctgggtgataatgaattcccatgtataatccttaattagttccaaccatctcctttgtctcatgttcagatccggctgagtaaagatatactttaaactcttgtgatcggtatacacctctgtacgagtaccgaaaagataatgacgccaaattttcaacgcatgaaccactgcggccaattcaagatcatgagtagggtagttcttctcatgcggacgtaactgacgagatgcataggcaaccacctttccatcttgcatcagaacacaacctaacccaagttttgatgcatcgcaatacacttggaaacccttctttggatcaggcaaaatcaaaataggagctgatattaagcgacttttcaactcttgaaaactctgctcacattattctgaccacttgtacttcacatctttctgaagcagtcgtgtcatgggcttagcaatcttggaaaaattctctataaacctccgataatatcctgcgaggcctaggaatctgtgaatctctgaaaccgtctttggttgtttccagttggttacagattccacattactaggatcaacggcaactcctcctgctgagatgacgtgaccaaggaacttcacttcagacagccaaaattcacacttgctaaacttagcatacagttgatgttctcgtagcttctccaacgcaaggcgaagatgttcttcatgctcttctttggttcgagagtagataagaatgtcatcaataaagaccaccacaaacttgtctaggtattccataaacaccttattcatcaagttcatgaagaaagcgggggcattggtaagtccaaaagacataacagtacattcgaacaatccatacctagtggtaaaagttgtgttaggtatatcttcctctttgattctcaactggtgataccctgatcgaagatctatcttggagaaaacagtggcacctttaagctgatcaaacaaatcatcaattctgggtagcggatacttattcttgatagtcacatcatttagtgcacgataatccacacacattctctgggtatggtctttcttttccacaaaaataaccggagctccccatggtgacgaactcggtctgatgtatcctttctgaagcaaatcgtctacttgcctcttgacttctgccaactcattggctgccattctataaggtctcttatggatcggagttgttccaggtaccaaatctattctgaactctatatcccttttaggcggcataccaggtaaatcatctgggaacacatcggaatactcccggactataggaatctcttccaaagttatctggttcagtcttgaccttaaagactcagaagacaatgcatgaacagttacaactcgaccatcattgctggtgagagttacttttctgttggcacagtctatcacacctttatgtctggctaaccagtccatccctaggatgacatcaaggtctttggattctaacaagataagattggccagaaatggtactcctttaatttctattctgacagaggggctacgttgcaaagagagtgcttgattatttggggtactaaccatcaaaggacgtctaagatcttctacttccatcccatgatttcccgcaaaactcatagataagaatgaatgtgtagcaccagaatcgaaaagtactgttgcaggaactgagttaacaaggaacgtacccaaaatcacatctggagcatcttgagcttctgcagctgcaacatgattgacacgggccttcgatgctggtgcggtagagttgctctgggcagggacaaccttcacgcgtcggggcttcggacacttgtcagcataatgtcctgggtctccacagttgaagcacaccacgggcttgctgccttgctccctcttggcaggctgtttgtcgcgaccgagaaaattgcattttcccgaacgctagtgtattaatccccgtcccaggaaaagccggggtacaccatacaaacatgatataaaagacacatctttattatatcaataatatttacattattacaaaggcacttaaggcctgacaataaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggagatgcataattaatgcaagggagtacaaggggataataacataggggttaagttttgcagtaaacagcatttaaaagtcacttagttgcccaaagccattttataaagacgatcctagagctacacagtattattaatcaaggccgtgaacccacacgagcctgccttaacccaaggcctacgatgattcagaccgaactggcaacccgaccctgggtcccagctcgtcccaagccaacccaagccaactattccacattttagttgttaagcaggttttaagaattaaaacactaacttgggtacattgctcggcttgcccctaaccgagggcgcggctattcgaataggttatactctgatcagaggtgtacatcttttcccacaagacacatcttcctcacgtgtaaccacgtgccacataccaccacggcatttggacggg

SEQ ID NO: 43347 - DNA, 4013 bp, Oryza sativa
aatatcccaaagtctagagttgtaaaatcacctaatgttacctaattaaactgcgaagcatctacctaaaattaaactagtggtgccatgagtagagtgtccactagttgaggttttgtttattctagggtgaacaaggtaataataacaataacaataataataaggtcataacaaaggtaaataggcatggctagataaaacagtgatattgcgggaatttaaataaagcgataatgcaataatttaaatcaacataattttacaaactgggattcaatatgttcaaagatgatgtgacttgtcttgctcgctttcccaaacgtcggcttcaacttccacgaagagcggatcttccgaagctgcaacgtctacacgaccaacggaaaagaaaaggcttttactctaataaactccatataacaagcagaaacaaagcacaaaaatgggttcttgacttcttaagaaaaaattagagacttgaacggtccaattccgagttcaaatggccaagttatggccatttgaagtttatatgctctttaattgaatatttgcgaatttcttcatttaaattttaatttaaaatcggatttattgcgtcagccgaggggaggggcgcgcggaccgggtccacgggagtggggcccacgcggcagcctcacggtccgcggtggaccaggtgcacgcggcttgcgccggccggcgccgtgggtcccacgcgtcagccgcacccgcgggcgcgggcggctgacggccgggccccacctggcagccgcggggcgcgcccgaaggcggcctcgccggcacagccgacgggaggcggcgcacccgcgccccgatggtcgccgccggtgaccaccggcgcggcggagcggcgcccgagagaggggagggaagggggaaaggaggcgacggtccacggctcaccccggggcgacggcggcgacggaggaggcggccggagcggagggaggtggtggcgcggctcgggtcgacggggacgacggcgctccggcggtcggcgaccgaaacggagaggtggacgaggtcggcgaggatgcggcgaagccgaaggaggcggcgccgaggtgggaggcggtccggggtgacgacggcggcgggccggagcttggcggcgacggcggagagagagggcgacgtcgcgagctcaaatccggcgaggaggaagggcggcgagaggcggaaccggacggaggaggtgcggggagggtttaaatagagccggggcgagagagggtggccggggaagggaggaaaccggcgcgggaggtcggccgccatcaatggcgccggcgagatttgcgggggcaaatccgcccgtttgaacgcgggagagagagagaaacggggggaaagagagaggggatcacggggaataattccccccaccctaatgcgcgcggggacggcgggaggcggcgggattcacggcggcggcggcgctagggcgcgggcggggcggcgggagcgggggaggatagggatggcaggtgggccctacccgtcagcgagggtggcgggcgggcccgcccgtcagcggcgcgcgcgcggggagaggccgagtgggcccggggaggaggagagagagggaaggagatgggccgagccggcccaagagggggagggggggggaaaagactttttagggtttttctttttacaaaatcattttaactttgtttatttcttaataattattatttgtgctctgaaaattccactaaaatttgagggctccttttagaccaaggagaatttaacaaaaattctccgggccacatttgaatttttcttatacgcattttagtgtttgccaatttcttttcgaattttaattaattctattattccttttagaaaatgatttttatttcgggatgaatttatcaggacgtgacaaatccaccccccttacaagaatctcgtccccgagattcgaggaggctagcatgaagataggttgggcggtcttctcttcttgtctgacttcttccgctccgtcttctataacaaacttgcctaacaaaacttctccactctggactgcttggctcgatctcctgttgcaggtggaatcttcttttcacctgactcgaaccagggtgcacctttcagctgacgcagactaggttgcggtagtttaatgatgcttccgttccggaacttctcacgattcatatcttcggcgtcaacctcacacaagttatcaacttcatgtcatgtgtcgtaacctgcttgtcatcatgagaataccatgcttggcgtttccttccagcttaccaccatatgctttagactatgatatcccgcttactaaggataccatgattgacaacttgccattaactgtctcatattagctttcctggtctccggtgctaggtacttctgctattcgatgcgagggtcaaccactctaactataagttatgcttcccaagagaaccaacttatcccactggatatactttgacgtcttcccaactggctttactgctggatttgttattgtctaatcattatcctgccaaatctgaggcttcgttgttagatgtgattttaacctgacctctgtaggttatcttcgaacatatcacttgattcataactgggaatagctctcacgaacaagcaactcggattcactttctttatgttcagtttactttccactatcctctccatgttgtcatcatttagccttcaacgtattcctttgcacctttaaccttgatgtgttccttcccattggatcatctcccaagacatggcattgcctggtaaccggtgcttgcacttttcactccgtgtagcatctgataccgagttgaagatttcactccttgccttcatagaaacacttttacctaggtcatcttgcttacttaatgacaaggtgactgttgcggggcaattactatcaggggtcttccctgagcgatgcagagcatgtttctgtttatcaatcacctttcggcctacttctttcatgctagagaacatatttgccaatctcttttatcaatcttctttcggcctatctctaacaggtggtattctttaatgtggattgcggacgcttctggggacgatgaggtcctttggcttgctgcctttcagtgaaaccttgatgtggttcgtcaaaaagctgcactgactaccttcagggaaatacattgcttgctatctgtatctatgccactagggttttattgccgatgatcatctttagtgcttcctcgagatggggagcatccaaattgttcttctgccatatcacctttgacccttttctgatacctgatagactaattaccaaccatcgactactatgttctcaaatattgatgtctcctggatcttcttaactgtttgcaggtatatccgaacttatcaatgtagaggcatggcgggtacccttatgggtttcatccaacaatccttatcttgatctgtaaaaggcgtatccaaactcctatccccaactactgtctcattggctttttaacccaacacagtttaattggttttcttttccatcaacaggttggttattaactcgaggttagaatatagttcctctgacacaagaccctaggtctcctttgtcagtaaacaattatacacatgatcacatatccgcatcttccaaaagaatcctcttagaacttgtctgtattacacatttctcccttattacacgaacacaaggcactgccttaaacaaaaagggaaggtgcttatcatcggtacattgtatcctcaacattaatcatccataaacatagcaagctcactgtttatagacatgaatatatttatttattacatgattgctgcaaactttcgattacgcaatgataagtagcgaactgaaaaccacaagcgtggctgctcattttgattctggagagatatagctggcgttgttctagtgactgcatcatccttgattggttctgtgatgatgtgataggactgcacattgc

SEQ ID NO: 43348 - DNA, 922 bp, Oryza sativa
ggtccccacctacccgcattaatggcgaccggagcggtcccgccacgccacatttaatgcggtgtgcagtgcactcaaccgttctgtgaccggtccaatgactgatgggacccaggatgtcagacgcaccatcgcgtgtgtcaggcgatgtgcagcccgacatatcccatcaaataatgatggtgagaggttctcatcctcttatcccagccggagtcagtcttcccgctctggtcaaagcaatgctcccgtttctcggtgtaataggagcccagaagtcttcacccattaaatggtgactgacaggggcaccccccgtgtcaggcggtaagatttgacaggccccatcatcaagacgacgtgcgcttagcttcccaagtcaagatacaagacatgcatttaatgcaaagattataatacttctccaccagagctaggttaggttgttgggcccatgtggtaaccccttgaggtataaaaggaggtccaggcctagtggtggaggaggggggacttccgagcgaactggcgcttgagtctcgcagccccagacacttgtgttctacactcgaccataattccaaacacaggagtagggtattatgcttcttagcggcccgaacctatataaaccccttttgtctcatcgtctttgggggattgaatcccctcaagatcacacagcttcgctcaccgaatcctcgaatctcacccgctgcccccggccgaactcacaaaggggggcctcacggttccctggtggaggagttcattctccgacagattgctacactaccaatttataggtagtgttaaattttaggtaagttttggcactaccaatattttggtagagatttctattgatttggcaagttttagcatccatccaaacatcacacaagtactatttagattaaaa

SEQ ID NO: 43349 - DNA, 4755 bp, Oryza sativa
cggctgtgcttagatccaaagtttggatccaaacttcagtcattttccatcacatcaacctgtcatacacacacaacttttcagtcacattatcttcaattttaaccaaaatccaaactttgcgttgaactaaacacagcctacagagtactacatcaacaatggccttgtttggatcctccgaactattaaatagccctccggaatcttgctatttaggagtattaaacatagattaccgacaaaaccgattccataacccctaggctattttgcgagacgaatctaatgatatatattaatctatgattagtggctgattactgtagcatccctgtagcaaatcattgattaatatacctcgttagattcatctcgcaaaatagcctaggggttatagaatgggttttgtcagtaatttacgtttaatacttctaaatagcaagatttcggagggctatttaatagccctccggatccaaacagagccaatgataaaactaaacagttctgtgtcgtttgaattgtacagacaaattcaacaccagatgaccctcgtaggtcgtagccatggtccaggaccccctctctcaagtggagtgtctgtcggcctaccacctccactcatgaatcatgagcggccatcatcattgccccctcggtatgtttggtataatctggtaaatgaccgtcttctcttttaggtctctttgatttggagaaaaaacataaaaattttgaaggatttcaatcatataggaaaaattcctatgaatatctttgaatcaaatgattgaatcttttccattcctttgaaattattatggaatagacaatcttatagacagtgtttagcaaatgacaaagggaaatgattttccacccatctttaaattctaaccattcattatccctctaccatttaatcctaacccttcattcatttcccaatcccaatcccaccccccatttcccattatccaaatacacccatagagatttttgaggaaatttagcaagagctccaacctcttggaaaactttctttgagtctatctctctcatccgattcttgcgtttttcctgcggtccaatcaaacgataattcccgtgtttttcatgtgttttgcaatcctctgttttacacttcaattcctttgagaatcctgtgtttttcctattccgccattttttccaccctgcgattcaaaggggcccttagctcgtgagaatgtgagtataaggggaaaaattggatagaagattctgaagatgcaatacataaaagagttgtttttagacatgagaaagaatggatggaaaatttagggtacttttgaattgtgtcggtgatatgggccgggggtatcatgtttagagggaggaggctgccccccaaggccacgtggccctcccccgaggggagtgaggcccgaggtagggcggcggccactccttcccaaagactagtcggaggaggctgccccccaaggccacgtggccctcccccgaggggagcgaggcccgaggtagggcggcggccactccttcccaaagactagttggaggaggctgccccccaatgccacgtggccctcccccgaggggagtcaggcccgaggtagggtggcggccactcctacacagactagtcggaggaggctgcccctcaatgacacgcggccctcccctaaggggagttaggcccgaggtggggtggcggccactccctcccagagattggacggaggaggctgcccccaatgccacgtggccctctctcgagggggatcgggcccgaggtagggcggcggccactccctggccgagactagaggtagaaggctgccccaggccccacgtggcccttctccgaggggggatcgggcccgaggttgggcggcgaccgccccctcccgtgactagggatcgggctcccccgaccccctctctaggtcaccacgtacggtgggttaggtgtccgcctccaggtccccacctacccgcattaatggcgacccgagcggtcgcgccacgccacatttaatgcggtgtgcagtgcactcaaccgttctgtgaccggccgaatgactgatgggacccaggatgtcagacgcaccatcgcgtgtgtcaggcgatgtgcagcccgacatatcccatcaaataatgatggtgagagattctcatcctcttatcccagccggagtcagtcctcccgctctggtcaaagcaatgctcccgtttctcggtgtaataggagcccagaagtcttcacccattaaatggtgattgacaggggcaccccccgtgtcaggcggtaagatttgacaggccccatcatcaagacgacgtgcgcttagcttcccaagtcaagatacaagacatgcatttaatgcaaagattataatacttctctaccagagctaagttagattgttgggcccatgtggtaacctcttgaggtataaaaggaggtccaggcctagtggtggaggaggggggacttccgagcgaactggcgcttgagtctcgcagccccaggcacttgtgttctacactcgaccataatcccaaacacaggagtagggtattacgcttcttagcggcccgaacctatataaaccccttttgtctcatcgtctttgggggattgaaccccctcaagatcacacagcttcgctcaccgaatcctcgaatctcacccgctgcccccggccgaactcacaaaaaggggcctcacggttccctggtggaggagttcattctccgacatttggcgcaccaggtagggggtgtgttcgtgatttttgaggttctttcgagtgccggcgcgacgagcgtcgcaccgccgatgctggggaaggcgcagcctcctcgggagagccgcgccaccccaggcagggggctaggcctcccacttcctcactggaaaaggctagcggccaggcctttgtggcgagtcttcggaatgtccgatggcccctaaagtttcgacacagcctcaccgagaagtacgacggcggcgtcaacccctccgagtccctccagatctgcacgatgatcatagaggcggcgggggtgatgaccaggtcatggcgagcttcttccccatgaccctcaggggccaagcgcggggttggctcatgaacctgctgcctgcctcggtctactcttgggaggactcttgcagttgagctccgggtgccgtcgaagcccgggaccctctatgctggttcttccgtagcggctagctttggtcccgccggctggctatggtgcccggcccggctcaactaatcatcctttcaaccttcaagtattttcaatttttcaattcatcagcataatatagcttgaagtcttatatttcttttcccccattcttttctcatggccctgcgacgctcgcgtgttgcgcattcgtttgcttcctcggtggtaagagcccaacctctctctcatctacatgaacgtttcctcgccaagtatgggggctaagttttctagccgtattccagccttaagttgagctccgggtgccgtcgaagcgagggaccccctgtgctggctcttccgtagcggctagctttggccccgccggctggctacggcgctcggcccggctcaactgtagacagggatcgctggctctagagtttttcggctctcacactcgtgcgaaagtagtcgtccgtgtagaagggagagatattggaaggaggccaccgaaaggaaagagcaaacataatgtgtagcgtggggacacaggctcgtgggaacctgacctcgtttgctaagtgatcacaggcttcccaagatggttcggaacccatggtgggggctctcttcgagctaaaggtttaaaagatcgcgacatgcaagcaaggtttgtgttttcttcattcatacaagcaattctttgctataagtgtggggctacgattcctagctctatcctagccctgcgtcgagctctgggcgccgtcgacgcctagggccccctgtgctggctcttctgtagcggctggctttggccttgacggctggctacagcgcccagcttggcttgatcgtgggtgaagattgttggctatggaaaatttagtcctcgcactcgcgcgaagataatcgtttgcataaaattattattgcttatatttatctctcgcccatctctttctcgcggtcccgcggtacccacgtgtcgcacgctggcttgccttccttggtaacaaaaagtttatattcgcttcatctattcaaatgattctttgctaaaagtgtgggggctacgattcctagctctatcctagcactacgtcgagctctggtcgccgtcgacgcccggggccccctgtgctggctcttccgtagcagctagctttggcaccgccggctggctacggcgcccagtctggcttgatcacatgtaaagattgctggctatgggaagttcagtcctcacgctcacgcgaaaataatcatttgaatagatgaagtagaacaccaacagaggttaacaaaaggcaggggctagcgaggtacgcggcgtaaggtcacgggcccgagagaatctaacaacgtttgcagagtatatacaggaaataagttcacggcctaaggtacgtgctaaactcccaccgcccaactcccagaatgataggatagaagatcggacccacatgtcaactgactagaagattggcgtcaaccctgaccacctgggaaaggttttggtcagggctcacgccgggg

SEQ ID NO: 43350 - DNA, 3626 bp, Oryza sativa
ttctctaccagagctaagttagattgttgggcccatgtggtaacctcttgaggtataaaaggaggtccaggcctagtggtggaggaggggggacttccgagcgaactggcgcttgagtctcgcagccccaggcacttgtgttctacactcgaccataatcccaaacacaggagtagggtattatgcttcttagcggcccgaacctatataaaccccttttgtctcatcgtctttgggggattgaatcccctcaagatcacacagcttcgctcaccgaatcctcgaatctcacccgctgcccccggccgaactcacaaaggggggcctcacggttccctggtggaggagttcattctccgacagattgctacactaccaatttataggtagtgttaaattttaggtaagttttggcactaccaatattttggtagagatttctattgatttggcaagttttagcatccatccaaacatcacacaagtactatttagattaaaaagtttagtagggcaagatttggcactaccaaaaacagccattgatgctcgttgggggggggggggaattgtagcaaccgaactgatctgagtattgcacagtggagtagtaggcaaaaggccattttggattgaagccaaaatgtaaccttacctatttattggtagcttcaatagtgatagtgtatgtttggattgaagtcaaatcattaataatgtctattaacaatttggcactaatctagaactttcttctctatatcatcaatatttggctttacattggtagcaattcaaatatgtaccatacatctctaccctactaaaaaattactagtaccaaaacatgccaaaaatttggcactatcaaagatttggtaggtaaaggttggtttgctttgtagcctaaatagaccttaccaaattttgtcaataccaaattttggcaagttttggcatgactaattttggtaaggtaaagttgtgtttgattgaagccaaaatagcctaagttcactattgaaatagcctattttcttaggcatgccaaaatttggcttcaaaccaaatagacactaaacactattgaaattgccaaatattgataagcctaatttaggcctcaatcaaaaccagccctaaataaccaaacagccccaaagttctgtcatggcaaagatcatgaaaagcatgtgactcttcctcaagcatttgctataagcataccaattttgttgtttaagagttccgtttcgacgtttgccctctcctcttttggtgtttacatccgcagaatacatccgagtgaaattttagttgtttctagtatttgtcctgactttgaacatgtaacataatattggatttctcacggttatggtactgacatatactacgatgttccactaactaaagcgtgattaaatttggcatggttttcctaactaattttttactttgattttttcattactacgatgttcctagcaacaaaaccacaattatatgaaaataaattcaaatgtcaatataatgatattatttttgtaaaataaaacataatttataataaaatagtatttgttaaatatttagatagttgaattttaatacgtgcataccttattcagtgacacgggtggagtaatgtgttatgtatgatttatgaaaaatctcatttgtactctagataaactcgatactataagctatcgaccaagttttaacgatttttagccggcttgaaatgtgcatctccaactgtttgtttgaaattcgtcgattttcattcaaaatcaacgataaatcgatgacttgggtggagttcaaaatttgatttataaggaatcgagattatgtgcttgtttactttgtagccgctctcaaccttacctgtttttttttttcacatttttgtattactaggttttggtatactggatgtgtttaatttaaagccttatcaaaatttggtagaattttttaagtagaaactaatagaattactaaagtttaataaggtaatgttggtaagcatacgtttggtttatcttatcaaaatttaatactccatccgttaaaaaaaaatcaacttctagagtttgaattttgtcccaaaaaaccaacttctaccctcctacctactttcagcacgtaaaacgataagttttatcccttcaataccctttatctacctatcatttttactgtttttttcaatgattaagagcattttagtcattcaccatctccactaattccaccttgggatgctagtaatgcaatttttttggacggagggagtataagattcgaagtgagaatacaatgaaggagcctaacaagcatgatggcttgatatataagatccatccaacgcatgcgcgttttatccgataatatagggtctgttcactttgatgctattttcaaccatactattttttttaagctgtcaaaaaaatatctacgtttactttattgccaaatttggtaaatacataagaaatcctggtaaaattttggcaattttaccattttgcaaaaattttggcaatggcaaaattcgataaggtttattttagctacaatctgaacatgtccattgtactataatggtatgttagcttttatgttagcttttataacatgcatgtaaattgacacgataactgatagatagtactcttttttaagtattagagtggtcttatttctcagtctcttggtcaacacaacatccacctgtttctatcccaaccattcttaccaacaactaatggaacgtttacctcgcgataaacgtatccaaaatggtcaggaagctcaatttttttttacacggcatgaaattcacttgactgaccggactagagagagatccaaagagtagatcggggcgtggagaaaaaagaagtccagatagaccccggaccccacgagtccagtcaatcgcaaacagcgcccacccacgaccacgacgaacacaaacagtaagaaccaccaacgaaaccgatctaacccaagcgaactccccactccacccgcaagcaagggtagtagactagtagtaggcgaaagaaaaaaaaaatccccccaaacgagagaagcggcagcgacgacgacgacgacggcgacagcagcagcggcggcagaagcagcagaagcaaccccctcctccgccgctccgccccatcggatcgaggccgccctagggtttcccccaggctccgcccctccgcttcccccctctccgccgcgcgcgcgcggggagccaccaaaccctaggacggcaaacccggcgcgatcgcccacggtggaggcctcgtcggcgccgagaggagccgctccgggctcgggtcggggttccggtacctcaccggcgccgcctccgggtggtgggaccggtggatggtcatgggagccagcggctccaagctcgagaaggccctcggcgaccagttcccggaaggcgagcgctacttcggcctcgagaacttcggcaacacctgctactgcaacagtgtcctccaggtctctatccccctagccctcacgcctccgtagcttgtggattttctgtgactgaacgcgcggtatgctcggtgtgattctggggattgtga

SEQ ID NO: 43351 - DNA, 2685 bp, Oryza sativa
ttattgtgcgagaaacccacaggagacaattttagtgttcactatcttagtaccttcgctatagttgtagatctaccttatatttgtaaagttctgtgcataatattgtagttgtcatgaaatatgatgaacaagtttatattttattatatcttggtatgcaatagtcaaataatgttatcattcctgaaccatattaaattatggactatttctgtttggtaaatgttctgctgtaatctcttcttcacagtttgcaatcttacaacttgcactgcacagtcaattattttttatacaccttattatttacatgaaccttacaatgatacttgtgttccaggcactatatttctgcatcccgttcagggagaaattgctggaatattatgcaaataacaaaactcctggagatgcggaggagaaccttttgacttgtttggcggatcttttcatgcaggtaaagtggacaaagtataagtttcttacttgatgataatgatatgtaactgtgtttgagcatattgttgctttcaaaaactttgaatgggtaacagcttcttcataactgttcttcattgcattcagtggaactttcatctaccaagtattatatttctgattgttaaggacaatagtacgctgatgttttagttgaagtaggattgtaaccatgatgctagttggtaggccctatttgcttggggacttactccctccgtcccaaaaaaaaggcaaaccgtgggtttccgtgccaacgtttgactgtccgtcttatatgaattttttttataattagtattttcattattgttagatcataaaacatgattaatactttatgcgtgacttatctttttaatttttttcataattttttcaaataagacggacggtcaaacgttgggcacggaaaccagggtttgtctttttttgggacggagggagtattagcctgcttataatctaaatacctaaacctaagcaaacagaaagtttttttattcggctttttttaaaagccataagccactgttgcaccaacaagccaaatgctagatttgagtagcccttttggcttttgtgggttggtgttatccctccacccttatacttgtggattaaaagctatggccttgcagactacaaatttcaaatagctagattaagagcttatgctgaaaaaagtggtgggtcttaggctcattcctgggagaagaatatcagaatatggtaagtcctattctatattatgtaaaggccttaagttttagtaatgccttacagggtggcatcaagtgacttgtatctgctgtgcagcctttaaaatatctgttccctctcttcaggatgacacgatgctgtaactgtagtagacagaagcatgcaaagtatttttattttcattctaacagttctcaagaacaaatgtttttgttacgacaatttaagaacttatattgtcctattgattatgcttctgcaataaggggttatctgtaatggcatgttttagttgtagtggatgtcgtggtgttgtcatgccgatgacagggtgtcaagtcagttgaaagcaatcagtactcaatattattcccagaccattcaccctgagtccttgatttgaggtgagaagaccctttaaaggatagataatcacaaagaaataaacagttctagcagaggtctaggagatagggatctctgatctggcttctgtggtttctctctgtgctgctgcttaatctctgaggagaacctggtggacgtggaagaagttgtggaggcattagggggtagcagtatggcagaggaaagaaggataggtcataggtcaggaaagtagtgaagactgctacctggtgttggtgtgagtggaagcctggcaatatcaggacatgagattacgtaggtagtgaggtagctggccgtctcacatattatccccctcctgctatttgtgtgctccatgtgttgattagggtgccagcttttgtttagcaccctcatccattgaagtcatcatataatcgctgccagggtgaagtttcgtatgttgccagttaataaatctctattgcactgagtttgaaggttttacgtcatcgtgtgttgatcagagaattatgatggaagccacttgatagcactgtgcagctccatatgagatatatttgttgtctgtgtgctattttcttgtttgggtatcttgaggtgatttttctagtcttcagagagtgcactgtttattggaagccacttgatagcactatgcagatatatttgttgtctgtgtgctatttatttgtttgggttttcttggggtgatttttctagtcttcagagagtgcactgtttattggaagacttatatcaacttacttagagtaatgtacactgacctgctgttacaatcagcatatattctaaaatccatcacacaagttgattaccaaataagatatttggcttgatgtcgtacccacaaattcattgatctgtgtgcattatgtttactgctcggttttgtatggtctctgaaatttctgtcaggatattgtctctgtcagcaacttaatggatcataatatatattgcaggtaagccagtcaaagaaaaagactggcgttattgctccaaaacgctttgtccaaagagtaaagaaacagaatgaactatttcgca

SEQ ID NO: 43352 - DNA, 726 bp, Oryza sativa
tttgttttttgtttttgggcatatagggatacttttatagaattgaaatattttctgtgtactatatcattttctgaattatgatctgtactatgtgatatattcaggaatgcctgttctcatagatgtttctgttgtaagaacatttgtagttgacttactactttgatggtacagcatacatttattagatagtgttgactcagttttattctctcgctaaatgactgaaaatttgtgattgctcatgtggtggaattcgatcagagtctatccgaaaacatgcatccagaatattggttttcccagatgcttttgctcaacttttgttaacatttacgcttcttcactctccaggttgttgctggatcccatccccaccctgcaaacattggtgaattgttttctgagggctcgttgaatccatatgccgaagatccttatgcatttggctagaaggtaatatagtttccctttttttacttattgtattttctaatagtaattatatgtctgcatgaataatccatcaaggactgcatgcaatgttctaaaatgctagagtagtgcttcagcgacttttacttttggtgaatagcattctcagttgtcagacctgaaacttgaactcctctagcaccatactgcaactttcgtatgcttgccgtccttgacttgttgtatgtcaaatgtacctgctttgcagtgtttggaaatgttgatctt

SEQ ID NO: 43353 - DNA, 5351 bp, Oryza sativa
ataatatgagaaagggagtattcacttacaacttctgaattctaatcatgcctccctttgcagctcacatttgaggtgctgaccttcagaagcatgatgatgactcccgagtgcaatccccaagtcggattgaatcaatgatcttgcggccttaggcatctgaccatcctgttgtacgaaacgacaatcgttaactgcgttgtatctgcaatactgttacgacacgggttatggcatctgaccatcctggtgttcataacatactatcactacctgtgatgtatctggaatatcgatacgacagacaacgattctcctgcgcgtacagcatcaactgaaaatgccagtgttagttttgctatttctaacgatttgcggaaggattttaatacattgatattccattgccggcggagtggacaggcaacggaaaacagtagcaaacttggtccgaggacaaagcatctagttttaatttgagcaattttaccatacaacatttggtatctcgaggtatcacattttacatacaaaattttgatacctcgagctggttggtaaaattgtttttttttttcagtttatcagtggctttttatggcttgcgcatgaaggtcctctcggacatgaatttgggccgagtgaatacaaatatctcaataaagtgcgtgtcactggattcaaagggtccagaggacaacttgagtttcttttgcatctcatggaaaatgcacctggactagaagtcataactgtggatacagctgaaagaatatggaaggatgaatatcataagaacgaatatctctgttctctgcaagactgcaactttgctcgtcagaccgccaaacaacatccttcgtgaagcacttccaccggccgcaaagatttccgtcctttagcatggatttgtgtaattgtttagtagtgagttcatgtgatctctctatatatatagtgttacatacctatcgatgatttgaagtttgagcaatagatgaatgctcgatttaaaatactctttggctggtgcaagtgtcatgcattttattcactagtacgaggactaaagggaagtcgtcgttgactcctctatagttggtactagctgttaactccttccgttatacggagtactagtaaaaattaacaaagatgagatacatgttaatactataaatgaaatgtgagataagtatgtccatattcatatttatagtacgcaatgtttagattcgtaatacaataatacatcttattctatattagattactaattttttttcgggaatacacaaaaggattgcgtacttttgtattaagagaagtaaagaattacagctagattactatattttgatttagattcgtagtacgaagatgtatactttctcgtattagattacttatttactttacccacgagctgctcctcgtggtctacactctggcagtggcaagcattcgcgaccttgtagggggtgtgtgacagcggacaggatagcaggaagcgccatggcggcaggtgtcctcgacgccggcggcgctgtcccggccgcagcttacagcggggagctcacgctctccgtgcttgtcacatgcctcgtggcggcctccggcggcctcatctttggctacgacatcggcatctcaggtctttgttcttctcccagcttgtgcatccgcgtccacgatggattgcttggattctttggtcgattatgatctctctgatggtgctcgactgtttgttccaggcggcgtctctcagatgaagccgttcttggcaacgttcttccccaaggtgctgatgaggatggccgacgcgaagagggaccagtactgcgtcttcgacagccacgcgctcacggcgttcacgtcgtcgctctacgtcgccgggctcgtggcgtcgctggccgccggccgcgtcaccaggtggctgggccggcgcggcgtgatgctgatgggcggggcactgttcttcgccggcggcgccatgaccggcggcgcggtgaacgtcgccatgctcatcgtcgggcggatgctcctggggttcggcgtcgggttcacgaaccaggccgcgccgctgtacctcgccgagatggcgcccccgcggtttcgcgggtcgctcaccgtgggcttccagttcttcctctcgctggggatactcatcgccaacctgaccaactacggcaccgcgcgcgtcccgtggggatggcgcctctccctcggcctcgccggcgccccggccgtgttcatcgtcgtcggcgccttcttcctcaccgacaccccgagcagcttcgtgatgcgcgggaaggtggaccgcgcccgcgccgcgctcctccgcgtgcgcggccaccgcgccgacgtggacgccgagctcaaggccatcgtccacgccgtggaggccgcgcggggcagcgaggacgtcggcgcgttccggaggctggtcacctggcgggagtaccgcccgcacctgaccttcgcgctcgcgctgccgctgtgccaccagctcagcggcatgatggtcctgaccttcttctccccgctggtgttccgcgtcgccggcttcggcagcaacgcggcgctgatgggcgcggtcatcctcgccggcgtcaagttcgcgtcgctcatcctctccacgctggtcatcgaccgctacggccgcaaggtgctcgtcatcgccggcgccgccctcatgatcgtgtgccaggtaagtacgcgtacgtaccataccatgcatgcaaagtatgtaacgttcgttgcatccgtcgtttagaattattgctgttttgtgatcaaggtggcgaacgcttggatcatgggggcgaagtccgggaagcacggggaggtggcgatgccgagggcgtactcggtggcgctgctggtgctgacgtgcgtgcagggcgccgggttcgggatgtcgtgggcgccgctgatctgggtgatccccggcgagatcttcccggtggaggtgaggtcggcggggcaggcggtgagcgtgtcggtcacgctggggctcacgttcgtgcagacgcagacgttcctggcgctgctgtgccggctcaagtacgccacattcgcctactacgccggctgggtcgcggccatgacggccttcgtcctcgtgttcatgccggagaccaagggcgtcccgctcgagtccatgggcgccgtctgggcgggacactggtactggaggcggttcgtcggcggcggcgacggcaaaccggagcagcgccgttgacgaatcatctccgtggatctacacaagtaccacgactacacttacttactaataaagatgtgtgtgataagctttcgtgccggtcatgcatgctgaactagtcaattataagccttgtcactttgttcagagggtcacaaaattcttgggaccagttgacaacttgctcaaacaaatattgtgttatcggtgatgacttgcgcgcggtgactttgagatcattgatatagtaccacggatgggtaattatcaatactcaatcgtagaaagaacgtgcttccgctatatatcagtgtactactagtctactgctccatccgtctcaaaatataagcatttttatattttaacatgatcttcgaaatgttacttttaccaacgttatctataaaagtaaaatgttttaaataaaaagagttgcatattgtgatagtttgtttaatgataaatctagtagcatcaattttatatgattgatcttttttatttttttgctattaatagttaaagttacaaatatttgatttggtattatgttaaaaatacttatattttggtacagagggagtagtatactcaactctactttagtaaatctactttgaattttatatttctgatactcgaatttggttagctagtgcctagtggactagtaagtgaaagagaaagacacaacttgaccgtaatcgccttttttaatggagggagcaagagaaaggacagagatataccgaaacggatggctagagctgcaaattaaaagatataattaaaccattagaggctaattaaagatatataaaccattttcatcgtctaaaaagatggctctacggcggactatctaacagtatcctctgccgtacagtccataccgtaccaccaatatgtgtatgtatccctatatatgtactttagggtctatctctcagtacgacacgtacgtacggtagaaagatgtgcatcccggactattgagacggtttaggtatcatgactcatgcggggctatttggttgccaattttgcaccctgatagaggattttttctgcatttaatttgacaatcggacacttttcaaaaactaatttcacaaataaactgtagccaaaacttatttcaaaaataattctttttttcaacgccaaatcatatggtgctgaacttagacatatcaacgctaaatagcacgtcactgaatgcatgttggcacaccgactcagtctcccatccgtggtggcacatcattcagcatcagttgacgtggtgttgaggtatctaagttcaacgccgtatgatttgacgctgaacaaaagggtaatttttaaaataagttttggccacggttcatttacgaaattagttttcgaaaagggtcaaattatcaaattaaatgattttcctaggcggagacttcccagcgttggtttgcgtcctgagtggctgaagctttgcctcatctgagctgctcagacgacacaaaatcatccaacaagcatgaaataaaatcatctaacaagcatgaagataagtgcccacgcaaaacgagataaatcattagcacataattaattaaattttaattattaaaagcttgaaaaaatgatttatttgattttttttatagcaacttctatgtagaaagttttcgcacgaaacataccgtttagcagtttaaaaggtgtggtaacgaggaaaaatctgtatcttgttggagttatatgtatcatgtgagacgtgattcgtcattcgggcatgttactcgggttgccaaccattgttacccttgtaatgaccaaaattttgttcaacggccgatgtgagcctcaactattagaattttgtccgctgctctagaattttagtaaagttgcagtgttccatttccattaaagcgaattgaagacaaaatcttgggagagttgcttatgctattgtttagtttgatatatcaataaaaagtaccaaatcgtaatcgaagaagttttcaacaagagataaggtctaaaggtgtaagtggcgtatataaatgggaattaactaggaatggttagttatgtattagttgttgctcaaatttttatttcaatatgcaacttg

SEQ ID NO: 43354 - DNA, 18382 bp, Oryza sativa
cattggctataaaatcattgaaatacttagaatcataagaatattataaaatttgaatcctagaaatccttatattttgttttggcactgtggtgagcttgctattaccaaattttgtagtaaaacaaacagtaccattaaatggtaaaaaaatgtaagaatttgttaggcatcaattcaaataatcccttaatccaaaatggcttgatgatttttcgaaagttggcttgaacacaggaagacaagatagaatatacttgcttttgttgtgtcttatttaaagcatttgtcagatggttggaatggttgcacacgaaaggagcacttggtatcggtagcttaaataatcaaacaatggaaatttgtgataccttgaaccttgttacaaatagctatctgtctgatcctcaaattcaagctagtggggttaagagcgagttgacactccatatatatctttcatgtacacctctgaaacgtaagaaagctcatctgaccgcagtttagctccctcttagacagaggccagagggagaaagagagagagagagaggagaaggctgagactgaacattcaagatggccggaggtgtcatcgtggcgaacgacggtgatggctccgccgtggaccacggcggacggctgacgttctcggtggtcatcacctgcctcgtggcggcctccggcggcctcatcttcggctacgacgtcggcatctcaggtgcacgcgcgcatgcgcctctcgattagtctgatcttatcaaaggaattaactgacctgacctgcttctgcgtccatcaaggcggcgtctcgacgatggagccgttcctgcggcggttcttccccggcgtggtgaggaggatggcggaggcgaggcccgggaacgagtactgcgtctacgacagccaggcgctgacggcgttcacgtcgtcgctgtacgtcgccgggctggtggcgtcgctcgtggccagccgcgtcaccagggcgatggggcggcaggccgtcatggtcatgggcggcgcgctcttcttcgccggcggcgccgtcaccggcttcgccgtgaacatcgccatgctcatcgtcggccgcatgctgctcggcttcggcgtcggcttcaccaaccaggtcagtgtcacagtcacacctcttccatcatcttccaccatgctgtaaatgcgtctgaccgtcgattagtattgagcgacacccttaatcctgcgtcagcggattgtccaaagtctttggctgatagacacagagacggagccatcatcattgctcattggtgaacttatctgctatttgctttcagacagctatgttagtatctttatattatatcaggatatgcttcgaagcagccactgccatgatcccaagtgttttttttattatttttggcttaaatataagggcaggtgaatccgcacatacagagaaaaaacgagagccaatccattcgtcaaatgactcaaaccaatgcgatctccaagtagtagtatactagtattcttaattatctgtcagtccactcatgaaactctaagtgcgattaagctatgaagaacgttgcagttaattacagacagctagtagtatactgtagtacttaggtcgattaccacatggcctattccgacatttggtgcaactaatccaccgatggtggtggtggcctggtgcgctgacctgtacccgccgagatgccgcgccttggcctcggtggcgtcacgcatcactagtaccaaccacgtcccgcgccgcgagtatcacacgagtgcaccgggcgttgcagcacgacgggttcgatcgtgtcgtgtgggttcttgacgaacgaaatgggcaggcggctcctctcttcctcgccgagatggccccgacgcggtggcgcggctcgctcacggccgggttccagttcttcctcgccgtcggcgtcgtcatcgccaccgtcaccaactacttcgcgtcgcgcgtcccctgggggtggcgcctctccctcggcctcgcgggggcgcccgccgtcgtcatcttcctgggcgcgctcttcctcaccgacacgcccagcagcctcgtcatgcgcggcgacacggcccgcgcgcgcgccgcgctgctccgggtgcgcggggctggcgccgacgtggaggcggagctgaagggcatcgtgcgcgccgtggaggtggcgcgccagggggaggacggcgcgttccggcggatggcggcgaggcgggagtaccgcccttacctggtgttcgccgtggccatgcccatgttcttccagctcacgggcgtcatcgtgatctccttcttctccccgctggtgttccgcaccgtcgggttcggcagcaacgccgcgctgatgggcaacgtcatcctcggcgccgtcaacctcgtctgcctcatgctctccaccctcgtcatcgaccgctacggccgcaaggtgctcttcatggtcggcggcgccatcatgatcatcgcccaggtaatcaattgcccaaaacgttcacttcatcagtagtactcgggcttgaactttttttttctcttgaaggttggggtggcgtggatcatgggggcgcaggtggggaagaacgggtcggaggcgatggcgaggccgtacgcggtggcggtggtggcgttcacgtgcctgcacacggcggggttcgggtggtcgtggggcccgctggggtgggtgatccccggcgagatattcccggtggacatccggtcggcggggcaggcgatgaacgtgtccatcggcctcggcctcaccttcgtgcagacgcagtcgttcctcgccatgctctgccggttcaggtacggcaccttcgcctactacgccgcgtgggtcgccgtcatgaccgtcttcatcgccgtcttcctgccggagaccaagggcgtcccgctcgagtccatggccaccgtctgggcgcgacactggtactggaagcggttcgcgcgggagcaaccaaagacgagcgccgacgaaccgaccgggacgtactgatgtttcacgatgtgtagatgtacttaattctgtggagtacatgtcttgtataacttttgaatcatggtacttggtcctagttcactcgtctgtttcaatcgaaatcaaatgtatagaactccaacatcggtcgctccgatcctacatagctcaagtgttgaaaaatcctcacgacactgttgcaagtgatttaggatttgaatagcccacgtgggtgtctagcgtggcaaaaaaaaaaaaaaatcgtcagcataacaaagttactgacaaagctctttaccctctacccctctctctccccccccctatagatggccatgtgggccaggccgtgccgtgcctgggccgaggcttgtcgggccggcacggcccgaccgacgcaccgggccatgccgtgccagcccacatgccgcactcacggcccaggcacggcccaacacgcctcgggccgtgccgggccggcccgaaggcacgatgggccatcgtgcttttcctcagaataagtctaaatttcctctctcctattgggctgtgacatatgtatagctaaaaaagtctattttacctccctcttctttgggctgtggtatataaatagctacgataaatctatttaaggtccctattctttagacaatgacatttatatgtctatttttagtccctatactttgtgtaccgggcctggcctgccggcccgaccgtgccgggtgtcacgccccgaattagtcctgaccggaactaacccgtgacgctccaaattaacctgttaatcgataccagtcccaggaaacagtgctggtatcacagggagacagaatatcacagcaacagaagtctcttcattatagagtagaagtacagtcatgttgggctgcggacagatcccgagctcacaactgcattacaaaaagaaagcggaagctaggacttggactaaacaatcacaggcgcgacttgggaactaggccgaaaccctaaaactcatcgtagccggcttgctcctggaaaaactcctcatcagcaggattcgcttcatcttcttcagcaactgaggggggggatatttatatagagcaagggtgagtacgggagtactcagcaagccaggggaaataagtgtttaatgcaggcttcaaggaatggctgttgtttttgcaattgattttatttgaactattttctaaaggcaactaagtgagtgcttctcaaacgacacggatgagacagtgcgtctcgtccgatcggagtatgtgcaatgtgtcagtctttagatcttgaaacaaggttggcacccggccaaaagctttttgaacggccacccgggccaacaacttttaaactgccacccgggcctagctgatcccatcagctgcaggttttccaaacatcgaacccagtttcacaacagcaatttcacaagcagtagtcaaacaaaactacgctaggaatcacctcacatccgcccgtgaccgtgggcacggctgttcgaacagtttaatgacctctgcagagggggtacactttacccacacgacattactaacccgggtcacccagcccgtggggatcagccacgtcgggagacctccaagctttcatgacaaggcatttcgaaagccgatgcaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaagtgtcgggttttccaagtcttttggaaaactccagttttacccaagttgttactcagattttaagtttgaaggcgaccgtcggtactcgcacagagtgcgcgagtatcgaggcgcaactgggtggttacaaggggacatggtatagcaattaacaatggaaggatcaaatgcgacaatttaggtaagtccgccaatctgcttcgcagacgggacaacagattaagtgtgatcctatcaatgcataatattttgcaagcaacataattaaatttcaaatataggctcaaggtgttcaaaggtggcttgccttgctcgagatctggagcttgatcctcgaaatcctcgcactgcgggtcttcgggctccgaaactacacgcgaaacggggcaactcaacaaacagtgaaaataaagccctattaatgacctctgagcgtgccactagatagatctcgagatttgatgaattttggaagttgaacggagtcaaacggatttacggttgggaagatatagaatttctaagattattgaatttctaagattatttaattaaatccttttttggaaaagagaaagaaaaggaaggagggaggaaatttagactttcctcgggcggctagggtgcggcccaagggatctggggcggctcggccgagcttaatggtccggccggcccaaaacggcccaagcgcgcgcgcgcgcgggaggggagagagagtccggtggaccgggctcaccacgcgcggtcccgggtgggacccgcttgtcagcggctcggctcaccgtgcggagggagcacgcggcgcacgcgcgcgggcggggaggaacgcggtgcacgcgcgcggtccgctgcggacgcagatgcgacgggcccacgcgcagcctcacggcttgcggtggaacgcgcgcacggggagggaccgaccggggtcggctcgacccggtctaagctgagctggcgccgacgtggcgcctacgtggctgccacgcaggacggcgggaggtagacgacgacccggccgtgaatggacggcgggcggcggcggcgagcggcggagcgaactacggagatacgggcaaaagcgagcacaccgggcggttgttcgtgacagggggaggcgagccaacggctcggattcgccggaggtcgctcgacggcggcggattgcggcggcggcaaccggcggcggaagaagagggaaacggcgacgagagcatctacggcggtgagagcatctacgcggcttcgggaactcgacgctagcgtcggattgggcggaactacgccgagcgaggccggcgacgagcgggtgctacggagctcgggcggcgacggcggcgagcacacggcgagcgaaggcaacggttggggcggcgccggctagctacggggggtctattcgagctactaccgaaagctagggggaggagacggagcgaggagggggaacggagagagacatcaccgagaagaggaggggcgctgtgacgagaggccgacggcgcgggagtaatctctccggcctcgggccggggaaggggaaggagagggcgcggccgaagtccccttccgcgtcctcgaatgcaccggctctcccggcgctcggcgaaggacggcggaggtgagacagagcacggggcggcggctatggcgcggagacgaatggaagaggaggggtaaggggaggccgggggtttaaaggggacggcaatgtcggtttgagaaccgacttgcgcagtcaaggcgcgagctggcgctccggctagcggccaaattggcgacagggaggatgacgccggcggggaggaaaaggggaaaaggaagggggaaaaggggcttgcccctttgccgatttgggaaagaggaggaggggagcgggggcgacgcggcagagggagggggggcgctgcctccgtcccttggcggcttgcgcgcggagtggcgggggccgggcgatgacgacggcgatgacggcggcggtttggagcggagcggcgacactggcgacaggcgcgggcaggcgctgacgacggcggcgaccgagcggtcggccgcgcgcgcgggaaacagcgagaggcgcgggcgcgcgcgagcaacggcacgcggggagcggcagcgagggagagagacgctcggggtggctctcgacgcgcgagcagcgcgcgggcgaggctgagcgggggggggggaaggagcgcgccgggggaggggaagagagagagaaaaagagagcccgggagagagagagagatgggccgagcggaattcggcccatcgaaccccgggggaggcaaactaaactttgcggagggaatcgatttggaaggatttggattcggatttgaactcgacgatagatcggggattgagatcttgagagggcacggacactagacaacaatcaaagaaacaaatttcgcagatagggtttttaagagataattttcccgctaggcgccacgacggaacgggcgctacaccgggccggcccgaccgtgccgggccaacccagcgtgccggtggggaggcccaagcacgacctgacggtcgggccgtgccgtgcttgggccgggccaaaaaggcgtgccgtgggccgggcctttgggcctcgggccttatggccaactataccccccccccagaaattcccctctccccctctcaaatgagaattttcaaaatatgtcattctattcgtaccatcctcaggatttgccattcaattcataacactccgtccctccgaagccgcacaccgtcgcaagtccatgtcgcgccatccgtctgcctcatacgccgttgctcgcgagcttctccttcccacgcacgggcattttactagtatgttaatataagggctctaaaataaataatgaaaactgcaagagaatcagcgtcgaatacaacaatcacaatctttgttgtacgcataggaaattcatgtccgtggaggtggcgcgcccggggaaggatggcgcattccagcggatggcgacgaggcgggagtaccggccttattaccaggtgttcgccgtggccatgcccatgttcttccacctcatgggcatcatcgtgatttccttcctcccccccgctggtgttccgcaccgtcagccttgtccgcctcatgctctccaccctcgtcatcgaccgttacggcggtaaggctgcaaggtgctcttcctagtcggtggcgtcatcgtgatcattgcccaggtaattaagtgcacatgtccacttcgtaagtactccctccgtccaaaaaaaacttaacttctagagtttgaattttttctaaaaaaaaccaacttttatcattcttcctacccttagcacgtaaaacgagaaggcttattccttcaataccctttatctacctatcactcttactattttcttactgtttttttcaatgattaagaatattttattcattctcaccctccactattttcatcttaggatgataggaatggattttttgtgagacggagggattagttgtttgttccagcttgagtctcacatgtacggttttgagtttgagcttttcttgaaggttgggttggcaatgtggcatggatggtggtggcgcaggttgggaagaacgggtcggcggcgacggcgacggcgtacgcggtggcagtggtaggcgttcacgtgcctgcacacggcagggttcgtgtggtcatgagtgccactgcggtgggtggcgccgtgcgagggagatatttcccggtggacatccggtcggcggagcaggcgatgaccgtgtccatcgtgtccaggggcgatgagcgacgacgaaacgaaccaaccgaagtgactgatcgagattgatgtttcacgatgtgtaaatgcacgtacttagtcctagttcactcatctgtttcaatcgaaaaatcaaatgtatagctccatctttatatgctattgttagaagaaagactacttccattgctagtgtcaagaaaactgttccacttaatatttttttagaagagttttaattggttagaatattgtatattggctgctattgtacatattcagttgaatcatttctctgattattttagatggaattatcatcagaatattctgatagattctcggtgaggtcaatgcacctagctttaatcaataatggctatattgagaggaataagtgtatttggaagcttaagatgccacttaagattaagatctttacgtggtacttgcttaaaggggttgtactaaccgaggacgatttgataagacggaattggaatggtagtttaagatgttttttttatgaaaaatgagactattcaacatctttttatggactatcattatgcaaagtttatatggagagcagttcagttctcatttggttttaaccttcctactagcatatcctcatatttttgatgattggctattggggttgacaagaaaaagagtaaactgatatttgtaggagcatctgtcatatattgggctttgtggttgagcaggaatgatatggtttttaacaaatcaccatctatttcatatatgtaggtaatttttagggcaactcattggctctggttttgggcacaattacaaaagtgtgatgaagatggagagtttctaaaagttgcatgtcgtaatcttgagacgacggtcatgcaactgtttgccaactatggatggagattcacaaataagcttgaataaatgtgttctccttggtttggtttcttcatttttatggttggtgtgttcttctatttatggactacactctattctagggtgctactgtgctagtttgtaataattagctgtagctcttttgagcaaagacagggatgttatattacactagcaaaaatgctcatgcgttgccacggaaagaaaatacgagaaaattgaattaaaacatattaaattctaattaaatgaaatacaaattttctggaatatttgggtattttttaaataggtagatataaaattaaaccaatttacaagtaaactaagtgtgagaaataaaatgatatggatggatttaatttttattaaattcttcatattaactacaccattttaaattttcttggaatttacagagcttaattgctaattttgctaatacaaacatcatttcagcatttatttaaataaaaatccttcttttctctatgggccatttccagcccatgttcttcagcccgcaagcgacaaaagtctaaataatattcccatactcctctcacttgccgtgcggcctgtaacctcaaatgtgttggaccaacagcccgcgtgcggcccaagtggtccggtccgatgatgtaggccagcccagcgaacgatcgatgattggacggctcagtcgattccaaatcaatcaaaaccctaaccataaccctccccctcccccgatcggctcgccgtcccccatcccccctcttaccgccggccgcctcccccgccggacgccgcctatcgccctcccccatcggcgccggctctcccctctaccctccagcggcgccgcttcccctcccctcccctctcccttctagcagcgccgctccctctccccctctccctcccgtctcaccggcacggtgcggggaaggcggggtgcggcggagacggcgtccctccccctctccctctcctcgtcggcctcgacagccgtccctccctctcggtgacggcgccctctccaccctcaagatccagcagcgccttcccaacggcggcgtcgacagcgacgacagtgtcaaaggcgtctgcgggtggatccgtcggcgatggtggcgactgcaggcggatctggcagcggcagctccctccgccgcctctcttctcgatccctccgttggcggtggcaacggccgaggagatccgacggcgccccgtggatggatccggtggcgacaacggcgttggtggcttcctggtgatgtttttatttttcttcccattctttttctcaatttcgattggattttgtatctagtttttttttgctttatttgccttatgatgcactcggaagataagatagatagattgaatcggacttttttttttgttttcatgtttttttcgccttttttgttattgtgaatgacggaaacgtttttaatttttttaccgcttcacatataatcgaatccatgccacatataattggattcgattttttttcacccttttttcacggatggacgatgaaaacacctttaattttttaagtagtagagatacagatagagattatctaaattggctgctccgatcctagatagctagagacctgaagtcttgaaattctgaagtgagcgggccaccattttgcattcgaatcgaggacggcggcctcagatgggaagttacgttcaagactccgagtccaattcttgtgggccctaatgtcgtattgggccgaagaatccctacttcctacgcgtggccgtagcctaacgatttctgtgctgtgggcctgggcttctattcccactggactataagacattgtgcacgcgcgctctctctttcttcctgcgattacaccgaagatgtgcatgcacaccccccgctaatacagtcatacacaagagttgaagatcagtgttaaattcctaacatcactacatatttctataattctattcaaatatactcgtgtgtataatattcgtgagcaggaagatttaaacttctcagtggagtaatatactcacgatttcaccatcacacaaccactcttcccttctgtgttatatacaaattaaaactgcctccatgtgaaggtaaatggtggataaaatgttgggtgaaattacagcacaagccaaagctatggacaaacgtggggctgtacatcgaagaaagaaatggaaagataatatactgtaatatgggctttacctggttggcttgacccaaattatttgtgggccctgattacatgcccattgtatgcacaatttatatacgtactagtagctctcaggtcacatctcatactacactaatggcaacttgtatacccagaaagaaaaatggcaactagtataagactggatagagtagaccaccacttcattggatgggttcttttgtagatatatatcaccattcagttcattttacatgaccaactctgcatttatcgtttgcagatttctgtatcttcttttattcttttatacttcctggtggacgatagttaggcctgaactttgtagatagtacaaaataaacttctttactagtaattagaactagaactcgatcattgttgtgttgttataaataccccgtcgtattgctgcggaaaattaagctgtataatatttataaataagttgtaatatattttgtaaaccaaagcaaaatgatgtcttatgttttatataatttacgcatggttgcaaatataatgcaaggtgaaattgatacttcaaattttgagcttaaaaataattgagattgtatggttttatgagagaagaaaaaagaaactatgtgtatatagatctatcattcgcaggttagaaataattggaatgatgtggctttatgagataagtaaaaaataacattaactaaatttagtgggatgaactatataagtatatatgatagggtttaacagaacggtcaaaccaaaatattggttaatctggcattgccttaatgatgtggtttttaaccataaaaatatataacattatgcaggttatcttggtgtgttataactggttgtattcttgatgtatgatgctatcatagaaacaacataatactatgtgtaattatgctaattagtacacatttgaaattggtaaccaataagcttttgttctagtttggatgatgtaataccaacagaatttcatattagaatctgtgtgattttaaaaacgttatttcaactgattattttattggtgaaagttaaaggtttgtgacgtttgtcccatcacgttattttttttagttcttttctttttacttccgagatctttttggttgtctgtcctttggtaaggaccggagacgtaattcatttcctctgtctaaaaacatattagcatcaaacaataatcaataagaggctaaactgcagttactgtactttattcatgattatgcttattttttgaagcctcgatgtgttccaaaatcacactttgaattttctatgtgctcggtgatgcgtgcctttcaactttttgatgcggatgtgacgaactaaaatttgacctgagttaacatacaagagatgatgcgccttatgtacatatggacagtagatagttgccggacagccccgctaataatgtactagtcctttggaacttttttgttaccagcacgctctcaaagcggaagaactactccggtggcaaacacactcaagatacatcatacatgcatccatttcgctaattaatttgttcccttaattggcactttgaatctaagagtgtgcggtttgaacattgataaaacctgcacatcagcgtgaacttgatagagtttttttttaaaaaaaataattaggcggtgaacttgatagagttagatcaagccttcaactgccgtgacaggagaggctttgtctctgtgcatgtccacgtgttatcgctttcctcacaattcatcgcactctcgctcgttgatgtactgcctccccggctcccccgaagtcagaaatccacaggggatcggagcacagtgtgtgacgcgcgcggcctataaagagaccccgagacgctgcccctctttccccgtgtagagttcagaagctcctttgctgagacagatttccgagtagccggcgaacgctttgccttgctcgctgtgtagctagcggagggcttggagcgatcgagcgatcgagcgcgtttgcacggggctaagcgtggaggagaggccggtggtgagccagcagctgtgcaggcagccaggcaggcagcaagctagcggccggctagtcgatcgcgcgcggctccccgcgcaatggcggcagggacagaggcggcgcgggactacggcggcggcgtgacggccagcgtcgtggtgacctgcctcatcgccgcctcctgcggcctcatcttcggttacgacattggcgtctcaggtatagtagctgcctccctcttctcatcgtatattctctgcgaatccgagttgatcaactaggtagaaatcaacctcttgcgcgtctcacccgggctccggccggtaaaacactaaaattttcgaataatcaggtgcggttcggttgggtcgggggtagggcagtagcattttcttgtaatttcgatgaaaggggatgggtagcgctgtaattagttttggagcgaagctgcgaagcgatgtttttgccgctccatctcgatagtataattttttggagcgattcaccccgctccgctctattttttggtggatctatcgtttggcacagctccagctctagataagttggggctgggagctagacctatgttaaacggggcgttaatcaaaacacacaaaaaaaaaatcctcatgtttgactgctccagcagcatgtttgttgatcttcgaaagaaagacgcattcatcaagcatatatcttattcttcctcaccagctgccttgatttactgacacagtaccctgatatgctaatgggccagactaggttggttggttgggaccaccgaaccatcctaggcaagtactattctgttttgggatttgggttgtggaaaaagccagatttaattatgtggcgctaaaagaaatacttgcccttcacataattttggaggccgggtttgtggcattttgcctttaacgtactgtcatgaggttcattttatcagcatttgggttccaataattaaggccatgattccaaaccaacaaaggaattacttcttccccttccaaagttagtgggtgataatatggtgtcacgccccgaactagtcccgaccgggactagcccgtgacgctccaaattaacctgttaatcgataccagtcccagaaaacagtgctggtatcacaggaagacagaatatcacagcaacagaggtctctttattatagagtaggggtacagtcatgttgggctgcggacagatcccgagcttacaactgcattacaaaagggaagcggaagccaagacttggaccaaacatcacaggcgcgacttggggactaggccgaaaccctaaaactcatcgtagccggcttgctcctggaagaactcctcgtcagcgggatccgcttcatcttcttcagcaactgggggggttatttatatagagcaagggtgagtacaggagtactcagcaagccatgggaaataagtgtttaatgcaggcttcaaagaaagactattgtttttgcaattgattttatttgaactcttttctgaaacaacgaagtgagtgcttctcaaacgacacggatgagacagtgcgtctcgtccggtcggagtatgtgcaatgtttcagtcttttgaattgatcaagattggcatccggccaacagctttcaaacggccacccgggcctggctgatcccatcagccgcagattttccaaacatcaaacccattccacaacagcaaatttcacaaggcagtagtcaaacaaaactacgctaggaatcacctcacatccgcccatgaccgtgggcacggctgttcgaacagttttaataacctctgcagagggggtacactttacccacacgacattactaacccggatcatccagcccgtgcagaacggccacgactagagaccttaaggctttcatgacaaggcatttcgaaagccgacacaggttcaccatatgccaacgagaggggtcccagaccaacaccagattaggtcccagaccatactgtgccaggaagcccaggggtcctccccgataccaccccggcgaatccacatgtctcttagtatcaaggttcccccgataagctagttactcagccaggggtgtcccattccacccatgtggtcgtacttgtcttatgttcggaggagatggattgaggagggagaacggggagatgcgctatcgtgcggacggggcgcagtgacgatgggccgacggcacgggagtgatctctccggccttgggccagggaagaggaggaagacgagctcccggagtccccttccgcgtccacgaacgcaccggctctcccggtgcttggcgatggacggcggaggcgagatagaggggcggcaaaggcgcggtggcgcgagcgaaacgggaggaggaattgatgggagggcgccttggtttataggacgacgatgtcggtttggaaaccgaccttgggcggtcaaggcgcgagctggcgctcggcgctcgcggccaaaacggtgacagagacggatgacgccggcggggaggggaaaaggaaaaaaggaagggagaaagggagcttgccccttgcctctttggggaaaaggaggagggagcgagggcgacgcggcagagggaggaggagctctgcctccgtcccttggaggctagcgcgtggagtggcggaggccgggtcgtgacgacggcgatgacggccgggcggtttggagcggagcgacgacacgggcggcaggcgcggcaggcgctgacggcggcggcgactggccggtcggccaccatggcgcgcgcgcgcgggaagcaacgggcggcgcagcgatttgggcggcgtcggcgggaaacggcagcgagggcggagggcgctcggctcggcgcggctcacgcgcacgcgtgcgcagcgcacgggcagagcgggggagagggagagagagagagagagagagccggggagggagggggagatgggccaagaaggattcggcccattgaacccgagggaggcgaaatagacttttgtggagggatttgatttgggaaggatttggattcgggatgaactcgatgatagatcgaggatttgagatctgagatggcacggacactagacaacaagcaaagaaacagatttcgcaattaggatttttaagagatagttttcccgctaggcgtcacgacggaacgggcgctacatatgggtgggtttagttcacaccaaaattaaaagtttggttaaaattaaaacgatgtgatggaaaagttgaaagtttgaagaaaaattttggaactaaactcggccatgtagtgtaggtatcgaatacttctgttgtttgattggtcgatcaaaaggtagatactaggttacccagaattcttctgtcgcgttcgcgaaaaataaacccagaattcttttgtcagagatgggcacacagttctacgttttccttcgcgccacaggcagctttagaactcatttgatatagaggatttataggaatttttgcgtaaattgaactgcttcttgtgaaatttatgtaaaattttatccttccgaaaggtcgaaaggagcccttatattgaataccgtagatatttggattgaaatcaatttctatttaaaaccattttcgctcctagctagaaacatctccatcctcctaaatttagtagcgccgcctaaagttttatcaagatatatagagaataaacttatcctttcagttggccttttgttagttggaaaaattgctctctagttatatatgatgtagatgtcatcgctgacttggtggataaggtgctcaattgtttgttcttattaatagttccatttgatacagagtctgatgcaaggaatattgtattatcagagtcactacatagtacatatctgggaatcaaatttgacttagctttaaaaaatccacaccatatatattgtctacaagataaagcaagatttagctaaaatattgtacaggtcaaaaataatcttggacatattcattagcaatttttttaagatcacagattttttttaaaaaaaagaaattgttttgtcatggagagctccaagcctccaaaaactagctaggctgtccttgagaggctacgatgcttgccagctgagcctgagtacctgttattttcaccgttgctagtgatcgaccgatcgcttgatagctctagctctagctagaatcttattccaatcgaatttgatcgagtttcattatgttgcttaacacggaagctaacaaggatatgtcaaaagcaccaacacattttgccaaaaaagcatgtagggaatcagatctgcagcaatgcttcagggacgtaattaacaccacaaattattcactagattattgaagcagattatttgctgatcactcgttttaagtcatcttttaagtttgtttttttctaaaacatctaatttatcaagtaaataatccgtcacaataatccgctaaacaatccgaaaggaaaacgacctaagctaggcacttcacaattatattagcaaacgcag

SEQ ID NO: 43355 - DNA, 1210 bp, Oryza sativa
tctctctctctgttgcacaggtggtgtgacgcagatgcaatcgttcctgaccaagttcttcccggaggtggtgaaggggatgcgtggcgcgaagcgggacgcctactgcaggtacgacaaccaggtcctgacggcgttcacctcgtcgctgtacatcgccggcgcggtggcgtcgctggtggcgagccgggtgaccaggatggtgggccgccaggccatcatgctgaccggcggcgccctcttcctcgccggctccgccttcaacgctggcgccgtcaacatcgccatgctcatcatcggccgcattctgctcggcgtcggcgtcggcttcaccacgcaggtcgcggcccatttaaatttagcccaacaaatatatcaggcttagacttggcccaacccactaagataaacttattgaggcccaccatattaaatgggcccatttggaaaaaattgcttttgcgtcgcaggcggctccgctgtatctcgccgagacagcgccggcgaggtggcgcggggcgttcaccgccgcgtaccatatcttcctcgtcatcggcacggtggccgcgacggccgccaactacttcacggaccgaatcccgggctgggggtggcgcgtctcgctgggcctcgcggcggtgccggccacggtcatcgtggtgggcgcgctcttcgtcccggacacgcccgctagcctcgtcctgcgcgggcacacggagaaggcccgcgcgtcgctccagcgcgtccgcggcgcggacgccgacgtcgacgccgagttcaaggacatcatccgcgccgtcgaggaggcgcggcggaacgacgagggcgcgttccggaggctgcgtggccgtgggtaccggcactacctggtgatggtggtggccatcccgacattcttcgacctcaccggcatggtcgtcatcgccgtcttctcgccggtgctgttccggacgctcgggttcaacagccagagggccatccttgcctccatcgtacttaccctcgtcaacttgtgcgccgtcgtcgtgtcttccttcaccgtcgaccgcgtcggccgcaggttcttgttcctcgccggcggcaccgccatgctcctctgccaggtagtaccatgcaactcactctccattgttacgtcacaagtttcagatagttttaattaacttttaaaccgtgtgtgactaaaatcaatcaacgagtcggggcgggg

SEQ ID NO: 43356 - DNA, 3300 bp, Oryza sativa
ttcctgcagccccgcggaaaactttgctaaactctccacgagacatccctgtgtctatatggtatcaaaacagttatgaaaattttaacttgcatgcatgccatctaagaaacgagggacttttccaggagagtttagaagaattcagtgtgtgcgagctcatccatgtcttggttggcatgcagcttatgtgtcagtgtgacagtgtgtgacttcattgttctgctgaaatcttcaaactgtggtttcggttgacaagcatgcatgtggtaaacaatgtgtcaagttgtaaacagatatagcttatggccaactgaacatgtcggcgtgagttggcaataagagcgtccatggagtgtacaccaaccagctagatgcgtgtttgcatgtttttgttgattgattaatctgtaaagggaaagaaggagatgaatgttgttgattaaagattgctcaatgatcatgggttgtgtattgacttccatatttttttagggattaattagttgttctgttgacaccgtgcatcacgtgtgcatgcaccaaacaacaaaccagtttacttggatgacagcatatgagttgcaccgtgcataataaaataacctgtttaaaatggataatctatcgaggcgtttgttagtggtgctactccgagaaagatgagaaaaataaaacagagcaaataaaatgttttagagcagcactttaattttgtatttttaatagcggtttgagaggaaagtctaaaacgtagctaggcagcgatggaataacgacattaaaactaaaaccaagtacaagttagcgagcagccaatggagctacttgtgccaatattttttaaaaaaattacacagtacaacgcaaacactcacaacgcacgcacactcatccctatgaacacacgcacgcaaatcctacccctatgaacatctttgaagactgggccagtaaatccatcctaaagattgacgaagtcattacatgtgtctcgctgtcgagatagtaaccaatatatagtgaaaagaaaaacatgccacggtcgttgcataaatcataaacatgcatggtacgctagatatatctttcactagggttttatgggttaataatcatttaatttcaagtagttttagtcaagatttacaataaaatgatttttttttaaaaaaagaaaactatgcgtacgatgcactggttagttgcaacatttcaacatttttgtcacgaatttgtggatgttgaaaatacccttgaaagtcaagggatttgcattgcggggtaatcttacaaaacacaatttggtaaaaagaaatagatattgtttttagcaataatgagaccgtatccggatccaacatttcttttgtctcccccttagttcatttaggttgatgatttgctttgtgcatcaaaggtgtagtggctggatatacttattcatttatttaaaatgggaaataaatataataatatactctccccatcttaaaatataatacttcttgttcaaatacctatccatggattactatattttagaacaaagatggtactaaaatagcaagtatgttttacaaccatgacctttccacaatgccatgcactttccaatcttcatcctgtatttatgttggtttttgcaatgtgttttttaaccctgaaacagcagaagagatttctactgtaatttatgcaatgtgtcattaatggtttttctttttttcaaaactgttgtgaaggagagaaagtgaagtgcttactgactcaagtcttcctacacctatagttgtgacttgtgagataactagaaaattaaggcctcttttgggacatggaaattctatgggattttcactagaaatcactttaacgcaagcaatagttaataaaaagctttagaaatttctatcatatgttatcggtgaatgcttgggtctgcaaaataccatcaatggacatgagttttacattactatactatcaaacttcttcctttttgccatcgtcgttagagacatgttaacctttctccgttttggagttataaaaagtccaagttacccctattgtaacaggggccataaaagaccgcaatggtgcccctagtggtaagatggatattttacagtgtaaaagagaagacatgttcttaacgacgatagcaaaaatgaaaaaaaaacggaacgatggcatattatagtgcctgatattatgtaagaaggaagttgtcgatggcgtttttagaacgaagtctttgttgacagtatattgtctaatttctctaaatttttttgtgtgtcaaagaagattttggtacatgtggaatcacaaacttttgagaattcctctagctagaaactgaactatatcagttaatgaaacacatgttcttgatatgggctctaaaccgaaggtggagtcttccggcattatcggtaaaaaagaagtaaaaaataatctcaatgtcaacgccctgccagttatttgaagcattctgcaatgtcttcttgcaattaaatggcgatatttagccactatgagttattcacataaccacttgctatggacagctaggctgttcagatgctgcaacccgtgcatctaagcttgcatccctaatgagattaagatatcttgaaagatcgttgtgtagataccacagaaatatactagtataatctaggctcaagtggctcagaaacagaggcttcctgcactcttcaacggatccaaacagaggatgcaaagcacccggctaagctatatatactgatatacagcatccacgcacagtactaccttgcaagttccaaccattgttataggcaatctgatcagagcaagagagcacacgtttagaaatggccggaggaggatttgccgccgccggcggtggcagtgctcgcgactacggcggcggcatcactttctccgtcgtggtgaccagcctcatggccgcctcctgcggcctcattttcggctacgattctggcgtcacaggtgcgtactctactacagctacaggccatggctacagcttcttgagctgttcccagccctgttctatgatcatttctactagcttacaagcatgtggtcttcaaaaaaattctttcatgtttaaagcagaattgtttcttattacatcccctcaagggattaaaacagttttctcttttcgttacttattttacctggttccattatagctggtgtgagaaattaagcagtttgtcagaatgatttatttgggatgatattctgattttttccaagactggtcactagagaact

SEQ ID NO: 43357 - DNA, 12365 bp, Oryza sativa
tcatctcaatcaggccagatttgttaggatgcaggaaggcatctatatatcccgcctgaaagttacgggctccatcggttgcctacgggtgattataagttgtaacggtttataaataataaaaaattatttatagatgaaacttttacatatatatccttagccacttagaagtcaatgttgatgttgaaaaagcatcgaaatcaactttaaaattaagttttaaaatttaaggggctgttcagatcgtagccaagataaatcttaccaaattttggcaataccaaaattttggcaatttgacaatattgctaaaattttagcaggatttcttatgtatttactaaagtttggcaagaaactaaatggatgtacatattgggcaactctacccaaaaaatggtatcgtttgaaatggcatcaatttgaacaagctctaaattttaacaacggtttaaagcatagagtaaacaacgaggtccttggacttgtggcaatgctcaaaatttttttctataggagaattatatatatgcatacccatacattggggtattgtgtgagtgtgtttagaaaatttctccttccggttataaatattttttaataatgtccggttataaatatttgatattttagaatataatttctcaaaatctgaaactatggccatcaataatctctactacttaaaaaataagaggtgcttccatcgtacgtcaaaaaaaccagacgaagaaaaccgagcgaaaaaaatcgggcgaaaaaaaagagtccgatcaaaaaaggagaaaaagcgggagaaaaaaaatgaccgatcaaaaaaacggagcgaaaaaaaaaaccaaaagaccgggcgaaaaaaccgaggaaaaaaaccgggcttaaaaaagagtccgatccaaaaaaaaagggagaaaaaaaagaaaaaaaaatgtccgatccaacaaaccggaccgaaaaaaaattgtccgatccaaaaaaatacggggcaaaaaaaagaactaaacgaatcgtttaaaaaaagagcaaaaaaaatttaaaaaagtgtccgatttcaaagaaaaagaaattatatgtgatacggtgaaataaacgaccggacgaaaaaaataaaaaaaagggcgaaaaaaacaaatatgtacaataaaaaaggaaaaaaaatcaaaacgaatccgactccgtcgactcggtaataaaagggtgaaaaaaaataaaaaaagtctgattccaaataaaaagaaattatatgtgacgcagtaaataaaatggaatcctatttatatctagaaaggtccgacactataagaaagtggcgaaaaaaaccgttcgtaaaaaaatgcactacaaaaaaaaataaaaagggcggaaaaatgtctaatttctattcgtcgttttagtagtccgtttatatctcttctttatctctaatctaatctaatctaactattttaaaagagaagtttctaccgtatattaaaaaagaaataaatgcctgagaaaataaatacggtttaaaaaacgcgtgaggaaaaaatgtcagaaaaaagcgcaaaagaaaacgcgctagaaaaaagttccgtagtccgtaaaaaagcacacgagaaaaaaatatttccatcgtctatagaaaagaaaaaaaaagcatacatggaaaaaactattagaaagaagcgctaaatagatagacacttggtcggataggatccattgactttttttctatctcggggtacacgacttttgtttcgtcatctattctcctgtattggagaccctgcatatcttcgtaggcaattatcatactatttttgtgaagtatagctactattcttgataatatattatatgaaataatattagaaaataaacatattttaattgttatacagataagagtggacagtgactctattttgtgtagacttgatcatacgaggcaatgcaggacttgattggttgcaagaatgagattaaaagaatattttagattatatgcatgttgtcatatgaataatccaattattttaagtaaagcaagcatcgtaaggttgccatcatcgaggttgggctattacatttaagatgttccaattttctgattgtcatcgacatggttatgcatgaaaaacgtatattatcattacgttttttcacccgttgcaacgcacgggcatgtttgctagtttctattacatagcaaacatgcacacatacacaaacatgatgtgtagaaaacacacaagatattttcatgggtaccaaaaattgagtcctggtaggtggagttcgtgcaccaataactccaccatcacaccatcggtgtttctattacgagacaatccattatgtgcctttaactttgtcccaattctacaatatgccactgagtttaccaagttatacaatataccattgtattttgtttaacttctataatatatcattgtcgtctagttagccccattagtattgtacattcctaatgactgaaatacccctgaagagaaaatttccaaaatttggccgaaattccgaaatgtcatattgtaaactaccacggaaattgcccatatcaaactttggaagttttacaatctaatatttcatgattttttaccaaaatttggaagtttttatcccaagggtatttcggtcattaggataaaattgtatagtactaacggaggctaactggatgacgatgatatattattattatggaagctaagccaaatgcaatggcatattataaaactagacaaactctgtgacatattatagaacgggaacaaagtcagtgacacaatgtattctctcttctattatcctaatataaaattaatggttaaagtttgatagaggtactacctgatgcctccgaaaggcatacagagaagtaaaagtgtgggaaggttcaagttttgatgtgtaaaatggtgtaccaattttccgggtaaaaacttaggcatatactccaccttatttagagccaaatttaaatgtggtactgctcagagctaggtttgttgttccttttttttgggcacagttaagcatggccaagaaaaaagacgtataccattcaatcataggatgtgtttagttcacgttaaaattggaggtttggttgaaattagaataatgtgatggaaaagttgaaagcttgtatgttagaaaagttttaatgtaatagaaaagttgaaagttcgaagaaaaaatttagaagtaaactcggccatattattactccgtactagatactgtattaccgtgctacttgtcggtccatgactcctcgttgattacaggtggcgtgacgcagatggagtcattcctgagcaagttcttccccgaagtgctccgtgggatgaagagcgcgaggcgcgacgcctactgcaagtacgacaaccaatggctcaccgccttctcgtcgtcgctcttcatcgccggcacgctgtcctccctggtggcgagccgcgtcgccagggcggtgggccgccaggccatcatgctcctcggcggcgccatgttcctcaccggctccatcatcaacgccgccgccgtcaacatcgccatgctcatcatcggccgcatgctgctcggcttcggcctcggcttcaccctccaggtacaacgtggaacacaatatgatcagggtttatcataccgtacggttatatcacatgcggtaatcttttcagttttttgaaaccacggtgtactccacaataaccgcatggttaccgtggtaaccgcaaaccgcagggtgacggtaacaccatcccaaacggtttggtaaacccgtttggtttggtaacgctggatacgatacgatacacaaggcccagcaatctaggcccagttcatcaaatccagctcagttccaactcttcttttttatatttttccggaaaaaaaaagggttacatttttgttgctggtacagtcagctccggtgtatctgtctgagacggcgccggcgaggtggcgcggcgcgttcacgtcggcgtacaacgccttcgtcgtgatcgggatactgtcggcgaccatcaccaactacttcaccaaccgcatcccggggtgggggtggcgcgtctcgctcggcctcgcggccgtcccgggcaccatcatcgtcgcggggtcgctcttcatcccggacacgcccagcagcctcgtcctgcgcggccaccacgaccgcgcccgcgcggcgctgcagcgcatccgcggcgccggcgccgacgttgacgccgagctcaaggacatcgtccgcgccgtggacgaggcgcgccagaacgaggccggcgcgttccggcggctgttcagcaggcggtacaggcactgcctggcggtggggctcggcataccggtgttctacgagttcaccggcatgatcgtcatctccatcttctcgcccgtgctgttccgcacggtggggttcaacagccagaaggccatcctcggctccgtgatcaacagcatgaccaacctcgcctccacgctgctgtccacctccgtcatggaccgcaccggccgccggccgctgttcatcgtcggcggcgtcggcatgatgctctgcgaggtggccatctcgtggatcatggcggaccatctcgggaagcaccagggggtgacgatgccgcggagctacgcgaccggggtgctggtcctgatctgcctctgcacgttcagcttcggcttgtcgtgggcgccgctgaggtgggtggtgccgagcgagatctacccggttgaggtcaggtcggcgggccaggcgctgagcatctccgtcgcgctctgcctctccttcgtcgagctgcaggtgttcatcgcgctgctctgcgccatgaagtacggcgtgttcctcttctacgccggctggctcctgaccatgacgatcttcgtcgccgccttcctgccggagacgaaaggcatgccgatcgaggccatgcggtccgtgtgggagcggcactggtactggaaaaggttcgtcaacgacggcgaccaccacgacggccgtgtcgtcgccgacgagggtaccgattaaacatttatccggtgatttggtggtgtgatgaaccgtgtgatgtatgtgcagctgcacggctgtggccgttgagcatgatctaacatttcagtggcatacattgcccattcttgattaatttacccaaagtcgtccatcttagccttatactacgatcgagaacgcacacgctaactaaatttctgagatcaaagccaaacattccgcatcggcatatgcggtgcaaattttaggtcgacacgtcgccgaacttgtggtccttgacgaacctgccccagtaccagtggcgcgcgaagacgtggcccatggactcgagcggcacgcccttggtctccggcacgaaggcgacggcgaaggcggtcatgacgacgagccacgacgcgtagaagaggaaggtgccgtacttgaagcagcagagcatggcgaggaagcactgcgcctgcacgaagttgaggcccaggttgagcgccaccgccacgccctgccccgccgacctgacctccaccgggtagatctcgccggggatggcccagtacagcgccccccacgaccagctgaagctcgccgagaaggcgcacgtcatcaccagcaccgtcaccgcgtaccccttcgccatcttgctcccgtgccccagctgcgaccccacgatgctcgccattgccacctacgatacgcgtcggctcgacgtcactttcttgttgctgaaatgttgatgtgcgctctaggtgagtgtttgtttgcattgtttttacctggcaggtgaacatgagcgcgccgccgatcatgaagagcagcctccggccgtagcggtccatggcgaagcccgagccgacgatgccgaagatgttcatgaggccgagaatgacggcgcccatcagcgcggcatcgctctcgaacccgactgtgcggaacagtatcggggagaagaaggccgtgacggccacgccggtgaggttgaggaacaccgggaacgcgatggccatgaccaggtacggccggtactcgcgccgcaggatccgccggaacgcgccctcgtcgttcctgcggtcgtgctccacggcggcgaggatgtcgttgaactcggcgtcgacgtcgacgcccttgccgcgcacccgctggagcgcggcgcgggcgaggtcgtgcttcccgcgcaggaccaggctgctcggcgtgtccgggatgaacgccgcgccggccaccatgacggcggccgggaacgccgcgaggccgagcgacaggcgccatccccacacggggatccgcgacgtgccgtagttgatcaggttggcgatgaggtacccgacgctgatgaacagcgggaagccggagatgaacccgccgcgccaccgcggcggcgacatctcggcgaggtacaccggcgtggcctggcccgagaacccgagccccaggccaagcagcatcctcccgatgatgagcatggcaatgttgaccgcggcggcgttcacgagcgcgccgaccaggaacatgctgcccccgatcagcatgacggcctgccgtccggtccgccgggtgacgcggctcgccaccagcgtcccgaccatgccgaacgcgtacagcgacgaggtgaacgccgtgagcgcctggctgttgtagatgcagtacacgtccttgctcgcgtgcgccgtccccttcagcaagcccgggaagaacttctccaggaatgactccatctccgacacaccacctgatgttcgtcgcagacatgaacaagatttgtatctcaaacgtaacgaaggaaaccgatgataaattgatcacttgcagaacacgagcaacccaggcatcagttcaagtttcatctttgcgaccaactaaaactagaacatatgagagtgaataacttgtgtcacgtaatattttgtgttttacatacactttttctgccatgcaccaataatcatacatgctggagatagtggtttcgagggatctagattgtcttctactcttctatactgtagacaaccattaagctatgggggtaacagtaaattactgtagtgagtgacacgctgtagcgattactgtggtactttgatctcagttgggcattttcaaattccaatcagatggcaaagagaagtcataatgcaaattattgtctctttcaatggtaagccacatgctactacaaaggatccaattcaggtgctgtgtataataatagtaaggaacggcagaaaaagaaaagctttttacaaaacactatggatgcaccatggtcatttcattagaatttatttcttttcacgttgatagggattcctagtatttctatttgacgcattttagtcttgatcaatcatcacatcaacaacttatctccttagaaaaaaaattccgatcctgtcaaagcccacacaccatcactcaagacatgataaaaacccgattccccgatccaaagcaagatttctaccatcgagtggcctacaaatactactatactcgcctatatagcacatactaataatctcgacaagcaagctagccatgccactgaagaaaaagaagcaatcataatctctcctttcttttgttgcaggaaagcaactgagaccaaggattccaggaagatgcccgtgaattacagctcggggtttagcgcagaaaagccgcaccaaaactcgcggcaacaaaaggaggggcaaataagatatacgacgagacgccaccatgacatctggtctgaccgaagcagcagattgcacacagaacgtccaaagttgcaagtaactgtcgatgcacacctagcgacaagttgatgtactacgttccgagcgtaagatgtgggagcagctcacgtccttttcccacattccacatgagcctcatttaaaattcatttggaagatgaggtaaattttgaggtatataaaatctgtactcatttaggtctcgtttggaagatgagaaagttttacactattaagtgtgtgcttcatataggctcccatcggatggcccaataagccaaattttgaattttcaaacttaattttgagatattttcaacgtagttttttttagcattggcttttaagttacaaagagcacatatataaaagttttacttacaaatttatttttattccctaataagccgttttggcttattagaaaaaaaaaagccaaccgatggagcctataaaccctaaccgaattttaaattttagaagttaattttaaattaatataagtgtttttagtgttttttattgtttttgtttggtattggatttaaaccactaacagagctatatcaaattttgtctctatttttttttgcttcgctgacatgttttaaccgaaaaataaataaaagaacagaactatataaaaaactaattctaaaattttgcgtttcaaacgggcttaaaactttgaaatacagaaagtggtaattcccaagaagattactgctgctatgtgggaatagaaaaaaaaatgtgctgctcaaaataaaatctcactatcttccctaaaaaaaaaatctcactcatctaaaaatatctcaggtacccctcaattctaaaaatgactttgatttttggctcagtaaagctctgattctaaaattatgtttggttgtcagccacattttaccacagtttatcatgtctaagattagataagtttgatcataattgtggcaaaattcacttttaataaatcaagtcccacacgttaatgaatcaagaaagtgtgacaagattatcttagacttgttaatgtgggactcagaatttaattatctcaacttaaacaagtactaacaatatttaaaaacgtggtaaaatatagttaggaaccaatcacacttaacagcctcacgatggaaagagagtcaacggacatacttatgggctctaaaggtttaactgtaaccaacctgacgtgtctaatggcgctccacgagaagatgggtaggccgtacaccggccgctcgctggccccgccgccgcagtgtggccatccaattcgaccggattgtgtcgcctcacctggtcccgcccaagcaggtgaacgggcccacgtgtaaggatctgccaggtggggccccacctccgcctctatcccctcctggccgtccgatggctaacgcgcggctcggatcacgcttcctcgaaagatatctacttcctggattttcttctgtgatgtgcccggttaatcagcagctgctgtacgttcggtttgacgagagaacaagagctgcgtcctcttcggcctctctgggctttgatttgaatgaacgcggaaatatcacacgagaactaattgttctcccgtgaatcttctcaagaatagaaaaaaaatatcctcttcctctgttgtaaaattcaccagtttgattggattagatttgttcgctcgcgtgatgcttacacctgcgcgctgatttttttttagattattaaaaactgaggccagatttggactactccatgtgttgggaatctgccgtggaagaagcagaaacggaataaagaaaccaaggggggcacagggcagcagttgagatgcggctcggccatggccgcttcagatcaaagaaaatggtcttggcttgtagcgagtgacttgagagacccaggaatcaagtcctcaaagtgggctagccacaagccacaggagaatcgtatcgttgtcgtcgaggtcgtgatgaggggagatatgatggattgggagaatcaccgactaaaatgagtggtaaatcaaatcgaatcctacgcgatacgtgtgcagagatttcagaagaagaagaaaaaaagaaaaccacggaattaaacattcagaaaaattttcagaaaagagcacccccaaaccgcatgcaattgcaaagtaagcgatcgatcgaatccgatccatctccagcgcacctgagatgccaatgtcgtagccgaagatgaggccaccggaggccgccatgaggcaggtaaccacgaccgggaacgtgaggccgccgccgctgccgccaccgccgccgtagtccgccatgccgccgctattgaggagggagccgccgggcattctccgtcaccaatcttcagagcggccaaatgttgttgctgctgctgctgctgatgcctgatgatagtgttgggagtccaaagccctccaggggggagagtctttatagccactggcctgcctgcctgcctctgtcgctagctaccactcctactattcctactgccaggaccgtttaattctggcccctttcacatgaaggcgctgctctgctgtgccgttgcgttgcgcgacctgccttatctgcccccgccagcgccgcacagatcaggcggccgggccattatcccaggagggaagaatggacaaattcttcgtttcgtttcaccggcgcgcgcccgcgtgaagcggctgcctctctcgagtctcgactcgacacgtcgtgacaacagggggagtaacagtgtcccaaatgcggccgatatgatgtgttggtgcggttacaagattggcgccgagcgcgtaaaccggatcggtccgttttggtggcctacctactatgctgccccgattggatgctcgcgtcgcatataatggatggcacccgagcatatatgtatcgctattcgctacaagttcctgcagcttttgtgcatgcctctgtggcatatatgtgacatgtatagtcccgtcctgcacattatgaccggccggttgcacgctacttcagttccattggtctaacagatgtgtaatccaattgttccggtagctgatgaagaaaggtatacatggttcacactagcttgtagattaattcaccgtagcacatcctagtcgattcttcctcaatcccaaaacaaactttttttagtgtgaatctggacataccctaagcatattttatttttatatatgaaactgaaactgaaactgaaactgaaactagagggagaaaaggtgtgatggaaaaactgaacttgtactctctttttttaaaatgggaaagctttgctctcctagtatatatatatatatatgtatatatatgtatatatatatatatatatatatatgtatatgtatatatatatgtatatatgtatatatatgtatatatatatgtatatgtatatatatgtatatatatatgtatatgtatgtatatgtatatgtatgtatatgtatatgtatgtatatgtatatatgtatatgtatgtatatatatatatatatatatatatatatatatatatatatatatatatattaacacaacaagttcatctgtgcacgtataccacatgcgcgcaggtgtgttgttgttcttctgcgttgcgcctctctctctctgtatatatatatatatgtgtgtgtgaatctagacatacttaaaaatatatatgtccagattcatataaaaaagatgatttattttggatggatagagtatatcggtgtacggatgaacgtaaaccaacggtgatcggttcatccaagagctggcttaccaaatttaggttggaaactttgggatcatacgcacccagatgtggaggaagaaatcagcacccgttccaatcccctagcgcgctattctagctatgtacggatgcacctttgttgcacgtcagtcggaaggcaagaaaatagtacgacatcgacatatatacccagaagctagttcacgtatgcgccgatcaggcatcccgcggttgaaagcttaataaaaagtaggcaaaagcacttgccggaaggaggcgtactctgttgatatccatttccatttttctttcccagaatatatgaagaacttgtgcatcacggtatagaatttaagttgcggcagactaaaatttaaaactttaaactttaagctcgatgctttttcatcgtatttattttctaccgtaactcttaggtcaccaagaacatatataaatatatataaaaaaaactatatctataattttttatcactaataagtatttaaggtttataatcacttgtaaatgaatcaggctcatagttttgtatggtgttcgtctctaccgaagatgaagtttggacatggaaaataagaaaagtattagcgcatgactaattaagttttgattattattagcttaaaaatgtatttatttaatattttaaattaacttttatatagaatgtgttcgcacaaaacacaccatttaatcatttaaaaactagctaacaaaaaccaaaccaaggtagaatctatatcttaatcaattgtgaactgggctcaccagtatagccgccagtgcgaaggagcatataaggaacatgaggggctgcagg

SEQ ID NO: 43358 - DNA, 6038 bp, Oryza sativa
ctagccggcttcaccatccgcatcttcatcaggacgccattctagtagagcttggttctgtggcttctcattggaagatctaacatcaactagtccttcgatagagcagttagacagctctaacaacattgcgcagaacccgcaggagcaagatctgcaaactgtcccatggttcaacgcagagttaaacctctggaatggacgcgtacatatcagtataccatgaagctgatgatggagcatcagaggaataatgtaaagactaagaaaacatgatggagcactaggccactatcgccctggcaagcacatacccctaaagaatccttcaatttctttatctccatagattgcttctgagctagttcatgtgattcctgcagtttcctcagggctccactcaattttctctgctctttggaaacctgcttagtgcatcaggaataaaaaataaaaagtaaactagataagccacagatatatcaaaacaaaggtacaagtcaaattcacttatatttatatactaaaacatacttggttttttaaatcatggggcaaccatttcacgtagtctatacttacgtttttctagctacatttacacatctaacttatttatttatcagtacctgagcctctagttcctggatttgttggatagctgcctgctcaatgcaagaccgacgcttgtattcttcctcaagcatgccagttatttggtaccttagttcagccatttcttgggtgagatcttctgcatcctcctttgccttcagtttttgttctcgaagctcttcctaacatatttaaaaacaaaatgcttacattacaccaaatgatcgaagctattcaaataaaaaacaaatggaacagatacatcctcaaattagctacttttggtacagttaacacaccggtaggacgtggcagcgggagaatagagggagggaaagcaaaagtgccgaagtacatttagtagacataaactaaccttgagctgctcaatcagtagttcagattcttcacttcgctttgccatattttcaagtattgcaccgcccctctcatagtattgaccatcaatcttctcaattgttttgtcaacttgctcatcagatgttaaagcagtggcaactcctccagggaacaaccgttttagttctttattctcaagtaaaagatggtcaatagtcttatgtgcctcttgcagctggagctcatactccctcagtttattatctgctatggctttatcagcagaaacatgctgaccaaagctgtcagcatcaaacagtctctgttcaagtgtagttaaatcaagttttaagctctcaatctcacattgtgaatccaaatttacattctcaagcttctctatttgtaaggctgcctttttcaatttctcttcttggcatcggacttcttccatcagaagccagcactgagaatcagaccgcatcagctcatcatctataactctaactctttcaggaaacttttcaagttcagttagtttcagttcaagactgtggatatgctctcccatgatgtttgcttcaacatttcggatatttagctgatcctgcaaatagtctggatttgaaaccaacaaaaactgttcaagtcattgtgttaacaatagcacggactaacagcaaatagagagagtagaaacaaaggaatataccaatttcctgatagcagttcctcagttctgtttccaatttctcgatgtaatgcctgtccttctgacaggccctaaaagctgcatttttgtctagcagcattttctgcattaattaataaaacaattagctccatcggagtgctaacaaatcaataacacaattctctcttatgatacattgttttggagaacatgcgcaatactatcctatgttacattgatttggaaacatatcaaaatgtcacatgatctggagtgtcacttcgaaatgagatggaaacattatcatgccagtacatagaaaattccatgaaggagcttgcaccttacaggcttacagtttgtcatagttatgttcaatttacatgttttataaacactatatgaggattctatcaaacaactgtttagctaaaatttccactttacagtgatagattgacacatataccaggtggaaatatccaagacttctcaccttcttaacaataacaaggaacagttttcaagcataggaaagctcatgaagctacttaggttagataccagactaccaggagtggtaacttaagttcacatgaatcatatgaactgacacctgagtgtaaataacaacctaatcctcaatgcatatcaagaaatggttaggtaatttggcattacacatgtgaccaagtgagtagacaaataggctgagaagaaagtgttctggaaacttgagaaaaatctctctttttttttgtatcaatcattaatttgcagggtaagggagaaaatcttccaagtgccaatatcagagttaccattgaacaaaaagaatgtcagattactggtttctcacaacactaaaaaataccagtgctcccaaaaaattaagttttacaacgaataaatcacgaaacacatgtcaggtacctcttgattgttctctcttttttgcagaacctttgcaccattaacaggataatgcccattgccattggagctactagacatctgcaaagaaagcaacggataagccctactgacagaaaatttggggaactcaattaagatgacattatcctgtgatatcaagcacaagaacatatttactagagtagttactacgctgccatatcgaagctagagattggcaatcactccaacatggactctcatgctactatagttgcaaaccaagaaaccaaaatgcggatccaatatttacatagcataccgaagccgtgccctgaacgaaaacagcgtgtacctctgaatagattcagcaatggatagatacagtacaccaggaatcactatgagcaagcgacgaaatcgagagctactcgggagcaagtttgggctcccaccgctgcctccgaccttagctccgggaagcagtcaagcaggagggttcggccggcggcggaccgcgagttcagttcccggccgcgggcttggcgtcggcgaccgacgacaagcccgccggttaggtcgggcggcggcggcggcggcggcggcggaggggggaagggagcggaacggcgagggcggccggtggccgagggaggcagggcagcacggggggccagccgcggcctcggggtggggttgggtggcggcggcggtggtcgccggagtgggggggtgagacgcgagggtggtggggacttggccgccgccgccgctacggagtaaagcagtagaggctttttgcccacctttctcgagaattggccacaacaacatgcacgccacctatatgagaaaatgtgtgaaccaaacttgccaaatgcttcacctcaaaacatcatccaaaagcgaaaattcatcaaattttggacaagctaagctactactgctcgatttagttctccgttctataagggaggaactttcagggacagtagctgcaagaaagacatatccaaaacttgtgcaatccacttggtccaatgctaagctttgcgaccaaggttttgtctcacagacagatcctcctcattatcaatggacaaccccaaatagcacattactactcaatacgcataaggtttggggtttgcctttcgttgtatgggtcaaacatgagactatatataccaaattctaaactttgcaccgttaaaatgagatgttgatattaaacagtcagctaaaagaataggtataaaagggatcaaaataaaaaaaaaattcaagggtatacaaaggaacgagcaaagctcaggataattttctattactattactaagggtgtatttgtcatttgctactcaatctgccaatgcaactgcattgtgcatttgtgtttcttcatgaatgcagctcattagttaatctagtagtactagtcctgttcttgaatgtctcacagatgtaggcacacttgtccccacttgttcttcactatgacagcatcacccatccgggaaaatcattacccagcactgctggtcaacagtttaagtacgcactgactaaactcactaaaaacggtataagtacaatttgacacttctttgctcaatagctcacacacaaggtttttcttttagataatagctcaacatacacaagtagcatactaataaaaaattgttagttctagatttcatacctcttatcccagtagtaagatcatgaaagaatttaataaagttgccaattgccaaccatgccaaggactactcaactagtgctagatttctgaattttctttttttttcttttcaggttgatcagtgtagcctctatgcgttgtcaatgatacttctccctttattttcttcaggaaggaacagaaagtcaccttctggagttcttgttaatgatccttctggaagaattaatcttgcatgaaaaaaattggctaacttgcaacgatggagaattaattaattgcagggatcgatgtgtgcacccaagggaaaagccggccgtatctatgcaagataagcagcaagcaaagcaaagttgatgccttgatggccgtagttaagtacagggagacatgccagtagaagatgcagcaaatggggaggctgcagcaaagatacgacgtgtttggatgttccaacaactccactgaaacagtttaccaatcactcgctggtcatctcacactaataactagttttaatttggcgccacataatgctggtccatgcagatgcaggcatgcagagcgtgatgattcactgaccaggcatgtgggtacccggcgattctactagtctgattaatcaactttgttaattgagcaacttttgttgtttcagtatttaaacacagcagcaaagttagctgtttatgtgttcaggactggatgaaggtttaacaaaggactttgggctactgacctaatggctaattgacagaaagtgatgttcatattgatacctacagtttatcaagcagttctttaattatatgcatgcagttaaattacgtagtactagctttgcgtattgtactcccttttgaagagctgcacagctattggcaaaagcttgattaggtttgtttttgatgcccaaaaaaatgtcaacatgaagcactagtttattcagcttgctgtcctgtagttccatttagtggactcagtgtttcccatgactagataagttcccatataaatttgttgcttgttccaaacagaaacaatttctttttttgggggggaagaaacatttttttaataaacagtttacaatcttgtaattaactgtgtcattctatcttccttatgcctaggttcataaggagaacctatttacacctcagttagcctagcctgaatattattttttctcacctgaatcttcaatttgagttgcacaccaaagttgtgttactcaccaatgtcctttggttgttaaagtcagtatatgcacgttctcagacagccagacaagtaaaactaaagtgccatattgatagaaaatgttgctccattcgtatgagacttttatggttgatggattatcaccgagatgtattctaataactcgagtggatgttcgatcgtttattgcatgtcaactggatggttatgaaaaaatttcaaaaaaattgacaagatagatcaatatataatatatcactttacaaacatgcaagttcaaattcaacttctataagttgtaacaaaaataacaaatttagttgtaaatatacatatagtaatttaatttttgtttattatttttgttacaatttgtagaagttgaattttaacttgcatgtttgtggattgatatattacatattaacctatcttgttcatatttttttaattttttttataaccatttagatgacatgcaataaactggtggacgtccactcgagctgttaaaatagtgt

SEQ ID NO: 43359 - DNA, 1775 bp, Oryza sativa
catccacattcaaatgtaccccttattaccttgcataggcgcatagttgcatgcattgagaagtaagcacagcactcaacggtatagagaatttttttttttgaacgaatcggcaagctgccaatttcattgaatagagaaggagtaaactttacaagtaagaaaaaccaggcccaggaccttcggtcctactgagctaaaaataaaaagcaagccagctaccaagatgcctcgcccccgcccgagaccatgttttggcctcctctttaattttggctaacagacttcctgtagatagctctttgtgctggaaaattctacgatttctctcgttccagattttccagttgaccagaagtgttaacttgcgaagtgctttctttgggacttccttcaagttggcggtggcctcccaggtatagagaatttgcatttcttcgtctttcttgtttccttttggagtcttgaacaagtgtttgatgggtgtgattgatcactgaagctactacatactacatgacggccaaatctgccgacatccttgtgaattaaaaaaaaactgacagacttggttagcaacaacaactgggaaattaaacggcaatttgggtaattataagcagctagactgattaagaaagaattaagtgtaaataagctgtcactcgcacgccataacatttgcaactatccaggagatcatccatataaaacacatatgtatgcgttatattgccgtgtcactgtgcggtaatagcgtactgtacattactaattcattattattgggtacaaggtacaagaaaacgatggatacgcatgcaattgctacatagtccagcaccatattttagaaaataatcatttggtatatctaccagacctcactggtaaactacgtggtagcttctattgtttaccttgcagtttatagatttgctccggtccaacaaaaagtatctcaaggtaccagtacctctcggtatcaaatcgttttcgatcgttggatctaataatgcccattaagatccaacgataggaaatgattggtactgtgaggtatcggagcaaatctcttcagtttataagccactatcaaattttaaactttaaaacttaagcttaaagttgatattaggtttttttcgttatagtttgttttttaaacatagattttagaagtcactaaggacacgtataaaaatattactcataagttatttattttaccgataaatcgtaaaacaacttattagttgtaggccaaacgataggtaaaactcagtggtaaactaatagtgttatgaataattaaatgtatccaaacaataatgaaaaagctctaaattctttcctaccactcagaaaaaagcctgcaatataatctgcaataatcataaaaagaggtccagtggatgaatttatcagctggcagcaaagagacaaatatccactactttattataagacgatgtatgcgatgttaccatatatcacgccattctatctccaatgaatattgtcggcttacactagcctacccatgaacaactagcgatgcgtatgtgtcattgtagatagatagacaccatctggtcatcgtcattacccccccattacttataggtgtccaaacgggcggcacggcccggcccggcacgggcacgggtccggcacggcccgtttcggcacggcccgttaggcacggctgatgaaacgggccgtgccgtgccggcccacgtgccgagcccgccggcccaagcacggtcccgtgg

SEQ ID NO: 43360 - DNA, 5680 bp, Oryza sativa
  unsure (1)..(5680): unsure at all n locations
aattcctgcagccccgttagtgtgccacgtggcgccttcccattcgaccgccgcccgcccacgtggcgctttcggcctgacgggccgccggcgaaacgggtcgtgccgtgccgcgggccgtgccgggccgtgccgctacagtagccgtgccgtgccgtgccggcccgcgggctcggccagcggcccaagcacggcacggctactcgggccgtgccggcacggcccgttactgtagcaggccgtgccgggccgtgcctgctacaggttcggccgtgccccgggccgcccgtttggcccggcccgtttggccacctctaccattactgctccctacagatagctatatacagttgctcgagaaaatctatatacggtggtatatatccatatcaccatgatcagggttcacaaagccgtctccttggtgggtttccaagttttcacgaaaagtgattaaattttattgaaaaaataaaattcagtttgactttctttaaaaaaaaatcattgatttaccgagtggtttgtcaactccagccaacttaaaaactgtaaattccgtgagagaaaaagagagatgatttttatagattgtgtgaacacttaccaaggtatcatttcatattattctcgtgaagtaagcataactcaattgattagattccttatgataaaaccagtccacttaaatcgaagtcctaacttaacatgagtgttgttatttacgactaattattctgtcgacagcgaggcgtccaaatttgataaaagatatgggcaggttatgtttctaaaaaaagaaaaaaatgtcctcgtagacttgacacgtcatcaaagcagcctccacagcggaccagctttctctctccaatgtaacccccttctttctctctcctcttcggcccatgtgactctctcttctccgtctgtttttaactttgcttccatgcatggatttctcctcccccctctccctcaacctcaaccgcaccccccgctcgatcgcgtcgcccctcgccatctctgcagcttaaccacaccaccaccccaccccaccctaccctacctttcctcccctctactcctccacctccacttcgatcgaatgctcgctgccgcctcagatcttcccgcgcgatcgcgcccagctgggtcaggttcgttcgttcttgatccccggatcctgaattccggggtttcttggaattctttcttgggttcgccatggatgcggggggagtggagctctctggcgtgatgcatcggtgtagggtgtgcgggaaggggttctcgtgcggccgctcgctcggtggccacatgcggtcgcatatctcgtttggggaggcggcggcggagctcggcgccaatggcggcgtggttgggtacgggctgagggagaatcccaagaagacgaggcggctgtctgagtttgatggtgatggtgatggtgaggaggtggaggtggaggagggtggcgatggcggcgagctcagggcgtgccgggagtgcggcaagctgttctcgtcgtggcgctcgctgttcgggcacatgcggcgccatgcatccggcggcggagggaggaatcacgacgacgacgacgatgacgacgtggatgtggaggatgagttcggcggcggggaggaggaggagattgtggcgccggcgccggcggcggtgactgtgatcgcggcgccgccgaggcggaggcggcggtcgatgcgcgtggcggcgcccgcgcccgcgcccgcgccgccgcggccggtgctgctgggcgggttcgagaaggaacaggaggacgtcgcgctcggcctcctgatgctctcgcgcgacaccggcgtgtggcgctcgccggtcaaggcggagacgttcgagaagccggagcagaagaagaagaaggcgacggcgaagcagccgccgccgctacccctcccaagaaacggctacggctacggctacaactccgacgaggattcagctctgctccagtacggcggcgacgtcgcgaagagcaggaagcgaagggctagctaccactctcccaattccatctcctcgaagaagaagcagcagccgcgcgcggcggcgccggcgaagcggacacggtacgagtgcccggggtgcggcaaggtgttcgcctcctaccaggcgcttggcggccaccgcgcgagccacaagcggatcaacactagctgcagcgcccccaaggtctcccccgccaccgccgcggcggcggcgcccgcgccggagccgagctcggagacgtacgcctcgctgagcaccctctccccctcggcgtcgccgggctcggcggccgccggcattggcgaccgcaaggccaacaacaagtcgtcagcggaggaggagaagttcggcggcgcgtgctcctccgacgagctctacgccgagctggagctggagcagcgctcgccggcggcggccgcggggtttcttgatctcaacttcccgccggcctcatcggaggttggcgtgaactgaagcagaattggccgcgtcagcagctgcacggagccaaagatttcttgatccgaaaatcgaggcgatcaatggggaactgtacagattcaattcattccattcattccaatctcgagctccaagctttccaagatcattgaggaaaaaaaaatcgacaagtgatcagagttttctcaggttattccaaagttttcttcatttttgtttcttcttcttcttttttttttaacatttcctttatttagttttctctcctttgaacttctttgaaggggctaaatcacaataagcctatgatgataagagctcacagcatctgaactgattcagttattaatagcttaagattagctcaaagcaactgtttttaactctgttatctgcttgcttttagcaactatccctgtgtcagtatactaactgaatcccccgtgaatttctgggtcaatgctaacctttgctctgctcctacttttgctgcactaatccgagatctgccttgggggaggcaggcagcagcaaagccagcaacagcttggttgcctcaaagtaaccacttgcttcagttgctgcatgcttagtacatcagtactgtcatgccattggttggtgtggctgtgagtgaacattgtgcagcagagaagcaagcaacaatagcattggacccccaagaaccagtacattatctctatctgtgacagagaacacaagaatgcaaatgctgataaagaatcaagaaagcattgtgcaagcagcaaggtgagtagagagtgatggaagcagagagaagctgcagactagtgatgaaaatgattggtgagtacagtgtaacaactaacaacaagtctctatgaagaagcaggtactaagcatgcatgtgtgtgtgtgtgtgatggcatgtggtatcaatgcttctggggttgttcacttgtccaccagagcaaccaggacaagtcttctcactctaccattccggtgtcattttctctctcaacccctcctcttgttgctttagcaagcctgcagcttaaactagattatgttttctttcctcaataaagattaatagtattgttaatcatgacatctttccctcacctgtttctctctcaagagagaggaggaggtgcacaggcacagacagctcacacaaacattgtgttgttcatgtctctttcttgcctacctttgttgaactggtttgccttgggagacacacaggacactcgaggctgcctggctggcctctttgtcagggagaaacctgctaatctgctataatagtgttgcttataattctatgattctatccatcacaaaggacacagtatagctgcatcctttaactgcagcttgcaggcctttttcatcgtttacttgttagcttatcagccgcgaccaaaatttttagtactaaaactcaatattagagttgatgttagggtttttttcatcgtagtcaattttccaacattggctttttaaactcaatcttgttactctgcaatagtatatgccttgcttcagtttgagatattcagtaaactgtgctgctggaaaacaattttttgtaggtccatatgtgttgtggtgttggttatcatgtagctcttgtcgaaaattgaggtgtctgaatataatgccaaaaggcaagcaaaactgcaacgcttgatagttaagaattttgggacggcagaggctaaatagggtgtgtgatatcaatgacaatcagatgtggaccattcttgtgctgttcttctgcggccccatccttatttggtggagctctcgatgtatgttggcgatccacttgtcaggcaaagtctctttgtttcttttgtggtgctaactttggatgttggcctgaattgaccacaataatctactagcatgtctgatcagtgatcagttcgtggtttgatggtaattaagaagctcaaatgtgcacaacatagttgaactgaattatggctgatctggtactgttctactgaactcaattctcagtttagtcagtgattaggcacaatttgtcctgatgtcagatatgagtagcttccattttgcttttacgaagcacataaattgtgccatagtcttacacacactcatcactaactaaatttaaagttattgccagtgacacatccatttgcagtttttgcattgacttgaactgaaggccccaatcaaacaaaaccttttgtttttcctcaacctccatccctgaatgagttagtttacaattccaatttcgatccaaacaaaacagcacgatccttgaccagtaacagcaagtccctagaataataatgccactgtttttcttttaagtctcagaacgagcatgcagtccatcacccccttggaagatcagacacaacaggccaaaatctagaaaagaaatgagctgtcacaaagcttcttctgcatctaatctagccaaagcatcaggtcatcacattccacaacttgtgagaaagatatacacctgcagagaagaaacaaagatctcccggattaatgaccatcattgcaagaaaaacaatgaaaagatactgcatcaataaagccatgagaggtcaggtgatgtgcaggccacacctctatctgtgggctgtggctcccacaaaagtttgcagcttaaccagcagaagccattgctctcctgcatgcctgcattgcattgcaacaatgcagccacttaaccaacctttctttggtctcaaaaaaaaggaagaaaataaaagagaaaagaaatcttttattagcagtcagcacagatccagatctgcctgcctgcctgcttaggtgatcagtacaatgttgctaaaattagccaagtgaatgctccgaaagataagagctctaattggctgtatgtgaccaggtaagtaagcagccaccaacttaacctgacattaattgtagctaaccattttagcttgtttgtgttttttatttgtggcctaaattaaagtcgttaataattcggtacattatttgatgatatactggtctaccagaaacaaaggtagactctatttgtgaattcaagaatgtaataattgggaaggccgattaattagttagtataatgaccaagatcacaccagcnnnnnnnnnnnnnnnnnnnnnnnnnnnnnnnnnnnnnnnnnnnnnnnnnnnnnnnnnnnnnnnnnnn

SEQ ID NO: 43361 - DNA, 6983 bp, Oryza sativa
  unsure (1)..(6983): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacatttgcgttacgtatataaacgacataattcccactaccctgcactccaaaccagcaataatttatcatctagatacacaacaacaatcaccagtcaaccatatattacaccatatattacacagataacaactaaaagtaaccagaagtaattacaagaattgcatctaaccaccgaatcgaatcgagatctaagcagataccttgcaggggcggttcttgataacaatatacccattcttgcggatggttccggcctgctggggataggtcttggacgccccagcgtcggccttcgactcgaaatggtgctcctcagagtccgacatgccgatcttagcgagcccctgataacaaaatcaaatcccaaacatcaaatcaaacaagattgcacaaaaaaacgaaattcccaaaccaagaaaccgagcaagtgtggtacggaagcaattggactacgaaccaaatccgaatggatttccaccccaaattaccttgtttggatagatcgcgaggagaaggaggcggtgagcgagagagagggaggcgccgattgatgataagtgataagctcgcgttggaatcctagggtttggttacatttatacgctgctaacaacgtttccgcctcaccctctcacccgcggagacaccacctgtgacactgacggtgggtcccggaacgacccgtccccacctgtctgtgagcgaggcggtggtggcgtgttacgagagtcgcagccgtcgattcggtctggggatcgggacacgtgtacggctgcggagggagggcatcacctcgcgttcgaaccacgccatgggcggcttggaagaatctttcttccttttttattttttatctttccttttcttatcttgaagtttttatatttttcttcattgcttttcgccgtctcttttctgctgatcggtgataagtcaataatctctcttgtgattccgatcgggtggggattccctcaggagacgtcatagccgcattgttatgagatgatcaaagaggaggagggcctagttggatgtgacatggtgttctttttagatagtgttaaagagagacactcttctttccaaaagaagctactagtacactcaatatctatatatatatatttttagagaagtttctcttaaaatacttatctaatttataatctgtatataccgttatgatcgttacaattaaatctttacaacaagatcttacatgattatattctgataatatatatatatatatatatatatatatatatatatatatatatatatatatgacggagcgtggggctcctcaccgggagaccgcacaggcccccctttgccggttcggccgggggctcagggtgagatcccaagctctctctgtacgtggaaagatcgcgacctatcgaaagagcatgagacacaagcgatgtatacaggttcgggccgctgagaagcgtaataccctactcctgtgtttttggtggatctgtgtatcaaggagctacaaagtgtgagccaacctccccctttgttctaggttccgaatcaggaaagaatccaaaaaatcccccttctccatgggcgaggtcctccttttatatttcaaggggataccacatgcaccctccctttccaaactggacttttcttctcttcataaatggacggagatttgcacggttgccctccgaacgtccttctgacgggacggcacatacctacctccacttctgccgggggcaggcgcgtcgtgggaacgtggctgtctgccgacgacatgatcagtgtcagaccggtcacaaatcggtcattcttgtccaccacgcgtcagcttagcaacgtgcatgtttgcccttcttcacacaacatcttgcttgtaatggttaggatgaagcctggcatatatccgaccggggctaacgtgccatctctgggaggtaacacgctagctccagctggggacgagtgcctagaagctctcgtcttgacgggatggggcgaagcgtgcgtcagaccgcctgtcgcctcctaacccgcgatctgaccggtctgtgactggtcacagaccggataaacgagtgcactgcactgtatttcgtgcggcgtgacacgtttagccgagccgcaataaatgcggttaggtgagccccgctgtgctcacctaacccatacacgcggagtagaacccgcgaggggtcggggcgcctcggccctcgggggcgaggcaggagtggtccgaccccccctcggggagaccaagaggtgggcgcacacatcaccctcgggcccgacgtcccccgagggtgccaggccacgtgggcgattgtgtctgcctcaagcctctagtcgtgatactcccggtcccatgtcaccgacagtagcccccggcgttatgccagggcgatcacctttttcaagggaagcggtcgggcgtgacgccatccctaaagcctggtgacaagtgggaccggtctctacaaataggcagaaacccaacggtcacaaactacgcacatcggcaatggtaactcggctgtcagtaatgagcggtctcttccagactgccacattactcgagtagcacacgaatctggacatggcgattcgtttcatctgaagatatggtaacgtcgcttcggttggcgagcgtaattaacgcgcgcacgatatgatctacctcgaccgccacaaccacatatccacctcatgcgccgcaagcgggcgaatgggattagtggaagcgtgggcgcgagaaacgagggggcgaaatagtgggcgcgagaaacgaggagccgggcacagcattggcaagggtataaaggcactgggaagggatttgtttccttcctttcgccattattccccttgtctttaccgcttgcgccctaactccttcttccctgcgcccttctttcgccacacgcgctcgctctccatcttctcttcgtccggcgccatggcacggggctccgcactgcttgatggtagcgtgctgccgccttcccgcatcgtgagcgagaagcaggctgggttgccgcgccgcttcatgccggaatctgccaccggccgtgagatagtcatgctgggcgagggacgcccggcgccagactacccggggcggtccgtcttctttctcccctttgcaatggcagggctggttccgccattttcttctttcttcatggatgtcctggagttctacgatctccagatggcgcaccttacccccaacgcagtgatgacattagccatcttcgcgcacctgtgcgagatgttcattggggtgcgcccatctcttcggctgttccggtggttcttcaccgtgcagtcggtgtcgccgccgtcggtggtcggtggctgctacttcctgccgcgggggccggtgttgaaccgctacatcccctgcgtcctccgcaagaagtgggatgactggaagagtgactggttctacacccccctcgccgacgaagcgcgcctccgacttccgagccagcccccggcgcaggcctccagctggcgggcgccggtagatctgggggatggctatgacgccgtcctcgaccgcctggcgggcctgcgatcccaggggctcacaggggccatggtgtacggcgactatctccgtcgtcggattgcgccactccagcggcgcgctcggggcgcctgggagtacaccgggtccgaagactacatgcggacccaccagggagtcagatgggattgggctcctgaggacttcaagatattggtccaacgggtgctgaatctcaactccgtggaggcggccctcattccccaaggaatcctccccctctgcagcgatccagaccgcgcctcgatcctgaccattatgatgggggtcggggcctctgaggagcaagctccaaagggccatgacggcgcaggagggagccgccggggggagcaatctaccccgagagggggtcgtgcttctgggtcccgtgtcaggggcccggggagcagccgccctaccgacgcccgggggaagaggaagcagggaggaacacctcccccatctcctccccgagggggcggggcggcgcgtgctagcagcaagcgcccggagggggccgcgccagcatcgcagctcgagggggagcgcaagaagaagcggccccgcaaaatggaggagacagaaccatctcggggaaacctcatttcccttccaaagtggtcgtttaaccgaccccctcgcaggttcgtctctcacccatcgtggctgtattcattctctcaacatgagttttcactcgcccatcttgttcgtcttctggtcttttcttttgtttcagcgagatcccgtcgcgtccctcccatcattccaagtccggccagcctgaggccgaggatccggcggccgcagaggcccgcaggcgggaagctgaccggcgagaggccgcagatcgcctacgggaagccgaggaggccgcccaggaggccgcccgggctcgccaggccgaggaaactgctcaggaggaggctgcccgagcccaccaggccgaggaagctgcttgggaggaggccggatttcgccaggacgaggcgatggcgacttccgaggcagctcgcgaggaggccgcgggcgcgtcgctcgggcccactccctcgggcgacgctcaggcgacaacttccggggcagctggcgacgaggcagcgggcgcgtcgcttgggcccactccctcgggcgacgctcaggctcaaccaggtccggaggacatccctgcgtctggcacgtccatcggcgggccgagccgcgcggcatcttttccgaggcgacttttccccacgccttctgctgccctactgagcgcagagccccttctgcaagccttggccgccgcaaacaccacggtgttggacgggttaagtgcccaggtggaggccctgcaggcagagcgggcggagctcgacgccgcgtgggcgcgcgtcgaagaggggcgacgctcggtggaggccatggtggaggtgggccgtaaggctcaccgccggcatgtctcggagcttgaaacccgtaagaaggtgttggcggagatcgccaaggaagtggaggaggagcggggggctgccctcattgccaccaccgtaatgaacgaggcgcaggacaccctccgccttcaatacgggagctgggaggcggagctagggaagaagctcgacgccgcccagggggtgcttgacgctgccgctgcccgagaacagcgggcggtggagaccgaagcggcgtcccggcggcgcgaagagaccctcgaggcgcgcgccatggcgctggaagagcgcgcctgtgtcgtggagagggatctggcggaccgcgaggccgctgtcaccatccgggaagcgacactggcagcgcacgaggctgcctgcgccgaagaagagctcgcgctccgcctccgcgaggacgcgctcaccgagcgggagcgagctcttgagggggccgaggccgcggcacaacagctggcggacagcctgtccctccgcgaggcagcgcaggaggagcaggcgcgccgcaatctggaaggtgcccgcgccgagagggccacactgaaccaacgggccgctgagctcgaggcgcgggcgaaggagctggacgcgagggcgcgcagcggcggggcggccgcgggcgaaagcgacttaaccgcccgcctcgcagctgccgaacacaccatcgccgatttgcagggcgcactagactcgtccgccggggaggtcgaggccctccgcttggcaggcgaggtagggcccggcatgcttcgggacgctgtctcccgtctagaccgcgccggccggcaagtgggcctctggggcgggcggactgcgaagtacgccgccaaccaggggggcctcgcccagcgcctctcggagatagccgggactctccaacggctccccgaggagctcgagaggacgattaagtcatcctcgagggacctcgcccgcggagcggtggagctcgtactggcgagttaccaagccagggatcccgatttctccccatggacggcgctggacgagttccctcccgggaccgaggatggtgcgcgcgcgcaggtccgggacgccgccgaccatatcgtccacagcttcgagggttcggcccctcggctcgcgttcgccctcaactccgacgaggaggacgatgacggcagagtcggcgacagtggcgacgaggctggcgacccgggtgcatcggggtgagcccccaggcccccgccaatctttaaatagtttcttcttttcttcttccgaggccttcgggcctcttttttgtatagatcaacttaatctgtaatcaaaaatgaagaaatttttgtgttaatttcatcttgctatgtgtatgagatgaggatgatctgtgccgtggtccttttgtgtcttagcttgaataagggctcgtgcccaggttctggtcctcaaaaggcgcgggtcggggcttgtcacgcccagaaattcccgaatagaattccaagcagaatgtgcattaaaatccccgtccaggaccagccggggtacacaaacgacaatgttgacattcagatccacgtcttacaaacatcataaaagtcttacaaaaatgcagcggaaaacaaaagaaactggagctaagccttgactaaactacagcgggaacaccactccacaggcatcctcgacggcacggacgaagcctactcctcggggaaaccttcatctgacacatacccgtcctctggggttgggaaaagtagagcaagactgagtagtacccactgtactcagcaagtcataccggaataggggtatgatgcagggaa

SEQ ID NO: 43362 - DNA, 15834 bp, Oryza sativa
attaccaaatgcggacacttgccaaatgcccctaccagcacacacagatttgcaatatctggcctctctcttctctgcctcaagcttctttaatatatttggtgggatttgccaattgtccctttctacaccttccctcttattattgaaatcacccatcatttttgtccttatgtgctcaaccatggtaattatgggttcatctctagctcccagtatctttgaattgtatgtttcacttatgttgttaagaagaagatctgtctttgctctagaactaaacatatatctacaccaatgcttggttggaaccttgcttagccactcccatgccctcaaattgttaacctttagttcttgcatagcagcattgaactcagattgtctatatgcatatgctgctcgttccatcaaacccttcagatattcccctctaaatcctgcttgggaaaaattggcatgtaggtgcctaaggcagtaatggtgctcagctcctgggaaaacttcagccactgccttgcgtagtccctatatatggcagcaaaatgttaaaaaaaacagttgacatgtattaatgcaaagtagacatatatgatagccattaccttttgtctatctgacatgaatacccagcccccaaactcttctccttttccaatggccttctccaaacatagtaagaaccatgtccaagattttgtgcactcagactccactactacaaaggcaatagggaaaagattattgttggcatccctgccttgtgctgctagtatttgagaaccattgttgagtttgatgtcacatccatctataccgatgaagggtctgcaaccacctaagaagccagtaatttgagcatcaaatgacaagaacaacctttgaaacctaggccttatttctggctcaggtgatacttcgcacttaacaaaaacattgcttcccggattagcagatagcacagcatgagcataatcttgaattcttttaaactgcaaatcatgatcgcccataactttcttgtaggcctccctccttgccctatatgccttacttatgctgacttctatattggtatctcgcctgacacaatcttgaaaggcatgtgcatcccatttcttctcagatctaaagaattccatgtattcattagtaagccatctccagtcaagctgtgctatattgtgtgatttcccacagctatgttttgaaacatacttctttattttaaaggtgtcttcaccaggcaattttgaagcatatatgtaccaaggacaattatctgccttacacttgacagaaacttgattcctatcattcttgcccttgaacacctccctcccctcgttgatgatcatattcttcaaagcagctctgaaaagatcaacattactgaacaacatgccaacttgcatgtgtggacgccgtagggtggactcatcaaaaatgatgtcttcaattcctcttgatctgtgcacatagataggtgcttcgtcattgaaatctattgtgtcatcattgggctcatctgacaaataatccacctcagctgattggcctatatccttctcttttctcttgttagtttttttccctactagttctttttcctgtgtagtttttcccggatgtggttctgcttggttaacctctgcatctatctgactagtaccatataggtcctcagtatcagagtctccttggaagaacattactggctccttgccaatagcaggttccttgccttttttcttttccctcaactgttgctgtacatactcttcatgcaatgtcaaatcatctttatcaaaatcacctgggacactgttatgatgtccgattaatgggatactacttgggcttacaaaccttgatgtgcttccattatcagtcactaattcctgcggccttgcaaaaatgtacagtgagcactctgtttccgtcttatgatcatccaacatcatcttgattttttcatcatttagaatcagtacaagaccttgtggagggacataagaaggcttcaagtagtatacaccatctcctttttgatatccatgtataagcaatgactcctccaaatcgatgaatttcagagaatccctgtctaaaagatagatcgatgaacaattcctttccccaccagatttcctagggcttccactagttgtacaaccagtatgaacaatgaaggaaatactagttcgacccatctgcagagattataccaatttattggtttgcaacctaaatcaaagagcaaatattcgattatctgaatctagtaatacaacaattacatgcataaaacatgatccgaccaaaaccagggagaaaaaaggaacctgtagaatgaattgacgaggtgatcgaagtacaggatgcttcagtgcttccttctacgacttctcttgccgggcaggggatttgatatcccttctctctgtactatgcgatcatcgtcgtacttcgccgttgtaccgctgttctttcgccgccttagtgttgcagtagcgatcgtgaaattaaagcagggaaagatggaaagtggaagaaggtgtgcgcgcttttgccgccaatgtggcacgagacaactccacccgtgggctgcgctgaaggcccacgataacgagaaattgagcgcatcacgagaaagcgtaaaaactgaataggagtggaaaattggaagagaaattaatttatgtgtagtgttttgaacaatattgagttgtggggggagagtagaaagagcagtgacttgtagggggggggtatttggattttcccctttcagcaatgttctgtgagatttttcactgtgacaggaattatactagcaaatcatacatcctaattcaaattatctcctttggattataaactcaaattaaccatgacctacaaaaataaaacaaattagcatttaatagcctctcatcgtttgctctatggctgataaataagtggagaaatcaatgtagcaaccaaaaaaaaaaaacttgtcctagtttcaacaagttggccacggcggagggcctagggggagaggtgttccatcttctctcccaccctttctccctagatcctgaagacgtggatgaattgggctttatgttgtttgtaaggatagggttttgggcgatcttggttgtttccgttgttagcttagcggcggtcggtccgatgctagtcttctccaagacttgtagtttggcgctaccggtgtgtgggtggtggtatattttttcgtttttcctagttacgaccttacatggttgtaatctttgtaattttttcctgttctatcaataaaattttgcaccgtcttgtgcaagtcgttaaaaaaaaacttggtgatgttcttagcaacttaattgctaatgtgaaaaaaataaactctaaaatttttcgaaatttaaagttcggatgcagcggagataagctggagtaacaaacaaacagcggagaaattattttgtcaccgcgtaaaccatttcccaaatttaagaaaatttgcacaaccgcaaattgaggaaaaagtacaccgaaggtccctcgacttgtcatcgagctacaaaatcatccctcaactgcaaaaccagatatccgacgtcgcttaactaatcaaaaccggttacaatatgtccttcggtggttttgacaccggttttatcctacgtggcgcctgagtcagcgtaggacccacgtgggccccacatgacaggatgacacgtcatctctctcccctcctctctctctctctcttctcttctcttctcttctaattcgccggtcatgccggccggccgaagcaggggcaagagccactggtggaggggctaggggggtcgtgtcgccagcgatggcccagacagagttgggcgttggtggtggcggcgctggcggcggcattccgtgacccgccgcagccttgtcgcatcggggcgcagcggatggcgagcaccacctcgtcgccgtcttctccttcttccccgccaccggcgtcgagctgccgccacaaggattacggcgtcgagcgcggcctcatcggagacacggctgctgccacaaggattacggccgcgaggcagctgtcgccgccgcctccgcagtcgacgtcgtcgcccatgcagctactcccagtgaactggaacgcgtcccagatgttggggtcgaagttggcggcgaggaagatgaccgtgaggagcgccgccgtgatcgcgccgaacctccggttgtcgcagcctcgcaggagaggggcctcgctgaggggaagaggaggccgtccatgttgaatcgcagcgcgtggaacacgatggggaagacgagcatgtcgtccagcgtcgcctcgccgaagaggaggaagtcgaagaagctggtggtggtgtacacgaccaagcagagcagcagtgacgcccgcactattggcctgatctgggagtggtccttgagctcgttgtgaattgtgtgcactgaatgcagtggcaagttaatcacattcccacagaaaaatgcaaacttagctggtaattaaaatgtaccgttgtaatggcaaatgtaggcggtcacaactcacaagaactggagctgcagtgtgaagtctccaggtggagctccagtcatgaacatcagggaacagcttaggcatcggaatctgccctctcatcagcttgatggtggcgattccgacattgatcaccacgaacacgatggccagagcaaccgacacggccggcgtgtatttcagtggatctgaactcatcccagggaaaaagaacacaagccattagagtcacaatgaaatgttcagtgaatctgaccatcacgccgacgttgttcagttgttgacgacgacgcagagctagaggatccccctgccgaaagcaccgaaggcgtcgcccatggcctcgccgtacgaggtggcgcccacagcgcggctgaactggacgaggagctcgatggaggcgtccgtgagcaccgcggcgagcatcaccaggatgaggcccagcacgagactgagcaccttcatggtggccgggagcgccatgatgcccgcgccgatgatggtggtggacaggttgaacaccgcgccggagaaggacgcgcgcggctccttgccccgccgcctgccgaccgtgcagctgctcccccgccggtgcccgtgaagaagagaggagagaggaagagaggtggagaggggagggggaagaagaggctgacgcgtgggtcccacgctgagtcagctgccacatcagacaaaaccggagttaaaaccatcaagagaccaagagacctagtttgtactggttttataagatgggatgctttatatccggttttacggttcaaggacgattttgtaattcgatgacaagttgagggacctttcggtgtactttttccgcaaattgagcaaccttcacaagttcatatcacctccttcaacccaagaggcccaaaagggaggaaaaccccagttaacccccatggccgcctcctcttccttcctcgccgccggccgccgcctgatccgcctcggctgcggcaggctcctccccgccggccacgcgcgatcccatggctccacccctgccctcattcgagccgccgccgccgcctcctcccccgcctctcctcgcggccacagcggggggaggaagccggcgcggcccccgagcctgcagtccacgctgtggccgttgggccacccgggcacgctcctggtgccggagatcgagcggtgggcggccaagccaggcaaccgcctccgccacgtcgagctcgagcgcatcgtcaaggagctccgcaagcgacgccgccaccgccaggccctcgaggtaactccacctttcccccccccccccccccccccccgtggcccgtacctcagctcagctcatcatcagtagactattatggggcgttcgatgccgttgcggcctcaaccgctgtttggtttcttgagttgcactcgccaaattgttggccctcttcatgcatgtgaggtgtatgatgtaatgctgcaccatgaacaagaagagagatgtagtagcgtcgtgttaatatagtttgggcgttatgaagaactggcgattggctgtgtacaactgaacatcatgaggaggcttgcatgacagtttgttgtcaattgggagttgggagtgttcatccaattagaggatttgactgattgctaagtgttccatcggttaatgtatttggtttagtttctgtgatgggattgtatgtttttttccccaagaaatgaaacctgatcaatagttaaaagcactaatataatgtgcttatcaattatggttgcaacactgattcatatctataatttacactccagacctcaagagcttatcaccattggggcttcttattttaataatcaagtgcacttcctagttggcatgtttaatttgatttctctgtaaccttttactttgcgcaggtctctgaatggatgaatgccaagggacatgtaaaatttctgccaaaggatcacgctgttcacctggatttgattggtgaaattcatggaagcagtgcagccgagacttacttcaacaacctgccagataaagataagacagaaaaaccctatggtgcacttcttaactgctacacacgggaactcctggttgaaaaatcgttggctcattttcagaagatgaaagagttgggttttgtgttttccacactcccctacaacaacatcatgggtctgtatacgaacctagggcagcatgaaaaggttccttcagtaattgcagagatgaaaagcaatggtatcgttcctgacaatttcagctacagaatatgcattaactcttatggcacaagggctgattttttcgggatggaaaacacccttgaagagatggagtgtgaacctaaaatcgttgttgattggaacacgtatgctgtcgtggcaagcaactacattaagggcaacataagggagaaagcattctctgccttaaagaaagcagaagcaaaaataaatataaaagattcagattcctataaccacctgatttccttgtatggacatctgggggacaaatcagaggtcaataggctgtgggcgctccaaatgtcgaactgcaataggcatattaataaggattacactacaatgcttgcagtgctcgtgaaacttaatgagattgaagaagctgaagtgttgctgaaagagtgggagtcgagcggaaatgcatttgacttccaagttccaaatgtcctgctcactggataccgccagaaggacttgctggacaaggctgaggcacttctggatgatttcttgaagaagggaaagatgcctccttcaaccagctgggcaattgtggcagctggctatgcggagaaaggtgatgctgcgaaagcatatgagctgacaaagaatgccctatgtgtatatgctccaaatactggttggatccctaggcctgggatgattgagatgatacttaagtatcttggagatgaaggtgatgtcgaggaggttgaaattttcgttgatctgctgaaagttgctgtgccactgaactcagatatgactgacgctttgtcaagggctcgaatgagagaagaaaagaaggttaaagatgcagtgtaagcactatgatgaagaagataatgtttcacgagctctcaaggctgctctttggtctgcactgacactttgttcttgctgcatttcttcttctcgtttttttttcttttttaggagaatgtgggtgggggatggtaaccaaaatgagatattatctgacatacagtagttctggtaacattgtctgtacctgagtacctgagtgaacttgttatcactcgattggtcactttaagtatgttgctgggattctcagcaatagttatattgcttgagttataacgatcgtagagccaaaatcactcaaaatgtagatgattttgatcttgattttgcacgtatgcataacaaacgctcatctcacaatcgtttgagagttgaagtgaagcaaaaacttccactaaacccatgttttcacatgatatttcgccaaccttcttcggcctctctttgcgtttccactgaacagcatatccatgtatcgattcatccatctatccatccattcaagatccaaccacttctccctaactcataggtgtgttgttgcgtaagctaagctccgatggatttgcatccaaatccaaaaaccgtttgcatggatgcatgagaaacagctcatccctattaactctgcacctaataacaaatccaaatctcgccaaaatcttatcccttttcaaaatctctcttttatatacatgtagctctccatctcatttcacaccatcactggacgagcagtaagtaaacactctgtggaacaatggccgccgtccttcccttgctcgccgccgccctcctcgtcctcttctccggcctgcatcccgccgcctccaccgccgccgccggcggcgaggcggccaccgtggttgtcaaggcggcggcggccgtctcccgcaccgacgacaacttcgtctgcgcgacgctcgactggtggcccagggacaagtgcaactacggcatgtgcccctggtacaacgcctccatcattaacctggtaattaccacccctgaaacttgattagccaaacttaatcaccttcatttcatatatggatcaatctacttctaactgacactgagcacgtcactcttcttccctcacaggatctgaacaacactattctgaacaatgctgtcaaaggtaaataatttgcagatcactgatctatcaaaaaaaattgtactgaaattaaccagagttttatgtgatgttgcagcgttcaactcgcttaggattaggctcggagggtctcttcaggaccaggtgacgtacaaagtcggcagcaactacggcgattgccggagcttccagcgagacgacggcggcctcttcggcttcaccgacggctgccttgaaatgaaccgatgggacgagctcaacgtcttcttcaaaagaaccaagtaattaaactgcaattatcggctaattaatcgccatttcgaggaggattaaatgactaattatctttgatttgatttgattgacgtgcagcacgacggtgacgttcgggctgaacgcgctcaagggccggaggaaggccgccggcggcaaggacacgctgtactccggcgactgggacgcccggaacgcgctcgacctgatgcggtacaccgccggcaagggctaccgcgtcgagtcgtgggagctcggcaacgagctgtccggcagcggcgtcgcggcgagggtggcggcggcgcagtacggccgcgacgtggcggtgctgaggaaggcggtggagcgtgtgtacggcggcggcggcgaggtgccgaaggtgctcgcgccgggcgggttctacgacggcgcgtggttctcggagatgctgcgggtgtcggggcgcggcgccgtcgacggcgtgacgcaccacatctacaacctcggctccggcaaggacagggacctggcgaggaagatgcaggacccggggtacctcgaccaggtggagaagacgttccgcgacatggcggccacggtgcggggctccgggccgtggagctcgccgtgggtgggcgagtccggcggcgcgtacaacagcggcgggaagggcgtgtcggacaggtacgtgaacggcttctggtacctcgaccagctcggcatgtcggcggcgcacggcaccagggtgtactgccgccaggcgctcgtcggcggcaactactgcctcctcaacaccaccaccttcgtccccaaccccgactactacggcgcgctgctctggcaccgcctcatgggcccggtggtcctcaaggcggcgaccaccgccggcggcggaggttcgccgtacctccggtcgtacgcgcactgctcgagggagaagccgggggtgacggtgctcctgatcaacctgtcgaacgcgacggcgttcgacgtgtcggtggccggcggcgcgctcggcgcggcgccgtgcggcgggcggagggaggagtaccacctgagcccgctcggcggcgacatccggagccaggtggtgctgctcaacggcgaggcgctggcgctcggcccgggcggcgagatccccgagctccggccggccgtcgtcggcgacgggtgcgcggcgccgctgcgcgtggcggcgcgcggcatcgcgttcgttaggttcacggaattcaaggctcccgcatgcgcggcctagccgcctaggcttaattagcacgtgctagtaatcgcgagttcgtagattatgcagacatgaacaacatttgcattgtatcatgagtttaatcgtttttgataactctgagaaatggagacgtggttatcagctttgcttctggtttgatcactgtaaaattattaaagcacattctgcaccgatcagtgaaggcaagtcagtgagatttgatcatttctaatagagattttttttacttgagtacgtacaaatcgtccatgtagtttatagttgcacgcaaatcggggaggtagttgtgccagttgatcaataattttcagttacgattgtaacctgtgttttcatattactccatttgtcgcaaattataggacatcctttaaaggaaaatcagactcgataactttacacttaaccaatatcactagatttatatttatattttaaagtattttcatgtgatgctaatttcatttttgttggaaacataatatgagataaattaatggttaaagtatgtcattaaaaaccgtgtaaaaaaatatagactttataatttgggacagcgagagtacatcacagcctatatatagggtgagtttgaggagaggaggatagagaagattgagaagataacgaggtgagccattagcgcatgattaattgattattaactattttaaatttcaaaaatggattaatatgattttttaaagcaaatttcctatagaaaatttttacaaaaaatgcactgtttagtagtttaggaagcgtgcgcacggaatacgatgtccctttctcacccaatcccccagaacgaacgcacccataatgtacaaacaagtttgcctccaaacaaagttttttttttattttttagacttttttatttttttttattaatagatcatcccaacaagcatttccaaatctgaaccttggaaatgttttttttgtaaaagtctattaataaaattaaaaataaaaaagttcccaaacaaacatgtggcagttctccaatgtttcgtgtgggtaaaaactgaaaacaaaattgacatttcctttcttctttcacaaccattccttacacagcccaaaatgccgccccgactaaacagaagacggttgcagatcgcaatcataatgcatgagtgcaattgcaatcttggccacacgcaacaaatatatgcacaaaatattggtgccctttggaagaatgtccaactgtaatctacatacatatgctctagccagaaccacgctacccaactcaggagtaggcactaccagggacaacgacaagcaacgacttatcatcttcttctgctgcttcacttgcctacaatgggaaaaagaaaaaaaaaacaattggaaccatagtccaggaaataagtcagtgagtgcaatcttacatagcataaagggatagacattatccagatcaagctatttactaccctttttttttcaaaaacaaagggtgtattttgacgatccaaaagacaagctttgactgtaaagtttccttacattatttcacttacggatacaaaagcatactcaaaatcctataatatcacttttcatggcaaaatgtaaatattattagattaatagttggtcaaagctcaaaattggacagtcaaaatatgccttatatttctgaacggagacagtagatgatttgccttgtagaatgatcgcaaaattatcattcttcaccatgcttaagaaatggcatgacagccaactggcaatagtaacagaagctaatatatgagaaagtatcaacagtaagcacaggagagtcactgtgttactgtaatcttaataatttcagagatggcatcacttcagaggaaaaatgttttcaaaaaaagtttgaaatagggcaggactactaacttcatccttctgctgattattgacggtgtttttcagaagctctttagctttctttgttaatcttttcgctccttttgctgtgcacaggtgacctcagaatgacaagccacacaaagagttctcaaattctcaagtgtgcattcccctgcgtgagatcagataaattagaccataatgttaagagccaaaagcacgcaaaaattatgcacacactttacctcctcctttatatacaggcactatatgatctgcgtgccaagcattaccctcatttggctcatgtacaagcttatctagcctgtggtaaaatatagtgaaaaaaacagtgtcaccatcaatctacaaattaggagaactactcatattcattaatattttgtgagttcagaccacaatagtgtccccaatagcctgtaagttgcctaaataggcaaagagaagttaacataagcacaaaacattgaaaagcataatatcaaagtatggcacttacaatttcaatctacttgcaatatttggagcaacattcctaatgtattcttctctctttttcttgcataatggtctgatattcttgacaagctcgtgacagtcaagtttacacttggagcatataccatgttcaatttcaaatagtgcctattcatcaggcaagcattgctttagtacatataacttccatattttcacatatagctggcataccagctttattcataaataatgcaacttaacactttgtttatgaatgctaattgcagaagattaaagaaaaatctcacctgccgtgcaaacctgccactagttctcgatctgaacacctcgaagcaaggcagaccacagaacaggtcttcaaaatattcaggtgactttgcaagccttccactgatcacaaataacaacattgttattttttttcaaaaaaaaaacacagatggctactggaaataaagtgcacaaatgagacatattacttgcaaggtccttgacataatttgcagagaggttcatcgtgaacagtccagccttgagtgtactctctctctctacttgtaccattatgcaaaaccacctttctgcattcagcattttatggcaaaggattattaatatctcaccatggtgttacacgcctctgacttcctcctttaagcaacccctatgaagtagagcacaattgacagaaaataaacatgattaaaccaaggaatgccaagacatattttttttcatttcatgttattagtttggtacaaaatcagatcctttaaactgtatttctaatgaaagattaatacatcgggatgatatgatagcaggtcacaagcgaacccttagctacaatgagatgcctagggtagtgtggcactgtggtgggcctagcagcttaaaagcagcagttttattttgctttttttttgtatatgccaaatcaccgaattgaatcctccattagagtaatatcctccattagagtaagagtcaaacattgcaatatcctctattagagtaaatcctgatagaacttgagcaatttctagaacataagaaaaacttgcataaagaatgatatagatagaacatagatatgcttaatatcatggaagcgttgcttttgcatattttctgcaatatttggaattaaaccaatattcaaattgatcactcaaaatcaagaggaacgtacttttgtgctgtggttgttggtatctttcaggtagcacaactcaaggctcaagggaagctgtaagggctttcccagtagtctcttctgctcaattggtctaagcgccaaccattccttcacgaacgctttgaacgtattgcaaaatgcaggatccctcttcaagagacgattacttgttttcatggtattatcagaacataaaggtgactctacttcttctggcaggaagttttcaaaaagtggtctgggtcttgaatcatgccctggaacacatatgtacaaatgaattcggcctgtgtgctggctaacctgtaaaatacgaagataaatcaaatgaattcaaagaatgaagaccggaatggaatgtaaaatgaaattaacttcacattaatgagacaagtcatgagaacagaatatgaacagagaggacagttaaacctcaaatcgcagaaacttctcttcaatattgcagtctgtagttgctggaaggcctaaagtctgaaaaatttcagaaagcctccgacgagcctgcgatatttgaggtgatgttgcataggatatagtgcaaaacattgtataatacaagcaagaactttttattacctttactgatttagcgcttgacattgaagggcaaataactgaagcttgagagatagaagaactatcaaaagctatctcttcatgtgctgttggagatggacaattttgcattaccgtatgaaggctatcatcctgaggaggcatagaaaaagaatcagttgaaggatttcataggactactgactgataagtagcaactagcaagtagtaaacatgtaccaaaatttgcaaggaacgcctcttttctacctcaaagtgaagaggaattgtcctaatactgaagaaatctgactcaaaattcatatcgttgaggccaggaaaattctcaatggacatatcatcactttctacattctctcctggtccatgcccacaatctgcatgaggttcaaaaaattcagcctttcatttcacttacaagcatgtaataatgattggtaccaatgcatgaattctctgttaacgatgttcagatgttttaccagcattatgattctccaaaggaagaaatccaagctgtgattttccctcagatttactgctttcctcaaggtggtaaacttgatcaaccttagaaagaaggaaactatattgaatgaataaacaccaaatactgtagaacaatgcagtcccttaattggtctgttaaccaacaagattctactaagccaattgattccagcagtgatataagaaactatgtctcagctgcaaaggtatattgagtagtatatcaatcccttctgttaaatgttgaagtttaatggcatcagacttttatagtactggtaaactattttggttcattttgtaaattattttctacttttacagcaccaaacatgaaatggaaaagattgaatatgcaaacattcagtacaaattcagcataaatttctaaagttatgtggtgtgtcgcattataaactatagaaaaacctaactccaaacaatgggtgcatacttacattttgtcaattgttacggaccatggaagcacctcaatccaaacaatactacacttatattgtagtgcccatcctaacctccctaaggaacagtataaaatcaaaaattacatgaccctatggcctacctcaatctctcttatagcatctttctttccattcatcaatgatgagacacggaacagactctggttcaaatgaagccaatgtgactcatctaatgtgttctgtgaccaagacaaaacagaacaatttatagttataatttgacaaaattacaaagtacgctacaggaaaaaaaaaaggaactaacccttgcacagaatatatatatgttgacagcatttgtttgacctcgcctatgagctctatcctcagcctatcatcaacaatcaaatgtaccaaacagtt

SEQ ID NO: 43363 - DNA, 5723 bp, Oryza sativa
aggcgtaaagggatcaaaagagagcaaataggaataagtgtttttaagcaaatagaggagaaacatttcttcttgctcgactgatagggaatgacttgacctgatccctatggaaaacatatctgtaaagaaacttacatatatataaagaaataaacccaacaataaaactaattattcttatctctgaattccaattaaagctacaccaccaggcccagtgaataatactgcagttgctacagtacatataaataatatcatagtgcgaattgtgaatggtgggctacacaacaggatggtgaaaaaaaactcaaaagtcttcttgtaccctatggatgaggaaaatgtatgtgcaagagagaaggctaaggacctgaagcaactctgaagctgactttgggagctccacgaaaacaacattctgagcagatgagaaatctaaaccaacaccgccagcagtaattccaataattgcaaccattacctatttggtagaaaataaaagaactagtaaaatagtaaataatggataggcagtttgagaataaaacttgagagcttaacatggaataccaagtatgaatcgaaccgaatggaagggaagggacaacctctggatttaaacggaaagaatcgacagcatctttcctttccctaggagatgtgcttccgtcaatgcggacatacttgatcctctgctctgtgacaaacacctacgtacgaagaaaaacttcagtcaaaagtattggcaaatgtttttcataaagttagatggtatagtttaatatgatataatgctatctaactattataaagtgaaagtgtgcacccgaatatccgattgatcattagtctgattttttccatgtattcaactgattaatggactatcttgaacatggcggcaatgggatgattgtcttcaatggagtatctccaagtttatcaaccgacttgatgttagcaagtgaggaagctggcctatgtaatttggcggggctaaggggctctccctaattatggaccccagctagggcattttattttagttttagttccttttggtcatgtaaccgcctttgcaatgggttgttttgcggtggtgaggtcttgtacttcttgctgttctttggcgtgtttggactcctattaatgcaatgatatgcatcttgcgtattcgacaaaaaaaacttccaaaccattacgagaacatctacagtcccacagaaagagtattatatgctagagaatgccagaatgctggacatggtactggtggcttctaaaaaacggtgccaatgacatgtacatggccagaccaattttacacatacaccagtgtttctattcatatgagatcctatagtccagcttcttgacacatcatttattttgtttcatttactctaaagatgaaacttctatttcattaggaggaagtgaagcttacaagatatatagaactacaaatagttgaaatgatacttgcaaaatcaaaattacataaagtaacatagttgtgattataaatcttttgttactgttcaagattctattgtcaatcgtgagaaacatagcatgataaactcgcaaagaaaatacagaaaagaaacctcagaatttacctgaactccatctaggacctttaaatgatgggcgaaaattattgttttctggcaattagactgagagtccagactaccattatcagctggttctttcatgatgaaatgatttaagaaccactcgctgaacccaggtattttcacaataccaatttcttgtgtagtgagattccttggagatttcttgcaaccatcagctgtgggcaaatgaaaaggaaatacaaggaaatgagcacaatgtttataaggagcagacagaccaatcttactaatcttgaaccctgaaatagtagaaaacatgtgctttatcccaagtgttaataccagtgttacatttaacattgttacattaataattgtttatgagaaagaaacatgttacataaggataaaaagaggaaggttgtctcctttaaagtggcacgctactcttaaaaagaggtggttgcctggttgtttgtcaaaaagaaacataatgttttgatcatggtagttcatgtttaacatatcagaatttttttaaaaaaaaataagtacaatgattggaaatggcaagtaatgttcttcacctgtaaagtacaacaggatattgcacagttgcaccaacatttctacttgatatacatagtgttcttcagaacagaaatcaacaaaaatgctggttatctttttcttgacaaatgttctctgttactatagataagaaaatggctctttttgaaaagaagttgtaaataaatttcgattcagacagtgtcaagtacaataccatactgcgccatattgcattgcttatgtcataaccaactgccaatatgcaaagctgtaaacccatacatgtttggcattgcatatgccacaaatgccaagcaagcttcaacaaaattacagttccatataagttgttgcattttgttatagttctgaaatctaacaatatcaaacattcaaatgcaacaaggtgtgtattatatatttcagcataacaaaggcacataaaattataactgatacaaggaggtctcattatcatatctgccattagctcaatgagtgttaccttcttccatgttcacctcctcagagtcattgctattgtctggcgaggcaattgtaggaatctcatcactagtgttcacccctttgatacaagatatagctgtcttgatatctgatgcattcagcttcaaccaaataatctgtcgacgtttgggaggtagttcattcaacaaatgctccttcaagcgcctaatctacagcacagaagtaaacatcatctgttatatccgacatagaatggtcgatgaacaatcaattaccagacaaaaacatcatgtggttagcatgggttgtggcgacaaaacaactacaatatttgcaagcatattaataataaacagaaatggtataaaagggaaatttgaaaacttgtggcagtattatcgtgtacttacaaatctaaactcgtgaacttcccgtgtcacagtactgatttttccatttacaaattcaaggagaaatatcatcaacataacacatttggaacacttcatatttcccataataatacttatggatagtctgaataccacattcagataacatatcatgaataaaatgaacgaaacaagctatgcatagcaggcataaataatagagagaaagaacagaccatgagagtctgactgagcaaaacatttaactctgtcaaccgagcaccctttgaaaaatcctgcagagagaaaaatggtgacagccctcaacagaatcaaatgtttatctacatatgctcctactactggaacaaaaattatttggaagcactggttttctgagtttttcataaactatttcacagttcactgattgattagtgtataagcagcatagatggtacacaaaagcaaatactccttgtttcgcattatatatctggtcctcggtccaataatcaagaaaacataaaatcgtaatacagttgataaaatcagaccaaatttgatgccattagatagagtacttgtacatctatctaataaagcaacaattgttcaattccaccaaaaacaatagttcaattccacatttatctaatattgtgcccccttagtatgtacaccagaacaatattgtgaaatagagggagtaacaacctagtagagcttagcaatagaaaagctggaactctgccttgagaaaccggacactcaaaatacctggtaagttctcccattgcagccttgaacagtatgtagcaagcaatatttgttcgcaaagtcaaatttattgctgccaagcaaatggggcctgaaaagccagggaagtgtgatcagaaaagtttgataagactaacacaatacaatggcattcaccttttccttaccatagcatatttatctgatgatagatgtcaaaaggtctattgtctcctaggagaaaacaaactgtgagatagatctgacaagcaaaatagaagtctccaatcaaggctatcataagtaaaccatacataagtaccaagaaatcagattaatcaagtaaagaaggaaacatataggaatgacaaaaatgtacttgagtgctctaaatctctacggtacaaacagccagacttcgagccaaatatggaaaaaggaagatattgcaagtaacaagtaatgaccagtaaccaatgaacatagtgcagagaatgcatttgaaaataatatgggtaagtacaaatacactagatgaacaaaaaatggttgaaagagtaatagacaaaaaaaaaaactttctgtaaaatttcagaaaattgggccatgataaagttttcatcattcccttttctcaattacaaggcgcaggtagcttggatattgctatccacacccacctctggaattttaaaaccgtttagatgatgtacacaaaatatgtcatatatcatagcagctatctgcatgattggagatccagatatcaaggagtaaaatagcacaatagcataaggagctttaagagaaattcaaccaatatctttaaagttacaaccttgacaaagagggtgtcccagagagcagcacaatgcgactgacatttggcgctagttccagtacagcctgtgtctgtcatgaggtcataaaatagtaccaacggtcacttaccattagtgaaatcaaatgcaatattgatacacaaggtgactgaagtagttggaataaatagtttgagataatttcaacatttgtgcattgcaatattttagaaagcagggagaaatgctgaaaaatataaccagatcaataaaatcaactgggagaattttattttaaaaaaaagtgaggcgtttctagcacaataaaatatgatctaccaaatttacaaagcaccaaatcaccatcatggtctcatggattggagaattcaagagctgaatactttatgttaattgtattgatacataagattgttgcatgacaagctaataatttaaacacctcatttttttcgtgttttttctttgtgcagcgtatgttgtgtgattcatcgataatcatcagtgcccatctcctattcatcatgcttttgcgaagacggcttagcatctgatatgaaatgaccactgcctttgggcaagctcctaaacgttcaagactgtcttggtgaccaaacactgaaaattatacagtgacaaccgaactgttaaaattgtgctcctaattaaaaaaataagtatataacaaaactgaaaggctaaataaagtagtaatatacaattgaaggacaagtgacaagaaatatgatattagccatacttttttaaacagtatcttcagttcttcactagtatagaagaatcaaattattatattgcatatgtgactcagccaaaagttaaaggcactatttaaacctcaagcgcactggtaaacttgagtaaaatacttatgttacctaagtttagggctgaagttcacaattttcaactcaggtcaatacaatcaatctttggttactgcattataattcctttcatactgttcatgaaagcatttcatttttagctagtgcaactttactacaagatttacaaaacctctagctgatcctagg

SEQ ID NO: 43364 - DNA, 1862 bp, Oryza sativa
ctatacttttcatttaaaaactatatgttcctggaatccaactagagtaaagagaaagcattaaagaccctcaatgatttcagtaatgaaaatgcgggcaaagataaaatcagcacttcacaactatcaaaggcaaaatgagttttatacaccagagctttacaataatcataataccagatttcacatcaacaaactgtaaagactattagaggttgaatgattaccaagatgaatatcttttggcagaaatgaaggatcccatcgttccaattcctctgcccatgtataacgcaaaacagctggacacactattaacactgggccctcatccttgtagcaacaagctattgcaattgcctgcatttaaatgaatgagaatgtgctgctttcacagggaaaaaaggacgctcaaaagcctattcattcaattattcatatgctctaaaaaacatttttttattaagaattgtttggaaatgaaactaaaatggaagttgctatttcatataagctgtgtttctcaaaaacgcaagagagctgtgcttctttgtattatcgaaagaagaagaaaaaaagaccccttacaatgcctcaggcagtttaatattcatataagtctaatttattagtgttgtaaacagtaacatgctttaacagtgtgcccaaacttcagcattatgtaggctccaaaaccttgttttcaacaataatactttattcatgtgcacaatagtcatacagaatagcaatggttgcatgctctcatgtaaaatgctcacctggagagtcttaccaagccccatctcatctgcaataaggcagcgcccatgccttcgaagcccaaacttcacaccttcaagttgaaagggtaggagtgcatctcgtaagtgttgtggcaacttcatgagaagcccgtcaacttctttatcagaagcgcagctttcggcaaagaacttagggagattcttgataacattccttgttttgtaaggtatatcttgcacagcaactccaggcaacttcttcaggcattttaacacgggctcatagtccatgagcttaaatacggagaaaatatggccactttgactttgtgttgtagagaatggtgcagccttaccaacaatacaggggaaggatcagttttaattctagatcaagaacataacatcccagaaagccaatcaaaataggttaaatagaacagtaaatatttgttcttttatgcttgaaatctactcattactttacacctagaaaaaaatagctctgaattgtaatatcgctcacatcataatgcatccccattttgtgcttataaccattgagtttgaaggctcttcatcttgctcagaaaaattagtggcatggtcattattattgaaaaaagatcgaatagaaataaagaagacgcataaatttctgttattcataataaagactcaaatggcaccaataaggccttaattacccataaaacttaggtgtatattttaatggccttgctagaagccagtaagtaacgctttcagtgttcgactacatatgctgcctgtgaacatgtttaagtgcataatgcatctatatatcgagataattggtcaagtatgtgaaaggggaaagcccgttgatgggtacaagtagacatgagaacaagtcgatttggatttaccagttttagggactttaaacatttagaactagggttcacccaacaaactcccgacgaaagtaatccaaatgggactagggttcatcgtttgtgtgtggagagactatctttatcgagtcaccgaattctcggagtgatatttcaagaaatgcttgcaaatatccacggacttgctaagctgtcgcca

SEQ ID NO: 43365 - DNA, 10419 bp, Oryza sativa
cctccgcgaagcgcttgcgcctctcgaggcgggcgaggcggttgacctcgatccggcggcgctgctcctccgtgatccccatgggctacaactagtactccactacacctcctacactaccctactacacctcctacactaccctagagtgtgcggattcatgaggattcgggaggagggtttggcgttcgggaaatgggcgggcttttggtttggtcgtcggagggcaagaaatttgcacatgtaccacggttaaaaaaccggctacgctacgataccgtcacttaaatggaattcgcttcaacgttatcctcgagatgtgagcattcgctataatgtcattttcaccatttgttacaattccaaaccattttccaccaaaataatattttcgcggaccgttttgcccctggaacaactcacccctccaaaagctaggtcgcggcgccagctcctctctccccagctgagctgcttctcctcctagagccgattccctgcgcggcggcgcagctaccccaaccacgccgtctccatcctggtcctcgtcggcgtcgtcttcatcctggtcctcgtcaacaccgtctccatcctgctagcacgccacctcccccgatgcattgcacaaagtgtctcaatggacatactctgtttgggcggcggcgactgctaccacagggaagaggcgcccggtgcaccctacggtttgggcggcggcgaggtggggaaggcgtcgacgaggtgagggaaggcagcggcgagctgagggaagacggtgcgaggtggggaaggctacggcatggatggcggtagaggaggtcgcgtcgtcgcgctgagaggagagcggcgcgtctaggcagcagtggtagcgtcccctatgtgtggttcagttcaactagatctaggggcaaaacggtccgcgaaaaaattattttagtagaaaatggtttggaattgcaaccaatggtgaaaatggcattgtagcgaacacccacatcttgaggatggcgtttgagcgaatcccatttaaacgatggcattgtagcgaagccggtttttaactgaggtacatatgcaaaattctctcggagggcgtggacgggaggggaagagctacagagttcttacacacaaatgccctatttgaattgctaccaaaaacatgccctaccaatattttggtaatttgaatagtacatgtgtttgatttgaattgaagcacattcattggtaatacctaatctagatttggcatcatctagaatattcttcactataattttcacattttggctctaggttggtagcaaaccaaatatgatcaaaaacaatattaccttaccaaaaatttggtagtgccaaaacttgcctgtattttggcactacaaaaaaattggtaggtaaccgtccaaataggcccaaaattttacatagttctaaaaaaaaacacgcatgaatcaacagatctgtgtaaaatttgtgagaattatgtaaaagaaaacacatgaatcagagtattgagcagagctctctaaacacaaatgaatcaccaacgcaattttacatagttctacaaaaacacacacacacaattttacatgttattacgtaatacttcaatcatcaaatccatccaacgctctatatttatctacatcggatcaaacgatcctggtcgactcgacctcacgtgcctcgtcgcgtcgtctcgctggtctcctcccccagctccccccgccccgaccagtgtttctacttttttttttaattcaaattcaaatttaaatgggtatataaacatttgagttataaactttggttctataaacttaaggtatataaactttatatgtatagaaaatactatatataaaaaaatatttgaatttaaatttaaatttaaatcgaatatataaatttgaatcggatatataaacttttgacttataaactttgggtctatagacttgaggtgtataaactttagatgtatagaaaatactatatataaaaaatatttgaattcaaattcaaatttgaataggatatataaacttttaacttataaattttgggtttctaaacttgatgtgtaaatttgaggtgtacaaattttaaatgcataaatttactaaaataggaaaataatgcggtgccaaaaaaagaaaaccatgaggaggggtgatcgctcggggcgatcgatcgcccattaggaatctcgcgtccaaagctgcgtttgggttcgggaaatagaggagataatacaaagtagttcatacaaaattttgaatgtttgaatccctggtaatttgtggtgaacgaagtaaaaaaggaaagaaaacgtttcaaactctaaaggacagaatgggtgttccaaagacagcaaacccaaccgagccaaattataagtaagaattttattttaaaagtaaagtaaattcatttttcaaattttataatgattaataattaattaatcattcgctaatgacattttctaatctgacccgagttgctcaaacgaatgggaatacgactttggttgcaaaacgaatgaagacctagccaatttttctttttatttttgcaatgaccaatgtttgccattaccgaaaaaaatggcaaggctatgtatggcaatgaaccagcatgccttaattctcaaaagtaatgcagcaggaacagacaggaaaatgaaatgcatgtgatgagcaccagttttatatttttgacagtccaattaagctaaataaacaccacattacgtgctgtgaacatataggacatgacaggagattggtgtctcggttacaattaggggaagcagggatgaggcatcaatgataaaggagagaacagtataaaaatagctttttttccccatctgatgcaaagtttcaggaagaacaacactgcgatgcaaagccattcttgtcatcctgcagacctgcaggtcgccttgcgcatgcattctcccactgttagtcgcaaccaaagattcagcaacgaacagcatgcacgaatccagggtttcagtcttgcaaacctgtcagcaacaaacgcttgttcagaacactcttgtttttttttcttgagagaaacatattttcaaccaattgggaaaattatggtcccagaaggacagaactacttgtgctaagcaattgtagattgattttctagccactgttcatactactatcactaaagtaaatagctctgcatttgactttcagattgtacatctgctttgttatcttagctagcagctttgtaaaacaataattaatgaacttgaagattgctgacatggataagatcatcccacttcatggatcattttgaatatgaaagttcctcaaactatggtttaataaagagcattcatggttctaatggcatttaaaagaagggttaattggatccatgccactgcaactttgctaaatttaaaaaataccactactattcatcatatcggctacatgccactgaaaatttataaaattggaaccatgccactgccgttcctttttccatctcctatctcacgccgtctcgtttcccccgtcagatgtggcgtcatatcacgttatttccctcttctttcttcctgcgaactcggcggccacagcgagcgctcgagggctgaggaggtcagagaggaagacgtacggcgacgcccgcgggggagtggaggagggagcggaggaggtcgcggaggtgcgggagcgcgcggcggcttcctggtcggcctccgcatccgccgggagcttcaacggcctcccatccgccggccgaccattcgttcctcttcttcggcgaggaggccgacgccgccggctgcctcctcccccgggcttgctcctcgtgctccaccgcggcaagagagcgtcgaggagtggaagtcgcggccgacggccaacgccagccgtaagccaccttcgagctcgccggagacaacgacgacgatggcgacgaggagggagttcctccccctggagatccacgacgatgacgaggacggtgacttcctggtcgccgacatccacccacccccgtcgcgccgcagctgctacgtgcccggccggcgcaacgtggcgtcgccaccgtcgcacatggcgacgccgccgtgctcgacgatgagctcggtctcgggagctgccgccgccgccgtcctcgacgatgcaggtgcacgaccttgccctcatggccgtcagagttataggtcgccggggagccgagcggccgctggtgccggaggagagctcgaacggccatgtgtagatgaagctctcgctggagccgaacagccgccatggctggaaggcgatgccgagcaacgcagtgaccagcgccaccttggcgaacgtgaacttccgcgggctcaagctgacgagcgcgtttgccggcaccaccacgttggcgggaatgttggtcgtgatggtccaagtacttctcgagcttgctgatgccctccatgccgtgcatgatgacgccgagctgcgcggcccagaaagcgaggaagcacgcgaactccagcggcgcagccccaggcctggcactggcgcgagcagcggctggtacgacttgagcctggacggcaggaggaggaacacggcgcggccaccgatccaggattcgatgccgaaccacccgcaaccgatgagcacgctgatgaccgccagcaagtgcgtgctgcgcaccccgaacgccgtacgcgcgagcaccaggaacggcagcccgtgcgcgcctcctcctccaccgccaccatcgcgccgacctcctcgcaacctccctcgcgtcaacctccagcggccatggatagatggacgatggaacaaaggaggaaggggatgaggacgggatgaggatggcgtgagagaggtggatggaaaaagggacggcagtggcattgttccaattttagaaattttcagtggcatgtagccgatatgacgaatagtggtggtatttttttgatttggcaaagttacagtggcatggatctaattaacccttaaaagaatgcaataagagtggcaactgattaggtagagtcggtccagggatcatgaatactgcataacacaaccatgtaaacaaatgagaataagtataattagtaatgtctaccaagcttttttttagacaataggcaaatttcattacctggccctttgaagaaagccaaaacataacaaggtcttatacaaaagaaacgaaaactaaacaacagggacaactagctactgaaaacaggtaaaaaaaggatggggattccagctaaccagttcaggacccgttctctacacagggaggcaacatcaaaagcagtatcaggctatcagcgccccataacccaacccttaaacagaccataaacaaacaacttctatattcccagatcatcaaccaagcttttcagacatgaaagtaactatagtatagtttccaacaaatgttagttaattcttttggagctactaggagtaatatcagttatcacatatggagcaagccacatatattcatgagttgaatacaaaaggcttaagcatgtaacagtttgacatacacaatctactgttgaacattagtcattctagatatccaaccatgaaaagtgatattggcattcagaatgaagaaatgtgctgacaacgaatggacataaaaaatgtctggatattcttcggtttgtatattcataatgaagatacctatatatttatcttgaccagtagtcaataaaaagtcaggctttgcagtttcaattcagtaaatataaacaaagttatactttgcaagacagcaaaagagaaaatgtaaaatatgatcacctgattcaagttcctgattactactcctctggtacttcctcagaatcagacagaggtagaagggtaccaattccaatgacatgtccgttcaggcatacaaaatactccacagaatcctcgtaagcaccaagcctggcagaagaactccccggcgacatatttgcttccaacatgctccacagcttagccttacagtagggacatgactcgcttggatggaaccttgcccgcttctcaatcaacatcttcttaacctttgaggtggcgaacgacatgaagataccacggaagaaacccaagtcaccttcatccccttgatcaagatgctcgcatggatctgagacatataagacatcattcctacactgctggggcaggaaactcttgcccgcggtcctcgaaaagcgtgtcctgaacacaaagtgcccagggacatgaatgttgttaaagaggcccccttttgtgcagccattgcagtagatgagaagcttcccgagcgccttccagttcccgtcgacaatgtgactgccacccgaatgcaaatccagcatcatcttcggcgccctggcgtggcagaactccttccagagcacctgcttcgcgacctcgtcgaaccacttgcacacgcacgagagcacggcgatcagcctggggttccagttcatgtgacgaaagaccaggaacagcgcgtcctcgctgaggtgtcccttgatgcaaacgcagctcgccgagtgcatgcaccggtgctgcttcaccaccagcaccatttccggcaaccgaatcactccagctacaatgctcacctcctcatactcccttcagtcctgcatcacattggcatttcagttacatgcagagcaatcggttaccaacatcgcaacaaatcaataaaaatggtcaagcctttcatacagatagatcaggtactaaactatacccaatcattttggacagttctaacgatctaaactaaaccacgcatgtgggattcaccataacccccaattttttcagaaagaaacaaaaactgattttagtactgtgccacgcaacgaagaaatccgaatcaaactaagccgggatggatctccacgctaccaccacgccgccggctcatgaagcggagggagagagctgagagagaagaaggaatacctccggtgccgaaccgccaacggcggcggcggaacgagcgaggccggccgcgccgcgccgcccccctcccaaaacctgttcacaccggcccgcggcgcgcgcgcgcgcgcgcgggaggaagggcgggagtcgggaaggagtggaggctgcccgaaccgtgcgtgccggagcggccaagctcgccggccgccgcgcgaggaggaggaggagaggcggagcggggaggaaccagccgagccaccgccgggggagagaggaagcgaggcgaggggagatagagagaggggaaggagacgacagatggaaggggaacgggggcattttggtcatcgccattttcctcactttgtttagagcagggctatatctatatttctagttgtttaacatattaagatttgaaaaaaataaaatactataatgtctttatcaaataatttattgttgaaaatggaaaggtcgttgaggggtagaagaaaaagaatttaaataagatgtgagtgataggataagtagtattttagagtgacaagtattgttagacaaaatttgaatggcaacggataaagtagtttggattgctactttaccaaaatttgccctaccaagagagtagcaaagcaaacatctctattaaacactatctttgcccatgaacttgtctcttatgagcatatttttgtttcaaaccagttcatttttaactttaccctatcaaagttttggtagtatcaaaatttgatcaagatttggcgctatcaatatttttgtagagcatcaattcaaacaggtgctatgtcacattcaatcttaggtttatatttttgaaagagagagtaattaaaaattcttataaatatcaatccctccaatcaaaatttgttttatgtttggtaccacaaaattccacatattaatattttgtttaaaaaataataacaaataaatggttttaggtagacttgcctcgaaaagaggtacataatattacaaacttaggagtatattttattaatttattttaatataaaatttatcaaatcatatactcgatgttaaagatttgtttatgatggagggagtgcttcaaacaaatatttatatttgatttattcacttggttcttatggaaaattgaaatgtagtaacattgttttgtaaaagtttatgagattctttttgtgtttatatcatttttttcttttatttgttcgattaaaatttaaaaattcatgtctaaatccatctttcctcccaccagtgctagacaggaataaatactactccaaaattaattcgtttcaaatgccaaaattaataattgcttaaactccagatattgaaaatacaaacatttattagtggaatagcgaggcagaggactcagggattacgagattacccctgggccagtcggcgactagtagtcggcgagatgaggtcgagcgggggccacctcaggatatttatgagtttgtttaactacagcttgttaaattaaatagagtaaaagtaaatggcaggcaagatcgtacggcccaatgtttattgctgatgcatctcttccatctctctggtttatggcgatagcgacatgtactaggcatttttttggcatggactaaggtagtatccacctggtgtattataatacgaaattaatacaatataagaaaaatactcctacaaccaggctaccaacttggttgatgcctcttcaacttgtacagacgttttatttatttattttttataacaagggttgtgtagacatgtactccataccatttacttttaacttttaccactcgtccttttttttcaaaaaaaaatgtagtataaacttggaaccatagcctcgttaataacaaattaaatatgtaaaagttattacattgattaaagttgaaacattgatgcttaatagtgacagaaaaatgagtacggatggagtacgctcatgtaatatttttacaaagttagtttaatttcttttaaaaatattttagaattcttcaagttgatcaagtttatagtcctaaatgtggtcaaacttgttcagaacttttagaatcctatctcaaacttctttcaggtcaaacaagtttgtagaagaacaaatttcattaaatccattgtatatttgttttgtcaaaaatgtcattattaccttcatctcagaataagtttatttttggttcctcccgtttgttcaaaaataagttagccaaatcttataattttatttagtatgtaactgaggaagtatggtaattaattagacagatatatagttatatatgcatgtctataacaatagtagtggtaatatggtaatatagtaatcggttctgtatctacctataccattattatctaaaaaagaaatctacctataccattaaaaaaaataaagaaaataaatccacgagtgatccacgggagcatggtatatccgtatatctggagatgcgccggccacgggcagcaacttgctccgatcccacttggccacttgagcgtctcaccttgccaacttggcaacttgcaaagggaggcgcgcccctcctgtcgatatctttcgtgcagccgaaagccatgtcaggcccataaatccgggcccacatagcgcggtgtctgcccgcagcccaggcccacgtacgggcgtgggcccgatcggccctgtgaaatgtactgtgcataataattaacttgatcgatcatattaaatggaacatttttttttcttgttgttattattaacacattggcaatactacaagtaaatttgttcattatagtaccagcatttatttatggagctaaggcaagagatggggaaaaaaacccagaaattctggaaccgctcagagtatttgaataaccaaaaaataaccctctagctctgttattgtgaacaatccgagagagaaaacatgacattaaatcgctaagagagttgagttctgagtgcagtgtctcacatcgcggtaaaaggcagtagttaaactctaaaaattatcaactggggttctagcgaacggagagaaagctgcatcgatcctttcttatatgtcagcatccaaaacaacatcttagtttttgcatcaacttccaaatttgggtagcaagcaatgtgactgaaatagtaatgtcatctgttaagataatgcgatagcttgatactctgatagatcatagtcctgtcaaaaaattctgttctgaagtcatcatcttgaggcaccatgatggtcaagcagcctgatagttcctctccgtaaaaagccttcgtcaagaaaaagtaatcaggagggcaacagctcagattaccatgtgcaaacattagaaaaatggtactacctccggtttttaatagatgacgccgttgactttttctcacatgtgcgaccattcgtcttat

SEQ ID NO: 43366 - DNA, 3360 bp, Oryza sativa
caaacatgtgagaaaaaaatcaacggcgtcatcaattaaaaaacggagggagtacctgaaagcattcaaaagaggatatttagaacccatgaaaaaatgatttaacaaacacatgctatgttaaatggataccaatctgacaaagatgagttaagagagaagttgagcagtcaaagggaaaccacaaaagaatgcatattccacaccatctctatcaacttggtttagagaagactacaatcaataggcgaatagccaatattttttgaggaatacaaatatacaataacaaaacactgggaactacaaaagaaattgtaggtggcatccttccagcatttgataataatgctgatacgataatatgacagcaaaaggaaaactataaggaatatgaaagagcttaccagctgctctgtcaaaaatgatatgccagagccagaaactccaattgccaaagcaaatctctttgaatgaatacctaggttgtgtatatttctccttcagtaactataatgatagttgtcaaagtttggccatgaagtttcctgcctttcttttggcatattcgtgaactatgccagctgtgctctgtctgtggcgcaaataaaactccgcaagcaatattctactttcttcaggcaagagatcaccatgatgaccctatcattaaaaaaaaaaaaacttctggtaagatagtattcgttatacattttttacaaagaacttttaagcagaatatgcacttggcagtgcccttgtttgaaggaatatttggacagaatgaacagagaagtgaatttataaagacacatttcttaaaagaaagtaagttcagaccattccaaaatccatcagtgagctgaaactgaaactaacaagtgatgattcaagccatttggatatattaactgcaaatcgtcaggataaaaaactgacaaaatgcttcactggttgttatacatttccataatttatatatgagtttggagacaagttcaacccactagcagaaactgaatttggtgtttattcttcctgctggtatatttagtagtaatgcttgagacacttacgatgcgggaaattcgatcacagacagcatggtgcataaggattccagctgcaacagatacattaaaagaatccaccatgcctttcataggaacactgcagtgcaagtctgacaactttaaagcatcatcacttatgcccctgccatagaagtagaatggctagttaatatacaagtagctccacaagtatactgaaaaataaattcccctaagttagtgtgatatactgagtactctctttactttccaaggtataaatccatataaatttcacagtggactatttggaacttctgtagtaaaaacaaacatggcatttctagtttgtaataggaaaacttctaagcaaaccattttgtacaacatacatcaagatgattaagcagatttcttgcaagaggagatgtcagattagttaccccaaagtgattaaaaaagatgtagaaaagtaatgataaagtacaacatacatgaagtagaaaagaggacatcgtatctgatcattccatttaaatacttttgagactcattataacatgattgcaagagaagatgtgcatctggagaagaggaagagccctacataagttcattgcccacaacaatagcggtaggttgcgaccaatccatgtcgtacacacaaacctacagatccattacgagcatagttattccttgaactgtattacttagatcagtaaatgataaagcatctttcaatgcaatacagagcggaaaaaaagtatattgagaaaatgacagtgtagtattacattgttgcaaaatcccacaaaaggctgaagttaccaattcactaaagaatgtgtatttgggacagataaatatatctttcattctaacctaaacggtcactaatatactctcaaataggagatgacaataatcattctgcaatcagtgatcaacaacattggtggtggcaacgaccacacaccaatctatttcaaggcttttctagcctaattttacaacaaatgtttttatcttgtctatgtaagtcactgaaaatgttcttacttgaaaagaaaaaaaaagagttgtctttcactgcggataacaaatgacaatgcatgtaatgatcacaatcactcttttttggcttactgttcaaaatacgagcgaaaactaaaaaggtgagcaacaacaaattaccgaatcatttcccaaataagtagttgcaatgcgataaccacgcttttttaaagcatcaaagcattctgcagttgagctccataattcgatatcaagccatttctcagcacccatgctcacatgcctattgtctctatacctgcaatagttaagaagtatattcattcaatggtcttgcaagttgagaaatatatacaaattttaaaggatgcaatacgtatataatttcattcagataatcagatatcagaatttatgtataaaaaaactaataagaaagaaaaatgttctgtgttcttcagtaccaatccagtggtctaattaggaaaaaatttagcataaggaatcactctctttgtgttggatattagaactacatgactagatgagggatcatttccttccggtcagtatttctgccatttttgtacaaactactgaatggacaaataaaatgcacaggtcacaaaaaatatttctcatttattttgcacctcaatgaaaaaaagaataataccatgcagtattgaggtaatcaggtattgcagattcagtgtattagaatattattagatgcaaactggcaaactgtatgctgaaattagatggttgagcattatcagaagttcacaacaacaatttcttcatgggatcaaactaaaaccatccatccaaatagattagtataattctcattctctacaactattcatagttccctacttggctacttcgctcaaccaaaccgagcaatagcaatgtctgtcatgaagagtaagttaaacattttggtttcacctctgcaccttttgttgttgtcgcaggagatgacgtgcacggactgcacgcctagcgcgtcggcggaccggaacgccgcggagacgttcccgaagtcagagagcccctccacgacgaggcaaacggagtagctccggttctcgacggcgcggcggatccgctcccgccgcgcctccatgatgtgcggctccagcacctccagcacctcccggctagtcagctccacgccccccgccgcccggaacgcgtgcaggtaagggaaccacctccgccccgccccgcccggagggaagtccccgtccgcgcgacgctg

SEQ ID NO: 43367 - DNA, 9191 bp, Oryza sativa
ggcggcggtggagagaggggaggcgcggatgcgagatggaggcggaggagggggcctggggcgggggatggaggcgaaggcggaggcgagggaggagacggagagcgtcctggaagccatagctgcggcggaggcggctcgccggcgttcgtctcctgtaagaactggactgtggggaggaggagagcaagtcgccgccgccgccgccgccgcgctcaccgctgctgctgctgtccaaattccaactgctagtgagtagtgaccgctcgataggctggagtgtctcgcgctcatcagaacgggctgggctggcaagtttagctgcggcacattacggcccaggcccatactgcgacgagatgcagcggggtgtgcacggagcccttggagtggttggtgaactggtgatcgggccgtgcggccacctacctggactggacagactatcagagtctccagctcctcaattgccgctggccgctgctagctttcctttctcttttcctgcataataaaaaagttgtgtaacaagtcaccattttcagcaacactcagcaaattaccactaaaatttccaaagagctttattcacaccagaaattcagaaacaacaccatctcccgagtggccaaaatagttggagaaggttaagatagtgagtaatgtggatatatcgacagcgccccttctgcgaattatatatgtgctagactgttgagaacgtcaattccaaatctagtttcaagaagatacattgcaaagacaagccatgaatcacccttcaaggtcgcttcaacagatctgcttcaacagatctggcatcttctccctttcatggtcttcttcccttctgttggaggcgtgaaattggaatcgatggattggattttaggctgtggagagaagtgcaaaagctatacgcatggaggcggcagtggatctcagggtggagagatgatggtgcccccgccggcggctgtgcgacgggaagaggatggctcgatgtatccctagacaggggggggggtcagcggctccccaagttttcggcttggtttgttgttttgagtctttcaacacatcggctcaactctaaagaaggcttggatgcatgcgtcagctgtctacgcggtgtcgcacatgaggcatggtgcgacactgctgcaagaatttttttcctcgtccaagtctgctttgtcgacgaggacaagatctgctgccgcctgccagtgcagagcctcctaccgcccccccccccccccgcatcgccgacatcgaaaaccagtcagggaagagtggatgacttctggttcaacatcaacacagtggcctacttcgaggcggtgaggattgtttgcatgaagaaatccttttataagcccaaggtatacatcctttatataagttgttgggtttgtaataagtgaaatattaatcacgttaacaaatcgttgttgaatactgagttaaataaacaaaaaatgaacaatgaatctctttaatttatggtcttgttatacaaaaatattacaataaacaaacaaaatctgtcaacctttaggttgagatgacatgaaacagttgggttgatcttattttggattctgtttggttagagaaactagaggccaaatcatatagggctagaagtcagaccggtcaatgcaaaaccaagcaacaacaatacatttttctcgattacacatggttatctcgtgttaatatttcgcagttttggatcgattagatacaggtagtatttttttgggttaattggattcatgccagtataaatttgcttgttttgaaatttaccattaccattcagttaattgaaaatatgccacttttgtttgtttgtaattgtaatgatgccattgatctatatattttacatacacttgacagaaatgcccccgtcttcaacctccttctcttccccgtagagcagcaggagcattctttctcactcgctctcggcaagcaggagctcggcgtccctctcaccagcgtcgggcattgctccgggactccgcttgctcccctcactccggcggcggttcttggcagatcggacatgcggatatccggccgcgtccaggcaaggggggtaggcggggggtcacggatccggtgacgatagaggcgaggggctaggattcggcggtgttcatcgccccgtctctctcctctagcaatcaatggtgcacgagaccactcccgacggtagcggtgagctcgtcacaacagcagcaaggtctcggagacggcgggtactgcaacggcggcacgtcagagagctgatcctacagagacaacgagctgtgtagcggcaagcaaatctggctgcgagctgtagcaacaagctcgtcgtgaaggtatggatccatacgggaccaacagcggcaacaacagtagaaacgacatgggaggaggaggaagaagagtgaacaacgccttggactggctcagccccagtggcgacggctgcgcacgccctgaccctgccgccgtcgcttctcttttggtgcctatcagtgaaccctgccgtggaatcgctatgagctggaccaccgtggaaccatggacgagcagcaacacaagagaagaggcgagacgacctcaagctctacctgctgcatattgagggaggaagagacagagagagaagatgaacaagagggaaaggagctgaggaaggaagaagacaagggcatattggtccatacgagaatacattacacaaaaggatgtataacatggcatggttccaatctcagaataactgcaatgatatggtttcaattatataaattataatggtatttttcaaaactagcaaaataataatggtatggatctaattaacctttttttagcataaaggcacaaacacatctgggtccaaatcggtgccaactacacatacgcaaattactaaacaccaacgagcaacgcaacagccgcatatcacagcaatcccattctcttggcgcattccacactaccttccagcgtctcctccaccccatacttgtatctgaaccccaaatccgtgagcttgtttgtatcagctcccaccctcacgccctcccctaccaccctgcgagttcacaaacaaacacatataaaattaatgagtaatattatacgtccaatctagttgtacaacttatatacaaccagagatatgtttttagatatgcaaattatagatcaattaaagacgagcatgctcatatgcatagcaatttccacaattaataaaccatgtaaacaaacaaacaaacaaaaatcaaaagagaaaacaagaaaatgattaattgatcatgggcacacatactctcggagcttgatcgtgatctccggatacttggcggagaagtggtcgacgaagtccttcatgttggggtacccggcggcgcagaggaaacggccggcgatggacggctgctccatgcagaagacgtgcgcgtcgcagacgtcgtcgatgtgcgccagcggcacggagccgagcagcgcctgcaggtacttgagtccgccgtggtaagactcctggccgatgagcggcgccacgatcgccgggacgctgagcaggtggtagagccgggtggtgtcggcgtcgccgccgacgagcgcgcacgccagggtgaccacctcgaacgccctgctctcggactcgttgtacctcagcagcgccttttcggatagcgttttggatgatgcgtaaacctacgaagcacagatttatattctgaatattttcgctaggaagcatgtgttttcagtattggaatacttaaggcatgtttagatcccatcctcaaaattttacacccagttacatcgaacgtttgaacatctcaattaggcttaataaattcgtccgcggtttattgacggatactgtaattagtttttttattagtgcccgaacaccccatgcaacaccctatataatacccaatgtgacacgctagaacttttgacccctgaatctaacaccccattagttgatggacattgatattagtacacctaggagcaatttaagcacacattcttccaacgtgtatctgcagtcggagaaactaaaataacaaaaaaatacactgtaaatgaaaatttgttattttctttctttaagtgtagggctaatttgttgtactaacttatgttatcacaatatatatcttgttgttttttaaaaaaaattatttaaaaataacctttttttttgctggttgattacttgatttatagccgacatgtcgctgctgtatgggtgagactggccgagtggagtccagcaggactcgttgatgaagtccttgtacccctcgccgccgtcctcccggagcggcgaggcggcggtgacggaggcagtgtggatgacgcgcttcaccgtctttgatcgctcgcattgcttcaagatgatgcgcatcgcgtccacggccgcctcggcggtgttcttgtactgcaaaatcaacaaattacccacgttatttacacatgatgacatgacattgatatctttttcctgcgtgttccgatcgagcttgtgactacgtataccttgctgctgggttcatgctgaaacggggtggcgaggaggaagacgaactcgcagccggcgatggccggctcgaaggtgtcggcgtcgtacatgtccgcctcgaacagcaccagccgctccgccgcgccggggagctctctcaacggcgccgccttcttctcatctcctgtcagatatattatctccatatctccaacaattggaaacagggagtgattgggagaggtctctagctggctagctagagatggatcggagtacgttgtacgtaccaagatttctcaatgttccatggacgatgcagcctcgttccaagagcttcttgacgaggcaggtcgcgatgtagccgctggccccggtgacacacaccctgcagcttaccatagctcctatttcccttctttctgttcctctcgatcgggctctagtcaagtggaatatttagttccatggccctctctaccatcgctcaaatagtcgaagggactatctatttatgtcgttatattttttattgtaagaaatgtcttttttattttccactgtatagtggagtacatacgtttacaccataaaggttaaacttgctctgtaatttctctaatgcgcaccatttcttttacttccgccaaccataaatatttgactagataagttcttaccaaactttttaaactttgaccataaattttatattaaagtaaacttataaaactaatactttatgatattacaagtaccttctgttttcgagggattacatcaaaagttattatggcgaggtattactagctggtaacaaacagggcggaaaataccacatggtgaggtggacagatttggctttcccaaaagactttgggggtattggcttgactaaaactagaatgctgaacactgttctatcggccaaatgagttatgaaaattgagtcctcatacaatagtctgtgtgttgagttgttgagaaaaaaaatatctttaggatagaggagtttcccaatgtaatggtcaaaagggatcacaattcgagaaagaattctgaataccagaaaatggatgaaactagggtcatagtggcttctagaggatggaagacatatatggttctggcatgatccttgcccccttaagaccacatacccaaagattttttagatttgtaaccaacgagacatcacaatctcaaagttggtaacaaagagtgctagttgtttatcttttataagatcttttgaagacatagaaagtatgatgtcacatatataattgaagagattgtactagtcaattcaccagacctcatgatctgaggattatcagctaataaactatacaccacaaagtcactctatgaagcaatggcctttagaggtgtgagagatgtgaaaatgcagtgtgtagaagaattaaaaaaaactgggagtgctcagaattttgtcaataggtggggcacttgtatcgaccacccacattctttttacctacctcatggcctctttaacttggtgcatttgtagagattcttttgggtggggaacaagagattttgatgagttctttttgctaattaacaattctaaccaagttgaatctagagtttttactgctgtatttgtggttgtttgctggttattatggaccactagaaataatatgatttccagatccaagccgttgtactctccactgatcctaccttttcgaatcatctctcttttgctgcggagagccctttgtcacactaaggatgttgtggagatggaaatggttgcagagaagttgaaaaatgtgacaaccgctttgaagatccgaagaacaggggttgggtagcctatacctctgctaatgttctgtattattcctgttttgtaatagatctaagagacatcaggtgcttgctactttagagctgcaggttttatccctgttgcatgatgatcgcatggtgtttctccaaactcgttgagtcacttggttaagttgttcatcttttgtaaactggcaacccccattaccaactctaccgtatgacgtaatgtggctttcaatataaaccgggccgcaaggtcttctctctaaaaatacaatgtacgtacttttttagccaaatctacccatatttttgcttatttaaattaagcacttaagaagctataaattgttgaacgctttaaaagtttggctagatatcgtcctgtacatagattgatttacaacagaggcagtagttgtctgtctcagggtttttatttttgtaaatctggaaaaaaatgatataagtaagattggttggaatgagaacattattggaaatgggacggattgcgatcaagttatcatccaactgttcatccatcctgtgtgggatgtgtggctcacacatatcctgttgttgtcctgtacctctccgcagtgtctggatcaactgtatcctccccaagttgtagtacaaacttacatcaaagccctgtgcccctgtcctagctgagtgcatccaatgtttttcgccgtttaatttcctacacacgtgagtggatggcccggccggcctgtctctatatatgtactaggaaaaacagtggctggcttgcttaattatgcatttgcaggaatggaaccagcgaggaggagacgggaggatggactcaacaaaccaaacagatcaagcaggatatataggtgcccgaaacctatagtaaaacctagaccatctgatctgagccaacggtcgtcactcacagcgtggtccgtgtaggcaggggctcgcgatgacgacgcagcagcagcagctagctatagctacctagcatggggctggaactagaaccatggcggacgacgcgttgccaaccgatcagcggctcaggccccttcgccggatcacgagcgccgcaagcaagcagagaagcagagacgtataatggaagcttctgacaactttttttaaaagataatggaagttttattaatagtcagtaaaatacaccaagatgatacattctaacttaatccacccccagcctctgcatagaattcacacagccaaaaacactagacctaagaagacttccccatcacaaaacatagaaactagtggttatcaatccgtagagactaggtcgccacccatgcttctgggtaaaaaaaaaaactcctgtgctacctggtcgaaacgttgtgataccaccgcaatagtatcccgaagtcccggtttgtagaggatggcccaggtgcatagccaccggatgactaaagtagcttttgacaactatagtttcttcaaggatcaaaagttctaccaaatagttttttttttagattctgagacgttgtagttgtagatttcagaaaatgaaaagctcagcttctccaggatctcacaagatagttaccgatcagctatttcttagaattttaaggctttttcaaataggtccatagttatatatgagtcttcacatcggtgaccaacggattgtaacaactccaaccgttacgaatggatggttcctagtgaatgcaccgtgcatactgtagagattatggatacctcgtacccacacggcatgtatatccgactgggtataggggtaccatatacggttagaatatctttagtaaaggactcggttgttatgttaacttgtataataataattaaacattcgatagtcctagtcggttatgattgtagtttatctttacttgcatattccgttagtaatatgagctgtatcttgtaatacggactcctccccctatataatgaggggttcgggtgcctctagaggcacaacttttctcccagattatacgatcaataacacactcggcggatcaatccctggacaggaatagggtattacttctcattgagagggcctgaacctgtataaatctttcgtctcctaagagcatctccaacagcctctctatcccactctccaagttaaattttagctattctagctaaaaaaacgtgctccggccaacagcctcttcaaccggatggctaagccatccggctagccaaaaccctccctccactagccaaatttggccactttatttggctggccaattgtgggccccccacaacccatctccaccatccccacacacggcaactaggaacaggaggagcacgaggagaagccatggagaggagctcgagcacgcagccgccgaccaccgctcgccgtgaccaccgtcctccactcgccgcggccgccaacccccacgcggcgcagcgcgcagcccgccggcccccgttcgacggcgcccgcctctcctccgcgcgccacggccgccggcccccgtgtggcgcagcgcgcagcccgccggcccccgcgcgacggcgcccgctgcccccgcgtggcggcgcccgccgcctccgctcaccgcagcctccgtcctctacgctttcgatgctgtcgcccaccgccgtcatcggcaccattgcccgccgcgacctccgccgtcctccacgccgtagccaaccacgaccgccgctgaacctcgctcctcctcgctccccgccgcacctaccaccgccgtcccctccccacttgccgcctgcttcctgccaaagtcagagaagggctgcaggaatt

SEQ ID NO: 43368 - DNA, 3745 bp, Oryza sativa
gtagagatggtaaaaggagaggctcttggagtgaacaattagtttgactagccaaatcagatggagagttggttatatgggtgtttggaaagttcaatttagagaggctgttagagatgctctaattcatccacttttcctgcttgacagccaccccttttagtattgctgaaatattgtttcgacacattactgaatgtaccgtcttgtcactagctatgcatcgggccaggcatgaccgcataaattcagaggtcgagggatggttttgtggtgggtcggagaagaaaattaacaggctacctgatctgatcctgatcctcgtctctagtgctccaaagtaatcgccactgtacgttgatacgatggagcacacaggccgccggccacgaggagaacgatccatatacccaacctctgaggagtcggtgttcctttctccgacccacagcaacgttatgtgtattgcactgcacgatccacaaagagagtagattttgattcctcaatgggatgtcctctcgttgtttatatgtcgctcaaatggttataaaaagatttgaaaaaaattggaaatttgtattaacatgtgatatatcactctacaaacatacaatttcaaatccaacttctacatctctcaacgaaaaaacaaatttgactgtgaatatatgttaattagttgtagtttaatttgttttgctttttttcgtagcgagatgtagtagttaattttgaacttgttgttataaaaccagccccgaaatcggtagctaaacgcggaagaaacgccatatgagatctaaacatgacgacaacaccgagacacgatatttggtagttcagccgtagcctacatctccggggcactaattactagcgctctttcccgattcagcatattacaacatatcagagttacaacgactcacagccggtcgctgtcggcatccgctccctctcgctatgctaagtctccatacgattacagtaggcatgcccctctatttaagatagattctaagatagagttcgattcttagtctaatcctaatacctattacaactctaagtcctaaactataacgaactacgtaaatatattcgacacaagctcataaccatttgagtgacatataaacaacgaggggacatcccctcgaggtatcaaaatagtttacagatccacgaatgtatatgcagttgtaaaatataaccagctagctagcgtagtgtgcatgactaagctacgttcttcactcaactttcccaacctctactctcgcgtgtattgtgaacaaaaaaaatctttctttcaaaattcatactaatccactttttttaaaaaaataactaatacttaattaatcatgtgctaatgaatcgcttcgtcttgcatgcgcaaggggttagttcccaccaccaacttcatagcttttacaacattaccttgttcaatagtgctccctccgtcccattttaagtgtatctgttctgtcttacttgaaaattttatgaaaaaaataaaaataataagtcatgcataaagtgatattcatattttatcatttaataacaataaaaatactaattataagaaaaattaaacaagacggatgatcaaacgttggacatagaaacccataactgcatttaaaatgggacgggggaagaataagatgtcgagaaaaaaactaaatgatggagcatgcagacaagtggatgaccgataaataacataagagcgagctgaggaggtgaaaaataacataagaaaggaggacagcggccggaccataaaagagtaggtggtggtaattgacgggatatccagaaacttaaaaacagaattcccaataacaattaggttcaatttttgaaatttcaaagacgataaagaggaggggcggtgggcaaaggcgtagtgtcaactgccatagtgtcctggcagttgataggattttgaaaaagtaagaaaaaaaaagaacccaacgatgattaggtctaatttttaaaatctaataaaaagggaaggggatagcgggcgagtcttaaagcagtaagttgacaacgttttataagactttaaaaattcataaaaacgaagccgagcgagtaagtggaggagcgttaaatgagtgagtcagtgagaggtatgtttggatggtagaatttgcatggatagaagatgacggtccattttcttacagacgagaatttcctcggctttgtcggaacactgccaccgctagtggtggcagcatcagacacctccttgacgaccttaactttcagagatgacgccacctgatggtccgcgagcggtccgatgatatcagtcaaaggaagggcttacgctcaatcaagtcataaagtgatttcgaaaggagaatgcgggatgttcatcaaatatacttacattgatggcttcatcacgttccgccgcccccttttcacaaaggggcatagggatgtcactcgccgtggtcgggccactgatcatcacttggccgacgcggcgctccacggtttcgccgctcaaacctgttaatcgagaaccaaccttcgataagtcaagaggaatgcgagcacaagtatgtcaagataaatgcgagaaagataccccgaggagaaacccgggtcgcgtcctctggcctggaatagttataagctggatgggcccgagcctgaagcggctggatccgcctaccaacgaagtctgcaacgacttcatatcccgacaaaccccgtactcggagatcgtcgatgatgtcgataaacgattgaagagagggggtcaaggggggctttgcggtccaagacggaatcttgtccggttgatcttcaggaaccacgaagacagggttcgagttcttgatctcaagataaaaccacctattcctccacttgctgcgagaagaagggcactggaagggaacgtaacgcaacttcaggccatcccgaagtcggaacccgacgcaaccagataccctgttggattccatccaacgcagttcatagtaaaagcgaaaaagatcaaggaaaggctctaccccgatgtaggcctcgcaaagatgcacaaagatgctaaggaaggcgatggaattggggttcaaatggagaagagaaagaccatagaaattcaaaaccaggagaagaaattcagaaggtggagggagaaaaccgcagagaacataatcttcgatcgcaaccatgcgacccaagatgggctgaggattagtacctcctgcttccctctccatggttccacggccaggaagagcgccatcctcctggagtttcttcaacgttgcactggtggaagctgatttgccgaggtccattgctgatcgaaggtcgccggaaaacgagcctaggttgatgaactagggtttcttgcggcggcagagaaggcaaagagtgcatggaggtggtgtgtgtttaacaggtttggctgacttcaaaatagactcccaaaattcctttaaataggcgcactaccgacggtgcgaattccagggaacagagagatgcccgccggaaatttctggtcccgttacgcgcgacggttttttggacttcagtttaaaattcgctcgtgaccgttgggcttcaaatggcgtgctcgactatggtctatctccgcggtcctcgcaccgggaaggacaacagtctcgacacccgaagtcgcaaatggttacacgagttccttttaagcagaagtcgggggctactatcagggtta

SEQ ID NO: 43369 - DNA, 7311 bp, Oryza sativa
tgtatattgctaaggaaacctttcacagaatctacagatgggaagaatcctactcgggcagaaccaggtcgttggcgtatcgtatagggtctgatacctccgagttctatgaggaaatctccacatctgcgatataaaaggggccccccggggagggtttagacatcgaatctcagagccaacacaacctccacagcctacgaagccggagcttacgaggagccaagtcatcgagagctagtcgaatcaactcgactacaatctcgccggatccgacaagttcccttgttctctttgtaacctgtgttttctaccatataattccacatcaactggactagggctattacctatcaaggggtctgaaccagtataattcttgtcttttgtttgcttgatgtcgtactacgtagatccttgtatcaacgtaccccaataccctctatatccggtctacgggtatcacccgtcgacaaatctatgatccgatcacaccgttgtattcgttgtaattaaatctttacaacaagatatcgcatgattatattttgataaaagaaaaacatatgtttcaatctgttaatacttattgtttcacatgtgacagcgacatgttacaatgtgtatcttcaccatgtttcataaaatatttaaatgtttcaattgctgttttttttgtttcaccatatataacttaatatttcacttgttggtcaacgctctcccccgcactgtcgtgcgcccgcgttgctcccgtgccgcgttgcttgcctgtcctgcatgtgttgcttgcgttgctgcttgcatactccctctccctctccctctccctctccctcctattacatgtgcctaattttttcctcaaattttaaatatttttctccaaaattatatatctgatctaagtttcaattataccattagatttttgcacaaatacttaattatgttgaaatatttttaaatagacgctacaaatcatacgttcaatatttttttcaaatatcaaatgctgtttctcgtctgtatgcaggaacgcgttggaggagtgaggttgtcgcgtgcatgcatgcaggagtatagctggttgccaaggtggcctgaggaaccattactctctctctcttaatcaaactttaaacaaaattctattctaaaatatatatccaatctataatttataacaagatctcacatgaatatattttgataaaaatatatatgcgttctagaaaaaaacaaacttatgttgaactatttaaaaataattctttcatcacttgtggagatgtttcaacgcacttcacaaattgttccaaagaggtacaacaaataaaaagtattgactgcaacaataatcattattacatgaaacattaagtcccgactagtgaaacattttttatatttagattgaaacatcgaattataattattgttgaaacataaaaaatgtatttgctgaaacattgctaatgcattaatgaaacatcaataaatgcttgttgaaacatttcagtaacaatgtgtgtaacatttagaaagtaaaataaaaaatcatcggaatgtagtcatgtgatatcttgttataaagatttaattgtaacgaatccaatgatataattagtttgaaattcagataaatagtttaagagaaaaaatcatttaaattttgaaacatgtttgcatgcatgctccgttggctcgtcatacacctaactaactgtctcaccatgcacctacacggttgttcttttagattgagacgctcgattttttatttctggccggacggccgatggtaagcatttccgcaagaacacgagccattggaatctcatttctctctgccatgccaattcatgtgtgtgtaaaattgattgataggagtttgacagcaagaacgcaagaaccattttttttctaatgaattcgtgaaatttgcttatatttttttaacacgagaggaaaattactcgtttgcacgtattgagtttgggagataaatagagatatatgtggtggtgcgggccggtattcttaccatctccaagtttgaggtgatcataagagcttatccaccctactactcctaactaaacataaatctagataagcaaattccaccaaacaaaaaactagaccaccatatctatacctaatagaaaaataggtaaatcttccataaaatttttcgtccattggtatctggcttcgattactatttcctcgatgatccgtgcaatacaaaatccggacgcatgacgctaacgcctaacaacgagattttttgaggtccctcatctacaaaactagaaatcttagcccctaaactcattcaaaccgttcaccggaggtcccttggcagtatatgtaggtggtttcgctgatgtggcatcctagtcagcaaaaaaaaattaaaaaaggcccacatgtcagctgcagtttttttccttctcttttctctcctcctcttctctttcctctcctctctctttgctggcggcgggtggcgatgggcgagcccgcggccggagtaggcggaggggcggcgtcagcgcgcggctagagcaagcggagcggcagtgtctccgagcgagcacggctgcggcggcggccgcgttcggctgcccctagcgagtggcggccacgccggaggccgtggacgtgccgcggctggtgctccacttcgatagcgctgggtcatggagtagcagagctcgagcacgggggcaatgccgcagagctcggggattacgtcgtagctgaacccgaacccgagatccacgcacccttcagctcctccaggtcgtcgtcgactcgtcggtcaggctccgtgcgtgccgccgccgctgccatcgctcccgctccttgccgtacacgcgccgccgccaaagacgacgacgccgcagggctcctccttggcgaccaccaccagcttcgtccaccgtggccacgccgcctccgagcgcggcggagggcaagcggcggctccgggcgtgggcggcacgcggccggagcaggcagagcggcggcatctccgagcgcgggcagagcagagcggcgggggacgcggaaggcatggcgggcgagcggcggcatggcgtcgcctatttccccctctcccgccggcctcatctcccccactccgcccggcctcctctccccctctcccccaccaccaccatcaccatcacttccagggagccgaggcctggagcgaggcgcgccgctctcgccgccaacgacgacacggctggcgaagtaggccggcggagctcgcccaccaccgccacgctcctccttcggccacctctatgctcgcccgccgtccgctctgcccgcagcccgccgcgcttgccttccgctcgcccgccgccgtccaacgcctctccgcctgccgccgcgccgcccgccaccgttctgcccacaggccacgctcggctgccgcgcggacccgccaccgcgcttggccgccgcccattcctcctccgcttccttccttcgtgctcacccgccggccgcgctcgcctgccgcctcccaccgccacacggacccgccgcccgtgcaacgccactctgcctgccgctgcgccacctgcctccgttctgcccacaagccgcgctcggctgccgcgcgaacccgccgccgcgctcggccgccgcccattcctcctccccgtgccattcctcctcctactcctccgcttccttcctccgtgctcgcctgccaccgctcggctgccacgcgaacctgccacccacgcatcgccgctccaccggcctcactcactctgaagaagaagagaaagagaagagagaaaagagagaggagaagaaaagaaaagaaaaggaagatgtgcaactgacatgtgggccccatgtactttttaaatgttttttctgctgactaggacgccacgtcagcgaaaccatccacatatactgctaagggacctccggtgaacggtttgaatgagtttagaggcgaacatttctggttttgtggttgagggacctcaaaaaatctcgttattaagttgagggacctccggtgaacttattccccccgcaaataaaagagaaaagagagagagaaaaaaggaataagttcatctgaggtctcttaacttgtcaacgaatccgattttcgtccctcaaccaaaaaaaccagacataacgggtccctcaactatcaaaaccgatgcagataaggtctctcagcggttttgagggtggtttttgctgacgtggcacctacgtggctaatttgacacggtcttcatctgacgtggcgcttacgtggcaatccattcagaaaaataataaaacccgtgggacccacatatcagtttcacgcacaaaataataataaaaaaggtgggacccacgtgggccccacttgtcatcctcaccctccctccctccctctgtctatcctctctctatccctttcctctctccggccgatggagcggggcgagtggcagccggcagagcaggcgacgggtggggcggagcggctagccggcggagcaccacgttgtccatggccctcagctccggtggcacgttgggctcgtcctcgaacacttccaaccccgcgccggcgacccttccctccgccagcgcacgcaccagctccgcctcgtcgatgttggcgccgcgcaccacgttcacgaccacgcccacagcgtgtccagcacgccccagtccatgatgtgatgtgtctccgccgtcagcgcgcacgccacgacgagcacgttggagctcgcggcgaggtcggtggtggtcgaaaaagaaatcaacaaaagaaagacatccccagaaaagaaaaggcatcatcatttgatgaacaacataggggaaaaaggtagattaataaacgcatgaatgaactaaaatcttgaaaccacgcggagcaaaaatgaaaaccgaatgagttcctaaatccccgaccagcccttatctttgaagaaacagaaggcagattggggaagaatgttaccaccaaaagaaaaaaagatacaatctctgaaattcataaaggttgaactggtgatgacgagatagtcctcaaaagaaacctgcaaaaagacgatctcgcagcaaagtaagagagcagcaatacaatcatatgaaaccatagagaacatcaaaggccatgtctacccaagaacaggagaagggagaaggaatcacaaccaaagctgatgcatgtcatcagaaatttcacctcttttcctttgcatttgcagctgcaacccgatggagatccagctgctccctatagcagaagcgggcgacgacgcggtgctcccccagcgcgtcaagcacgcccccagtccagatgtgccgtgtctccgccgtcagcacgcacgccacgacgagcacgtcgaacagggccgacagcggtggagtagaccccgccggcgttgacgacctgtacgccgcgacacacgcactcgcggaggtcgatgtggttgatccccgcgctgatggtgatgatgcagcggagcgacgggacggcgtcgaggagctcggcgccgacgcggatgggcccgccgccgaagacgaggacgacgcgaggtgggtcggcgtcggcggccaccgtgttgagtaatgcgtggatgggaagcgtcggcgccgaggagaggggagagagaggatagagagggagtgaggatgacatatggggccacgtgggtcccaccattttttttattattttgtgtgtggaactgacatgtgggtcccatgggttttattattttttcagctcaaattgccatgtaagcaccacgtcagtgccacgtcagataaaaaccgagtcaaattagccacgtaggtgtcacgtcagctaaaaccgccctcaaaaccgtcgagggacctcatctgcaccggttttgatagttgagggacccgttgtgtctgattttccggttgagggactaaaatcggattcgctgacaagttaagagacctcagatgaacttattccagagagaaaaagagagaaagctagctagcagcccaaccaaagcagcagcaagccggcccagcaaaaagcaactacagcctagcagctagcccacagagcagaggagcagcagcccagcacaatactgcatgacactgtagcaaccaagcacgaacaataccacctcgcttttccagcttgagcaacacagcttaaataggaggcttgttgaggactattaatgctgcatagagtttggacttacacaaacaaggatcgaagaaaaaataacacatttttaaagttataataaaaacaatcacatgccttttttttaattgaatcgtgtttacataacctaaccacatcatcagtttttttttctttccattcattgcacgatttccttctgatttttgtagagtgaaatgattttacgattggagtgtagtgaacttgatatgatagctagccaaaaaacatttcttctactatggctcttctttgctagtgaattttttttatcaatatcaagtaccggaaaaaataaccattcattgcaactgaatctaataataatacatgacaaaagtaaatgtttattatggtttcaaattttagtttgtaatacataattttattttaaggtggtattaatagtttttttataatcatccatgtcagtggatctagagcaacaaataattatgttatgtgagtgtctttcctctttttttaagaaaaaggacacccatgtgagtgtctttctggcactggaaatatttgatttgcctataaggacttcacttaacctggtaatcttacgcttccacacattcactactacttttttttatacttcatctagtgcaacgtaccaacatttttactagtatatgggtgatcatattccatctcacttgaccatcatccaaacacgaattttttttatttataattttttttattaaaagttttacaaaaataatttttcattttgaaaattaacggaaatagtcgcctaccgccctcccagagggcgatttttaaaaatcgccctcccagagggcggcgaaaatgacgtggcagacggccgttcgctctcgggcgacggccgtcaacgaaatttgcaggcggcccccttgccgccctccgcgagggcgattttctactgtgcggggggccgcctgcaaatgggcggcgagggggggcatggaattttgcaggcggcccccttgccgccctccgctagggcgattttgcactgtgcggggggccgcctgcaaatgggcggcgagggggcatggaatttttcatgcggccccctt

SEQ ID NO: 43370 - DNA, 4462 bp, Oryza sativa
agggcgattttgtactgtgctctatattttttttatataaatatcaatagttatcaaatctttttatattgaaaactatacaagactaaaatctccaagactggtaaaatacaattttattattttttagggcatatttggaatgttaccgtacaaatattttgttaatgccaaaatataagcaagttttggcactaccaaatatttggtatggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggtgagggatcgacgctccgtgagaggaagagctggcgaacgcgcccgaagaggtggcgaacgcccctgcggagctcgcggaagcgccggtcgtgcctgcgaacgcgctcgaaggcatacgaggtcctgcgatgaggaaacgtgcagttaaaaaatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgctcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtatggctcgatgatgtaattatcataaaaatttagaaatgaacaatccgaactcacgagtggtcggcaggggggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaaggaaaaaaaaaagaagaggactgataaacttataacgcagcgaagttgcactaaccccacgtcgacaccagtaagtccccatcgtgggaccgtcctctggccactgcgcgctgcgaccaaccccgtagggtgcgctgtccaccactagtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtacaaaacactcagccggtcgcaaataagcatgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtcgacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtgcaaaacaaagcaaagttgagttcaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaagattgaattgtaattacacgatagaagtatttagtccgaacactcattacatcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaactttgatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttat

SEQ ID NO: 43371 - DNA, 869 bp, Oryza sativa
ctaaacattaatatgattttccccattgtgaactagttgaactaagcatggctaagcaattcctagtccaaactctaatcatgttataaccccaagctaacaaaggagcatggtatcaaaatagtatggctgtaacaataggtaaccatcccatagtaatattgcaaaaccaatgcggtatttgaaagaaaacattaggacatttgcaatataggatcaatatgatcaagtgacaagcatgacttgccttgctctgctgctggaggaacctcggcgactatctcgaagtacaccggagcgtcagaggaatcggaatctagcgacatacaaagcaaacattgcaaacaggctataagactactgaaacagggaacaaaaccatttttaatggattctacacatttttcttgatttactgagacttgaatgggattaaacggagctcggatgaattagttatgaattttagaagattcactgtgtttattactataaaagaaaaaccttaaacaatttattgcgcaatattaaccagggctgacgtcagcacgggggagtgcggcgccgacaagcggggcccaccggtcagcggcacggggaggagagagggcgccgacacgcgggacccacaggtcagcgacccggggaaaaggatggggcggcggcgccacgtggcggccggaccgacggccccgatctacccaagggtaaattggacggcggcgggagctcgcggccgggatgcgcgggcacggcgcaagccgaaccggcgaccatggcaccggcggcgcggcgctcacgcggcggcggcgcgcaggcggtagcggcgcaaggcgacggccgacggcgaccgaccggcggcggagagc

SEQ ID NO: 43372 - DNA, 1519 bp, Oryza sativa
gacgcgggggagtggggaggagagagaggcgggattcggttttcgaatcccggccatctcgggcgcgggcgcgagcgggagagagaggggaaaaggcgcggagagcgcggcgcacgcgcgggcgtggtcgacgtggcccggagaaggcggaggcgtgggcgcggcgacggttgcgggcgcggcggcgcgccggaatcggcgggaggagggagacgggtccgacaggtgggccccacctgtcggcgaccccgagagaggaggcagcggggcggcctgggctgccggactgggcctcggcctgcggccggcccagcaaggaggagggaaggaaaaagggaaatgggccgacggcccatttgacaaaaaggaggaaaaagaaaggaaaaaagaaaaagaaaaggaaaaaggatttttccctggaataaaatattgcttgctcaattttaattggttaaaattatttctagagctctgaaaattccactaaaaatcctgttaatgaattttgacatgtagaactcaagaaaaattccacatgtcaagtctgattattatttgcattactttctttagggttttctcctgatttcacctgcattttcttagggtcatttgcaaattaccattttgacttgggaggaaaacttcggggtgtgacagggctagtgcctggggagatccacatgtcgagactggccaggccgggaacgtggtgaccgagggttatgggtgacccaattgtgggtttttgccgattcccccccggagttcaccacgccccggggcacggctcggttctgggccccgtttggcgatttttagccgacccgagcccccgagggcaggattgagcacgagtgacctatttcaagtcaagattcttcaaaaggaaaaaacagcacagatacaacctttaggaaattgaaactgcttttattgaaattctgaaataagagaaataagaaagtgcatgtgtggcagcccccggccaaccctgcacgcccgagggggtgcggggttggcccgagcctgaaacctaacacccgacccccccctcaggggtagaagcgacgaaggtgctcgatgttccatgggttaggcaactcagtgccgtcgcccgtggccagccgtatggagcccggccgggggacgccgatcactcgatacggaccctcccacattggtgagagcttgctcaatccagcacgcgtttggacgcggcgtaagacgaggtcgtcgacgcagagtgatcgggcccggacgtggcgctgatggtagcgccgcaggctctgctggtagcgtgcggctcggagggccgcacgccgccttcgttcttccaagtagtcgaggtcatctctacgaagctgatcttgatcagcctcgcagtacatggtggtccgaggagacctcagggtgagctcggatgggagaaccgcttctgcgccgtagacgaggaagaaaggcgtttccccggttgctcggcttggtgtggttcggtttgcccagagcgccgctggca

SEQ ID NO: 43373 - DNA, 6129 bp, Oryza sativa
tgaggcctttgaggatttctgcattggcgcgctccacttgaccattgcttctggggtgggcaggtgaggcgaagcagagcttgatgcccatgtcttcgcagtagtcgccgaagagttcactagtgaattgggtgccgttatccgtaataatacggttaggcactccaaaccgggccgtgatgcccttaatgaatttaagcgcggagtgcttatcgatcttgatgaccggataagcctcgggccacttagtgaacttgtcgatcgcgacatacagatactcaaacccgcccggggcccgcctaaacggtcccaggatatcgagcccccagacagcaaatggccatgaaagtggtatgatctgcagggcctgggccggctggtggatttgcttggcgtggaactgacacgctctgcatcgccggaccaggtcgaccgcgtcattgagagctgtcggccaatagaatccttgacgaaaggccttgccaaccaaggtgcgcgaggcggaatgggctccgcactcgccttcatggatatcggcaagaagctcaacgccttgttcctgaggaatgcacttcaggaggattccgttagccgcgcgccgatagaggatcccttctaccagcacgtagcgtttggaaatgcgttggacgcgttcactcccttcgcggtcctcaggtagagtcttatctgtgaggtatgcttggatctcatagatccaagcaatcaatctaagggagctaggagcgctcccctcgggtcccgaggcctgggctccgacgggcctcgggggccgatcaggcgcgtccgtctcccttaaggggtcgggtcgcgccgacggctgggcaagcctttcttcaaagacgcccggtggggtctgggctcgcgaggacgcgagtcgtgagagttcgtcggctatcatattatcccgtctgggcacgtgccgaagctctatcccgtcaaaatggcgctccatgcgccgtacttggcgcacgtaggcgtccatctgcgggtcagagcaccggtactccttacagacttggttaacaaccagctgagagtcgcctaacaccaagaggcggcggatccccagtccagctgccactctgagtccggcaaggagcccctcgtactctgccatattattggtcgctcgaaagtcgagacggaccaagtatctgaggacgtctccgctcggagaagttatcgtgacccccgcaccggcaccctgaagagacagggagccgtcaaactgcatcacccaatgggcggtgtgaggcagctgcgaggggtccgagctggcctcagagactgaaacggtctctggagccggggtccactctgccacaaaatcggcgagggcctggctcttgatagcgtggcgtggttcaaagtgcaaatcgaactcagaaagctcgattgcccattttaccacccgtcctgtaccttctcgattatgcaagatttgaccgagggggtaagacgtaaccacagtgacccgatgcgcctggaaataatggcgcagtttcctcgaggccatcagaatagcgtaaagcatcttctgggcctgagggtatcgggtcttggcgtcccggagggcctcgctaacaaagtagacaggccgctgcacctttcggcggggccgattctcttcgctaggggccatatccccggggcgctcttcgtccaagtggcctctcggggcgcactcgctttctgtgccgatgacctcggggtcggaggaggacaggggcggccttcccacagtggcctcggggccgtcctgggggtcgggggctcctggcgtcgtcggacgagcgggcagaggcccaactccggtcgtcaggggccttaggccaccgttcggctcgggggcctcttctccctgctctcccctgggtcgagtccgcacagggttagcctcggggtcaaagggcgataggtgcggccttcccgcagtggcctcggggccttcctgagggtcgggggcacccatcaccgtctgacgagcgggcagagggccgactccggtcgtcagaggccttaggccaccgttcggctcgggggcctctcctccctgctcgctcccgggccaagtcagcacagggtgggggtgcgcggaatgaggattgtcctcatcacgctccacaaccaacgctgcgctaactacttggggggtcgccgctaagtagagtagcaggggctcatttggctctggggcgaccagaaccggaggagagctgagatatgccttcaatcgaatgagggcatgttcagcttcctccgtccaagcaaacggcccagagcgtttgaggagcttaaataggggtagcgccttctctcccagcctcgatatgaaacgacttagggcggccatgcaaccggtgacacactgcacatccctaagtttgctggggggggcgcatccgctctatagctcgtatcttctcggggttggcctcgatgcctcgggcagagaccaagaacccgagaagtttgcccgcaggtacaccgaatacgcacttatcggggttcaattttatgcgggcggagcggagactttcaaaagtttcggctagatctgagagtaaagtctcttggttgcgcgtctttacaaccaagtcatcgacataagcctcaacattacgtcctatttggctacccaaagaaattcgagtagtacgctgaaaagtaggacctgcattctttaacccgaagggcattgtcatataacaataggttcctatgggggtaatgaacgcagttttttcctcatcctccctagccatgcgaatctgatggtaaccagagtatgcatctaaaaaacacaaaaggtcgcaccccgcggtggagtcgacaatctgatctatgcgaggcagggggtaaggatccttaggacatgccttgttaaggtcggtgtagtcgatgcacatccgaagcttgccgttcgccttaggaacgaccaccgggttcgccagccactccgggtggatgacctcgcggatgaatccggcctccagaagtcgcgccacctcctcgcggatgaaggcttgacgttccggggcctggcgccgcactttctgccggaccggccttgcgcccagccgtacggcgagacggtgctcaatcacctccctggggaccccgggcatatccgccggtctccatgcgaagacgtcaacgtttgcccgcaggaaagagacgagcgcgtcttcctatttgccatccaagagaccaccgatccgtgtggtcttggacgggccgtcgcccaggacaacctccttgaccgggacctcatcgcacgtgactatccgctgcctcggggcggcgggggcggatgtaccaagcctctcgtcgccaccctcgggcttggacacgacggcgaggcggtccgcgcgctgctccatacaagcgagcgcgactttgaggtcgccatggacagagatggggccatcggggcccggcatcttcatctggaggtaggcgtagtggaccgccgccatgaacttcaccaacgcgggcctccccaggaccgcgttgtagggcagactgaggtccgccacatcgaagttcacccgctccgtgcggaaattggcgggtccaccgaaggtgaccgggaggtcgatatgacctagcggccaagtgtgccccggcgtcacaccgatgattggctgggacggccggagcatcatccccggggccttgatggcatcaaaggctgcgggggaaaggatgttgagggctgctcctccatcaatgaggacccgccccaacttcacgttgcaaacggtgggggaaaccaccatcgcaatctgccctccccgggcaacgcacggtgggtggtcggtctggtcaaaggtgagggcaacctccgaccaccgcgcccgacgcgtcgcctcatgagtaggggccccggccagaagctctcgcttcatagccttgaagctccggcgagaaacgtgagcacacgctcctccatcgacggtagcaatggtggccccaggctcttgaaaacctaggtcatcatcgccatcatcgatgtcctcggcgggggccttctgcttggcctcacttcgccgatggccggaaggaaccgccggggacttgccttcccggcgctcctgcctcctctcctcctcccacttccttgtccgctcagccaagcttttgactgcgcgacagtccgcaaggtcatggagggaggtgttgtggacggtgcaccacttgccggtggggcgctccctgctgggagcgctggcctccttctttttgtcgctcgcaggcctcccctttcgggtggcccgcgaagcgccctcaacggcgaggacatgaccctcgtcgtcggaatggactgacctctttttcctcctcctgtcacgccgccctgtttgagcagcggatccgggggcggccgaagctgccacaccggaaccggaggggttccaagtccaggcctcctccttgcgagccactcggtccgcgagctgaaaaagctctgcggtagtctggggctccttggaggcgatcttttcgagcatgcggttgtgccgcacgccccccctgaacgcgtaaattaccgcgtgtgcagggatgcatggtatggtgttgcggacttgacagaaccgctgaatgtacgagcgaagcgactcatcatcccttcgctgtactgcgtgtaagtccgcttcttcacctgggcgcggatatgtgccctgaaagttcatagtgaactgctggcacaaatcctcccaggagtggacagacgcgggtggcaagttcattagccaaccccgcgcttgccccttcagggccatgggaaagaaattcgccatgaccctgtcatcacccccggcggcctcaatcccggtcgtgtagacctggagaaactcggcggggttgatgctgccatcatatttttcggcgatggtgggccggaaccttgggggccaacggacattccgaagactcgccacaaaggctctacagccgacaccaccaaccgggggcacggagggctgatccccacgtccgtgtcgaggtgacactctggacgaggaagcgccctccgttgcgtgggcagcacttcggtcattgcgccggcgctcgatgctggtgcgggcgtcctgctccccacgcagatcttcccgggtcgaaggagtcgacgaaggagtggcagccgaacggcgaacagcggctgccgctcgtcgtgccctccgtcttgacgatgcggagccggtggtagcagcaccagaggccttggtggcggaggaccgcccaccagcatctaggcgctgccgcgccgtcatgaccaatttggccacgtcgtccagccatcgttgggctggagactccgggtcagggacgacaggcgggtggcgtaagagcgcgcccgcagcttggagcgcgccctggggcgtgctgccgtcgccgtagacgaggaggcgacgctccccatctcgccgttcttttccgtcgcccgcgatcggtgaagtcgcggatctttcgaccctctcgagcgcctccccctgcttaggactttggcgtggagggggcggtggagtacgagctcgacggcgtgggttcggctccccgtcgtcgccactcatactcggagagaggtcgtgcgcctttgcttgctcggccatcaggctgaacaggaaaagcttggcgcacagggcagagtgcgagagctcagaagacacacgctgaaccccctacctggcgcgccagatgacggagcgtggggctcctcaccgggagaccgcacaggcccccctttgccggttcggccgggggctcagggtgagatcccaagctctctctgtacgtggaaagatcgcgacctatcgaaagagcatgagacacaagcgatgtatacaggttcgggccgctgagaagcgtaataccctactcctgtgtttttagtggatctgtgtatcaaggagctacaaagtgtgagccaacctccccctttgttctaggttccgaatcaggaaagaatccaaaaaatcccccttctccatgggcaaggtcctccttttatatttcaaggggataccacatgcaccctccctttccaaactggacttttcttctcttcataaatggacggagatttgcacggttgccctccga

SEQ ID NO: 43374 - DNA, 13308 bp, Oryza sativa
tgcactgcactgtatttcgtgcggcgtgacacgtttagccgagccgcaataaatgcggttaggtgagccccgctgtgctcacctaacccatacacgcggagtagaacccgcgaggggtcggggcgcctcggccctcgggggcgaggcaggagtggtccgaccccccctcggggagaccaagaggtgggcgcacacatcaccctcgggcccgacgtcccccgagggtgccaggccacgtgggcgattgtgtctgcctcaagcctctagtcgtgatactcccggtcccatgtcaccgacaatatatatatatatatatatatatatatatatatatatatatatatatatatatatatatatatattgtaagttacttttgtcatatatgtgatttaagctctttaataacttatatattttaaatcacgtattgtttttggatctatttgcgtcattatgctctacataaaatatgtgacaatgcaatatccatattggatatatattcaaatattttattaatttaaaagtcatgtatttaaattgcagagtaatttagctatacaatagaagtaacttagctatataatagaagtaacttagctatgcaatagaaataagtttctgtagtagaagtaattatatgcaacagaagtaatttagttatgtaatagaagtacttctaactctctgtagtataaataataatttacataaatcataaaagtaacttagcataaaatgcaagtaaattgttacaagtaaattcgttgtaggaaagaaaatatggtctatcgaaaaattaaatttaaagtccacaaattacagaattgactaaaaacaataatacaaataatcaatttagagcattatgaatgtataagaagtaacttagtcaaatataaaagtaatatatatatatatatatatatatatatatatatatatatatatatatatatatatgataaaagtaacttacgtatataataaaagtaatttacaaacataaatattttttcgtcgcaatataatcatgtaagatcttgttgtaaagatttaattgtaacgaacacaatggtgtaatcggattgtatatcggataagtaattttagagaaaattttataagaagggtaaaaagaaatgcatatctatatagatgtgtaggcgtttgtctgctgtcttccgttcagatgtgtaggctttctctgctatgtacgtaagctttctataccgtctccgttaagactaaacagagaggcaaacactgatattttacaaagtatatctgtggattatatgagccattaatatattgttattgcgcatgtataggagacatggaatattgcgtggagttgaccagtatgtcggcactttgttggcgtgtagcaaatgtcatgatgcaaaaattctatgggcgccataggttttcctgtggtggaacgagttgacgtgagtttaaattctagattagtactgttgctcgtatttacggtttttttttcataaataaccgatgtactctttaacaataagataagacctttgtcaatctcgagttatacactttcggtgagttcgtcaattataatatatacaccttcatcaatctcaagatgcatgtgctggctcagtattcatataagtaggggtgtgcaacatattcatgtgtatcaatctctcaatatgcatgtcggctcagtctttaaatgtgctcatatgggtaaaggtgtgtgatacgttcatgtgtatcaatctcgatatgcatgtgccggctcagtctttatatgtgtttataggggtagggatgtgtgtgcatatttatagaggtgactgcgtatgtgtatatataagcgtctacgtttgtgtcttgtaaaagaaaaaaaaatttaaaatcaaaagtaaggtagaggcacgtgagaaaatgttttttttcttgactatagacgtttttatttgtcattttgtgtttagatgattctgttaatccctacgtgtaaataatattcttctagttacttttagcagggctacgtgtaaacaatattcttctagctacacggctgagctactttcttattatttgtagacacgctttctaaactgttaaacattatattttcgtgaagaacatgtgtccagttcagcgggaacgtgccagttacatggttacgggacgagttggatgcagataccacaagcaaacaagaggtggcagttacagtctcggtaacatggaaagtcaaatgcaagtaaatacttcatccattttatattataagtcgttttgattttagtcaaagtcaagcagtttcaaatttaatcaaatttgtagagaaactagtaaaaatttcaatccaaaacaaatacatttatgaaaatatattcaattatatatttataatgaaactaatttgataatattactatatttttctataaacttgaaatggtttgactttgactaaagttaaaacgacttataatttgatacaaatgaagtaataaggattggattaagtcaagtatagccttctataacttgtgttaaagcttaaatgtgaggcacaaatatgtgactgttgtgtgtttcgttgctagttgctacaaacctgcaaacacacctcttatttgtttataaattcaaaaagacaatgtaagctaatgtgcatgcagttcaagattgacataatacctcctttgattggagtagatagctttgcaagccggtggttgcatattagctagggaaggaccaaattagagcgcaagaaactgcactccatcgttttggttactgggatgatccacaaaaatgtaagaccagtgtctttcgtgggatgacatatacggcacaaagagctaacaaagacaataacaatgatgaaggagctatgaatttgattgtatgtaaggatctagactaatagctaaaaaatgttctattttaggaggtagtataatatagcggttatccggctcatgcgagctagctagcctatgatattatatatgagtctaagctgagctatgtgatttatgggtccgagttttttttctcaatccatggttgtacgatgtttttgtgagcctcttaagttctacggcgtaattagctttggccaacaatttatttaccgtgttttatttatattatctatggtggtgtttgaatctcctgaaaataaagacgaagataaagattaagtgtttcatgcaaaaatgaattggtaataacgtgtgattaattgagttttaattattacaaacttaaaaaatagattaatacgatattttagagcaattttcatatagaaagtattcccataaaacgcaccgtttagccgtttgaaaaatatgtcactgagtatccaaaattttatctctgctagtagaggaaacgaacagggctcacattaaagaagaatgttgctaagcaaaatgcaagtactcagccaacaacccacttgctaaccaaaacctcgatatctatcacatgaactaaacatggcacttgcaggagcatcaacaacaacccacctgacacctacacttaaccctaacctgaaacgcaacgaactgcaagttagtaccactccacgtgaccgcgcgcccatctagcacgtcaaaaacgctcgcgacgcgcagtagaaaagccacccccacccggtcggagtcggaaaccgaccgagcccaacgcaccgcaccgcaccggccaaccagtccacggactcgcgagcccaaaccgctcagccgccgatggcgacgccgccgccgccgccggcgccgacgccggaggtgttcgacgtcgtcatcttcggggcttcggggttcaccggaaggtacgtcatccgcgaggcgctcaagttcctgcccccgtcgtcgtccccgctccgctcgctcgcgctcgccggccgcagccgcgaccgtgtcgccgccgcgctccgctgggcggcggggcccgggggggcggcgcccgacctgccgatcctcgtcgcggacgcctccgacccggcgtccctcgccgcgctcgcggcgcgggcgcgcgtcgtgctgtcctgcgcgggccccttccgcctccacggcaggcaggtcgcggcggcctgcgccgccgcgggggccgactgcctcgacatctccggggagcccgagttcatggagcgcgtcgaggcggagttccacgaggccgccgccaagaacgggtcgctgatcatctcggcctgcgggtttgactccatccccgcggagctcgggttcttgttccactccaggcagtgggcgccgccgtccgtgccggtgactgtgcaggcgtacctgagcctggagtcggacaagaggatcgtcgggaacttcgggacgtacgagtcggccgtgctcggtgtggccaacgccggtgaacttcaggcgctgcgccggtcgcggccaaggcgacccaggcccaatgtgagctaccgacttctctcagtttgtgaattgatttacgagttctatcaaatgctaattcaatcatctataaagttgctaattcgatcattcaatggcgtggtagttgataagggaactaaggctacctcaccgaaacaacatttgcatacagttagaacttagaaggatgattcgtcccctaattggatatgctgctcagtgttgataaccttctagttttattggtccattgtgaaatttcttttgttattggtgtcattgacttattgtgaatggttgtgatttcctttgtgctgttttctagtttgcccgaggatgaaattttccctgttttgatatagaatacatcctaagtcccaaatgctccaaacattgtttgacaaaatgatgattggtaatgacaattggttaagagcaaacttattgtccttatgataaaattgagaatttggtttttgtcgatcaatgtttatttcatgctgaatagagtttttcttttgaagggaaaacaacacgagattgtgccttttcattgaatatagcaggaaaaaataaaacccctaggggtatgctgaatagagttttgtactggagcagtacaattttattttccaaacgaggaatagactcttaatataagtataagatggttgaaggttacagaatagatacaatgaagaagggcgatccacatatttcgactgctattaagacgatatacaccactactgatgtctgtgaaacatgctgtgtgggcgccctttaattaactcagtatcattctttccctttttaatttgtccacaaaagatctatatgtcctactctaaccatcacctttgtttcaagtggtctgttgttggtacttggtacaatcacatgccaagcaaactctgccacttaatccactattctatcaagttgttgccatattatgcaccatctttgagctaatgaataacttttcaccttttttagaaaaaaagtctcggtactgtcatactggtgacatgtaaactaaatgactggtaccgtgccttttgtgtgaatgtgacgctaatccatgaggaataggttctcttgtttctttgtgcatcatattgacatttgctagttctttatgtgtcttacatgtctatatgagtactccacacttccccttgatgtccttgataatgattaattgcttccctctccaagttgttagtattgtgttcttagggcctgctattttcttccgctctattaatacatgagtcaagacagagcctcttttctttcacagggcctgttatcctttgattaagatcagagtgatgtattaacctacacgcctaattttaccacaacaccaaggctcttaagtatcactgcgctattttcacatagaaatagttaaaatcctacttaatcatgaaaactagcatggctagccgcgcagattgcgcggctagcatcattatattttctctcgtataatagcatatatgttttctcaatgtattattcaaatatattaaaataacaacataattttaaattttgtgctaacttacgaatctactaatgtgtaaattcatattgcattttatatacgtgttatttattaattatatttaatatcaaattttagttatttgtaaattatattcctatatggactctagactcgtctttcaatattattttaattccgaattttcgttatctgtaaattgtatttctatatagaatctaggctgttcttccaatattatttatttttaattctgaatatttctattatttcgatgtggactctaaactcatctatcaatattctttaattttaaattttgaatttcagttacttctaaattgtattcttatattgactttagactcttcttcccatgtttttttaattttgaattttagttatttgtaaattgtactatttttatatgaactgtaaactctactttcaattttattatgtttatttcgaattttagttagtttaaaattcctatatggactatatactccacttctaatattccttatttttaattccgaatttctattatttcttagttgtatttctatatggactttatactctacttctaacaatccttatttttaattccgaatttctattatttcttagttgtatttttatatgtactctatgctctacttctaatattccttatttttaattccgaatttctattatttcttagttgtatttttatatgtactctatgctctacttctaatattccttatttttaattccgaatttctattatttcttagttgtatttctatatggactctatactctacttctaatattccttatttttaattccgaatttctattatttctgaattgtatttctatatggactctagtctcctcttccaatattccttattttttaattccgaatttcaactatttctaaattgtatttctatatggactctgtttttctttttctccgattaatgtgggaatttctaagccgtgagagcgaacgtggaggcttctttttctattcctttaataagttaatagatagatcttgttaaatggcaggctactgccaaaatatgaagagagcaacaggagttaggaaagcaatagctacatgaatttatgatgtaaagttgactttaatgtgttttttcattttagttattgacctattgcaatagaagtaagagggtgaggaagggaaaaatctcaatgtagaggaactaaataaggaatttgattccacagtctgttctgaatgaatatccaactaactgttgcaggaatcttactcattacaacttatgagttgcaaatttgagaattgcaaaattttgaagagcatcttgtaagatgtttcttactacttaccctattgaaggactgaagcatggaaacacttttcatgttgttattgttgttgtttctgctgctgcttaaactaaaacccttaaattcattgcatgcgatggtgcctattgggtgaaattatgatagaaaccaaactattttctttggagataataatcacatttgatgctaacgcttattgctttcgacagattccaggccctccacctcccaaaggatctctggttgaacatgacaaggcactgggattgtggactataaagttaccttctgcagacacagtggttgtgaagagaaccctatcaacagtgacacagcatcctgagggccttcctggggtggaagaatccacggatttcgctgagcataggaagagcttctggtcttctgttaaaccagcgcatttcggagtgaagctcacctccaaatccttgctgggcattgcgcagttcatcttcactggactctgcatcggcctgctgggaggtttctcctttggcaggtccctcctactaaaattcccctcattcttctccgctggttggttcaggaagagcggaccgacggaggaacaggtgagcagcgcctcgttcaagatgtggttcgtcgggcgtggctacagcgacgcggctcgtgcatcggaccgcgggagcaagcctgacaaggagatcatcacgagggtttcgggaccagagatcggctacatcacaaccccgatcgtcctggtccaatgcgccctcgtcctgctgagccagcgagggaacctacctaagggcggggtgtacacaccgggtgccgttttcggccctaccgatatccagcagcgcctccaggagaatggcctgtcgttcgaccttgtctcaactaggacactgtgatcagaacttcagaagctgagcatctaccggtttgttcctgaacctgttgcccttttcctggaacctgcctcttgttgctaccttacactgaagaaacgtactgtagtagtctcttgctacgtgtgttgtgtttgtgtgaagtaacagtgtgtttctacatgtcgaaactcgaaactatgtgttgtccttgtgtgtagtacaagttgttatactgttccatctgaaatgaaaatgacgttcctgtgtaatgagaatcatctgggttccacgagtgtagcgtagatggttgttggcctgtgaaagcaagggcattgtcttgtctacgacatttaaatttaatttagggtgtgtttagttcacgctaaaattgaaagtttggttgaaattgaaatgatgtgatggaaaagttagaagtttgtgtgtgtaggaaagttttgatatgatggaaaagttggaagtacggagaaaaagtttggaactaaactcggccttattatggtatgattttgctgctatatatatacagtagtatatagaaaattaagttaaatattagttttttaagagttaatgttttttttgagaaaaaggtactcacgaagcgtgcatattcatcctctataaatgcgcacacgcacatcctatccctagaagtatctttgacagattgaatcgacatcttgctgtcgacgatatatctaaggaaatgattagccgtaaatacaagcaacagtgttaagtttagagtgttccactgtaaagaacctgatcagtcttaacttttcttgaaacattaaatttgatggtgccttattccgtggaacagtgaaaatactaacattggggccgtagcaatgttgtctcgtactctcgtgcattctgtatcctatttttctcaaagaaagtcgctgtgcaattcgggcaaaatttatccatcggtgatgtgccagaagcttccgtgccggttggagccacacggccacgcacgcatgggcgcgcgcgcacacgtgcgaaagccgcagcagctgctgctcctgcttcgcgtcgtcgccgtcgccgtcgtccctcccacaggttcctcgttcaaagccacgacttttgcttattctccccgtgggcccccgcgacgaccgaccgaccagcggcggccgctttcgtggaccggacaaaaggaaacgaagcccatgccgaaacggcaaatccaatccaaaatcatctcgtgaaaactttcaaattactcatacagcaaattcaaatcccgatgtttcaaataggattaatgttttttttcgcgaacgtgtaaaaaaaattatatgtcaatatattaaaagaaaagagcgtttgatacgcaccgcaatccgtcagaccgacttatgccaaaaaaataaagaaaaaatgagaaaaaaaacgagaaaaagaaagaaactactacggtggctaaacgcaacttaaaaaatagggagggacagagccccactaccctcttaagaagaccctaaaatagcaacaccagctaacaatcaaatggccctcgtagatgattaatctgcaaaccggcaagattactccggggatccgggcgagcgcgttcgaacgcgaattcgagagggaaattgggtgggaataatgatggattaccagtacgcgtttcttctcttttcttcttgtctcccatttggtttcgcgtgcacgcctcctgcagatggatggatggagtagtgctccatacggatttcattcgatagcaggcagcggcagcagcatcttgcctggactggaccgtgtgctttccatgagagctttctgttcgaacacctttgtccccctcctccccgttgcatggagtatgcgtgcaaagtggtgtgtgtgctggtgatggcccaaaaaacgttcgatccctttggctgtctcgtctttgaccatctcgctttctcagtgcgatgcatcatgactagtgagaggggaagagtgtgcgtgtgtgcgtgcatagagacgtcacggtccaagaaagcgagcgtgaaaccaaagcgaaataggcgttctgatggtggttgcaattgcgatgcatgggaacgttttctcgagggatcataatccatcttctacgtgagggtaatatagtagaagaatattgggatggtgagggtagtatagtagaagaatattgggatggtggtttgtaattgaatgcgagagaatgtcctctcgagtgatcggaatctgtcttccgcatgaggtggtgtgggagaagaacacaacgggagaaaaaaaagattgttgtgcttgaactattgaatgcatttacattgtgggggagaatgtgatggatacaaccaaaatttgcttctcttttgatgatcctacttgtgttattcacatcaagaattggggctaaaattaaagggaaaaaaaagagattttggaaacaaaattttgtacgaagaaaaaaagaagaattgtttgttggtgagatttttttatctacacctacgttgactatgtgagcttgtttgcttactcgccgccgccgccggacccggcgatgtcgagtaaggcggcgagcacgtccggcatgtccggccgctcctgcggcgagtcggcggtgcaccgcatgccgagcatgagcatgtcccagagcaccgcgccgctcgacgccgccgcctccctcgccggccacccctcctgggccatcctccggctccactcgaccaggcactcctcctcgccgccgtcgacggcgcgccgccccgtggcgagctccatgagcagcacgccgtagctgtacacgtcgcccttggtcgtggcgcgccacgtctgcccgtactccggcgccacgtaccccaccgtgccggccaccatcgtgctgacgtgggtgtcgccggggcggaccaccctggccagcccgaagtccgtcaccttgacgccgccgtcgcggccgaggagcacgttgctggccttcacgtcgcggtgcaccacggcggggcggcactcgtggtgcaggaacaccagcgcgcgcgccacgccgatggccgcgtccagccgccgccgccgcccgaacgcggcgtggtcgccgatgagggactccaggttgccgccgtcgaggtactcgtagaccaggatcttggccgagccggcgaggcaccagccgtaaagcgtgaccaggttcgggtgcggccacgtgaaccccatccggtcggcgagcacctccatctcggcgcggaactcgcgctcgccgctgtcctcgccgccgccgccgccgccgcagtcgcggagcctcgcgagcttcttgaccgccacgtcgcggccgtcggggagcacgccgcggtacaccacgccgtagccgccacgcccgaccacgcggtcgtcggagaagccgctggtcgccgccacgatgtcgcggtacgtgaacgccgtcttgtcgagcctgaacaccttcaccccctccgacgacgacgagcaacccgtcacgcacgacgacgagcacccggacggcggcgacgacgtggccgacatatggaacgcgccgcacttgcctccgccgccgccgccgccgccgcacttggggttctcgcaggagagcgactcggggtccgggtcctggtccaccggaaacctcgcccgcaggttggccatgatgaacaccaccgtgccggcgatgaaggcgatgatgagggagaagacgaaccacagcgcgatggttctcggagacatcccgcgccctctaatggcggcctgtggcgctctctgccggcgagggcctcgatcctgcaacgtgatgagggggtcgccgaggaaggagagctcgtcgaaggtcccgagctggccggtggtcgggacgtcgccggagaggagcgggttgtacgacacgttgaacttgttcaggccggtcaggttgccgaggctcgccgggagctcgccggagaagttgttgtacgccaggtcgagtatctcgaggcacaggatgtggccgatctccggcgggatcccgccggagatgctgttgttcgagacgttcagcacgacgagcggcaggtggctgatcgccggcggcagccggcccgtgagctggttgttgtcgaggtggagcaggctgaggttccgcattgcgccgatctgggatggtatctcgccggagagcttgttgccggagagctgcacgtagccggagatcgtgttcgacctcaccggcgacgacgagttggtgcagatcgggatgatcccgtagcccttgaggaggcgatcccatatgctgcggcaattctcccgcgtcatcaccgtgtacacgaagttgaacggcgggtaggtcgccggaatccaccgcctcatggcctggcactcgccggagccggcgagcacgctgacatccttccggttcttctcgaacgtcggcgcggggttcctccctatctctgccatctccggcgggatcctgccggtcaaccggttgtcggccaggttcagccagagcaagctgctgcagttgccgatctccggcggtatctcgccggagagctggttcccggcgagcatcagccagagcagcgacgtgaggttcccgatgctcgccggtatcctgccggtgaggccgttgtacgacaagtccagcgcctggagctcggcgaggcggccgtactccggcgggatcccaccggagaagctattcgccgggagcatcaggtacttgaggctcttcatgtcggccacctcgagggggagctcgccggagaactggttgaagctgaggtcgagccttgcgagcagcggcagccggagcacgccggaggagacgatgccgccggtgtagttgttgtggtgcaacacgaggtacttcaacgtcacgaactcgccgaggatcccctgcatgtcgccgccgaacgcgttggtgctcatgtccaagaactgcagcgacgtgcagttcgtcagctccggcggaatccggcgatcgaatcggttcttaccaaggatcagcgtctcgagtccggcgagctccccgatcccggcggatatcttgccggcgaaaccgttcccccacagcgacaggtacgtcaggttcgagcagcttgcgatggagtccgggaat

SEQ ID NO: 43375 - DNA, 5805 bp, Oryza sativa
cgccgccggtgaggttgttctcggcgacgttgaactgcgtgaacctcgcgatgcccggccatagctcgccagtgaagttgttggtgctgaggtcgatgtactcgagcttggggcagccgtcgaagaggccggtgatgtcgccggtgaagccgttgccggagacgttgagcacggcgaggtcgccgcacgccgccgggacgaagctcgccgcggcgccgcccacgaaccggttcccggacacgtcgagcgtgcgcagcttggtcaggccggagacgtcgagccccccggcgatgaggttgtgcgacaggttgaggtgcacgaggccgcggcattgggcgaggtcgccggcggggagctcgccgccgatgccgttgtcggagaggtcgagccacgtgagcgccgtgagccgggagaagttgccgaacgcggcgccgctgatggccgagccggagaggtcgagcgccgtgacgcggccgcgcccgtcgcaggtcacgccggcccaccggcacggcgacgcgtcggactccggccaccggtcatactccccccggttgaacctgttgttcgcctgaagaaacctcttcagctcgacgagcacctccctgtcgtcgtcgctggctaccaccgccacctgacctacaaaaaattcaccaaaattcggtcaaattccgcgcaaaaccgagcaaaccaaaccaaaccaaaccaagaacagagagctacctgcgaagaggagtaagcagaggaatccaagaagcaggggagacatggcacgccttcgagaatcatggaagaacaaggggagctacgacgaggacgaggcgggaggacgaatcctcatgtgctagctgcgtctccgcctcagctaccgctgctactccgtctcgccaattccagtggcaagatagaaagaagaaagtgagagggacgaactgacgaagtgagatgagagtttagaaaaaaaaggataaagtttttgagtgctaaaccggaggttatttaaggcctaataagcgacatgtgactgcgttgaattgaaccgggtaaggtaatggccgtcgctgtttcatacaagtagtattcctctcttcttctttttttcttttctcggtttttaattggggtttcaaacttcgccactgctgctgaccacacgggggacacagggtgatggaccgactgacgatggctcgttggttatggcctctgaattttcttcctctcctttatagtacaacttgtactattttccttccctcacaaaactgatgaaatttcgtaaaaatcgaccggcttttatgaatctgtcagatatgaaaaaccaattgccggttttcgtatgacattgatcaaaatttatcggtttttacggtttttgattggatttcagtaaactaatgaggagcggcttttactttgatatcgaaaagttagggccggtttgatttgaggcctaaattaggcttaccaatatttggtaattttaatagtgtttagtgtctatttgttttgaagccaaattttggcatgcctaagaaaataggacatttcaatagtaaacttaggctattttggcttcaatccaaacacaattttaccttatcaaaattagtaatgccaaaatttggcattaacaaaatttggtaagacctatctagaccataaaccaaaccaacccttaaacccttgctactacctttctgctcaatgtatgagctgcgagtataactgcgattagtaacgtaccaatcgacacgtctgaaactaattcccgattaatcacgggtttttttcctatggtttagaagttaatctcgtgggtctctcttgcttgttggaagaagagggaaggaaagccgccgttgttgacgacgagcgactcggcctggtcgggtcgggtcagtccaccaccgtgccggggaggagaagggcgcgggcgcggacacacgcacgcgcgcgcgtgatcgatcgcggatgcgtgcgggcgaccaggcgtgcggcccatgcatgcgctgaccagaacacgaacagcacgcggccttcggatttttggaattttccaggcggaggaggggctcgcggtcgggcggagtaaactgtaactgcaagtggggtggggagcgcgataccaccgcgacgatgcgtgatccggcatgagtgagtgaccggcgaccggcgatggcgaagggggcggatgggcgcgccgcgcggtggtcggggtggcgctgttgcttacgctgaactagtttcagtcgtatcctatctagggtttacgattccaagatggctgtctatttcgggctatggcgaaataatggttttagcgaaaaccggtagaaagccgatatattctgaacaaatttcacaaaccaaattttgaatacagattccttaagtttaccgataagctcgcgaaaactcgtcggctttggcaaaattccgagggaaatcattgaaatttcaattgtagctagaaaaagaggtaaactgaaattgttttccttttttaattcgttattattttctttactactgtaaatctcagtaaatacacagaatacatcaattttatcaaaaatttatatcccaataggttctatgaatatcgtactattttataagattttattttccttttttatccattcaaatttgaatttggatgaaactcatcgaaatctcagacggcttctactttcgagcctcgtcgaaacctcaaaatttcacagaattcgaccggttttcgtcggaattgtgaaccttaatcccatcctacacccaggataacttattttggaatagagaaagtagttacgattcgacttatctcatcatttgccctataataaataagccgatgttaagatttaaattttaaattatgttgtttattttaaaacattaacatttaatcactaaaaatacaacatgtatataaaatttttagtctaattattcttttttaaataaaccgtttaatatataaccagcctttggcctactaataggattctatgtgtccgcggacattattttttaaaatatttaggtccttgtcatatgttcattcgcttataggctacaactaaaatttaaaattttgaaatgtaattttagtcctacagttcatttgacagtttttaatcatataatttatttttcagctttggtttttatattgctaatgatataaatataatattttacactcaatcatttttgttgcttcattcatttcaaattttggttgctttattcatttatccatgacgtatgagtggtactaaaactgattagagatcctgtcgggtatttaggaggtctgaaattatcgagttattcgaggttgagtaatacgattattcttaatcaatgcatgtacttgtatatggaggtgaatgctagttgcttttgggttttagaaagggtaggggttcgaatccgaatcgaactcggaattattacaatccagcccaaggcaggggatgctgtacaaagatttttgcacttctagcgttatctgaaaaaggaactttgcacaaaacgtaaagcataaaagaaattgagaagatggagacctacgtgcatagcaactttagcaagatagatgcttccaagtccaagctcgagctaccatttcaagagatatgctcgatgggattctggtttgagtattgaaattctgtctaaccatctatatatgcacatagaatgcacaaagaaattatgtataaccatctatatacagggctgtgttctttagcctaaggtcccaactcatctccatcgtttttcgtgcgcacactttttaaattgcttaactttttttaaaaaatatttatataggaaagttgttttttaaaaatcatattaatctatttttaagtttttttaagttaacacttaattaatcatatattaatccatcgttttattttgtgtgggtaggggaggtcccacccctccaaaaaaaaaaaaaaacacagccgcaatcatgccctttatattattagcctaaagttcagcacacaaggcctagccttttaattaacctcatcatatatgcatgacatacatcaaacaccaatatataggataaatttatggtgggaacttaacctatgtgaaaactcatgtaagccacacccgaaaagccatctaaaaaaatcccacatgaagctaaaatgatgatgaatagaccgtgtaaagaatctttgcgggatataaaaacaaatttcgaaccagaaaacagtgtccaatcctttgtctgaaatttgtcatttttatctcacaattgaagttgaatttaggcaagatttttcacacaacaattcatcgtcatctatctacatatgagatttttttttgtgattttagatgactttgtggtgtggtttacacgagttttcacctaagttcaaaatcttcacttcttggcgtgacaaagcttgcaatcccttaaatcttttctttttgcagggacaatatctcagatatgttcaaacatatacttgagtataaacgcaatttgcttggttcactacagcagaacaagttagcagtgacgggctcaaactctcatctgtgacggatacaccccctcgtcacagatcagtggtcactgatgactcaagtcatctttgacgggtggaggtccgtcagaggtgtcattcccctctgacgagttgtatcatgtgacccgtcacatatgagaaaaatcaccccaaaaaaaaaagcaaaaaagagccacaaccacagctcaacacccgtcactgatgtagattccgatgaaaaaaaacaaaaaaaaagtatttctgggtagttgccatcgcattcatcacacacaaaaatctagaacatttcatcacagataaaagtctttatgaacatatcacacataaaacagccatggcaagcaagcaattcatcaaacacctgacgagcaacaaaaaaaaaacgaaggtgcccttcttcttctctccttccttgtctttctcgatcaatgccttcacaagaggaataatctgcaaggcaaaaccaaatcgaatcagatcaaattcaccagaataaccacgagagagatggatgcagaaatcagatctgggttcaaatcacaagttgagatcgaatcataccacgatgggcttgaactccttggcatgctggaccttcttgagctcggtctggaggcgacctcgtccccattgctgctcgacgccgccctcttcgccttctgcacccgggaagcggcgtacgggcggatctgcacccggcagttggggacgcagccggcggacggaggagacgacgcccggcagttgaggacgacggatccggcgccaggcggacggggattgaggccgcggcgccgccgctcacctcctcctcgcggtcgaggatgcaggccgccgaactgccgctcgccgttggaaccacctcgctgcaagaaaaaccggatcgggaagggggaggaggggagaaagaagggggaggaggatgggggtaccgccgccgcaccacctcgccgccgccacgcatcgctgagccaccgcccagcgtcgccgctgccacgcgccgccgcaccacctcgccgcttcgccaccgcaccgccgccgccgccacgcaccgctgagccgcagcccggcgccacgtgtcgccgaaccagagccgccgcccagcgccaccgccgccgccgcgcatcgccaaaccaccgccgccgcctcgcccgagctagggccgtcgggtcctccgccgccgccgcaagtcgtgagagggagagagagagagagagagtgaggataagggaga

SEQ ID NO: 43376 - DNA, 4814 bp, Oryza sativa
ccggatgcctcaccgatgacggcatcccgtatgacccgtcagaggtgacggtcatcagtgaccatttcgattgcccgtcacaggtatcccgtcagagatgtgaggatctggtgtagtggttcaacatgcaatatctctgaagatgcttagttgagtgtgtggtgggctctgcttcaatacgcaccatgttttttgcattttggatggatgtccttgtcagcctacacgatcaggagtcaaacaaaagcgctaagaacctaagacccttctttttcagactttaaaactgaagaccgagactaaacaactcgtatagtttaacggattatagtggattgtttatacatgagaacaatagttttatagtattcaaattcaattgtgacacaatttggatctatagtctgctatctgcaagagattacatttcacaatctagcttattcctaggtttttctgctaggcccgttttttttctagtgttctacatcttccttccacgacaccaccattttttctcatcctaaatagctagctgtaaattaaaccgtcgtcaaaacatgaaaaatgaaaaaaaaacctagccgattttgttgtgcaattagttgcacaaaactacttgatctacaactttttttaaaaaatggaattatatcagttgaagaaactaagttcaattttacaaattattaacgcaactgtgtagttcttatatataaaaaaaaataaacaccagtttaatatttatatatttgatcaattaatctacaccattacaatttattacagttaagtcagttctcttaagttatttactcattcctttggttttgtacttggttatacattcctgcacgaatgttcgtaacccatgacgtacgtttttggagaatagtcatgtgttatgcatgatcttcattctagcaaataaactatatattcatttgtgacgactggcctgcaggtttcttggacgaacctcatatagatagagtcaaagatatatctgggactatatggcattagagaagagagtaaatgttgcttgctaatgtcgatatttgccgtgctgtccaagtttaattattttaattgtttgtttttgtgtaatgtgtcaaactaatgggtccctctcgggagatcttttctccctgcaggtaccaagttcaattgggtgaattccacacaattgcaatccattttcttaggaaacatgttgatggaagacacacatgtctcgtgtggtagcttcctctgctctgctacgtactgattgattctttcgttgattttgacgtgagcatgaattttccttgcatgattcgagcagtctcattgcttagtctgcttaagtagctagattaattctgagaagcagctggtgagtatccagttaaccagaatttgggatagctattgaggcttgaatctatattaattagcagtgaatttctaaaacctatatggtcattttaagctagcacgtggttttgtcactaacttatactaccttcatttaagagaaaattgcctttatgggtgtgtttgattgcctacattgatcttgacgtgtatgtgcgagtgcaggtgagtggtgtttggttgtttgcacatttgtccaatctagaccgaactcgtgcgaaaggcaccttggaaccaaacccaaagagaatacatgtttcaacctttgctacctagccaggcccgacgcgtgcaggcgtggtgcaacagtgcgagcgtgagggtaggcacggatgcaggggtgtgggttgactcatccccccaccccattcgtctcacagaagtgcgaggaactcgaccttgcaaagggtgatgagaaaagctcgacgttgtctccaatccacttgccggatcgccatcatatctcatccaaccagatttggcttgggatggtagctatgagcacgctgtcactatatctggcctgcacgagcttactatcatcgtcctcttcttgttgtcgcctctactgttatgccccaacatcatctcttcctcctccttgtttagccggatctggtagcaaggtgtatgaggccactagatctgccatcttggttgccaaattcgaccactccggtgatgacaagcaacaatgacataggagcgcgagcgagatagagaagggcggagagcgagagtaatgggcctagaggagcgacgaacggcaagggagagtgggagttgttgtcggtagaggaagtggggaacgacaggtggcagaaaagttgggaatggctgacaatgcagtggctcatcgttttgttttttctttcttttcttttttcacctgtttgttgtaaaaagggtcaaacacatattttatttttttagacaaagaatgctacaatgatttcacacatatattattttttatatgtaataacttgtttacatctactaattgattaaatctcttttttttatgatatgatattatataggtaaccttatccaactttaaattttaaccacacttaaattcaaacaaccaatcaaacaaaatcagttcccaactggattactcatagaagcaattagataaaatctgatactatcttaggctaattaaattagtgcaaataaccaaatagttgtctatatgtgtacctctctagccaaaccaaattcaacctaaaggagagacgagcatgctagagagataccagtatacaaaacatacacttatttataggacaaaagtttaaaatttaatgacatgggcttacttgaaaaaggagggattggagtaactatcaagggaaaattcaacgtagtactttctgatgccactgcacagaatggaaaaaatgcagtacctttgcatcgatttaccacatgtggttcaattcactatttccatttgattgattccggaaataaatgcaaatgcattttcttccaaattgtactgcttttacacgcgcacgtgcgtcgtactgctagagtacgtgccggttaccatcagtacccacgaaccaatatatgcgcacaaagaaaaatgcaggaaaaaagcacttgtaaaaatgtcaattaagcagaaaatctcatgcatgacgtggcaattcctgcacatacattatccatccctacagggcacagtatactccacatcactagtactatactactatgtactatactagtagtaatatttatccagaaattaattaataattaatcatgttaaccaattctacatattcaacctcgtgctttgacttgctagctagtcctcgggcttcaggcatctgtcaggattaggtgaagattaccacaaaatgaatcaattaattagggtgttttagatgttgccatgaagctaacagagtgtgatattctccacagaggccactgctcggccgagccaggacaaattccggtgagaaaaaaccaataatgcacactgctggacaacggcgacgtgtacccttggcacgtgcaatctctcactgtcattttggtagtttatgcatgaccggcacaaggcccaatgttaagcttcatatgtgcactaaattacatgttgtatctaatgatcgatcattgggttcagattttgggaaatcgagacagaatgattgtttgatcgacgccggcacatgtgtagatatggttgttaacaaggggattaattaacggaagctagtgtatgtgatcagtcaatcattggcaagattagtccagatatgtttagcttaggccctgtttagattaattggcaaaaattttcactctgtcacatcgaatgtttaaacgcatacatgaaatattaaatataaacgaaaaaaataactaattacacagattacgtgtaaattacgagacgaatattttataaatctaactgctgcatgatctgacaatgtggtgctacagtaaatatttgttaataacggattaattaggcttaataaattcgtctagcagtttacaggcggattctgtaatttggtttgttattagtctatgtttaatactttaaaagtgtatccgtatatccgatgtgacacgccaaaactttacccccttatctaaatacagccttaattaagccttaattaggtagtaactaatgagtatatctgtggtggaataaagtttgcttgttgcgttgccgtcgtcgcaatcagcggcacatgctgcaggggggagaagacgccatggagggacagcaaggccaccatgcgttttgtgcagatgcagccatggagaggtgatcgtgtttcgattctcgtatcgatcatttttgccaatttgccatggccggattacggcggcggctcagctttgggcagcacaaaagcagctaggtgacacggtagaggtcaagagatggtgagcagactgtttttttttcttcacttctattccaactcacctttttcgttttctgggtatacgttttctaaatttctaaacgagtatgttttttagcaaaaaaattctatagaaaaattactttaaaaattatattaatctatcttttattttttaaattaatatttaattaatctcgctctaatcgtttgatttatttttcgcgtcaggaggcaagtttgggcgatgcttttatggctgcaatgacggctcggcccatatgctcgattgctgcggcatgtggcccaggcgccgcggcccgtgcatgatcggggcacacccaaagcgttttcagttgttaggatgtgtttggatgaattttttttatttataattttttgtattaaaagttttacaaaaataattttccattttgaaaattgacggaaatagtcgcctaccgccctctggga

SEQ ID NO: 43377 - DNA, 827 bp, Oryza sativa
gagggggcatggaattttgcaggcggcccccttgccgccctgggggagggcgatttttgcctcccccctataaagcccagcccctcccctgtgaaatttcattatattcactaaaaatccaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttgagtcaatttatagttggttgttgagaggatttagaatagaccaagaagtctacacaatgtcagtatctgttgtagtgagtcgtgcaatagaaggttatttttgggaactaatgccgatggacagcactgctgcttggagacggtatgtggaaatggcttttgaacggtcatggcccctcgttatatc

SEQ ID NO: 43378 - DNA, 4443 bp, Oryza sativa
  unsure (1)..(4443): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtaagttgcattccaaataaactggcctgagccctgagattgagaatgggccacacctgctagcaggctatcagcaggagaaatctcactctcaaaaccgagacaaagagagagaaaaaaaaaagaaaacataggcaactcaaaacttctgaaccaattgcgttccatgtaaaatatcaacataccatgacttttgactactttttattgaaacaacaaagtgtaaaagatgtgtgtgtagcatcctgatgtttgaatcacacggaaactctgaaactgaacagcccactctataataatctgtatccttcggcatatcacccacacaacctgatcttcagcaacaacgcatcatctcgggcaatctctgctgcgatcatttcagcccccatcaatggcaatactggcggtaccagcagcacctggagaacccgacgacgccatcatcggcggtgccgcggctgtgcagccaccagagaaggttggtcagggagttgccatcgtcgtgccccgtcagcgccctcgtcttctgcaatgccgattccttattgtagatcccctccagggcgtacacgaagcccttccacccttctccgaccccttcccttgacaatgccggcattgtccagtccaccagctccttgacgaagctgatgtccgggaacagcgcctcgctgatcggcaggacaggcagcagctggatccccagcctgcattccttccactccggtggagcgaaccagaggccactgtccctcttgttcgcccacaggacgccgacgacacggttgttgccggtgaaatcgtcttcgtagatggtgtcaccttcacggacatgccaccatgtctgtgctgcaagcatctccaatgcggtcaatgtcgcgccgatggagacaaggtgagtatccccatagctcaatccgagaagcgcagcggagtagtacgcattcacggcctcgctagtgctctcctggttgcgcccatccgcaaattctgtcaaacctccggcccaggaatggagcttccagagatcaaacatcctcaatcttgtgtagcttgcgccgtgtttccgcgacaatgtcatgaaatctgcaaccatggagtaggcctggggcatgtacttcctcccccaggagggatcaatcttggcaagcacagcaatggcgtacaagaagtaccccaaatggtagtggtgatcattgtaaatgccgaagccgaaatcggcgccggtgtccttggatccctgcaatgtgacaaggccaccccatttgggttcatagaggaatccattgccctggaagctgccatccagccatggcgtgacggtggccttcaagaatcgctgcaccgccgggatgacgtcagggcagccgacctcctcggcgattacggcgaacctcgccgccctggcgatcgccttgccgtagaagtaggaggaggtggtcgtgatggagctggaagcaagggcatccacatccttgcgcagcgcggcggcgacctcgcccaccccgtcgtcgctgatgccccgcatcgagtgccatgtgggggacaccggatcggtccggagaacccaagaatcgccgacgacgccgaccatgtcgccgtcgatactccggtacctgaaatcgtcgagcacccggacgcagcaatcctcggagaggaggcggaggtggaggggatgggcgagcatgaggaggtctccccacccttgcttgcgccaggtgtactcgacgcagaaggggcggttcagcgaggcctcgccggcggtggggaagcaccggctgtactgatcaagaaccgcctccatggacgggtccggcaggtaggcgacccggatgacgccggagaagccgggggccgacagctgcgtgacgctggactgcgcgaggcggatcggcgcggacgcgtagaggaggaaggtctggccgctgttcatccggagccgccacttggtgagcgcgtcgtcgcaggaggccacctcgatgaaggcgtggacggacgcgacggagatgtcgacggggcccgcggcgtcggcggtggcgacggtgacaaaggggcagcccctgacgaggaacgccctgagcgacggcgagacgtcgagggtgactgagaggtcgtcgaacgcggcgacccggtgcctctgccccgccgcggccgccgcggcgtcggacgccgcggagacggtcaggtcctcgacgaacgtctggatgacgaacgacggggagtggttccgcgccgggtagcacagggtgagcgcggcggcggcggagcggaccgagtacgggtggatgtactccggctggtcgccgttcttgagcacgaagttctggaagaaggagttggtggggagcggcgacgagagcagcgccggcgcgaagaacctggccgggtccgggaccaccgtcgacgccgcctgcgggaacgcgtcccgccctcccgggaacggcggcggcgggcgtccgtgcggcatgccgggcagcgccggtggaggaggctggatccccggcggcggcgggggcggcggcggcgaggggttggtgggcttgggcttgaaagggggcttggagaggaagcgggtgagagtgcggcccagcttcctcttccacctcctcatcgcctcgctatatatacaaatcttggctagattttgattcaaatttgatttgatttgattttgaactgttcttttttttccctttacagtaactcaatttccctgcatttccggaatttcctgtgctgggtttgacttggtttccttcgcccttaattttctgcctctgttttttttttggaattttgtgccaaaatttctaaggagtatttatttttaatttgggatgggcgtgcacgcgtgccacgtgagcgactatttcatcaaactttaatcaattttccgcctatctggggtcgcaataaatgacaccgtgtcaactctccgcgtctcgcctctcgcgtgctagcgcgtcggcgtcgctgcttctttccttcctcctgacctgagagcgatgattagtcgctaagtaaacgaaacaatttgatgcaaaaaaaaaaagaagaagaagaaaatggatggccatgagcgcatgatggaggagaaagtgtaagcaaagacaagattattttgtagtactccactttgcagtaaaaaaaaaactagaactccagcaataattgaatgtactaagactgaaagctcaacaacaactggctgtactataaaatgctaataataatctaacaatcttaagagctaagatcatggaggaaaaaagcaatatttatgctaataatgcatcgatttaattaattaccctggcctaacctgacgcaagtctcgaagtagagttagtttgatggagtggttgttggttggttggttgcgactgcgtgaagctggaagcgacgaagcgagcgaggcaggtgatctgatcgctactgcatcatggatgggttcagatatgggagaggcaggaaggatgcaagcaagggcaaggcgtagcttgtatagtttgtgtgttgccccgtgccgtaaggctggcaccggcgagatggggagacgacacaagcaaaggatggccttgccttgccggcggtcgcatgctttgcttgctacgcgaggcttgagaacaacacggttattgggcttcgtttcgttggacgccgccgcaaggaagggagacggggaaattgtggatgggattagcggttcctggagtgaataaattttagcgcaccatcatagttttttagccggtgtttactgtttactgttcagggggtgtttaggtggtgtttggatccagagactaaactttactccctgtcacatcgaatgtttgaacattaatttggagtattaaacatagactacttgcaaaatatcgacgtttgatgtcgcgattccggtatttgtgtagtatggggatcgttggtactatgatatatgcgagattgtaataaaagagatggagacaaggatttttatacaggttcgggcccctgaattgtcaggtaataaccctactcctgttggccgaagccgatcgttgctcttattcaccataatcacaccagtataatatttagggtagcctatctaactgttattgacttggcggtctgaagtgttgactcatagtcgacaacagggtagtcttcctcctcgagttcatgctcggcgagatcagagacagcgctagatccctat

SEQ ID NO: 43379 - DNA, 8885 bp, Oryza sativa
tgtccccactccactatggggccttgtatttatactcataggtatccccttgtccaagtagaactagggaaaccaatatcgataaaatccgagtagtccttgtcgtttctatgtagaactctagtcatccttccttatgcggaactccttctatattcgaaagtcgtttccgtataagacatggtatgtggtgggttctgccgagatttagtcaactactcttaggtatgtggtatccataactctgacagtagtccccgacttcaatgcaaatgaacaaattcatattctcaaccgctgaccttggagtaactgttatcgagctcacgtaaccgttctcggtgagttcaaagataacgttagacttcccttatcagcctcgtgcgggcacctatagggtttgtctgagtcaatctccgatgccaaccaagaaagtacatagcatacgactaagtctcccgtctcgctgtaatcgagaatttagattgaagacaagaaattttatctcggcaggtacaccatctcttcattccgtattccttgtagagatccaccaaccgttctcgaatgatcgagaaggcgcagagcctacgacgaagccttgtcaacatttgtcgtactcgccttagtcgatcttggtgtagaaccatagagacatggagtcttcaacgatgtcgaatagaattttcctgaaagcaatactcagaaaagaatattagataaaaatatcccccgagcagacgctcaaagggtgacatattataatatgtatggaaaaattgaaaatgaattaaatttacaaaccaatgttttgtgtacgagcgtcttctcttttaccgacttcgatcagtcattttgttaagtcatacactctccctagcccccagccttatcgtcggagaatcattctcggaggataaagctcttggacccttgacctgccttggttgaaaaagtgctgatcctagcccctagccatgaagttggaaaactcaatttccgattacacggcttggttaatacacacggcgagaactcttacatgaccaggtcttatatggtcgtttgtctctacatgatccgataaggccttatccgctttgggcgtccccagccgaagttcccttaagttcctcagaggccttgtcaggacggcgtaaagggacatgaggataggtttcagctctaggtgtcgttgtggtaagggatctctgggaaaaacacttggtgatattatgtacctgatatcaactttggagtagaggtaatgggaggatcgttgtaccgctggtcaaaaaccagttgtagccccaacccgaccacttgaagtaaaggtagtgggagaatcgctacaccactggtcgagaaccaggtagtagtcgtaactcgaccacttgaagtggaaaatagcgggagaattgctatatctctgatcaaggaccaggtagtagccttaactcgaccactagaagtaaatgtacgagagatcgctacaattgactggttgagaaccagtgagtaggtgtctctcgaccattaggagttggtacgaggaccgccacgctgccggtcaaagaccagtcgtagctgtccctcaatcatctgaagtcatctagagtcgtggtgcgaggaccgctacgctattgccgtagtcgtaccttgaccatcagaagttaaggcacgagagatcgctacgatttactggttcgagaactagtgagtagaattatctctcgaacaccaattgaagtgcggtgcatgagattgcgtaccttctactacgttcgagcagccatcggagtatacattatgctctcgcaacacctaatggcaagcttgctggctgcgatgagcatactgctaccttcttacgtggtctcgtagagctcagtcgcagtatgaacttattctgctcgatacatccatatggcaagcttgtcggtgccgaggagacattctacgcttttactggcttcgagcagctcagcgagtagcaattatactctctgaacaccaatggtaagttgcggtgcgagtagactgctacccttttacgtggttcgaagagccatcggagtagcaattatactctcgaactaccaattggaagttgcggtgcgtatgagactgctaccttttactggttcgagaaccatcgagtagaattatctctcgaacaccaatggaagtgccaaagttggtttattacatgtgcatctcatatggccagcatgactcacatacccaacttgtagcatatccggatgtccgtccgcaatcatatcgggtgatcaagccgacatcattagcgagcaattatccgttaacaaccattttctcaaacagcccagccatagccggtgctatgagataggtcgccggtcttggttggtaggttgggcgcgacgactctgcatttgtcgagatcgttctcgataatggggtgtactcgaccacaacttactcgagtgctcaattgttcctgaaaaatatttttctagaaggcaaagcatatagcagagaatatcgagtatgtactcaaaagactgcatggatcttctagtattatcagggtataacgagcggatgtaaatatcaggcattacgtaaaccgtaagaaagcatgattcatacagaagagaacagagcgagcccccagcgttagaccgtagttggcctaacatcggaagcactcgcacaatagatattatataaaaaacatgctctaggtaaacataataaatcattaatctgacaatgctatatgatctgaattggtacgataaattgcatataaaatattgcgtacctttgtagatacatgccagatgtatctacgaaattagtagatcaatttaaaaaatcaatctaccaattaccttgttgcgtactcgttcgatatcatgtgatctgacatcttttggtacaccgcggagcttgaggctcgaatgatctcgatagatcaagttgttgacgacgatggttccgatcttgtcggaggatatattccggtcgggtttgatctccccacagccgaagtcgtcgagtagcttgttgttggagaatccatctcttaaacccatctcgtcaaaatcctgaagcaccaaaagtcccctacctggcgcgccactgtcgatgtttgattttgcgattccggtatttgcatagtatggggatcgttggtactaggatatatgcgagattgtaataaaagagatggagacaaggatttttatacaggttcgggcccctgaattgtcaggtaataaccctactcctgttggccgaagccggtcgttgctcttattcaccataatcacaccagaacaatatttgaggtagcctatctaactgttgttgacttgatggtctaaagtgttgactcatagtcgacaacagggtagtcttcctcctcgagttcgtgcccggcgagatcagagacagcactagatccctatagccggcctccgtaggtaccggatagggtcggtctaggcatatctctgatgtcgatatccagcgtcttgtcttggcgtatgttggcttgtattggcttgtagttttgtggcgtctattgttccatgtcccctctcctcctaaggggccttgtatttatacccataggtgtccccatgtccaagtagaactagggaaaccaatatggataaaatccgagtagtccttgtcgtttccatgtagaactctagtcatccttccttatgcggaactccttctatatccgaagtttgtttccgtataagacatggtatgtggtgggtcctgccgagatttagtcaactactcttaggtatgtggtatccataaccctgacacaaaactaattacataaatgagagctaattcatgagacaaattttttaagcctaattaatctataattagcacgtgttactgtagcatcatgtaggctaatcatggattaattatgctcaatagatttgtctcgtaaattagtccagggttatggaataggttttgtcattagtttacgtttaatacttctaattagtaccccaacatacaatgtgatagggacctaaaactaattacaaaatccattagtaaaccgcgagacgaatttattaagcctaattaatccgtcattggcaaatgtttactgtagcaccacattgtcaaatcatggagcaattaggcttaaaagattcgtctcacaaattagtcgtaatatgtgtaattagttatatttaatacttcatgcaggtgttcaaacattcgatgtgatatgatgaaaatttttggggtgagatctaaatagggccataggttgtgtttcgttactttaggatcaactccctctcctcgttttccacgtgcatgcttctcaaaatgttaaaggtgtgcttttagaaaaaaactacacgaaagttgttttaaaaatcatattaatctattctttttaaaaaaatagctaatacttagttaattatgcgctaatgagtcactccattttacgtgcactgcacattagttcctaactaggaacaacgaacgcaacctttaaattagttcactatcgtaaattaaggtttcaacatttttacttgccctcttataaacacatcccgtcgctaacgttgcaaaatgtgacgagcggaggcgacgcggtaaacgggtgaggaggcgatgcggcgtacgtccgacctaagtgggacgagggtagcgttgtgcgagcggtggcacggagcgagcaggccatagagacgggtgcggcggtggagagaggcgacgtagcgtgtggccagcgttgtggaggccgacgcagcgtgaccggcggcagcaggtagacgacgtggcgacgatgaccggttggtggtttttccccgacaaggtgctgccgcacgagagatccagcgatggtaggcagcatcggggcaagtcatcggatgcagacatgtggcttgaggtggaaacgatgtgagcagtccggtcgaggtgacggcaatggtggtgccgtgaagtggatgttgtaggcctgtgacatcctcttttctggacgctagtccttttgtagtagatccttgccaccacaagatggttatgttggagataggggatccactcttctctctcaacctctccctctccaacccaattgtgtggatggagattgagtgcgccggatgtcgcacttttacttgatggctagctagcaacgaggcgttgacgcgatggttgcacattgaaggtgctcgattggtggtagtgctgagttaggtaggtgcatttcggtatgggagacgggaagattagaggcgaaagtctagcctgtttgggtcgacaatggcaacacctatgggtgtcgcttcctctagggcattgttgcggaaggattttctctctctaacggttttcttcaagtgaaagacacgtcaactctaggggtgggaaaaaagctcggattcgtgagcttagctcggctggtaagccaaactagccaagccggctcacgagccgctggtttggctcgtaagcctaggccatcaagcgtttatatagattatttatttttttatggagttattatttatcaacttaaaatttatcatgaagattttgaagaattgaaatataaacttatttaaattttacatgttgataatttgttcttactttttttaatgattataatatatatatatatatatatatatatatatatatatatatatatatatatatatatatatatatatatatatatatatatatatatatatatatatgaagaggtgtttcaacaagaaggcttgcaagtcagctcgagtcgggaaacgagccaagctcaagttttagcttgtttccctaaccgagccgagccaagccaagccaagcctagtttgttgcaagccactgcaagccgagccgagccaggcctggcctggctcatttccacccctagtcaactctcaggacaggcagcagcaatgctctcggcaccatgtcctcccttgaggcatcattttaagatccagttattaaggggtgtcgtgttcctgttttgctcttcagcaatggggttttgaatataggcgtatggtgtggggtttttttttcatgtttttctggctatagcctcctaatgctataaaattataaatttccttgtgtaacgagtactaaattataaatttattgtaagagttgacaaaagcaatgtgggtggaagtgaacaaaaattactcctcaggagtaagggcgtgaagttctagaagatctagcatgtgcagaaagcaaagcggcatttatttttttaagcataaaagttggaatgattatgagatgcaaccaactactcccgcccaaccaattgatgggacttagagcaggtataatagtagtctataagccagctgcaaatatattttaaggagataaataaggagagagaagagcagcgggctacagatttatagtcagctgtagaacggatttcaagacgcagtgtgtgtatgacatgtgagactaggtattaatagtgtagtatgtaactattgtatggatgagctattagattagatatagatgaattaaagctagtagttggctatactattaaacttgctcttaaaatctctcacacgaagtttaaaaaaaataaataaattccacacataacatttgtgctaatgtcaatatgataagtttaaactgagcgtcagaacttgaacagaagttctactatctttttgaaccttcaacctgtttagttcctccataataacaaaaaatttgctgttttagagcactttttaccaaaatagatctaaacactagtagcaaaagttgataatttagaatttgtcatttggagtagcaaattttatcaaaaagtacgttgggagccgtgctctctctctactgtaaaatggtaaaactttaccatgcaactaaataccaactagcaaaacttcaataccaaatcttttgccatcaaaacttttactaaaaatatttgacaaagtaaattgatctaaacaggcccatagccattagcaaagagcgagacacaaataaactctcaaaagaacaagaaaagactgatacagtatcgaagacataccattcagagtcgaaaagtgccttgaacgtgaagcggctaaaaatttttttagtccgtattacatcttatgtcaaacgtaaagtaatgataaacccattccataactttagactaattcatgagacaaatctattaagcctaattaatccataatcagcctatatgatgctacagtaaacattttctaattatagattaattaggcttaaaaaatttgtctcgcggattagctcttatttatgcaattagttttgtaagtagtccatgtttaatgctccaaattagtgtcaaaatatccgatgtgacatggactaaagtttaattcgtggatccaaacaccctctaaattcgctggtctctttagggaacgaatagacagttttggtcttttggagatagcagcatatcagatgtgaagggttcacaattccgacgaaaaccggtcgaattccgcgaaatttcgatgtttcgacacggcttagaattaaatttcgattggagtttcgaatattaaacaatagatttggtcgaaattcagttaaaatttatcgaaaaccatgatatcgatggggctcgaaatttagtggtaaccggtaatgtaaattctggatgtgatatttcacttcaaaagacgggctcgttctagtcccacatgtcatctctctcatgtgtcttcggtattataaacttttcccatctcttacaaatattttacctggtcttatgagactaactcaatgtctcaatccatctagttcaatctccaattctaaaatgcgtcccccctaacgtgaatgattaatgacaacgcaattaagtgactaacgtgaatgattaatgacaacacaattaagtgggtaggtaaaatggccatgatataatccttttttctatcgttaataaagctctctttttacttaaaaaaataattaagctaaagtgcatgtgttagtaccaaaaacgaatttcataaggcatggagatcgctacaaattaaaacaaagcggcaaaaagactctatggcttttaaatcttttgaatttgagccatacgaaaagccgggttagtgataaggctgtatttgtgtccccatgaagtccctttaggatccgttaaggaggatgagttgtgaacttctcctccccgcaaagaaaacgagataactcattagcacatactccctccatttcatattataacactttctagtattgcctatattcatatagatgttaatgaatctatacacatatatgtatgacaatactaaaaagtcttataatatgaaacggatgaagtaattaattaagtattagctaaaaaccttaaaaatagattaatatgatcttttaaagctgctttcttataattttttttaaaaaaaacgcaccgtatagcacttcggaaacattaaacatatagtaggagaccctgcgtgtcggcgagagcctccgtgcgcgccgcgccgcctcgcccctgcgcgccggcaagagcccccacgcgcgccacgcctcgcccccgctcctgccaccgccacccgtgtctctgttagtaaccctaggaaggaacgaaggacagagaagagataagaacgaaggtgaaaaaagaggtgaagcgcttttggtcttaccacgcatgagtcgcgagtcacgggtgcggaggtggtgggatcatttcgtcgcctcttttttccggatggggttgtcccgaatattgaaggaatattcccttctagaaccatcctatccttccttttccctcaaccaaacagatatactccatc

SEQ ID NO: 43380 - DNA, 1515 bp, Oryza sativa
aaaaagtcaacggtgtcaaatattttaaaacggagggagtataaaaataggatgttcccatcccatcccatgatatctcccaaccaaacccaccctagcagtcccgatgcacttttgcgctggaacttgcagaggttcaaggctcctactgtacgaagtcgaacactagtgcggttgatgggctgaaagcccaccgaaagatcacaaaaacacattcaaggccacagagatcggttaaaagcccatacgtatccaactacaactaggcccaagtacaaaaaatatttatcgatctttacaagttggttaaggcagcacatggcttttagaggcgcggatgttggatgcgcgtgccgtaaatttttcatacggacgaaaatcgattgacaaatagtataattttaatcgagtgttgtttatacacttttttcccgataagaaccagatctcctggttacgagaatagttgtatatgtggcgtgtagagaagagaaaaaataaataaatgaggaatgttagctactccattatgtaatagctagctctacacatgttctaatagaaagaaagaaaaaattgtaaatgcaaccttatagctaatctttatatatattagtgagagcgtattctatacacacaagatttcacgtgttaactttcaataattcagtgaagaaattgaaaacgtcaagggcttgtttggcagagttttaactctagctcagtttcagctctatccaaaataaaagtaagctaattgaaatactcttacaaaataaattagagagatgaaattagatttaaactgccgtacaactttattttatatagatctagtttttacttaaatttaagagtttgaactgttaccaaacaagtcctaaaataatttaattaatggggtacgtggcaaacgtaacctcaattcctcaaataacacgagaggctgcggcaaaaagccgacgacggagcaaaacgataaagcgagagagacctgccgagaccaaactcactgccgtgcgccaaacgtgcgctgcatataaaattcgccggaattccatctacccgcacaaaatattcgcgagatatttttgtttatcccatccgaactgctcattgatccgaccaaggcgacaagcacgacgtcgccatcgtcatcgccatcgccatcgccatcgccaattcgccatctcatcctctttctctctctctcgcccagtttggtgcacctgtccgcgacgcatctgccgcagcttcgcagcagcagcagcatcatgggccacgccgccgcagccgccgcggcggcgcacgtgccgctgggcgcgatcaccgtcgacgacctcctcgccgcgggggtggcgggtggtgcggcggcggagctgcacgaggcggtccggcgcgcggtgggcgcgcgcggcggggacggggatgcggcggcggtgtggggggagctctgcagggccgcgctccgcccgggcgtgccgttcgcggtgcaccggatgctctactacggat

SEQ ID NO: 43381 - DNA, 20269 bp, Oryza sativa
ggaggaggccgtattgaccaatgtcggccgcgtcctcgaggcgcgagggagggagttcctcggcgacaagtacaaggatccaatcgctagcttcaccgacttccacaagttctccattgagaatccagaggttgtggaagatgcaaaaatcttgccctcattgatccattgtttgcgattattgctgttttactgttgttagaggtgagcttacagtgtcagtttggccactgtttttcaagggcaggcgtactggaagatggtgtttgaggagatggggattactttcagtgtggagccatcttgcatcctgagggagaacgatgcttaccccggcggcgagtggttgcccggcgccgtgctgaatgctgctgcgaattgcctgaccgcgaagcccggaaggagttccgacgacgttgctatcgtgtggagggatgaggggaaggattctgagcccctcaactttgttactcttgaggaactgaggaaaaaagtttggtaatgactaatggcatttatatctctagagagggcaagtcgggtgtatataaatatgttttgtggcaatctgattccggaatcgattcttcttgttttgtttggagcagcctggtggcaaatgcgcttgatgcactcaacctggctaagggatccgcgattgccattgacatgcccatgaatgtgaatgctgttgtgatctacctggcaattgtgttggcaggctatgtggttgtctcaatcgcggacagctttgctgctcccgcaatatcaatgaggctaaagatatcagaagcaaaagcaattttcacccaggtatttgcttaattcacatttctcctgaaaccattgatgaacatgttgctcctttgctcaatagtttcagcttctatagggcaaagttttggtcatgcggactgacagctttaatttttcatgctaggattacatccttcgagatgacaaggaattgcctttgtacaggtgccttaacctttaaatgcacaggcttatagatcagtgttcgtattattagaatttgtctctaacatcatagctttcattctacagtagagttgtggaagctaaggcccctatgacaattgtgatccctgtaaggggatcaacaccaataaaaggactgcgtgctgatgatctgtcctgggaagattttcttgcaaaagttaaccatgccaagtaagtttgctacattctgatcatggtttcctttttttggtaaaatggccggtggctgcacgtggaatgactggtgtatctgcaaatttttgtcacattggatatgccgttactgcctaaattgtggagcagtcgccaaaattttccagtgcagcacgttcataatgtgtggtgtgcaaactccagaaaatttctgggtagttagcttggaaataatttacactacctctcagaaatacatgtttcttgaattaagtatgtattactatattatgcaataatgtgacaaaattgcagggctgataattataccgctgttgagcaacctgcctatgccttcaccaatatcttgttttcgtcagggactacaggtgagcactagtctagataacatgtctgttttgtgacttttgtgtgctctaccttaaccattcacaaatatttgttgtaatattgtgcatcacaatcatgtcatagtagatcctccttatgattatgagttccaatattgttcaaaatctgatagttgtcatattcaggggagccaaaagcaattccatggacacacttaacacctctgaagtcagctgctgatggatggtgtcacatggatattcgcagaggtgatgttgttgcatggcctactaacctcggttggatgatgggcccatggcttgtttatgcctctttactgaatggagcttccatggctctttataatggctccctgaatagttcaggctttgcaaagtttgtacaggtatggatgcttcatggtagaatgttcaacctcatgaaaatcagtatcagaaactgtgcactatcttttgattttgttcaaatacataataagaattctcctaagtatcagtgtcaaaatgtttccaaaataatttagaatgtgtgaatagctcctgtgtaggcctatgcttttccagttaagttcttttggtagtaataatacagatggatgatgttccttaactttgttagtaggaacaatgaacagcgtagccatgaaatttctgatactctctttttctgtatatattctacaatttttcagtttgaattacaatattttcttatactattttctcattactgaataacttccaggatgcaaaggtgactatgcttgggttggtacccagcattgctcgttcatggaaaagtacagattgtacagctgggtttgattggtcaaccattaggtaatttcttgagtggtttggactttacctcttttgttttagcttgtgtaagggaaatattgtgtatctctttggatgatatggtttgtgactgattatattgttccttatatatagatgttttagctcatccggggaggcatccagtgtggatgattatttatggttgatgggaagagtttgctacaaaccagttatagagtactgtggaggcacagaaattggtggtggatttgttgctggatcattgctgcaacctcaagcattatctgcattcagtacacctgcaatgggttgtaacctgtttattcttgacaacaatggaaatccattagtaagtattctggaatagaaaattagaaaaatttcttgcatgagtaacatagaattagtttctattgtgtgtatctccgcttaagcttgcaaactatgcagccacaagattctgttggtactggagaacttgcgcttgatccaccttcctgggagcttcaacaacattgctgaatgctgatcatcatgaggtgtacttcagtggaatgccagaatggaacgggaaagtacgtgtttcatccctggtctccctaatcatcgttaagttgagacttgagaccactaatccatgtaactgggtgtgcaggtccttcggaggcatggggatgaatttgagcgtactccagatgggtattatagggctcatgggcgcgcagatgacacaatgaaccttggtggaattaaggtaccaaatgccacaaatgcacaacttatttagcaaatttagatttcggcaatccagacattaatgtgtctcgaccaatctcaggtgagttccatcgagatagagcggatctgcaacagggtaaacgacgccatccttgaaacagcagctattggggttccacctctagggggtggccctgaacagctgaccatagccgtcgtcttcaaagaccaaagctcacaaacagaggatttgaatcagctgaaactggcattcaacactgctctgaagaaacttaaccctcttttcaaggttcttataccatccctgtgaatcatctcattgataactactgtaccctacatcttttacatggcacactgcgataacatcactaagcacctgtttcctcccatcatctctgcaggtttcttcagttgtggtagtcccttcgctccctagaacagcctcaaacaaggtcatgaggagagtcctccgcaaggagttcacccagcagccaaagcactccaaaatctaggtagttacaaaaaagcaaaattggttctattgcatcatacgtacacccaaaaggaaaaaacttcggcacagcaaactgtgaatacacatgtctggttaaaaatcactaaatcagttgtatagcaaggcttttgttctctccggtgtgaaatgagatgatagatcaggtcatgatgaggtactgaaagtgttattgctacattttcctgtcatatgtttttcgctatgtgaataaagtctttgtgggacttcagtgaaattcaggtggcctatagtgtattccagtgaaattcctaagctctattccctccgtcccataaaagatcaacctagtactaaatatttttgagagggaaacactgtaggggaagccccacggttaatatattaaacaaaacaaaaggttcaaattacaacaagttaatccacaattttagagagtctctcaaataaattaagcctataaactaagagggagatatcagtcttaagagctctccaagaggcaactgaaggggctagattattaaagattaaaccattcccattcctttgcttctaaatattccaagcagtatagagcaccttctcaacatagtgtgaagacatataagaattcttggcagcaaacaactaagggaaagatcccaaaccacaccaaattgagcccaacattcagagctaaataggcactgaaagaaaatatgcagggttgtttctcactcctgtagcacacaaaacacatcaaggaagcattttgaggagaacagtgccttctgtccagcatatcatgagtgtttaagcgatctattaaaagaagccaaccaaaaactttgaccttggaaacacacttgctctttcagattcaattgatataagctggcacctgaatctacgaaaaatttgtagcttacttctgagaagagaaaattccattaccccaagcatataagtccagctatccttctcatcattaagttgatctataggatcagaagttgacattatcatatattcctgagaggcttgctcagacaaaggcaagacaaaaagttctgaaagatcctttaaggagaacatatgaactgaaatcttgacattcctggaaaaagagtgaatcctaggaaatacagatgatctgagcttattattccacagatccttccaaaacaaacatgatttaccattccccaatattacagtttaaaatttccctaaaaatatccacaaattgcagaacatctctccacaaaaaggatcctttaggggcgacaacatgtggcacttttgagatgtacttttgagatgtagtaagtattccagatcagattaacccagggaattggtaacctattataaaatttgtgcaaatttttcaggagaagggcattattttggagtctgagatcaattacacctaaaccacctttgtactttggctgacacactctgtcccacatcaccaaagactttttgtttgaatttatatctgaaccccttcataaacaatgtctccttgccctatctatactctcaattacagattttggaagagacagaaaacacatataatacgttggcaaagaggagagtactgcatttacaattgtcaatctatcaccataagaaaggagtgctattgttgttgaaagacgtctctccactctatccaccaaaggggcaaaatcaattactttaggcctaattgataattccttcatttcacaatgtaagtcattctaacatttccttacatttatagtctagattcgttaacatcaatatgaaaaaatgctagaataacttatattgtgaaacaaaagaagtactaaatatgatactctctccgtttcataatataagactttttagaattgtctatatttatatagatgtttataaatctagacacgtatagaattatcgtactatgaatctggatcatcttactatgaatctagacgattaagagttcgctatcctggacgttgaagtcgttatccagattccttttttttgccggagggtttagacgagaatcaatgaaaggattcactaggtggggcccttctcacactgggtcaggcgtggcactgacacgtatgtcccaccccagggaactcggggtggggacactttgtcagtcgtccagtgactcgttgaggggattccacgtgtcccggttgccacggtggatcatgccgttagccgattcgaaagtaacgctacattcctgctcataagcatgcatgaccaactcaacatttgaccgtcgtcgtcagctcagcacatccaccggcctcggcttcgcctacctgtggaatgtggatacttaaaaggctcgatcgatcagtaaatccatcttataaaaatcttcccaaaaagaatctgagaagagacggcgatggggaagctggcgaagctcgtcggcggcatcaaggcgaggctgcgaagaaggaagatgctgacggcggcggcggcggagtcgtcgtcgtcgtcgtcgtgctacgacaagatggagaagacaaacagcatgaaggtggagatcactagccgccgcgcgcagaagctcatcgccaagaacctcgccatcgtcgacgccatggtcgccggcagcaacagcaacaacagcagcaaggccaagaaacgcgccttcttcccgtgacgctctctgattaatcccctccctttgctgtcgtggacatagataataatccaatgaccggtaatttgattgagcagtaggaattgcagaatgttttataggtttgtagaggatttatattagggtaaagtttatctttggatctcagacttccgtcgaagtccatagttttagctgcactagaaattatcttgctgtttttatgtcccgttcggtgattgttaacaagttattgtcccacatattgtatacatttttttactcttctttttccttgcatctctgtaatcactactttgtgtgaggaaataagggggaaaatgtgtgacatgtggaaccaatcccatattagcacctaaaacaacataaaacaatgttggtgcttgttactgttgttgtgtgacaaaaaaccaccatctaaaatcagcatcagggtgaaacttgtccgatttcaaaaatttaggataaaaacaaacgatttttatagttcacggtgaaaattggacttcaatgcaagtttgaaggctaaaaatagactttactctacatttgtctttctgcaaaaaagagtcgtcctccatccctgctactcccaccgcgcgtttcgtttgtacgctcctcttgcataatcatggtaagagttcttctcaatcaccggatctaatttttaccaatcacaatcctaacttctctagttacatactctctgggaatgaacctggacacgcatttgtccctccgtcccataaaaaaccaacttctgaggatgaatttgaacaacatttgtccagattcattagtagaagttttttttttaacagagcgtgtaggtacatgacatgttactactactctctccgtcccgaaataagtgcagttttgcactattcacgttcaacgtttgaccgtttgtcttatttaaaaaatttttatgattggtatttttattgctattagataataaaatatgaatagtattttatgtgtgactaaatattttcaattttttcacaaaattttcaaataagacggacggtcaaacgttgggcacggatatccacagctgcacttattttgggacgggggtagtagtaaaaaaagaaaagaaatactccctctgtccctaaatatttgagccgttgacttttttaaacatatttgatcgttcgtcttattcaaaaaatttaagtaactattaattctttttctatcatttgattcattgttaaataaatttttatgtatatatatggttttacatattttacaaaagttttttaataagataaacggtcaaatatgtttaaaaaggtcaacggcgtaatatttagggacggagggagttaattctttttctatcatttgattcattgttaaatatacttttatgtatatatatatagttttacatatattacaaaagttttttaataagacgaacgtttaaaaagatcaacggcgtaatatttaggaacggaggagtatgaaccatcaaatcccaaatgtgcccggcccatacagacccatcaaaagcccaacaccttcccacccaaagtccatccaggcccacaaaagacccaccacctccctctccctctcccgagtcgtccccttcctcgtctccggctcctccccctatccaatccccccctctcgccatccacgccgccctcctcctcctcccgccgccgccggagatgcaggcgacggccgcgctcttcctcgtccgcccgctcccgcgtccccactaccggtgagcgcgcccacgtgcccctcgaaacccttttccgcccctcctcccccggctcgcgtctctcctcctccgcgactgacgacgagctccccctgccggcccctctgtgggggttctccggtgcgcgcgttttccccattgtgtgcaggtgcttgcatgggttgcggggaggcgtctcgctggccccgccgcggcggcggctggtggcgcggggcccgcggtgctccatgagcctctccatcggcggcggcgcgggcgcgggcgccggcggggaccgcgggttcagctacggtaaggaagggggagggagatgcccgaaccctagcgatgctctctcgatgtctcagctgatttgtgttgttctgcgtggtctctgggttgcagagtgataatgcctgtttagctgctgcgatgaactgatcgtattggctgtgtggtgatcccatttattggattaccgatttcataatttgtgccatgaacacaatggagatgcttggtagcacaggctgagcatgcctggttcatgcctagtggagaaatatacaggattagctagggaattaacgtgtctattaccatactttatgcttagaaatttctagtgaaatgatttcaggaaggagagatgcatatgccttatggtgatatagcggcatttctagaattatgatggcgcagatgctggcatggtgatttggtactaatgctaaatcttgtttgttgggttctctaagctgaaagagggaatgctcttctatgggtttggttagacaagatatcaagtggtgccaattagttttcttgtgtaaatctgaagttctgaaccgatgatatccattgtattgatgtttatcaacagtgtctcataaattacgatattatttttatgattatttaatcaatgtcaaacttgttctgtgcatgagtttcttgtccttgcactaggaataaaaggtaatagaaagataactttcgttcatttatcttgataacccatataggtttgcatctaggtttcccacttcccacagattatttgcttgctacttggggttgttattttttgtgattactaagaatactgacatagaacccaactttccattcttttgattgtttttggaaacaacgtgcagttgtagagcttatcttatgtgatcttaaccctagtttctgtgtctccacagagcacgttccagtgtttccaagataccggattcgtgatccctacaagcttcttggtgttgatcgtgatgcagctgaagaagagatcaggagtgctagaaatttccttattcaacagtatgctgggcatgaaccaagtgaagaagctattgaaggtgcatacgagaagataataatgaagagctaccagcagcggaaaaagactaagattaatctgaaaactaagctaaaaaagcgagttgaggaatccccgtcatgggtaaaggcactgcttggatattttgaggtgccacaaatggatatcatttcaagaagattgttctttttcgctttcattgctggttggagcatagcgacttctgctgagaatggacctgcattccaggtatctgtgctttggtttttgctggcctttcaagttgtttttttcttgtttgatgacatatttcaattcatagcagtccaagaaggcaatctagtttgcacgtaaaatgcatatgcttgttcattcatctgaaaatttaaattatccaatgtaaccaacatctcttgttgagggtataaagacaatgcaaggcctaataactcctaaattttaaatatttatgcaatactagcttaatacacttcccatcttgagcacaacttctctagttgactagtttttttttttccttttgcagcttgcaatatctctcttctcgtgcatatatttccttaatgataagatgaagaacctcatgagggcatcaacaactgggttagtgggaattttttcacttgatatccatcggaccgtagcttgcctactttgatatcaatatcatgcttactcttttgttcttccaggtttggagtgcttgttggtggctggataattggctctctattggtcccacttatcccaacattcatcatcccaccctcttggtcccttgagctacttacatcattagttgcatatgtcttcctgttcctgggttgcactttcctcaaatgaaaaccttgtaaatcttgtaaccgtaaattgtagaattgcttgcagaaattttgcaactactgacatctccactatgggtctcggaaaagttttgtagaatgacatcactttgaggttctcctcttcttccatatggtcaagcctcagaattttctgttcagcacttctctgaaacaagaaaatcaatctgtccacaacttcaggtcattttactctatcgtttagccttttttctttttggaacacattaatctaatataacccgattgattattgtggagattgaattgtttcatatgaaaatctttcatgactttcgatcttgtggagattgaattagtttatatgaaaaatctttcatgactttcgaaggcagctgcatatgccatgaccttgtggcagacagtactgcctccagatttgttgttttcccaataaaagaaatggacctttgattctttgccattgacaagatggttccatgtattattggtatgaggtggcaacataataatgaaataacattctccttatataatggttataacatggttttattctttctccggtctttcggggtattttgttcatcaagaccgagatgtgctccaagattagtcctcgcggctatatgcttgctggtacagagacaaacggccaccccgccatcgtctgcgacaactgtacttgcaaaaaaaaaagtgaaatatcaaataaatataaggggtaaaactttgaacctaaaccagctaactcaccaccttataaagttagccataagaccctgaacgttctctcaactgtacttgctagtgtggcatgaatgaactgtgttaaattgacaattgttccgtgcatcttgatcgagattatgcagaagattacacaagaaaagaaaccctctagtatcctgatcagggttaaatttcgaggactgaactaactagtggaaatgagtcgataggagtctggtcttgactaattcattcatgttatgatagctcaagctatgcagacatgcagtatgcagtggtcttctccaccatctcgacgatgatcatgtaaggccgatcgagccgtatgcaccacaatccaactatcaccctcttcatcaccagccccgtcgcctcaccgataaggatgccgggtttccttgtgattttcattttcttatttttcaggtgccatcttcttatgctaatccaccagtatgacataattccgtattggggggggggggggggggggacttttctttttttttccccttttgaaaaggcctgtccttctctcatggcatccattgtcgcctcctcatcaaatgattccgtcctattgagtattgacaaaaactattgagcattgacaaaaagtttaggaggtaggagtactacatgtcatactttgtattatataatctgccactatgttcacctttataacaattaaaaattatgaggccgtttattttaagctaccgcaacaattgactccatatctaatatacatgcattgtttagttgcccgcacaacgatatcatatcccttaaagtttgaacatgaataatatcaagggctgtatacggtcgggcgtccgatagatttagagaaaaatcgggtgctgatgtaatgctggcgtcagcgtccgatttacgtgcaaaactcatttaaactgatttttcttttaaattacttatccaaatcatgatctgattgtactattaaattcgttgcaattaaatcttcaaaacaagaccacacatgcatatattccggcgaaattatttttagcttattattgaattatttttaaatattgcacgatgtaccactaggtatatcggaattgtttcactaagtagatcgaacatgtttcactcgattaaatcgggtgttgtttcaccttatatgaaaacaatgtttcagcaaatagcgaaagaatgtttcagttcactgcaatatttgatccatacatagtgaaacattgtaagtacactaggtgaaacatttttcggtggaacgaaaaataaaccgaattaccttaataggaggtttgcaaaatatgtgggttttttttgttgcaatggagtatttcagttcactgcaacattagatttatatatagtgaaacattatgagtacactaggtgaaacatttttggtggaacaaaaaataaaccaaattcctttaatagagggtttccaaaatatgtgggtgatttgttgcaactacgcgttccataatatcaaaatccactgcaacatttgatctgtacatagtgaaacatcatgagtacattacctgaaacatcgtaaaactactggttgaaacctcaaaaggaccatatgcaacattctaaaaaaatcaataaaaagttaaaatatttttttgtcgaaatataatcatgtgtggtcttgttgtaaagatttaattgtaacgaaattactatttagtggtgcaatcagatcatagattagataaatagtttacgagaaaaaaaaatcttttgaagaaataagagatgctagtatttgctttggctaacaacaatgtcacagcctgatagatagccgtccgatccgcgcggctcgatcacacggcgtgggcggcgatcgatttttcagtgcacgatcggacgtgcggtgctgagcattttcgataatatccgctaccaagtatattaggaacggacactaatgttgtgaagtgagtgtaactcaactgttaggttttttgtggtggaaccagttcacccggatttaaattttaaatttaatacgagtgtttgcatttatgggtactcctattatggctaattatttttttagggatagacgatgtacccatcaatagtaagtcacccacatttgtactttgttaaaaaaaaagaatagacactatcactctactttgtctgtgtcatattataagctgcttgatcaaatatgactaaattagtagttaagtagtatgggagaagggttctaatcaccaaaacttgtttactacatgttaattaaataaatataaaattaataatataaattaatatgtagtatatcacttcataagtttaaattcgactttataagatataagatttttttacgacctttaaaagtcgagtttgaactcatatgcttataaaatgatattatatactctatatcatcattcttctaaaagaataattataactttcgatccctatgtcccataaaaaatttttttaatgttaactatgaatctagatatatatatatatatatttaggtttaggtttgtagctaggattagtatttttttagtggagtagtagttgatgtgcaataattaacgagagaagagttttcccatagtaggattaaccaatgtactagccagccactggctaaacgcctagttgtgaagagagaacgaggctgatccaagatccatggacgcttctgcgatgctggtagctctactaaccatcctcgccaccgccgccgccgccgccgccgccgccgccgtggcgtcgtcgtcgctgcgccgccgcaagaatcagcctccgggctccctgggcctccccgtcgtcggccacaccctcgccctgctccgcgccctccgctccaacgccgccgaggactggctccgccgccgtgccgccgcctacggccccgtctccacgatctccctcttcggccgccccacggcgttcctcgccggcgcctcctgcaacaagctcctcttctccagcgacaagctcgccgccatgagcagcgcctccttcctccgcatggtcggccgccgcaacatccgcgaggtggccggcgacgaccaccgccgcgtcagggccatgatggcccgcttcctcaggctcgacgccgtcaagaactacgtctcggccatggacgacgaggtccgccgccacctccgcgccgagtggggcggccgcgccgccgtcgcggtgatgccgtcgatgaagtcgctgacgttcgacgtcatgtgcaccgtgctgttcgggctggagaggcggggcgaccacgccgccgtgaggcgtgagctctcgtcggagttccagcagctggtccgggggatctgggccgtcccggtgaacctccccttcaccaccttcggcaagtgcctcgccgcgagccggcgcgggcggcgcgccgtggcgtggatcgtggaggagaggcggcgagcgatgccgcgtggcggcggcggcggcggcagcgcgggcgacctggtgacgcacatgctggccgaggggatggacgaggaggagatcatcgacaacgtcgtgttcctgatggtggcggcgcacgacaccaccgccgtgctcctcaccttcctcctccgccacctcgacggcaaccgggcggcctacgagcgggtcgcggcggagcaggaggcgatcgcggcgcagcggcggcgcaggggaggctccggctccgccctgacgtgggacgacctcgccgggatgaggtacacgtgggcggcggccatggagacgctgcggatggtgccgccgacgttcgcgaacatgaggaaggcggtggccgacgtcgaggtcggcggctacgtgatacccaagtggtggcaggtgataaccgcggcgacgatgacgcacctggacccgaccatcttcccggaccccggcaggttcgagccggcgaggttcgaggcggcggcggcgaagtcggcgcccccgccgttcagctacgtgccgttcggcggcggcgcgcgcgcgtgccccgggaacgagttcgcgagggcggagacgctggtggccatgcactacatcgtcaccgggttcaggtggaggctcgccgccggctgcgacggcggcttctccaggcacccgctgccgtgtccaaaccagggcctcctcctcgacatcgagcccaaagaatacaatgaattgtgctgaattgtaataattgtataatgcattttaatcaaagattgtgatgaaaattacattgtatacttattagaaaacccattctactataatctaggcgtcatttcgattcacatgaaaaaaatattccccaaatccgtcggcggtggatcggcgaggaggaggaacagcgtgggcatacacgcagcctgcgtcgacgctggtgacgcagggcgggggacgctgccactctgcctgagagctgaggggagcggccggccggcgcggtcgccaccaccgccgcaagaatcgcagagcgctcgagagaaaggggagagagagatccatggcttcctccgtcgctctcaagggctgcccgctcgccaccctcctcaggcagctcctcgccgatgcgccgtccacccccacagggaggcccgtcaccggtcccgctgccttcagaaggactgctcccgccccgccgcctccgggaggcccacccccacccccgccgcccgagggcgcgtcgctccgccgctacgacgtcgtcgacgagtctggcccgacagcggcgaggagtacgacgacggcgagtgcgacccatagaaccaatggttaaagctcgtcacctctcaagcataagggcaattaattaagttatttggctacacagttacccacattaggacaaaaacgaatggaatggtgtgaaaggcgcgataaagttcaacaacgtgagaaaaagaggcttaaactttttagtagcttaagatgcggagaaaaacctcaatgaatggtgcccttattcgtttgttttccatagtacctacattttttcaaggcataaaccctcaaaatttcctcctagagtggttagttgcctgcgtctttacagtggaaacaatttcaaacgaatgacaggtgggtcccacttggcaggtcggttacactccaaaatcccaccatatatctccgaacccaccacactgacatccggtccccaccgcacggacggaccccacgagacagtgtctgaaccggtgagctattgggccgatgcgttttaattgcaaaagataatactccccctcctcgatttagaaacagaaaaccggattgctttgcgtctctctctctctctctctctccgcctttcccccttccttcgccgtctctccctctttccctctctcgattcccaaccgcaacgccgagcggcgtcgccatggacgacgaagccggggagtgagctcgccggcggcggagcatgatgggtttgggccgtgcgtggtctggccaacctacacgcgtgatccatggtcgctctgcccggatctgtaccggtggcgaggagagtttgcttcaaagtcctgtgtaatattttttcttccctactatgtccccttcggcgctgctgcctccacaggtctgcgcgtgttcagtaaattcagtttaggcgacgattctacggtggatctgattcttggcgccagagatgcagatcaggccgagtctgatggcttccttcgtcggctggatgatgataggtgatacggtggatctgattcttcttgcaccggagatggctccagatctcgttcatcggctggcatctggtggtttcgttcatcggctggaggaggaaaggtgagatctttatggcttagtcggctggagatggaaagatcccatcttgttggcttcccttcgtgcctgtcctgttatttccccctctcccttctggtttttcatcaataagactgcacacattgtcaggcatgagcggccaaatatatgatcagtataaagacttctttgtcaggcatgataagcatataagccttcacacattgtcaggcatgaacaggcaaatattagattagtaaatagggcttcacacattgtctggcacgaacagatcagtatatgaatgcaagattagtaccattgttacataacttggagaaatgaatttcttctgttctacatctcctactcctgaatttccagctgcaagtttttacatgttataagtctgcaagtgccataattccaaactttctaaaatccaaatgttccagtctgctttagttacttttatcatgttctatatctgcttcagtaatttcatttgtaactatgcatgtacaagtgcaaccatgtgcagatgcactattcatactgggctaaatgtgttcagacaacagcatctgctagattggaaaagactgttgagagctgcttaggcatgttttttttttcactttatggttttgatgaggttcgacccagaaaaaaaatgtggtagctgatttgtcaaatatttatttttgtttagtttatctcagatgtttcagttgtctcagatttgtgaaatatatattttttgttttagttttcactttgtctcagattcttgaaaagtcattcaaatcagatttttgaacaataaatacaagccttggatcctactacctccgtttcacaatgcaagactttctagcattgcccgcatacatatagatgttaatgaatctaaacacatacatatgtctagattcattaacatctaaatgaatgtgagcaatgctagaaagtcttacattgtgaaacggaggaagtatttttgaaccctgaagcacaaggttttggatatttctgccttagttttgcatgaagtattagctagctgtaacaagctaaaacaaataccatagctggtgtcctggtggtagcaagctggtatatttgaaagaactaatgaagcccttttttacccgagtttttttaacttgatttccactttatattatatttacatactactccgtgacttttttataacgtttgaccattcctcttattgagaaaaaaatataaatattatttattttattgtgacttgctctatcatctaataatatataatcttaacttatacttttacatattatatactatgtttctgaataagacgaatggtcaaacgttgttcacaaagtcaacggcgtcgtacatattgaaaagagggtagtacttctgtaaattcgtagcaaaacaactgcaatttctgtactgtatcaattttcgacttcttttgaccaaacaaaatttaaagggcaaccaaagcagcactaaggttgtgttcttttggaggggttgggaacccctcccctacgcatggaaaacggagcaatagattatcatatgattgattaggtattagctataaaaaacatgaaaaatgaattaatatgatttttaaggtaactttcctacataaactttttaccaaacgcgtactgtttagcagtttgaaaagcgtgcacgcggaaaacgatggagagtagttggaaacatatgggaaaggacacagccttataattaccttgtccacttcaccacggctttcaggtgttgggttgtcatttacctccatgtgatcgctccagctcacaagtgtcgacatctgcattcaataagtttttaaagtcttgatcaggtccctctaatttcagtttttcataaccgagaactttaatttgatgaaactgctatatatggtggacaaaatgctatatatatggtgaaaaatcttactatactttgttttgttcatatgtaatgctatttttgtatgtaaacaagttcaaaagatgtgtcagaagtctcatgtccagaagtctgtttttacaggaatttcaacataattttacatattacatatgttaaaattgcacttcattttcttctgcaatttttatttaaatgctgagctaaatcagtgggtgttttttcaatcgaggttagcatgcatatatatatagatcaaaccatacgctattatctgttctatttcaaattcagaaacacaagaattataggtgtagaatgcaccaatcctattattaagtccttacaaatgcatgcagcaaattgaaccatgtattcttgatattgagctgtgattttaatcaagaagtatggaaacatcaagattaccagaaaaaaattgtttctttcttccagagctaactagagaaacatcaagattcatggcaaagattgatcccggttaggtgcaaatatcatttgtttgtttgtttgaagttcagtgtaattaccgcatttactttatcgctgtttgcatatgttggagcgtcatctgcccctatccggctcaggttcacaagggaagacatctgcaataaaaaaggtaagttgtgtgttgtgattttataaaaccatactgacttgttcagtatcgtattgtttaagttgcatgttgtattatttctatgctgaattttcctactttgtgtagcatatgtgtgttctcttctgacatgtgacctcaatgtaagaaaaaatgacaccaccatgaacatctaagtgctctttctggcctgtgaccataatcttaaaaaaaaaaaccaaaaagacctttctggcctgtgaccttaatctatagaaaacatgactccttttatatgtacttatctgattttttttatgatgtttgatgtccgtgtggttgctggggatgtctgagttgtgtttcagagataggcactgagggttattttactagttttggaaggacaaaaggctttagtttattgctagagctctagctatcccctaattagcatgtttttcatccttgtctatggttagttttcagaactcgaactcaatgcctgagaattgaactttcagaacatttgtcatagatgatttggagttcattttttaactaggtagaaaagtgctacctgtattatgacaggatcattagcatataggtccattagccttacatccacttagcggcgagcccggcgagtcacggcggcggcgcgcctcccagctcgtggcggcgggcgaacgaaggcagcgaagcgcgcgggatggatggattggggcgccgtctcccgccgtggtggatggattggggattttcttgatctgcaagcgggcccaatcaagacagtcgttggatggggattggatggctgagatccaccgaatgtcacattgtgacatgcttacacaatgtcaccgaatctgagtccgtcatactagggtcagattctgccgaaattcag

SEQ ID NO: 43382 - DNA, 5207 bp, Oryza sativa
agtcctacacactcgaaatccaacaaatccgacacacgcattctcgaaatccatcaaatcctaaaccctcgaaatccatcaaatccgacacacgcatcctcgaaatccacagaaatcacacccgcattctcgaaatcaacagaaatcagggggaagcagcgttggaaacacagagatcagatttgttgcggagttgtgtacctgggccttgcgcgcctccaggctcttgctgtggtcccggtcccgcttctcccgggatgttgatcgccttggcgccctcgcaccaggcggggtggctcacggcgtcctcgtaggtgaaccgatcgaaggtgtcgcacctatggcgccctgcggcgttcggcgagcatggctgcggcacccgcaccctccccaccaccgcggccatcggcttccccgccgcctcacgcactcacactcctctcgtagatgttttttttttcttcttttccttctctttgtaaaatgtaatctgattttgctggttgcctagtcgtcccctgtttatataggcacgggtaactctctggtttatataggcacgggtaactctctggctagaacctactagaaattacaaatggttttaacccttctgagagtttttaactttttttaaaatcaaccgtgtaccatgcaattttttttacacgtccaacaaatcaacccgttttgagtggataaaattctttctactaagctgccctaataaaattcttacaacccgtttagatgtagggaaatttaactatttaccactcttgtgatatggcaattaacgatttgccactcactatctatgacatgtgggccctcatatgtctatgatatgtaggtctagtggcaaatcgttaaacaccattctaagagtggcaaatatttgtgaccatgggttagaaaaacctgcggtaatttaggaccaattcaaacgtgcgttggattaagattaaagtacgtgcactaaacaaaaaaagtgattagacaatgattaattgagttttaattattttaaacttgaaaaaaattgatttatatgatattttatactatctttcacaaaatgcaccgtctaacgggttgaaaagcatacgaacgaaaaccgagaagctagaagctagaagcaaaaaagcaagggcctagaagctagaagttggtgactgctgatagaactggaccgatctgaatattttaaagtaaaaatgtctagttcttttaattcgtgtattttcaatcaaatcacaggcaactactaaccgttttgaaagactatttttctctttacacatattagtttttcagaaactttagttgataggtagggtataagttacctaaaacccttgcatatttgccattatattcatcattatgattatgaataaaaataagtaatagccgatggataaaagagctacacaaaagttaattatatgtgggtccatctttgagctggtcttcatgttgtgttgctttcatatttggcaaatttttgttgagttggttaaaagttttatgaagtgaaaggaagtttatttgaaaatactggacggctgatctgtggttgtgcgactgtttcgtgccgtccgatctacgagttctacgacgaacggcccagatcaaagcaacggctagccctagccgccaccccccgccgccggcgtgcctcctcgccgttcttctcgttctcttctctttcgctgacctggccgccgccgccgccgccgccgccgccggcgatccgagcgggggtcgccgtccgctcttcttcctacttagtcctctccatcttttcccgagatcccgacacgtcccctctctgttcgcttcttaatcccacctctccctccgccgtgtgtttggttggttctccgctactgctacacggaggtggaggtggaggtggaggtggaggtggcggtgtcggtggagagttgaggttgtggcagcgatgtagtggctgtcgcggtggcgagcggacgcgccgctgggagtggtctccgccgagaccgaaacctgcgaagaggagatcgccgtcacatcctggaaacacctgccggcgctcggttgccatggtcgtcgcacgatctcaccatcctctcacatatcaggccaagaaggcagcgatagagagtcctaaggtacaataatttcaaagcaggtgagaaattacaacgctctgttgtttcatgctgctccttctgagctagttggtctgaaaaccttcctcgtgtgctttaggtgtttcgatcagatccaacaagtagatctgtttctcttgtaatttcggtggttggaatgtgcgttaatgagaacaccttttgaatgttgccatgtacgtttgtaagtgtataatgccttcaattctgctagatcttcaggatttagtctgttgcttatgttatttcagaatggatggggaccgattctgttgttacggccatgttgtaatgtaaagttagtctgtaacctattctgcgcaaatttggaagggcaagaatttgggggtgattgctgtggctgttgtgcatctgcagccaatctcagttgcagctgcggcggtggctacaacagcaagcgcaaccgatcaccccctttgttttcttcccactgttgtccatgaggacacatgttaggttgcatatgtggcaaagtaatatgctgcaggcctacatctttggttttcagcagctaacaaagcacactcttcctagtttcttgatgtacctacgtagtgatgctggtcttgacttagaaattagcatctgataaccacattggtttttcgcgattggtggatagttctgtcactgatcttattctcggtttctgatgaaggattttggctgtaaacatttggatatgtctacaatattagagtatatataacatgtgcaggctaaaccttactttgtttacttatacatatcagcctctatatttgattcaatgtgtgcaatctccaatgatgcttgaagatgcatgttttctttgcagtgttgtgtaggaaagtttgttagtaaagaagtgcttccaactgctcgaatgtgctcttgatttaggttgcaataatacctagttccatgtttgggtcgccaactcgccatattacataccacatgtacttatttgtgtttttggtttattcatgcttctgaatattcaaatttggttacttctgtaacaagttctctggactgtttacacttggccatttttcctctattctttcccttcagtattttttcctatgattatcaagggtaaacatgacccatcctacgatgttctctatttacaatagagagggagaaaaaacaaacgatgttttgaaaatacagtgtatctgtgtatggtttagagatactgatcctaatgtgtgtgtatggtttagagatactgatcctaactagttaggtgcccatgcgttgctatgggggaaatatagatcaaccttatcaaagctcaatatggttgtgttgtggaaaacaaaattagttggtgcatcaggaagcagtcaaggacatgacaacatgaaaaactgaatttacatcattaaatgtaaggataaaaaacttaacttatatgatcaaacccaattcattaaagacatgaacggatacaagtaaatttctggataatacactaatgctcatagccatctcttaagagcttctcaatacatcgagttgtaagtttgcataaatatggtgagcttgatgaaacatgaacgaatcaccattaattaggtactgtagcaagctgacattgtctgtttgctgtgaatcaggcgtcaaaaatcttcaaaaatcacagcactgttcacctctgacattattgcaactaaaacaagaggatccttgtccaggtgattgtctctgtatggtaggattgccattaatctgtccaattctcaaaccctttatacccgtatctgcatcaagctgaacaaaacaatcaactttgcactcttcaatttttttgctagtagcctttctataaacaagaggacgaaaaatcaaatatgcaaatgcaaactttccggatttagtgtaaacttatagagcccaattgcattcaattattagcgacaacaatgctgataagtcactgaaaggaaaagacacaccataatgactatacaacaaatgtctgtgtagaatcacttgaattgcttatatagaaagtatgttgatgacaacaatatacagtaaaatcagagaccgctacatagttcatgcactacaacatatttattcttatcctacactaattttgattattcagaagtgttttagcaatggaattttctttgcaagcacatgacatgggttaagttttttaatgaacatacaattgcttgatatgagggagttcacagttaacacaaagccatgaggactcacctgtttcgctaccttgcactgttatccacaaaaacatgcacctaaagctgtaaaaataagatggaagagaccgagagagaatgattagcttgtcacaagacatttggttggcatacatgagtgcctaatcctgagaaagggcagtgcatgttagtagaggaattgtccatgatgagtacctgaattagttcaaaaggtaaaaaagtttcagagaacatattttccaagtatttatctgattccttagttcagttgtcaaaaaaaaaatcagatatatagactacaaacatagtggacgggaattaaaagttttataggtctgtcaaatatgatgacaaatattttgttgatccttgaagcaaaatcctgcataggcaaaggattttataattgtaagtagcagaatccttcaagcgaaaccccacataggtaaaggattatatttggcaagatttacatgttaagtatcaaatagagaaaagattagtgccacaaatagattataattgtgaaatataatttactttacaattaacatcttatctttgagtagcacacatctttaggactacttatatactatcttttgctgcaaaatagcttgacaaattgataaaattggtgcaattctgcttgactatattagaaaattaactaatcagaaatatcgatcagaaaactaacaaatggttgtacgatgagttgattcatagcggatcccaggctatatatcttcctgaaaattcctataagctttctgattacttttgccattaggattttcaa

SEQ ID NO: 43383 - DNA, 6092 bp, Oryza sativa
ggacggagggagtatcatcatagctgatattaaatttgatcctactgcaacatatcatcaaaatagtcttttaaaggttattttgttcactaattagcagatgatttaatgtatctttttcaatggaatagatgagtaattatatcataataacatctctggttacttgccacttagttatcagcatattcactgtgtggtagctacactctaaaaatgggaacatctctgtttgtcatcagatgaatccacaggatattatttacgtttactggtttaggtatggcttaatgtagacaatgtctcatatttagcatgatttcataaaatattgttgcatcacatgaaaattcaggatgaaatgactaggaactactttacagaaaggatcgaggattggactaaggtgatggttggtgatgaacctgtgttacaccagcaaaaagcacaagaagtttctttttgatcagcatacaagtgtatattttcatgagcctctgaagcatctccagctaaacttttccagttacaggcagtcataaatacattgtttaaacaatgatctggtttgtattcgtcaggtccatgcaggcctaaggaagagggctcgctattaatgtcagtgctgagattgctgaatccatacagatcatatggaggcataatacagatcaaaacccttatttaggtgaaaaccatcaggttttctagatgtatgatttttttgcatgttcttcatacaggtactgtaactggtgtgaactgcaagtggctagcaccacaacctggtgtcgatggttttcttgtcagcggtacttcattgaaagtaaacattatataaacacagtagaatgattttgtaggcacagttacatgcctaattcactaaatacagtctcctttcttggctgtgtggcctgaatttaccagcatcattaattctgccactgcgaagtctgcctaagatcttcaccctgttcacttcggcatgaagatgtgttcaaagaggaacatacctttctctgtttggctctaaaagatgttattcggctattaaagcttttgtttattttacaaggaaaacaagaatatatttgacatgccacatttggccagcaaacttttcagatgaaatatgcaggaatcatgaatcaataatggcatgattagcaagcatcatgatgatcattttatttcaatttccacattgacatacctatgcccttggatgcgaaacacattttattttagttctgattagggtaattgattatttatggctagctaattatagtattgaaatatcaatatcctatatactttgtcgcagattctgattcggatgtaggagtattgattttgtgatagctgccttacctcacaagacctgggtcatccttgaattgaaccaccaggggtatctaggttattgtgaattcgtcatggcaatgcaggttttcctactctattaaatgcctatactgaattagtgatgggtttgctacgattgttagcttgtctgtttggctcgagtggaggatgggatcgctgaagcgtgatggttgttgctagccaccaatttagcttctttgatgagttcctaatttcctatttacttctactaattagtttacactggtttctgacatacttgggcaggctgaatcctctagctgtggatggttttggatgctctatttttagtaagtttactatacctcaatagaatagaatatattaagctctgctgcacaacacaaccttgcaacaatgtgatgaattattgctttacagagaccaaagcatcatgctaagagagtgatccagatattgatggtaaggaatgcatccttccatacgtactcatggtgggaattagttacgagcctatgacaacaatttatacttgtgcaatcctgcaggattttctcaggctcaatctccagtaactgagtcaatggttcagctgaaagtcgtcaaataaggtagtgtccatgtacgatttatttttttctctttcttttcgtgctctgaacaatagtacactcgtatgaaccttgaagctcttgcaaaattttagtgagttcgatttgcattacattcagttttgctatttcaaaagggaaagtaagacaattaaggagtttgccgctgagttatatgagtggtgaagacattgatttaaactttgctatgcaatttgttgaactagaaagaaacagtacaaaaccccttgattcaatgtcttgtgatgaagtaaccccgtaaggctatggtactcaataggaaggtatgatatatcaacacttcttcatttaatttatttgatgatacgatgaacatttgtttgccagaccaatgaagctactccaaggaagatttatagaacatgattttcagctcaaaccatgatcaatttttagcttatgcatatttattttaggagtagctcatgttttcctcttgttttcagcaagctaacttaggcgtttgtggagacaaagaggggactgataatttggagaactggatgtacaaaagagggttccctgcaacaagtatacatggagatcgaacatagtaggtacatcaaatctctgaatcatccgcgtatcatgcttacacatgcgtatcacaaatggattttgggggaaatcaattgtacccaatttatacttgatatgtaaaatagcaaattatttaacaactattgaatcttgaaatcactggaatacctgccaattaccggaacagtcattaattttattattggccatgagcataaaattttatagaacaacccttatttaatttgaaaacagaacccctatactacctttttgggtttactttagcaacataactgactttagttctcttttacaagaggcaactattaaaaaattaacctgataaatataaaattctttggtagaagatatgttaatgtttttatccagccttatgtatagatttggttgatcaagtagcagtagcttatatctatgctttttaaattgcctggtttacaaagatgcatagaaatttgtcattgtttcccatccgactaataccggttcatcaaagatctcattggcaggagagagggagaggtgaacaagggcttggcgccttgtcctccctcatgctttgagattgttttttattaatgatttaaaaatattgatgttatatactgtggtttaagcgtttctaaattaactcaacactagcaaaccttcttaacaaattcagaaagcatatgcaattgtaaaaaagaccttttcaactgaaatgacatagaataaaccctgttgatattaaaacccaacaaaaattataggagtatggtgtttatgtctcatcattcatcaaatgcacactggcactcaaggcggtaccaacaggttttcagttgcatgccgccatcagccactgagctcaaggaaagccaacagttaaaccaattagccacccaataattcaaagtttgatgctgcatttctgaatcaaaattgagatttgaatgttcactactgaatttaagttaagtactatttttccctcgtaaaaggatttcagaattttgctatcgatatgaatttttaacatatattgttgagacaaaagttcagtgctagattttttaaattttaccattattctgaatttctgaatctgtaccgttgggacttgaaagtcactaaagaagtagacaaagcactaaatttctaaattttagcaattgttcctgaatttctgaatatgtacaattggacttgaaagtcactaaggaagtagacaaagcagcaggtaacttagatgaccacccaatgattcaaatttcagtgctgaatttctgaataaagttgtgattttgaaggtcagtactagctttttttcgttataaactgaaattttactttcattatgaatttctaaacatgtgcagttcagaattgatcaggtaatggtaatgccaactgaaacgtacacataactgaattcattaactatttataaatgaggtaaagtaaagtagtacggagtacttggtactaattgatactggaacaaaacataattaacctaatcttaatcatgcagtattattagtagttggaacaagccagaacggcttgtgcacacaagaggcgtgctcgaacggcggcggcgccacggtctcgacgccgccatcgccgacgctgagcacatgcaggttgtagtcatccggactgaaggagttgaaccagtagaggcagttcgcccgcaccccgcacccgctcgccgagcacgacgcgccgaagttgccgccgccgccgccgccgaggacgaacgcccggtcgccgccgatgtccgccgtcctgcgccacgccggccccgccgccgagaagtccatccggtagacgctgaacttgtgcggcggcccttcggctcggaagccgaggaagacgacggcggcgaggtacaggtcgccgcgcgactcgacgaggtacgtggccgcgatgccgctcgagtcgggggacgggaaaatgtcgtcgatgccggggacgctcacggcgaccagcgccacctcgccgtcgccggtgaagtcgagcgtgccgaggctgaagtccttgtcctcgcagaagtagaacctcccgccgacgccggcgacgtcgaacaggtgccgcttcttgggggcgcggtactccacggggaggctgaagtagcccatgtcgtaggtgtgcgtcgaccaccgctcgccgccgacgcggcagaaccacacggccgggccctgcaggctgaggacgacgacgccggcgccggcgtccggggcgttgtcggacagcacgcacttgcgcgccgtcgggagctcgctctcgtcgagaggcggcaggccgaccttcctcccgtcacgggggtcgaggaggaacgtcgacatctccggcgccgacgaggagctcaggacgaggacccagccctgcggcgtctggaggtaggtgctggagtgcatctcgggaaggctgacgtcgtcgtgtgtcttcccgtcagacaggctaaaggccatcgccggcgagccggcattgcttcgctgcaccagcaaagggtaaccggcggcggccgacgggctcgatccatccgccatggtttgtttgctcaactatcgacgacgagacgattccggagtcgcaaactaaaatctcgggttatctctacggggaaaaagctcgttaagattcggttgagtgtatcacgttacgataggagcccttaaataggggatacgtataccggcaaaactctgtttaactcggtatcggcttcgcgtttcgcttttctgttccggaacggacaacaactgcattgacacggtgcagttttggggtacacgtgttccacgtgtactcggagagagtttctcgtaactctaaaatttgatttcccaataatcggatttataaaaagactaaaaaatgcccgttgcaactgaagtattttctcgtaactctaaaatttgatttcccaataatcgggtttataaaaagactaaaaaatgcccgttgcaactgaaggtattggtttagttaaggtgaaattttggatattttcttttaaaaaaatcatgagctgtagttatcgtctcaagttagcacgtgagtttttttaaagaaaatttcttatataactccttatgtattttcaaaagcgaatgagcttaaaaaccaactaaatgcatatatgtatttataaatgcaaacgaatttaaaaacatactcatacaagaatgacgtatcgaagtatcgataaaaacatctttaatttttataatagtagggatagggatagggatagagatagagaattgagtccaaagtttactccatcctttatatttaggacttgtttacttaattaccccaaaaaaattcctgccagataatacaaaataaatttttggtaagataggatatggatggctgatgtttagtttaataacttaccatatttttttggaagtattgagagtaggaagtttcagaattactaaaatttgatacacttgtgttgataataatacgataatgctgttggccggtcgcccggtgcgg

SEQ ID NO: 43384 - DNA, 18282 bp, Oryza sativa
agcgcccgattttatctcctcccgatcgggtgccggaccagagtcatctccataataatatgtctagaggatatgggatatgaccgatgtacaaagatctctcacctaaattttgttttgagattttgtaatgaggatttaagcattaaaaatatatttaaatccaatagctaacctaaattttttaatatattttttcgaacgcagcaagtgaggctaatctagctccctatatcagctatcatagtggggaaatcagagtctaagttaggcataaaagaagaggttgacattatttgttatcattggatcgatcatattcccctacagaaattgccaagagttaaaataaaaaagaaaacaaaatgcctaactttaaatactaaaattagtagaaacttgaataaggcaattcgtaatgctctctcatttctagacccccttttaggagcacgtgtgatttgaagattaatcattcccggggttcatacagaagctgctaagtagaagaaatatatgggttcaatagagaagaaggaaccaaacgcaacatgtctagttctaattttaggaaaattgttttcatccctcgagaagacatactccgtttcttccatgtcacctaaataattataaaaaataggtaagatagatattaacataagatatatcacttcataaacatgcaatgtcaaaatcaacttcagttgtaaaaaaatatcaaatactagctgcttcctttcccgcgcattgttgtggggatatgtataaaattacataagcaaatttgatgtgacaaaaatttgtggcattggatatatataagaatggtactcccaccatcccaaattataggtatcacttttttaggaaaatcaaactcactagtttttgattaataataatactaacaacatatatgctaagtattatgtatgttatacactagatttatattttgaaaatattttcatgtgatgtttatattcattgggaacatacaatgaaataaattactggtcaaaatatatcatcgaaaatcatgtaaaaaaatataaactggtataagaaggagtactatactaagcagtaatgcataactttgatttctatttagaaaattttacatatataaactaacaaaggagaaagtgatgataatatgttgataaattttgtccatctatcaacctcaaatgtatatcctttagagagaatatgtaagttaatcggccatcgggcacatcatagtgtcagtgacatcataaagagaaaagaaaaaccatgcaaacatatactccctccattaaaaaataaaatcaacctatgtccacatacatcaatctaggagagttacatctcctcgtagattaattttttttagacggagggagtatattatctaatgggagtagaaaatagggaaaattagctgtaattagagtaagatacgtaagaagataataaaataaaaaaacaaaatgatgaaatacgaacggactaacctattcttgattaacacatattcttggttgatgccataaacggtacgttcagcattgagcattgagcagggaatacaggaattgtgggtaaacgaatatatggttatcctgtaggttaattagatacatgccattataaatttaatggatttgaaatatgccattacaattcttgtatttgtaccaatgccattataattttaatatagtttaaaacatgccactggtatacatattttatccatattggacaaaaaaaaaaaacccgtcttcaacctctcgtcgttcatcgtcgtcgtcaccttgcctcgtcaccggagccatcctccgcatccccatcctcatcgccgattcccctcctccggaccatcgccggtttccccacctccgccgctgcggcctaggacttcgccaacaacccgtccgacgtggcgttgttcctacacacctccggcactgtcgacgggggatacccgtagatcggatatagatggtactggggtacgctggtacgaggatctacgtaatatgatatcaagcagacagaaaacaaagattatactggttcaggccccttgataggtaatagccctaatccagttgatatgggattatatgatggaaaccacagattacagagggaaaagcagaactcgatgataccgacgaggtcgtaatcgaacaggttcgaccagatctcccggcgacttggcttctgtagggtttaactccgtaggctgtggtggatgtgttggctatgagattcgatcacttagatcctcccggggggtcccttttataatcgcaggtcagctggtctccaagtaggactcggagacatcggacccagcatgatacaatgacgacccagtcccgtctgagtagtactccttccatctgtgaactccatggcgaatttctttaacgtatgccgaaaacgtccgtatacgcgcaagtataccatatcgatacgtgacgtatatcgaagggtagagggtataccttacccgtaaccttgacagtagcccccgacttctgcttaaatgaactcatgtaaccgatcgtgacttttgatgtcgaggttgttgttgttctcgatgtgaggaccgagagacgaggagtaatcgacaacgcccagtgaagctcaacggtcatgagtgaatttaaattgaagtctgaaaaattgccgcgcgtaacggacctagaaatttccggcggctatctctctcctttccttggaattcgcaccgtcggaagtgcgactatttaagggagttttggggatccatttcgaagtccgcctattgtgaaaagattctccagtctccaagcgttcctcgtcttctccacccccataagaaccctagctagttcatctcggtcccttctccggcgatctccggcggcaatggatctcgacaagtccacctccaccagcacgtcgctgaagaaactacaggcggatggtgcccttcccggtcacgggaccatggagagagaagtaggaggtattgaaccccagcctgtcctgggtcgcatggttgcgatcgaggactacattctctatggttttcttcctccgccttctaaatttcttctcttggtcttgaatttctacggcctttctttgctccatttgagccccagttacatcgccttcctcagtattttttcacatctttgtgaggcctacattggggtagagccgtttcttgacctctttcgtttctactacgagttgcgctggatggaacccaacagggtatccgaatgtgtcggtttccgactcagggatggcctgaagtcgcgctatatccccttccagtgcccttcttctcgtagcaaatggcgggcgaggtggttctatcttcagatagaaaattcagatccagtcttcgttgttcctgaggaatgaccagacaagattttgtcttggaccgccaaacccgccttgaccccatccctccagtctttcatcgatatcattgatgacctccgagtacgggggttgtcggggtatgaagtcgctgccgacttcattggtagacggatccagccgctccaggctcgggcccacctagcctttgactattctggactggaggactcgacccgggtttctcctcggggtatttttcttgtattaaaactgacttccttgtgtgcgtgttcctcctgacttatcgaattctagttctcgatctacaggtttgagcagtgaagccgtggagcgccgcgtcggccaattgatgatcagcggcccgacgatggcgagcaacgtccccgtccccctttgcgataagggggcggccgaacgcgaagctgccatcaatgtgagtgtactcagcggcccttttgcatttttcttccgagatagcattgtaacttcatgaagcgtaggctctccctctgactgatatcatcgggccgctcgtggatcatcaggcggcggcgtcgctgaaggaggacgtcgtcaaggaggcgtccgatgttgctgccgctgctgccacaacgagtggcggcaacattctgagaagggggaggaaattctcctccgtgatcggaaatcgtcggaagacaccctccccctcggtaagctctcctggtgtttcatcgcgtagtcggaaaacttccgcctcacatcatacccgttgtactccaggcctcggacgcgtctcccctgcctccgcgacggcagctgcttgtgacgcttggcgagaagtaagtggatgaatttgaggttttgtcacttcgtcaaacacttgcaacctgtctgaagtgcaacctttcgtagggcggcacgggtgaaggcgacgcaggacagatctggagggacctccagcgcgtcccctgatgtgtcctcgacagatgtcgtggtcgtgcccaggaaccgcgaggcgacgcctagtggcccagccagcgatcttgcggctggtcggggtccgtcgtctgctgtcctcacttgggaggagctccaggtcgagatgggtcgtctccttgaggctggtgctcacggcattagccgcgagatcgcggaggcgagggcagcggcaacgtcgtcggcgaatgagcgcgccgaccggctgacgcgtgatttggcggaggttcgtgaggacctccagaagatgagggagctggtggccggcaatgagcgacaacggcaagggctcgagcatcgtatgtcggagctcgagaacaacttgtcggagatccgtggctcgctgcgggtcacctacactggtctgcaccagctcgctgggagtgtggcgtcaagaccaccataccggcgaatcccgacgagttctcgctgacgtcttcgcttgcagaactggcgacggcgatagaggcaatcccctccaagcacgcggccaggatctataccggggcgtgccatgtccttgtgtgtgtgaggctggcgcaccctgaactcgatctgcggaagatcttggatcagggggtggctagcgacgcacgcaaggacgtgatggaggaagtcggcgatctgggggagtctgttctcccgctttttgaagagtaggattttggctcccttgtactctttagtcatgctttgtaaaactctcattggttctaaccgcctttgtgtgtgcagtcatcaccttagttttctttagcattttgacctcgagtactttgttgtcgtttgtagagatgttgatatcgaggatgtccagcagccgggcagcctgagttgccagtgatcgttccggcgcttgcgtccgagccgtatgtgccgcagggcgatgtagatcagaattcgcctgtggaaacgggtatggcgacgacctccttaggttggttatttttgtctgctccttttcttttacctcgtctgtcttgattagtttgacttaggtgtttgcgtgttgggcagacctcgagagtgtgcttgctgatcgcgaccgtcgcatacagtactggaggacgaagttcaaggtcgctgaacttgagagaactatattggaggtgaagagggaccaagctatggaggcgctccaaggtcgcgaggtatggttcaactcgtacctcaggagttgttgcacaaccatggcggttgtctgtagagagctccgggtacaccgtggggatcccgaggaatcggcagccggatacatctcgtggctgaatggggcctgcgcccagctcgaaggcatcggcaagcgtatcaacgaggccctgaagcaggagtgccgtcgatcgagccgatatgccggggggcatgtattggcttgtatacgagatcatcgtccgcagctgcacctcgagttcctccacgaagggttttctcattctcggagaaaccctacggagatagatcacttggcgaagtcgatggcgccgctggcggagaaggtcttccagtccatggactggcgttggccttcctggtagtcttcgtatcctgtgacaaatgttctggacgtagtgtgtaagagtgtcttctcacttcgcgacttcgatcagtcgtttgagttatacactcttcctagcccccagccttgtcatcggagaattcttctcggaagataaggctcttggacctttgacctgcctcggttgaacaggcactgatcctagcccccagccgtgaagttggaaaattaatttccgattacacggcttggttaatacgcacggcgagaactcttacacgaccagatcttacatggtctttcgtctctacaggatccgacaaggccttatcggctctgggcgtcctcagccgaagttcccttaggttcctcggaggccttgtcaagacggcgtaaagggacatgaggataggtttcaacgctaggtgtcatctgggtaaggaatcatcaggaacactttgattctaatctgtacgtgaaaataggctttattggaactgtaagatgtcttacaagtatggatactattgacttatacattgaatttacgtaattgatcaatgttccaggaatttgccaactcgcgaccatcgccgtctgcaatcttgaatgcgcctggctgcaagacttgtgtgatcgtgtacggtccttcccatttgggtgagagcttgtttcgccctgcttggctttgaacccgtcggaggacgtagtcgccgatcaaaagcgtgcgtgctcggatgcgcttctcgtggtaacggcgaagggcctgttggtagctgactgctcgaacggcaactcgttcgcgatgttcctcgagtagattcacattgtcgtttcgctgctcctcctgatcctcatcggaatacttctgtactcgtgtactttgatgtcgtagctcggtggggagcatggcctctgagccgtacatgaggaagaagggtgtctccttgttagacgttgtcagtgtggtacgcacggcccatagtactgatgggagttcttcgacccacttcttgtcatgtgacatgagcctgtcgtagacgcgggtcttgattccttgtagtactatgccgtttgtcctctcgacctgtccattgctctgagggtaagaaaccgaggcgaagcagatcttgactcctagcctgatgcagtaatcctggaaatcggcactgatgaactgggagctgttgtccgttatgatacggtgaggcaatccgaatctgcaaaatatccctttgatgaatttgatggcgttgtcggccttgatttcccccgtgggtgtcgcttcaatccacttagtgattttgtcgatcgccatgaataggaacctgtagccgccctgtcctcgtgggaatggcccgagtatgtctaggccccagcacgagaacggccaagtaagagggatagtctggagtgcttgcgctggtagctttgtgtgtttactgtggaattgataggcttcacaccgctgaaccatgtcgcaggcgtctttgagggtggttggccagaaaaacccttgtcgaaaagcttttccgactaatgtccgaccggccgcgtgtgacccacagatcccttcatgtatgtcgaggaggagatgtctgccgtcgtcggacgagacgcattttaggagtaccccgtttgacgccttcttgtatagatcgttgccgatcatacagtagatttttgctttacgggttattttctcggcttctgcgttgtcctcgggcaactcttcgctgcctatgaatttaatgagtggggtgcgccagttgtctgtggtctcgatatcggcaacggcgtgctctgcctctatagcccccgagctgttgttgaggcgaccgggctatcttcgccgcttgcctctttcactgatcgccttgtcaggatgtctagaaaggttccaggttcgagtggctctcgtctggacgcacgccgtgctatatcatccggctcgatgttgtcgttgcggtatagatgtcgaacctcgatcccatcgaaccttttttctagcttcctgacttctgcgagatacttggataactcggggctagagcacttgtaatctttatgcacctggttcgcgactagttcggaatcccctttcacgaccagtcgcctaactccgagtgcagctgcagctcttatcccggcgagtagtccttcgtactcggctgtgttattggtcgccctgaagttgaggtgaattgcatgcttgaattgatctcctgaaggtgatgtcaagatgaatcctgcccctgctccttggctgttgagtgcgccgtcgaacgccattgtccacgtttcgttgtcgatttggttgtctgacctgttatcaggcatagtccaatcggctacgaagtcagcgagtacctgggacttgatggctgttcgtggcacaaagtggacatcaaattagcttagctcgactacccattttgcaatgcggctgacaacgtctttgtttctcacgacttcaccgagagggaaggaggatacaactgtaaccctgtgggcatggaagtgtagctttcttgatgtcatgattaccgcgtagagcagtttttggatctgtggatatcttgtttttgtgtcgtggagagcttcgctgacgtagtagactggtcgttgcaccttctctctctcgacaacaatgacagtgctaacggaatatggcgtggcagcgatatagagaaacaattcttcattaggttggggggcaacaagtacagggggatttgataggtagcgcttgagtgcaatgaatacctcttcggcttcctgtgtccatacaaatttgtcttgcttcttcagcagagcgaagaaaggttgtcctcgctctcccatcctagcgacgaacctgcttagtgccgccatgcatccggttagcttctgtacttccttgagtcttgtaggcgacttcatgttctcgattgccttgatcgtcttaggatttgcttctattcctctgccagagacgaggaaaccgagcagcttgcccgatggtactccgaacgtgcacttctctggattgagcatgaggcgatatcgtcggaggtcttcgaacgtttcccgcagatcgtcaatcaatgagtcgcttgtcttggtcttgacaacaatgtcatcgacgtaggcctcgacgttgtttccgagttggtcgctaagtgcgccctgaaccgtgcgctggaaagtgtttcctgcggttattagtccgaacggcatcttaacgtagcagaataccccgaacggcgtgatgaatgctgtcttctccttgtcctctttcgccatgctgatttggtggtaaccggagtaagcatcgaggaagctcaacgactcacaaccggctgttgagtccaccagttggtctattcgaggaagagggaagtgatccttgggacacgccttgttgaggtcggtgaaatcgacacacattctccatttcccattggccttccgcaccatgactggtttggctagccactctggatagagtacctctctgatgaaaccagctttgagaagcttgtcgagctcttctcgtatggcttgttttcgatctggtgcaaatctccaaagtttttgctttactggtggcttggcgtcgggtcgcaccatgagtttgtgctcaatcacctccctgggtacccccggcatgtcggacggctgccaagcgaacacgacagcattgtcgcggaggaaggtgatgagcgcgagttcctatttctcgcctagtgatgccccgatcttgacagtcttgtcggggttggcactggagagtggaacgatcttgattgcaccgtccggtttcggcttcttgtttgtcttgctcactttcttgggtggctcagctgtggcaggtgggctgggcgtgtgctcgaccatgtcgaggctccgcttgtcgcattgcactgccagcttagcattcccttgaatagtgattgttcccttcggtcccggcatcttgagcacttgatacgcgtagtgagatgcggccatgaactttccgagtgcagttctcccaatgatggcattgtatgttgtatcgaattcagcgacatcaaaggtgatctgctccgttcggaagttatttgattggccaaaagtcacaagcaacgtaattttgcccaatggtttggacgatgactgaggagtgattccatggaagggttgatcggtgggcgtcaactcacttcgtgggatcaccatcgtgtccaaggtgctggtgaaaagaaggttaattgagctgccgccgtcgatcagaactctcgcgaccttgatattccgaatagtgggttcgaccacgatcggatatcaccctgggatgacagcagtcttggggtggtcctcttctgagaattctatcttctgttcagaccacttcatcttgggcgcagctccctgccacgtcgaacagacttcacgttccactttcttgtattctcgctttgaggagtatgccgtggaacatccgaagatgtgcgagacatggaaatcgcagtctgggtatgctgagtctgattcctgagtagccgcctcagcgtccttctcgaccacacgtactcgcttgcctttttccaatgccatatgttttgcgagcgactttttgaagacgaggcaatcttctagagagtgtctgtcagacttgtgtatagggcaccatgttttcttcgtgtcgctgccttgtgggtctgggcgcttgggacggtccgcgtattctgttgcgagaacttccgcttgagctttccttttcccactcttgtgatttttcttcttgcttgagtcaggtgcgtccttggctggtttcttctctcctccggtcttcggtttgtcgttcttgcgtctcagagcatcgtccgcgtgagcgcatcgatcgacaatttcgaattatctccgagtagtcgtgacgcgcctcgttgccaactcctgggtagtatagcgatctctgacaccggacttgaaggcgcggattagagaagcgttggtgattttggggattgtatttctacactcattaaagcgccgaacataatccctcaaggattcacccgggttctgtgtcaacgcatgtaggtcgtcttcaattgcgtggcgcttgtaaattccttggaagttggcgacgaactgctgccacaagtctgcccacgaagaaatcgagtagggcgggagatgcatcagccatgaatgtgcagagcctttcaatgcagttggcaaataattcgccaacgcgttgtcgcccgctccggcagtgtagagtaccgtggagtaaacctgaaggaattcttctgggtcggtactcccatcgtacttctctattgctcctggtcggaatctcttaggccatcggacatcacgcagcgaacgactgaaagctctacacccagcgctgggggtggtgggttgtcggcgatcatacgtccttcgtggatgtctatctgatgatgaggatgaggaagatgacgacgatgacgatgggtcacttggttccggtgtacgattatgaggacgtcggccgggttctcgagaatcctgtcgtcgtctcctgttgttgtcccagcgccgatctccatcgtcgttgtcattatggcggcgtcctcgaccagtattgcccagaacccgccgttcgcgatcatcgtgatcgtggcggttgtggcggttatcacggtctcagtcttcgctcgaacggcctcctcattcttcgttatcgtgacgtcgtaaagagacgcgatgtcgggaacggttctcgttgtctcgtgcgcgtcgcgcctctcggcggccattcaggtgatcgtggagatctccggtgtcgcgaggtgaaggggtggctcgatgaggtaattcccgctgttcagggttttcgccatcagcaccgccagttggtggctgttccgggtgcgctgcagcagcggcctcttcgaacgtgttgctgaggttggtcactgattcccgtagccgttctgtccaccgtgcgagatcatcgttcaaaacgggatcgtagggggtttccctcagtattgcgttgacggccctgatgtgttgggccggtgtagtcacttgattttccgcttccgcattagcgcgcgctgacgtgccggtcccgtcgatagccaatacctcgcgtggcgtacttgtcgacgatgagccatagtcttcgagcaggtgtagaactgacggctcgtggggatcgatgtcgattacccccaacgaatcgatctgagatcagcgtcgctccttgttccttgtcctcatccctgagggggatacgtgactgctggaccttaggaggtgacgtcttcatggcgctgagaaagaccttgcagcttgagaggtcgtgattctttgtcttgtgaataggacaatagacatcacgagttggagaagtacgctgaattccacgctctttgtaggcacgaatttcagcgtggacgttgagaaaaacccagcaggcttgcaaggtgtgttttttggttttgtggataggacaccaggaccttgtcacctcggaagtcatcctcgtcggctcgtgattcttgtcggaaagacaaggtttggccgcactaggatccttctcgggctcgaatgtcgtcgatgttccgttctccgcttcggcgggaggatccttcgacatggagttgtcctgggttgtagccactgcgttctcgcttccggtcattgatggaccagccaagatcggcaccgtggtgtaaaccgggaagacgatttcgccgacttgagtccgcaccagcattgttgaagcaggaactccttggttgaggttggtgttgacgctgttgtcgacgaagctggatgatatagtagtagaaccttgagcaccaagtccccctaccgggcacgccactgtcgacgggggatacccgtagaccggatgtagagggtactggggtacgctggtacgaggatctacgtaatatgacatcaagcagacagaaaacaaagattatactggttcaggccccttgataggtaatagccctaatccagttgatatgggattatatgatggaaaccacagattacagagggaaaagcagaactcgatgataccgacgaggtcgtaatcgaacaggttcgattagatctcccgacgacttggcttctgtaggcttcaactccgtaggctgtggtggatgtgttggctatgagattcgatcccttaggtcctcccggggggtcccttttatatcgcaggtcagctggtctccaagtaggactcggagacatcggacccagcatgatacaatgatgacccagtcccatccgagtaggactccttccatctgtgaactccatggcgaatttccttaacgcatgccgaaaatgtccgtatacgcgcaagtataccatatcgatacgtgacgtatatcgaagggtagagggtataccttacccgtaaccttgacaggcaccacgtcccgtccaccgccgcgccagagccgcgcggaacgcgatgctcgcgccggcgcggctgccgatcaggaacaggggcctgcagccgggcgagcccgcggcgtacgagcgcacccaccggaccacgtcggcggcgtcctcgaacgcggcggggaggcggtcatctgcgggttcgtctcggcgtgggtgctcattgggctcaacgcgctagcggcgaggctcaaattcgacgacccgctcgagaccgcgtagctgcacagcgagtgcggcgcgttgggcgtcatcttgtgggctgttcatgggcagtggcggcggccggctgctcggggcacacatagtggtcatcctcgtcatcgtggcgtgggtgagcttcaccatggcgctgctgttcctggtgctcaacaagctgggcttgctgcgcatctcagccgaggcacaagatggctggcatggaccaggcgcaccacggcgggttaccatgacgacgacgtgagtggcaagccggaccgcggcatcggcgggttcatgctcaagtcggcgcatggcacgcaggtcgccgccgagatgggtggcaatgtctagtggcatggaggagctgagctagtaatacacacatgtagcatctgcggattcatcggtgtcgacggaggcgatgaccgcggggatggtggccgtgagggccgtgcaggagttgtggaacggctcgaacaccgagcagaagaggacatacccaccagatctgctcgatggagagggaggggaaagcgattgcggtgtccatcaccggccacgcttgccactgccattgccggtctcgtggaagagaggagaggggagaaagaggaagaagaagaaaacaagggtaatttggtcaaaaatttattgtaaatgcatctcagtggcatatctcaatatgtgcaaaattataatggtatgatccaaattcacaaatactgatggcatattttaaaactggcatatttttaatggcaatgtatctaattaaccctatcctatatagggcgcgttcttaattcttcatcaagcatatatatgcatgtgaaactgacactgaagatataaattaaatgttaacaatgtttctagaatttacggacgttgatgacttattggttcctagattaaatggagagagctttcagaggagaggagcggtgattaatttatggcatcattttaatttaagaaaaaaacaataaataccattgacaaacgccaaaatttaagaaataccatcgacgaatgcgagtttcataaaatgccattgtacaaatgattttgttccagaaataccatcatcgtcagggttccgtccatcccgcgcccttaaatgtgatgttcatcctatatcgcttaacagagggatgctagcaaaaccctaacagcgatgatatttttggaacaaagttacttctacgatggcattttatggaactcgtacttgtcaatagcatttcttaaaactagcatgatgcgtgtgcgctgcaacggcattttttttctatttgtctaatatattatcattgtgcttgtctgagggtgagctcctccaccagggaaccataaggcacccttttttttagttttggcctagggcggtgattgaagttcgaggaatctgtggtgaagtatgcaggagagggggtctaacccctcgggggaaagacaatggtggtttaaacaggttcggaccgctgagaagcgtaataccctactcttatgttatgctgactgtgagaaagagattacaagatttccttgttggagtagaaggtgtttatcatgaggggcaggagactgctctagtgaaaaatgtctcatcccctccctcataaggccaggacctctttttatatctcaaggggttaccacagggacccgccgagcctatctagggaggataatcacattgattgcaagtcttgttccttgcattggtagtctcttacacgccttgctgcgccgtcgggcctgccgaatctatccagctgacacgggcgatgcgcttgtcactcggcatttaagggatgaggacttttcggtcctcatttataccgggaagttggaaccctgccctaaacgggttaggcaaaccgtctccggctgacgtgagaggctaagctgcctctcaccatcgtgatgtgacggggtgagggggggtgttaggcggctggccgcctgacatgcagccagggggcaggcgcactaccccggccacatcagtcatttgaccggtcacagaccagtctgtcgcaccacgccgcattaaatgtaacacgtggggggaggggtgctcgctcagaccacctttagtgctgttaggtgggcactaggagcgcccgccaggcgtggcacacggtgccacgcggagggggttggggtgacctgacccctggacacgtggggaagggtcgccgccctgcctcgggccgaacctccccgggggaaggccacatggctgttaggggcaagcccttcctcacagtatgggtaccccaggcccatattaccgacagtgctaattttgctatcatttcgtaaagataaaaaaaattcataatattatattgtcatattattctttcgacgaggtttatgacatgtgggggctagaaaataagcaaagttttgtgggtcccacatggtagttgggtggtggtaatgacagactcaccaccaccactaccatctttttatcgcagtgttcggtaggccggctgcagccgcggctgcgcacagtgaataaggcattgttcgtgccgcagccccgacaaccgaacataccctatattagtatataaagattggacgtttgttaataaaatttctttggattttctcttttaattgagtgtgaatcccatcataataaagtgaagatgggctagcagagtatctaatgctccgatttaattgaatggtttatatcacacatattttcttttctattggctggaataatacggatgatgtggccgtacctgatcatagctaattgggattcttatatactctatctgttttacaatataagactatttcataatataagactttctgctattggccatatttatatagatgttaatgaatctagacatatatatttgtctatttattaatagctatatcaatatgagtaatgatagaaagtcttacattatgaaacggaggaagtagaatttatttatatatcgctgaatgtacgttaactagtttcagcttaattttttataacttgtagaaattaaatttgacatgacatatttgtgaagtgatatatctcatattaatctatcttgatattttgttttaaaaatattatttaggtgacatgaaaaaacgaaggaatgtgccctcgagacataaaaatccatctcggcaaattttccctaacacgccaacttgcaagattttaatcaaacaaattttagatgtatttaagtatcctgcaaaatgtaacatttatcccaaattgcaaagatcctgcagcaaatgttagtttttttagtagcaattaataggtaaaaaataaccgtagttccttaacagcgacatcatcaagaaaaaccaataactaatatcatcgcatgattaggatttaccaaaccattttagatgtaattacctaacccccacagtttaacaaacagcttaccatgtagtataccgtagtttcaaaaaccgaaaaagttaccacacacaatggctgtgataacgggggatgctaatgcgcgggtgatcacccgcacccccccctccccctatacgtcctcttctccccttttctcctccccttcttctctttcctactacagtataccacaaatttttttttaataaaacaaaagttagaaaaatttatgtaaatatatattatatataaaaaatttgaattcaaattcaaatttgaatcgggtatgtaaacttttgacttataaactttggatctataaattttaggtgtataaactttagatgtatagaaatactatgtatagaaaatatttgaattcaaattcaaatttaaatcagacataattcaaattcaaatttgaaacgcgtatataaacttttgacttataaactttatatctataaactttataaactttaggtctataaactttatatatattagaaatactatatataaaaaatatttaaattcaaatttaaatttgaatcggatatataaacttttgacttataaacttttggtccctgaactttagatgtgtaaacttgaggtgtataaactttaggtgtataaatttactaaaatagaaaagtaatgcggtgccagaaaaaaatcaggtgggcgaactgatcgctaccagatcgcccaggcgatcgatcgcgcatcagcttttccgtgtgataaccacgtgataatcgtacaaaagtacacgcagaagaactagacaagccagaacggcgtctgacgaggtgcacccgggagagactcaaacgtgtcgaaggtctcgacgctgccgtcctcgacgctgaacacgtacaggttcctcttctcgtcctcgctgaagccgttgatccagtagatgcggttggccttcaccccgcacccgctcgccgagcacgacgcgccgctggagttgtcgccgccgacgaggaacgcccggtcgccgatgtccgtcgccctgcgccacgccggccccggcgccgccgccgagaagtccatccggaacacgtggacgtcgtacggcccgccgatgctgtacccctcgaaggcgatggcgacgaggaacaggtcgccgcgcgactcgacgaggaacgtcagcgagctggacatcacctggccggcggggaagtagtccaggacggggatggcgatggcccccaccaccgcctcgccgccgccgccgccgccgccgccgccggtgaagtccagcgtgccgagctcgcccttgttctcggcgaag

SEQ ID NO: 43385 - DNA, 8712 bp, Oryza sativa
acgtcgaagagttgcctcctcttgggcaccgggcagtactcctccggcaggtcgtagcacccgatgtcgtagccgtgcctcgaccagcgctcgccgccgacgcggcagaacagcagcgccgggctctccaggtcgaacacgaggacgccgcagccgggctccggtggccggcccgacagcacgcaccggcgatgcgccgggagctcgccctcgccgagcggcggcagctcggcgaccctcgacccgtcgcgtgggtcgaggaggaacgccgacgccggcggcgagctcgtcgtcatcagcacgaggaccaaaccctgcggcgtctcgaggaacgtgttgccgcacatctccaccgaaaggttgacgtcgagcagcttcatggcaggcagactgaagactctcgtcgccattgacgaagacgaagacgacggagtgacaccagcaacgccatatctctgcaccagcaacgggtaagctgcggccgccgctgtcgatgagttcgccatcgagatcgatcgaaaattttacacaccggatattaatcagggtgccttaaattagccgtaaatctctccgagtctgagtcctatacatgttcctggccgagtggccgcgatggattgcgcctgatgatcgggaagaaacattaacgggcatcgttccatactcaacttatctaattttttacaccctccatcccataaaaattatatttctagctaatttaggacaaaacagtaggattagaaaatgaccacaatgaccttatttaatgaactcattgcatgcacacattccatatatacaaatgattaaaaggaagtttgagagaattaacccatataattagcatacttaaattataagctgagagaacgtaaggaaacttatctagatgaatcaatttgttgggccccacatggctagaaatacaatttttgtgggataaagccttagagctagaaatgtaattttattgggatggaggtagtatattatcaagatttcggaggaaacaaactaaacataccatcaccaatataatataacctatcaaattttggtaatttcgaagtttatattctcaaaattggttttcactaaaatttggtaaggtatcaaactaattaaacatcttatcctagcattattaaagtttcataaaggttttttttccacagtaaacaagcccaaaatataaaggtattgtgggaggatggagtggtttttaggcccaaatatttttttttacaaagccttaatgtaagactattaatttcgagtcttttcttaataatggaatgaaacatttcggtctttgcttaagagctacagccaattattactaggttcacataaaaacaaacttacaccgtgagtatgaagccaaagtaaaaaaccaaaagtaaaagcaaactaataaaaaccaaacaagataaagcccccacaactactaaattctattggtgaatctccacccgaagtttgcaaagagtagcatgatcgtcgactcaaatttatgacacatatcttttattaacttgatatgatcatcatacctttgtagttgagtctattcccggacccactatgttgccctggaaagaacctgcaaataagattttgaaggtgatctatcaaaaaccatttcatttctactaagccagagagcccaacatacagcagaagcttcaacaataataagttccttgatctttttattaacacccacaagccaattcccaaacatataagatatactacgtggagggtataatccaaatgcaaatagtatagatctcctaataaatatggcaaaatggcaatctaggaaaagatagtaaatcgtttcatttttcataaaaaaacaacatctcaaactaccattccaattcctcctagccaaattgtcttttattaaaacaatccccttaaggagatatgacataaaaatcttaatcttaagaggcatattaagttttcaaataaacttatttctctcgatatgcccattaataagagccaaatacatagatctaactgaaaattgaccactttgatgaaaattcaatctaaatatatcatcctccactgttaagttaattaacatgcacaattgaagcacataaattcaaccatctaatcaagttctgatcaactaatgctctcctaaaagagacattaagcggaacaatactcataacacttgcaactgaggagtttttccttctaactatggaatataatgatgggtatctgtcctttaaagatgaatcacctaactacttatcctctcataatctaacttgttcaccattgttaataaaccaggaacccatatttagaaaagaacttttaaccttcatccatcctgaccaaaaatgggaatcctcttgtttccgctcaacttgagttatagatttagtatcaagatatttccttttcaaaagatcttcccacacaccttgttcatttattaatttaaacaaccacttacttagtaaacactggttttgatttctaaattatgaacaccaagtcccctttaatctttaggctgacaaatagtatctcatcttgtcaatatatatttctttttatgttcatcactttgccaaaagaaatgggatctataataatcaattttttgaagaacccctttaggaatctcaaaaaacaaaatcataaacataactaaacttgataacacagagttaatcaaaaccaatcttccacctacaggcatatgcttacccttcgaactactaagttttttctcaattctttgtttaattgctaaccaatctttattactaagctttataaaatgcatagaaatgttaagatatctaacataaaaatctcctagtttgcacccaaaaatatttgaatattgctcatgactttccttagcttggccaaagcaaaataattcactcttgtggaaatttatctttaggccagataaattttcaaaaccagttaaaatcaatttcatatttttagctttctataaatcatgctctaaaaaaatgatagtatcatcggcatattgtaacatagataaaccatcatcaatcagatgttggaccactctagaaatttgaccatcatcttttgctctctttattaatatagctaacatatcaacaactatataaaaaagaattggagataacgggtccccttgccttaaacccttgtatgtttgaaaatttgatcccacttggtcattgactttaatgccaacatgtccaccttgataaaagacgcaatccaatcacactattttttgtgataaacccttcattctcaaagtttgttgaacaaaagaccattttactttatcataaactttatcaaaatcaatcttaaaaagtacaccactcttttttatcagtgcaattcatgtatcatttcatgaagaataacaacaccctccataatattcctctcaggtataaaagttgtctgtgtgggactaataaccttctgagccactccggaaattctatttgtagcaactttagtaaaaattttaaaactaatattaagtaaacaaatagacatatattgttgaattttcaaagcctcattgcacttgggtagtaaaataatagtaccaaacttaagagagtaaagaggtaaattaccactatgaaaatcatcaaataaatcaaccaaatcgggcttaagaacatttcagaaaatctgataaaactcagctgagaatccatccggacccgagctttattatgttccatttgaaaaatcgcatcttaaatttcctcctcagaaaaaacttgtactaaagctttattttctaattgagagacctgtggaatatcacttatttggctttcatctaacgttaaagaagacttttataataagtggtgatttgcgccttttcacatcaccattaattacctaatcaccatcctgtaactgataaatccttgttttcctgtgcttaccatttgctaccaaatgaaaatatttagtattcgagtccccttccaaaatatttttagtcttagctcgctaataccatttaatttcctcttcccttagaaaacaggatagcttattcttcaaataaagtctagaatcaagttccacttgagttaacaaagttcatcataattttttatcaagaaaatcaagtttttctaacaaaaacttcttcccttttcttataaaggccactagtctgtttggcccaaccttagtctatttggcccaacctatttgatggttattataagtagatgaagaatttgtgtttaagagtaaagaagtatcgtcaaagatatctctattaggagtataattttgaagtactcttggagttgaccagaaactctctccggagtccaacatatgtctactccaaaacatcaatggttaactaacgtgccgtgttcatgcagaattttgctggtacatgtacgtatccctatttcgatcggatattacgtgttttccccgtagtgatagagattttcgtttgcgactctgaaatcgtctcgtactctcgtcaacaacaatggcagacgaatcgatcccgttgttcactgttggttaccctttgttggtgtagcagagccatgccgacggccaaccaggctcaccggcgatggcctatagcctgcttgacgggaagacgcccaacgatatcagcctgcagcccgagatgcactctaacaccttcctcgagacgccgcagggctaggtcttgtactgagcacctcgccggcgctggagacgacgacgatgttcctcctcgacatccagaaagaaggtcggcctatcacctctcgactactatctcacggcaaatcacaatgtttatgctacacactgaccacgacggtagcctgggaacaatggccatctccgatcaagtgcagttgttagtacaatgacggtatttaaacagttatatccatctacaatcgttcgttaagctaatgaacgtcaaagagatgtgccacgtcaccaactggctgctagcgctacggaccatgctacagtgcacaataggactaagggcttgtttggttgctaccctgaaacctgagtccaagcctgtgacttgcctgtgttgtgtttggttggtgccctgaagatattggcctgataaaacttgcctaagtgcgcacgcctaagtcaggcctaggaaattggtcgcctgatcaccccatgtactgaccaagtaaaaaaaatgggcatcactttcccccttcttgctctcaaaagtgaatataaaagcctaatatcttcacttctctaacatttggcaagtataatctcaggcacaaattgaatcaaacaacacctgaccattgtatcccatcaggcttatttttagggcatcaaccaaacacactactctcagggagacatgcctgaccaggtaactttgctatctaagctcaggctactctcagggatgtaaaatgctcaggcaggttgctcaggatagcaaccaaacaagccctaaatgtgcgggctacagtagcacacattaccctggccgaatctgagctgctcttatttgatatgacggtcacccaatgactactaaatttgtagtccctactacaaccgctggggtcctgatccgcttgaggcatgatgaaaccaacctgcttgtgatgacagcatccagtagaggatggcagcgtctaggccatcgagacatttgaccatctccctttatctcaaaacacaacagactagaccatctaggccatcgacaccgttctgtcacgttcttactacctctgtttcatcattattatacattgttttattttttttccaaatcaaacgtttttaaatttgattaagtttatagaaaaatataatgatatttttaaaaaaaaactatcaaaatacgttaaatgtaagacgtaatggaactaatttggcgctataaattttactatatttctatagaaacttggttaaacttttaataagtttaactttaaaaatatcaaaaaaaagagggaataacttttaggcaacaattttcatcaacatgttgcgatcatttttatcttcagccacgttgttttgtgttgttaattaattatataagttctaaaattgttttcgatttgatttgggctgtgccgtagaaggctggatcgtggcgctgcgtatggggctacaagacgggccgacccaggtgcgtatcgttcgacggaggcccaagttcggaatttctgatagccactaacttgatcctttttttcttttcaatctttccgtccatccgtcaatgtcctcgtatgaattcgcctgtgtggattggaggattggttgaaatgaattactttctgaataaaatgttgccgttaatccttttaattgaaacggctattgtttcacctactccgtattagagtatctactcctcttattgccatttgactgctgcacgatggtggtgtactcaattaatgaagattaagtaagcatatagaagagaaatcattactacatgattaattaaattttaattattataaatttgagaaataaatttattttgatactctcttcatccaaaatataataaattagcaccagatgtgacatatcctaatcttaagtatctagatatgcccctatccagaaatgtaggaatggagtagtggatttctctattttaaaatgaatggagtagtttagagcaacttttatatagtaaaattttttcgtataggacataccattcagagttagctgtttaaaagcatgtcaataaaaatagagataaattctactccctccgtctcaaaataagtgcagttttgcactgttcatcttcaacgtttgaccgttcgtcttatttgaaaattttgtatgattactatttttattgttattagatggtaaaacatgaatagtactttatgtgtaactaattttttaaaaaaattttataaattttttaaataagacggacggttaaatattggacacggattttcagtatttattttaggatggatgtagtagtatatcttcaaaagaaactgccatatggaggagacgaggagtatcttgcaactgaaacgcaagtactctacagcagcacctcgctgccgctactggctacgctagtactccaacgtggaccacacagtgaaacctgcaaacatgcaacgacttgtctcgtcacaacagtgtgtgcagattccgctcgatgagtactgtgccggtaaaaggcagctggggcatgcacagtactccttaacaaaaatatatcttcccaaaataattgtattttctatacaaaatttgttcaaaaataattttcactctagagtactaattattccctgaatgaccttttatttagatttctccttattctacttactcttaaccactctcacactctcacctatacatcatttaatgaagggtaatatagtttttttactcaaaccttagtactccatccgtcctaaaataagtgcagtttaacagttcgtctcatttgaaaaaattttatgattagtatttttattattattagttggtaaaacatgaatagtagtttatgtgtgactattttttatattttttttcaaataagacagatggttaaacgttaaatatggatacccacgactatatttattttagaatgaaggtaatatattctaaataatatagaattataattattttaaaacggaggtagtaaatcctagctaaaaatttagattggttatttttttttcggaagggtacattacaattgatacaagcaccgacaggataggataggataggagtggcctcggatatcagtgggctttttatttatttaccacgaattccctcgctggtgcgtaacgtacgcagagtgccgtggtagcagactgggagcacgtactttgccggaccctgatgggcatggcatatgcaattggcagcgtgatgtgagcaaaacaacagttcggggaaggccaaaaggattcgagacaggatggacggacgtctctgatcatctctgaatgagaattggatgatggaatctggtcagttacgcatcacatcagtgttttctgctgtcatgattcctggcctctgcctgccttgcctcaccctgttctctgtcagaacaactctctcgccgttttctgccgttacggtgagcgaactctttttaaactcttgagggcacaaacacttgagggcatgcccaacgctccaagcgtggtctcaccccctcgcgaggagtatattcacgttagcttggccgagaccgcatcctggcatagcgctgcgacacccagagaagtttgcgtggatttgtcagcttttgatgaggaaaaggtgaagaatggatgaggaaccgcgttgagggagaggcgtcgctacataccgtagccccgggacattgaggccaactacctcgcgccaccgcacctcgatctgccgctgccgccgctcgatctacccctgccacgcctcgatccgcccccactgccgctcgatctgctgccgccacgcctcgatccgtccccgccgccgctcgatctgccgcctccgcctcgatccagcgtcgccgcgcctcgatccgtgacaccgccgctcgatctgctgccaccgccttgatccggtgctggggagagaggcggcgaccgccggggaggggagagaggcggtgtcggcgaggggaga

SEQ ID NO: 43386 - DNA, 16877 bp, Oryza sativa
aggtgctgaaacataaaaataagatgagcgtataacttgcaccgtgtgaggcatatacctatctaggtgcttgattacttttgcttatgtggatgatggaggtgctccctgccttgggcatgcccggagaaacgtactactcctacaccgtacacggtacagcagcagtattagtaggagtaaattcggtgaaggaaatcgtgcagcctactgactactgtatgccctgtgcggctgtggcctgtggtgctgaacgatcagcttgcgctgcgccgcgacgcgagagaagggaggggaggcgactaggcgaggcgacgtcgtgccgtctcggtggtgggcgatgatgcgagcgcgtaattacgtaggtgggcgtcggtgttggagcggtgaattggagtcgtttctctctctttttgtctcgctttgcgcccgcagaattcacgccttaaaagccgcgcggcgctcatccctgacttggcctctcttttgccgccggactgaactgctactgctactatttgatccatcacaaaactcgtagtactcgtcaactcgtatatattttgctatcgcgtttagaaagttttcaacttatctttttcggaaacttttcaacgtatacgtgaaaagttattgaaaatacctgttgttcctgaacaaataaatggtttcatcagaaaatcacacgaaaagataccgtggttgatcaatcaaaccagaccacccgtcctgaaccacccaccccacaaaccgaacaaattaaaacaacaggaatcgagagcttggaatcatacgtgcagaaatctaaccaccgtccacgctagcttcaagacaaaaaaaaaaaacccagccgcgcgcgaggtgcaggtcgaaatcttcaggagacaaagacgacgcgtgcaatgtgtctagagctctcgcgtactactactccactactaatacaggactccctccgtcccataatataagggattttaagtttttcttacaacgtttgaccactcatcttatttaaaattttttaaaattattatttattttaattgtgacttactttattatttacagtactataagcacaactttttgttttttatatttgtaaaaaaaaattgaataagacaagtgatcaaacgttacaagtaaaaactcaaaatctcttatattatagtacggagggagtactagttactagccagcacagccgatcgacgtctctcaaattaaccaacgctgctagctcttgggcgagtgacacgtctcccttaattctttacgtggatccatcgagaagaagaggatatggatggttgttggagaggaggcaaagccatcgcctgagctgataacgacagctacacgccttcggtattccacgcgtgtatatactggacggttgaatttttgggctcgtaccaccacgccgctgtcaatcacttggtcgttttttttttaaaaaaaaatacgaattacccctgaactatcacggtcgactgaattactatttgaaccaaaaaccagatattactcagcctaaatttttaataccggacgaattacctccttcggtctaatttggagcgatttgtcctgcgcatagtggtgtcggcggtggagggcgctaccgggtggcggctgcacgccacggaggccgagttggggcgaacgtggagctcgacgagattccctctctctcgggtgtgggcacaggtcgcgcggcggcgaactcctggaaagatgagtgcatcgcggatgggtgctcatcgggatgcggcggaagcagcaggacagacgacacacggcgcccccatactcagctcgagggatggagatcggtacagcctgcttagcccgccgcctacctcagctcctcacccgccacccgccgcggcctctgtgcccgctcacctccggcctcggctcctcgcccgcagctgcctccgtccccgcccgctgccgcctccgtcccagcccgcctcgactcctctcccacccgctgcccgcagccgccttcgcgcccaccagtcgtggcctctgttcaccgagagagagagggagggagagaaggagagaaaaaaattgctgacaagtgggcccatcagtttttatttgtttttgctgattgtatcgccacgtgtgtgccacgtaggctgaaaaccacttcaaatcgagttagggtggtaatttatccgattttaagagtttgggggtgtcaaatgtccggtattatagtttatggggggtaaattgtactaccgcaatagttcaggtggtgtaattcgtacttttccctttttttggttaagaaaaatctaaaaataactgattcgatacataaatatgtaacataccaatttcatcggttgctcatatttttaataagccaaaattgcttattggaggacaaaaattaatttataaataaaacttttatatatgttcttagtgacctgatttgataaaaaaaatacattaaaaatatcttaatattaacttaaataaaattaagttagaaaatttgaattttggctttgacttattaggacaaggatgaaactatatcactcttcaaacatgcaagctcaaatcgatttgcacgtataaaaacaaaagtaacaaatttggctataaataatactccctccatcccaaaatatttgacgccgttgacttttttaaaaaattttgaccgtttgtcttattcaaaaaatttaagtaattattaattcttttcctatcatttgatttattgttaactatacttttatgtctatatatagttttacacatttcacaaaagtttttaacaagataaacggttaaacatgtttaaaaaagtcaacggcgtcaaatatttagggaaggagggagtacatacgcaatactacccacagtctaaattactattttatttttgttttacttatgtaagttcaatttgaacttacaagcttgccatcgcatatttatttattttattaattttttaaatattatacaacatgcatgaagcgaggagacgtcaccttctgaaacagatattcacctcccatagatattcttgttaatcttatgcgtgacacttccaatcctagaaacttttcttttttgggtgagataagcatcaggcaaagcgaaggaccagcatgtgtcgctcccttttccaatggataatatgccttttatttattaaaaactcgttttgcaagtgataatcttggcttaataaatgggagcagagggagagtgagacaccaccgcctcttgattctttcaagatttcacatgtttgaatttgagcagtccgtttttcatgacaacatgtagaagaggatttctatctctttcattatcttaaaaaaagtactaaaaaaaccactcagccttgctctcacgttagatcaaaatccggcggttcagatggagccacgtgtcagttggagtatccatgctctccgggtaagaaaatggaggccataccgaaccatccctacatcaaccggtcctgatcattggattgaatgatttgtacaaataactccaggaattagtggagtaatagagtaattaggagtactagtagatgcaaggcattgatgactggatatgtgactggaaacctgcatgattgcacttgctatggctcacaaggccacaggagccatgccaagctagccagctgattgaggcatggtttcctggcctctgataggcatctaccacctcatcaattcagagggtgatgggttaagtagtgtggtgcaccatgaccttttctatccaatattttgtccctttttcccccatgatgaacatggtcacacttggaaattggaatggaggggccaatcatctttcctccctctatctttctttttaattttatcaatgaattggttggagatccagggcaaatgatgttctcattgtgaccactttttatgtataggctatatataaaggtttgatgggatggccctacttctctaccgttatttcacataatcattagtttgtccttgccgaaattagttagacctcctttggaattaagaaatttagagatttttcagagagaagtgaaatagttcctgtaaaattcctactcattccatcctaaaatgtagctatttttagagtttaaatttgttccaatatatagctgtttctccatctgcaccattatctcaaccaatcatgcataaacatctcccatttaactttacatattttttctcaaaccatcacaatctttcacaatttaattaccctattttttaaaaaaaaaatagaaatatttagattttttttgacaccgaaatatttagatttggggatgaagagagtatgtttcacaaccggtactttgatatggtgtagaagaaatcacaaccggtaaaatatcatggatccttgaaaaaaaaataaagggcagctggctgaaaagggtcataaaaacacgctcctttcttttttcaagtgaaacaaagtcgaattttgaataggaaaagtcagcagctacagttatactaaaaaggtgggcataataattgttctatcaatgaataaaaacaaacaagtggggaaaataccagccaactctaatgcaaacattgacaataatacagacattcaactactaataagaagccattataaaaaaaaatcaactaaggctctgtttagttcctacgtaaaaacttttcaccctatcacatcgaatatttgatacatgcatgaagtattaaatataaaaaaacttattacacaggttgcgtgtaaattgcgagacgaacttttaagcctaattgctccatgatttgataatatggtgctacagtaaacatgtgctaatgatagattaattatgcttaataaattcttattagtagttaatactttaaatatgtgtacatatactttaaatagtttattgacggattctgtaatttattttgttattagtctatatttaatactttaaatatgtgtttatacgtcaaaaattttcaccgctggatataaacacagcctaagattctcctgtcttgcttttgtgagtaagttctaatataagtcccctgtttgctgattccctttgaatatattcttcgacatacacatccacccatactcgatgacaaaaacagttggaaacagctcttcatggaaatgctacattggccaatcatgctctttatttactcaacggaattatgggaatgctaccctaattatttattagatggagggtgatagttggtactgacaaaaattccttgttgtcagcttacattaagccaagatttaagggacacttctcttgatatggtactgaagctttttcttagagctgctttaatagacaacctatcataccccttctttagctatagagaatcaattccttcaaccccaccaatctaaactttgttacaaatcagatttcctttttcttttgcgattacccgaaagaccaacacacatacaacatatacatcactatacacgcaaaaaattcctagctcacagaattcttattcacaaatgaaccctgattaataaagtctttatttgtagagaagggtatttttactcggcctctatatccaaccagaaatatgtagcccttttaaattagtaaccgaactcagagctttgggtgctactcaggtcactgcaaccactagactacatgttgtttcacgattaataaagtcatacagttatattccatgaccacatatttggcgctgctctactaaatccctctaaaacatggaccaaaaaaattcatatggtgagagttgcaacttacacttattggtaaacaaaaattccagagctctctcagcaaaaatcttttttttttgtttttgatacattatatactccctccgtccaaaaaaagacaaaccatgattttcgtgtccaacatttgaccgtccgtcttatttgaaaaaattatgaaaaaaattaaaaagataagttacgcataaagtattgatcatgttttatcatctaacaacaatgaaaatactaattataaaaaaattcatataagacggacgaaaaccatagtttgtctttttttttttacggaggtagtagactgcaatttgcaggtaggactacataactacccacgacatgacatcatgccagccgatccggaccatccgttacttaaaagtggacggccaagatgagccaaaagtcagcggcacagtcgcacagtaacggcaaggactgacgaccctgaaaaaaaaacctcgtagcctcgcaagaaattcagtcgcgtctgcatacaggtcatccatctctctcactctgcctcgccgggaagcagcagcgagcgaagtagtaggcgagagaatccgagcgaggaagaaagcccgagccgaggagcgctttaaagcgggaagaagaaagaaagcgcgcgagtaaagaaaagggaggaggaggaggaaagagagccgtcgttttcgttctcctctgcttcgcctcggccacgctgcggccacctcctttctgccacggcaaaagcctcctcgggatgctccactgatcgtcttctacttactcctctttcttccagcttggccggcgtgtggctgattattccagaatttccattagcttaatcaccggatcaagaagaatgagagaaaggggggagaggctcttttctgtgggatgacagattccgttttgtaggagcagcgcaccatttcagatttcttcctcctcctcttcttctttccgttgtgcttgctgcttttctctactaccttttccactgttgcgaagtcgggttggtgggtggttgattgattgttctttccttcctcgtgagggttcttgcttcttggcttcttggccgcttcttgagttggggctagctggttcttttgctgtctctgtcccgtcaaactgaagcgagcgagagattgaccgggtgggtgattcttcttcgaggagcttcttcttggagctcgtgagagtggagtgatcgaggtggtggtgtgagagcagtagacaggtttttcttggggagcttggaggtagccggagttgggggaggaggaggaggatggccgccgcgccgccgcccaaggccgacgagctgcagccgcacccgcccaaggaacagctcgccagcgtgtccttctgcatcaccagccctccgccatggcgtacgtgcgctctgcttctctacttcacttcagggtttcttaatttttctgatctcgagttctcgattgctgcttaaagtgttctttgtgatttgtcctttcgtgttgttttttgtccatgcttttgtttggttgatgcttgagtttttcatcggtggatacgtgtggtgatcatctgtttatgtgaaagtggaatgttttagtactgaacttttggcctacttttggtttgatgctgatgcttttgcgtataaaattgtgtattagtttgtacgacatgcttttgttcttcttttctctcgttagttctagtattttcttactttgctcagctgaggaaaaggagacttttgattaactagtctataaagattaagttcaccttttaaagttttaatccatcataaaaagggttttgaattgcaaattctttatgcagttgcctagcagtaaactgtgtgtatgttcagttcagagatgtgttcaagtatatatgctattttttttctctgaacttgttatcttatcttatatgcagccgaggccattatattaggattccagcatttcattgttatgctgggcaccactgtcatcataccgagtgcacttgtacctcagatgggaggaggaaatgtgagtcccaaaacttatgtgttacagtacatctcttagttctattcacttgcttgacaattgatttcagtactactgaagatttatcagtgttaatttacacaaaaaaaaattgaacctctacatgctgaatatctgaataattgcttctttatatcaggatgaaaaagctcgggtaattcagacgctgttgtttgttgccggaataaacaccttgttccaaacattcttcgggtctcgtctccccgttgtgatgggtggctcatacactttcgtcgcaccaaccatctcgatcattctggctggacgttacaacaatgaagcagaccctcgtgaggtagtgcccagtggttttggtcttcggattagcggtgtctctgtctatttatgacatttttttttgtgggggggtgaaagctaacatttttctgctgttgttgttgtaaagaaattcttacggaccatgaggggaacacaaggtgctctcatcatcgcgtcgacgattcagatgatacttggtttcagtggtctctggcgcaatgttgttaggttggtatggttttggtctttatttgattgaagctagagctgtgtcgtgtagagttttgatttttgcaattaactgtcctgtattatttttgcaggttgttgagtccattgtctgcggttcctcttatttcacttgttggatttgggctttatgagcttggttttccaggggttagtagttctgctccttctatttttttatgtttttaaatcctgaatataccttcatgtttttttttttggaaaaatggatgcaggtagctaagtgtgtggaaattggtcttccagaactcatcctacttgttgcattttctcaggtattaatgttactttactactctctgcatagtcagagcaatagtaacatattttacatactgatcatgtttgtattcttgatagtatttgcctcaagtgttacattttgggaagcctatctttggccggtttggtgttcttttcaccgtttcgatagtgtggctttacgcgtacattctcacaattagcggtgcttacaagaatgctccaccaaagacacaggtgcattgccgtgttgatcgctcaggccttatttcaggagctccttggtaggattctagaataaccatagtattattccgtgcttttatttcgatggaaatccttacaaggtgttgattttttattgtaggattagagttccttatccctttcagtggggagctccaacttttgatgctggtgaagcctttgcaatgatgatgacttcatttattgctcttgtggaggttggtctgcagtacttaatcaagaatagaaagaaaaggctatgctagcatgcattctaagctatccatttagaagtaataatatgataaaattttgcctgtagacaactggagctttcattgctgcttcaaggtatgcaagcgcaactatgatacctccatcaatcattagtcggggcatcggttggcaggtaagtgaatcaattgtgccttttgtaccatagaatttgtcccatcttcaatttgttacattgattatcctaaaacattatcttcagggaatcagcatcttgattgattctttttttgggacggccaatggaacctcagtttcagtgtaagtatagcgttagtggataattagaaccgtcaatccttgattgctcagatagttcctttttttccctttttctaactgggagtgtgaatttggtattcacagggagaatgttggtttactcgctttgacacatgttggcagcaggagagtagtgcaaatatctgctggtttcatgatcttctttgctatccttggtaattctgctcatgtccttatagctatcttaacatattttttttgttgtgtagaagtcattttctctgccacacttggctaggctaattataaattattttgatgaaccaggaaaatttggagcacttttcgcatccattccattgcctatatttgcgggcatgtactgtattttcttcgcttatgtcggtaggttgagatgcctgaatcaaataaacatcagttccttcatctgataattctcaacatattattccgctgtaatgattcactgttccttccatgcgcaggtgcctgtggtttgagtttccttcagttttgcaacctaaacagcttcaggaccaaattcatcttgggttttgctttcttcatggggatctcagttcctcagtacttcaatgagtacacagctgttgcaggttatggaccagtgcacactggtgccagatgggtatgagaaatactacatcctacagaatcctcctttttttttcttcatagcttgttctttgttctgatcacttgatgataatctttgctctctctttttttttcagttcaatgatatgataaacgtgccgttctcgtcgaagccgtttgtcgcgggtcttgtggcctacttcctcgacaacacgatcgagacgcacaataacacggtgaggaaggatagaggctaccattggtgggacaaattcaggagcttcaagaaagacgcgaggagcgaagaattctactcgttaccgttcaatctgaacaagttcttccctgctgtctgaatgatctagcaaatgtcacccaagcaaaaatggttcatgtctgaacataattctgctggccttcttcagtgttgctgtgcgtcagttttgtgtacttataataggcgaatcttactaattggacaacggagatgtgccttagaatgggaatatcatgtctatttttttgtcctacaatgatttatgtgtcattacctaggtctttctcttatcaagttgtcaatgacccaatgtacatgtggcttttctatcggatagtattagtatcacatttaacaatatgacctgatgctgatctgcaatttagtgagtaaaatactgaagctgtcaatgcacatgtggcttcctcagtacagatataggagtaataatcatcagcaatctggcctgatgttcttctgcccttttttgggttaagtaaatagtgaagcgttttatgctattcctactcctgttacttgtagacagctccatcgttggcttatagccgtagccaaaatttaaacttagctaaattttaatttttaatactcaattttagagttaattttgagggttttttcaccataagattataagtttttttaccgtagtttatttccaacattagcttttaaatcactataagcacgtatataaaagttttactcataaattatttatttttagttactcaattcagttttgcacggcttatcagttccatctgaattgttaatttgcaccttgcattgctccatgtgcttggcaatgtttgttctgtattctggttattaatcaactgttaaagaagccatctggaattcggggatgggcctacagattggaattcataagagcccattgggcctatgccttgcagtctccttcgagtttttttttttaatccagtctcctttgagttgttggcttgttgcatgagacttgacatgctttaagctctagcacattggaccgagtcgtaatttacagcgtagaagttacgatgttttggtggaattttacaaagtatccatttcaaatattgccacctcagaattcaccagtcaggaatttcacatgactctcataggatttagttcaaattatatgaaaatcctccaaaaatcttccatttcagaggatgccaaattcatagtagcaagttgacagcagcgaatcctacagagcacacctatccagtgataaaatggcagcacaggtgtctccaacagaaagatcatgtgactgatttgaaatgtcatttgattggcacacttcaaatcttgcatggatctcatcacacaaccgaattgcagtttcaatgacgaagagacttgataccaattactacctagtattcttggcatgccaacttccatctgctagggctttgtgtggctggcaattgaaatctggcccccaaaaatgggagagatgatggcatcagagcccccaaaatctgcatggagttgaggcccatcctcagtgctgatgacaacaccttctatcatcatagggaaaatcctcaacaaccatgatgccatatgatatgatacagctcctgaaatagaggaacaagatcagagatttgattacgggtacaaagcccatgatacaaaaatgtcacaatagttgcagatcgatggcatttgatgattttgcatctgcagtggtcatggttatacacaggtccaatcatgaatcatcatcatacaagaagacccaatagaattatccgcatcaaattgcattgtgcgaatagcgcaaatatagcaaccggcagaaatgttttttttttagccgggcctaggcggaccaaatttacttaagaaaggggtatgtacatatttacaaggttccaacttcgacaagaggctgtcgaagtaaaaggatgttgtcacaagggcaacttcccgaaagaaaaaacaattacatcatgctgttgttactctcctaaaactttgaaaaccccggcttctttccagaccataacctcctctttaatcaaagcaaagaggctacccgctgtccggctctgactctggaaaacacgtgcgtttctctccttccaaaccatccaacagacaagcaaaactagcatgtcaaaagcgcccctgcagctggtctgaactccttgccgcgccaagagccaccattcccctagttccaaccctgcttcagccggcagttggatgccaattccagcccaacccttgatcatcctccatactctggtgatgtatgggcaggaaacaaagagatgctcacagtcctcgtcgctgctggtgcatagtgagcatgtttgatggtgtggccatccgcgcttgctcaggttgtcggccgttaggcaacggcatttttctgccaaccacataaagaacttaacctttgtcggtgctctcgtgtgccaaactagattgccacaacgcgcctctgtgtttgccataaaaacatgtcataggcagaggaaggggtaaatcttccattcgaggcccacttccatattgtctcatcctcttcccctcctcgcagctgcacctcctggatcgcatcccaaatttgaaagtactccccaatgccccggttggatggagctcctttgatgtcgcgcacccacctatggttctgtagtcctctcgccactgtcaaacccttgcgctccacatgactgaagattaacggaaatctcgcctttatgctcccaattggcagccaatccgcaagccaaaactttgtgttttccccatctcccaacacttgccgtgtggctgagaagaacaggtcatgtaactccttcggctgcttagtctcaacggttgtccaaggtctgtcgcgatgctctcctctctttgccaaccatttaagccgtaacgccatgccgaagaagtttaggtttttgatcgccaaaccgcccttttcatatggcatacagaccgatttccatgccactaaacaatgcctgccactcacctcctcctgtcccttccacagaaatccccgacacttcctatcaatctccttgattgcagactgcggtaattcgagcaccgacaagtaatgaacaggcagagcgaaaagaactgacttgatcaaggtcagacggtctccagtggataggaacttaggcttccaaccggcgaacttcttagagaaccgatccaacaaaggctgaacatcttgcttcgtgagcttccggagtgaaagcggcaggcccagataagtgattgggaacggctccaatctacaacacagaattgactgcaccaaaattgcctgatcctctaagcatcggattgttgtgattgcactcttcgcaaaattcgccttcaaaccagttgcctccccaaagagttgaaggatcgctttcactgcccacgtatcttgctgcatcggccggaaaaagaggaccgcatcatcagcatacaaagaaatcgctggtggccacagcctgcctcccatcccgcacatggcgccagctgagattgccttgtttaccaaggcctgccagacgtccatcaccaacacaaagaggagtggcgacagcggatctccttggcgcaaccctctcatcaaactgaacgggtcacattcctccccattcatccccacagtcgtccgtgtcgtgcatagcagcgaacaaaccccgcgtcaccagcgcataccaaaccctctgtgttgaagcagctgcagcagaaagggccaagagaccgagtcaaaagctcttgagatgtccaacttaagaaggaccatcggctggtgttccgtgtgaaaacgacgagccatgcctctgacaaacatgaaattctcatggatcgagcgtccccttatgaaggccgactgcgtgtacggaatcaggtcccccattctgcccgccagccttgttgccatcaacttggtcgccaagtttgagaaactgtggatcagacttattggtcggtaatccttcaagagcgccggcgcttctttcttcggaagaaggatgatcacagccgaattcaatctctcaaggttttgcgaattgccggagaagaatttctggagggctgctaagacatcacacttgattgtatcccagcaagcttgatagaaaagccctgtgaaaccgtccgggccaggagctttttcagccggcatgtctctaattgtcttccaaatttcctcctccccgaagtcctccactagctctgctaggttcagctgctccaagcctaaattctgaaaattgagccccctcctactagcatcagactcagtcgtgcccatcaccccttggaaatatccccttgtcatctgaagcatatcctgctgggttgaagcccgctcggcagaaatgttgggagccataaaatggtatatgatggaatggaactgaaaatggattacacatctagtacttaaaataggtactcaccttttctttttaatcaaattcatcttccaaagtattgaagtattagaaactattaagagtggcgggctgggcggccgctcggcgtgtccacgtcggatagctacagtgcaggggtggcgattttgcgaaaaaaccctcctctttgtgcgtaattcgatcgaggttcctaacaaacagtatccatgaggtgttactttacgtgaaggtccttcagaaatacggatattccatgcgaaggagagaaaaatcgtgatttaggaccgtgctctaaaaagtgaaaaacgaggggcttttttgcaaaactacgcgcactaatccactccccctcccacaaaccctagccgccgccgccagtcccctcctccctctcgttcattgctcagtatgtatcatcgagaatggtcagttgtattgtcaggttaatgacgtgatagtatttgtagcactgacattacctactgttttcctgttgtattgagtggttttggcaatgtttgcaggtacggattcccaataaactgatgttgggtgatctaataactgaaggcaaaatgaagtaatataatcgcatcaatttgtaatgttgtggggagttgattttgtttttgtttttctgtactgatgaggtgtaggctagcagcgcccgccaaccggcactgaggtaaggagttccacaaccacagcactcagatgcaaataatgggcatgcctctgtctaagctactaagcagagaagcacactgcaaataagagctgagtgagctgggagctgccaatctctgttttctctttttcttggattgcaatttttgattttagattggatatttgagagaatgcataggaaagggaaaggaaaagggaaagggatgcctttacattgtacttatctttccttacgttacctatctcagatgtggtcatagtaatatacttttttctttgtgccacttatctttcctttctatgctccactgatatatcagctggtccatgtgccatttggtgattgctgcttacatagttatttttatttatctccgtacgctatgtgatgttatattcccttctcgatatatgttcagccattcaatcagttttgattagttaatgttcatgcatcagatttgttaatacaaaatgttctctgatctggtattcagcttggctaccagtacatgttacaagttcaatcttccacaagcaattgagaaaggttgcaggtgagaggcaagcagaagcatgacaggaatattgatttacttacatgataaccgttgtgccattaggtactaatactaacactattattttaaatcatgccccttctatagcttgcttctttggctgcatgtactatagctgattctttgctgttatatgatattttgaacttcctacagatgttgtatatgctatttaattttcatttttgttttcatgctctgcagtttcatctgcatgtaacctaaataatttcacggtgctcaactggatcactgtgggtgtagtttcattgctcatttcccatgtgaatattaatttattggcaatcctaattgtagctgccatttgatctcctttgtgatgttttacctgtccaaatttttatcccaacgggcatccttgaggtatatctgtgtttatgttataggtgcgcgctgatgcttggttctgcttcatttaatggcttagcttgattaacctgaaaatgtgaattgtgctctaggggtttttataccatataatgtaatctcttatctttttcagccttggacaatcggaggtcattgagattaaactctgcttgcttcgcatcctccagtaagtgtaagacttaaaaaaaatccatgggtattttttcacttcccagtcgtaacatacatgtcataatgttaagcactaattgatttagttataaactatgtttgagattacactagcaggtcccattaatcaatggaaaatattcttttttttcgcacatagacaagttatatttccaagtaaatttcttcattc

SEQ ID NO: 43387 - DNA, 4516 bp, Oryza sativa
ttacttctagccgctgtattatgttttcagtttggccataacataatcgaggtttcagttaatatgtaatttgtggtgtattacttgctacctacagtcccattaaattgatgttttcttaccgcctatgctcagactacaatcactggcagtccaagcagcctgcttcttgcctcttttaataagattacacatatatacatggattaattgtgtgattcttctcaaaatgcacttgaaatctgaaggtgtattctacatagtttgtgtatatggatttattcactaattcttctgcaagcagacaatcttggtttgcagccccaagtaaagggcaagtgtacgaatttagccacaaaagcgacgccaacgaggatcgccatcgacggtgaccgctgctccatcgatccttcttcccccgtttgctactctcacttcacaggttcaaataccatccccgcgagatctcatctccaaaccacatgcctttactattaccacactatttcgctctctttctattcttttcattccccattttctctataccgaatatatgtttttagatcatcgagcgtcacacccttcctcgagtcaatcaaactatcatagatctaccattaaccctaagtactgttgacagccctaatcagtgattatgcttaagtgatctaacctacaaaccctctttgatattagctgacccaaaaaatcctttctataaccattttattataggggtagactatttgattgtatcatttaactatgtagatttggcatcctaaatatacacctattctattacatattctctcactcatccttatttcagttcagatataaatgttatactttttggcttgcccattattgaaacatgtatactcgtactttagcccctttcaattccttatattttatatttgtgtcatgacttgctaatatcggattcagttcctaatatttctaatataaaaatttccctttttccatacattagaacaataccattacacgaaagtacaataaataattaatactctttcacataaatcctttaactactatactgaaaaaaaaatacttacatcaactgtaaattattaagctttttcacggctatttagtcctattcctgcatcataattatcttatatcttatcgtagtatagccacttaacccagcacattatcttcttaccatatatatctttccagctacaactaagatttacaccacataaatacttacatacatcaagttatagatcatatacttcattgcatttctacatatcccaaaatactcaccctgtttaaaaataaaaaaattataataaaaactctaataactagctgagcctctcataactttttttatttatcaaatacatctaactacatgtgtatatatattgtagccacaatcatgtcttccgcagtgttcgcatcaatgaggctgaatgcaacaaatcaaagctacttggtaagctcaaagtcaaacaaaactttctatggacaatatgctgttagcaccagtgcggatatgatattttctttctacagcctgtgccaatcacacttgcgacagcatataagatgcagcatggagataatctgaagttaaaaacttcccatggcttgaagataaagatcaaaatcaaggaagtagctagcacactgtacatgacgacaggatggagataatctgaagttagaaactggagaaacgattcttttcaggatgccatcaaggtctaaagcgtgtgttatgatactgaacagacaaggccttattagatgtccagtgaagaccccatccaacagctcatcagctaacaaaaggtcccctgatccatcaggtcaattaaccagagcaagcacatttgaccatgcatcttctagcaaaagcgttccatttctgaggaatggaacaggtacaaagcttgcctcatcacattttttcaacttacactacccattaacatgtctattctgttttcgccgggtaatagaagatatacaattaaatcagccagatactcctccaacttacattggctaaaaacactgctatattgcctcctgcaaaattgcacatgctggacaagtgatttaaatctttctatctatgtttctattcatatgtaatcattttctgtgtcattttttactagcaggcagtaacaaaagaaaacctagcagacacctccttctgccaccagattaagctcacagctgaattgaagagttacatcaaagagattgcagattgtctagaagaatcaaacaagttctatgtcgtgcgtatgaacagaacattcatggaacaggacagagtggtaatttttgacacaacatttccatcttcttatacccatactgagcatataaatgtcacttttctttttcagtactttgcgactgagttttcaaagaaatacattgtgaacttggttcgaggcaagacagcaaacattagagtgcagattgcaggtcgaccctcaacaacttaacatcagggtggttagctttgcagcagccaacagcatcaacttacacaatctgcatcttccacttttataggacacaagtcacctcatgctcaccatagatgctctgtgaaagttacctgcatcttcagtagtcgctgctattatctaccctggaacagctactataattctctctattatcctttgcttgcggtctatctaacttcacttgctcagtaagcacgtgacctataactgcttatcattgtcctcagctccttttgttattcataagctgagtgaacaattaaccactttatgtacaaacagctggcttgttatactacaggttactatggtactatttgttgtttctttttaccatatgctttttagcttttcttagttaagagaacgtgtgcatcgcatctttccatcgacctgtctacaggcggcgcgccattggcgcgccccagcctctagttcacatagttgtacgcgcgcagcatgcattttatttaggcacggtccacaattcatacatgtatagtggatacgtctcgtcggcagacactcacggtatagtagggtagtcgtgtgtacagtgatatagtcatatctgcgcgtcttttcatgccgttcgttgacttcgttcacagggtcagggtcgggtaggcgatatcgagtgtgacgccacacaggccggggccaccgacgtcgcggagaatccggatgtagccgcgctcgccccatgactggccccatgagttcttgatggtccagtacttggcgccggaagacgcgtcggtgccgtacccgacgacggtgacggcgtgcgctaggcgcgtgccgcacgggcccgtgtaaacgccacccttgtagaactgcatcccgctaccgacctcgatggccacagccacgggctgccgagcgacggcggcctgcaacgccgcctcgttccgcggcggcaccttcccgaagccggtgatcttggcggcatggtgcgcggacttggcgcggttgcaggggccccgccgcgccgtgtacgggtagtccgcctccgtggtgaggccaccgttctcgacaacccatttgtacgcccgcccgtacgaccctaagttgcagccgccgtcatagctgtcgcagtccaccagctgctgctccgacagagagaccagcttccccgtcttgatcatgttcaggctctcgatggtcgccgctgtcacgaacgcccagcagctacctgcaggcgtacgtaacgtaggtccaatgcaattaataattaataattaaggtatattttacgtttgaaatggaaccatgtgtgaaatttacacgtactgcatgttgacgtttgggacttgggaggcacaacggcgccttgggccctccagtcgacactggccggaacgtccacgcggtaggagaagctggcgtcgacgtctccggcacccgtcgtgataacggagtcgtccacggggccatcgccggcgtagtacccggtgtacgtggccaggaactcctcctcggtgaggtctgcgaactcgttctcggcgagctggtaagtgaggtcgccgcgcaggttgacggcgtcgatgaactccgcgttgcggcggtacacatcgaaccgctgcagcgcctcttctgcgctcgggtacgaccggttgtgagctccctgccaagcgcggaacctgtccatcatcaccatgtcgccgacgtccaagcaactgcccgccgtcgcacgcgccgggagcatggaggtggcgagaagggcaccgcacgacgcgagcagggccagcgtgagtaccggtggcgaggcgcacgccatgaatggtgccatggcatgcacctaacttgtgggtaagtacgcgttccaccgttcaatattccacttctggtcgactatgcatgcttagctctacttacttatatggtgtgtcggggtgctgggctggaggtgtcaacgtcgaaaagatgcgctgatggatgtaatttggctagcgacaagtgcacacaaa

SEQ ID NO: 43388 - DNA, 3240 bp, Oryza sativa
catggcccgatggacgcccaaaagatgttcaacctcaacacccacctacgagaggaggcccacaaacccacattggattggctgactacctagtaagatgtaacaggttaaccgtttagcttataactggtaaaccataaagcagtttattagcaacaaaaaataataattaatgaacaaaacacttatatatatatatatatatattcttagcgatttaaaagctaatgttgaaaaataaactataataaaaaaaaaactcatcaaatataaaagttttaaaatttaaatttttgttgcgcctcataagtgccgttgtattcttactaatcaatcgagttcgatttgattttacaggttctatagggtgcctacgtgactttttatgttaaaaaaagttctccaaaagtgactggccggtcaaactctgatgaactccaagaacagacttgatatgttccagggcccacatgtcatgcacggctagaaaatgacagcagctgaagacaagaaaaacaagaactagtgtctgatgacaggcgcctcctccttttcatttgcctcctgaaacgattcctcagagcccatcattcctacgcatgaacagttgagaaagagagcttcaaaagccatcttgcttgcaaagttgcagtgcatttgtaacctagtagaaagcaactaagctatctagacatgttggctcattgtccatccaatctggagcacacaaaagaagaggttgtaatctctccaatcacaaaaacattttgtcttggacattgacgcggtcagtgacatacaaatttgataattaatttctattatagaatatatgaagatctgataaaattacaaattatagaagtattttgaaacaaacgtatacatatgatttccacacatccgatctaaacaactaaaatatataaatgttcaaagtttttctgtgaccagagagtggttagcatgacacctcacaatacaacttaagcttttctgtttttttttccattttttttttgctcagagattacttgacacatgaaaggggacagagttggaggcttggagcaacaactactcatggttttcttaggccatctccctttcttttcctctctggctttctcaatgatgcattcttgcttgctccaaacacttatccaggcatgaagccatgcatgcttgctttccaaccttttttttttctctgctcaatgctatgctgtgtctgtggcttgctccccatgattgcccctcaagagggccatcagtgagagacaactgcaattaggcaggatctatgtcgtctaatgagacaaaggcccaaccaaagccacacaagctaataaggctgaattaatatgtccattagggctgcagcttcctgcaagcttctacatatgtttcttgttccaaacaagagtgcttgtgcttggagccaagaaagggttagtgtagttaaattggattttgtgtctacggtgcacaagtaggacaagtgtaaccgtgtcaagttaagtgaataaataatagtgtaatcaagttggaagtatatatatctcccttaattgccttggcctgcaagacgtgttcagacattctttgcatgctctgtatgaaatgtgattttgccgtctagtgaatgtcaggtccagctagctaggtcacataatcatattaataggatctacaactcaagataatctacttgattgtcttcttcagccatctcttgaccatgatatcactttcaccagcttcaagactcttcctctctttttttttcttcttctatggcaacattgagagcctgtttcgaacgcagaattgtcacagaaatttctgaagctcaaaatgtttaaatgttgatttcattttagaggtctcgtcagcgtcttaaataacagcatggccttccaatatctgataggcctgtcctgtgactataaagaatcttggaactagaccgggcaactacaggcaaaacatgccaaatttatggccaacatagacaatacttgtaccacactgttccagctcttcaatataaggagccttcttgtcaaaaaatatatatatttggataagcaaaagagggagaagaaaaagaaaattaattaagcagcaggtgtgatggaaccagcttgtctctagccattaaataaggtgagctcatgcacatcatacaaaacaaaacattgcttgtgtcatcctaactaacacccaaacagtgtctctgcatatcgtgtgtaattgcaagatatagggcaaatggcaggattaggtatgtgttctgtcactagccaagtgtagatgccatgttaggattagctttcagggggacacagaaacatataaactttcactgaagcaatcctgtaagctgccggacatacatattgcatttgatacctacgttgccaataagcattgggaagtttggggaggaatttgatgtctggcacgtacaatttgaaaacactggaatcaatttaacaaaacatgttgtttggatactccatatataggaattattgcttaaattttagagggaaaaaactattatctccatcccaaattatagtaacatctggctatgtatctagacagtctaaaatatagtactccatatgtcctaatataagagattttggagggatgtgatacattttggtactacgaatctggacatgctccaaaatactttacaaaagtttctcaattttccacttaagttatggtttccacgtacatttctccatataaatgagaaattcttatcgggttcgaatcctacggaaatactttataaacagaattgctaaataacatttgatagaaatttagagccaaaatgttacatatttatgacattatattcttcgcgattcatgctaggcctccttctcctctaactccggtaaccctgacgaattccaatgaccggtagtagcccaatgatatgatttagagtttaaggttgaggtaggattagggtagcaagagggaagacggaagaggggctgttatctaggcttagagtgatatttatgggaggtggggcgcatcaatggtggtcagcgaaacgggtaggcggtggcggcagtgtcgaagtcgtgggggtcagtgagtagtgggctagtattggtactggaggcaaaacacaacaagtggttaggagggagtggtgtctccagcgacggagaaccaccaaagaatagaaagacagtaggttag

SEQ ID NO: 43389 - DNA, 15019 bp, Oryza sativa
  unsure (1)..(15019): unsure at all n locations
caccaaccgggactaaagatcactactttagtcccgaactaaagatctttagtaccaaccgggactaaaattcaacgcatagtatataatccctatcacttatcctctcctccataatcacagctcacacagctcaccggggctggtggccgccggctgtggtgggcggcggcgggccgggggcatgaggtcggcggtcggcggggccgcgcccgacggcggcaggccggagaccggcggggccgcaggtggtgggagtggcgttttctgtcttttttttgataatttttgattcactgagatgtataattttgtgattcattgtatcatatggatatgagatgtctaatttgtgatgtatttgatttgtgtgtatttttttaggatttatgatgtatttgatttgtgtgtataagtaactttaagatttatgatgtggatttgggatgttactttgatttggggatttggggtttgatttggggatatgcatgccacttgattcgagagaaaataaaaagaaaaaagaaagaaaaagggaccatttgggactgccgttattctctctttactcccggttggtaataccagccgggacgaaagatccctctcttagtcccggttgttgttaccaaccaggactaaagatgtcctggttatttcaactggaactagatttatactccggttaaaaacccgggactaaaggggttatcaaccgggagtaaaaatggtttctccaccaatgagggtgcattagtgtgttggggaagtagcggtgaagtaggcaggatcgaggtgtcgagctacgacgaagggaagaaaaagaggagtaagttaggttttaggtatttgcacgaatcttgaagtgatctaacagttcaaaattcgtaggatattagagaggtgcattgcgcattaccttaaataaaaatcggttgttcccagttaggagccctaataaacgggacctttgatcatgcaccataaaggctcctatacggcggaaatgctgttgggcgatcgatcgccctggggatggggtagcgataacctcccccctctctcactccacctagtttccttttttggtatcgtattactttcctattttagtaaatttatacacctcaagtttacacatctaaagtttagagaccaaaagtttacaagtcaaaagtttatatatccgattcaaatttgaatttgaattcaaatattttttctatatagtatttctatacatctaaagtttatacacctaaagtttatagacttaaagtttataagtccaaagtttatgtacccgtttcaaatttgaatttgaattatatccgattcaaatttgaatttgaattcaaatacttttttatatatagtatttctatacatctaaagtttatacacctaaagtttataagtcaaaagtttatatatctgattcaaatttgaatttgaattatataccattcaaatttaaatttgaattcaaatattttctatatatagtatttctatacatctaaagtttatacacctaaagtttatagacccaaagtttgtaagtcaaaagtttacatacccgattcaaatttgaatttgaattcaaattttttatatatagtatttttttacataaatttttctaacttttttttttaaaaaaaaatttgtggtttattgtagtggggaagagaagaagggagagtagagggacgtacgtatagagggagcgggcccagcgatcaccagcacattagcagtcccccttatacggtcctaccacttaatcatgtacgagccacacaacacaggaacacagcagagattagaggccaaggaagcatcggagcgaggtgatcattgacgcgcaattaaacaagcgtagaaaaccgggacgtttgggcggccgccacgcgggtttcgtccacaaatcgaagccgcacgcacgcacgtccgtccgtccaccccggatggatggatcgatggccctcgtgacctgcgttctctattcgttgcgtgcgacgccgggcacgaacgatccacgcacgggaggaactttgactccagatcggccgccctgccggcgaactggtttcgatcggagggagagagtgagcaaatccgagcacgcgactgtaagacccgctatatactgatattaacgaagttatcctaaacggcccgctgtcgataggatcatcatatataccatatcgagagtgcaacataaatcataaatacggggacttgtgctaaattttgaaacttgaaaccggatgagttggttaaaaaaaaaactaatcaattaggctacaccttacttcgcacgtacactacgttgtacttgctttcatatatatatacgtgaccaagcacccgtccaaggtattttcataatttatttgtatttgtacgatcgtcagaggaaatggaggtattggttgatggtttctattttgtctcgactttttatgggatgttgcaatgtacgtgttagatgagtcgcacgatataagtgtaaagtcatatgcacatatgaccttacaccgcagcgaccattgagccgcacaaccactgtagccatagccatcactacatctgagcatattcatagtcatattgaaatttaaatcttcagtgataataattattcacgcatgcatggataccttctaatggaattcatgggttcattccctgaatttatttctgaactcgttagtgtgcaataatttaagcatatagggtgttttcttcacaatagaaaaagtacagactgggctgatggtcctaaggttgagtactgtgctggaacatggaccatatcgccctatccccttcaggtaggatcatataatcttatcatctaaatgatttttttttgtctttagcaaatgtatggtcattttagctatagtacttatatcagtagtgtgtcactgttatatatcaatcatctagaaccatgggataacaattaaaattttccccagctggctaagctataatacgtgttccatcttccaaaactatgaataatttttaccatgatctctgatagcaatcatgcataatattatgcttgccgacttaccctagatcttgtgaaacctgatttattgagtatactatatcgagtagattaataggttaattaataatcgcattcactgtttggcttgtttagttgacttggttgctcataagtcctaaccctgcatacacacgattgctaaataccaaaatcatgtgacacgagtcattttcttggcttatcgtgtactctctttgtttaatttcctttcagtcctttctctcttctctctgaattttgtgagaaaaacctgtgtgcatgatggcaatggaaaaggtacgaaagaaacagactttattccacaagacttcacgagttgtaatacgtaggttgatgtcaattcattccagttgaattttttgccacttgtttcgagagaaaatcagctgatttggctcatgggattaggccaactaattaagcacgaatataagcatattggctttcgcaaagcctccactacttcattacaatatttttgtgcacgccaattaatttgtagtcaactgtatatgtagaaaaaaaatgctaatggaaacccatttatcagagaaatataataataaagctaataaaattttatgaaaaaaaattagtctatgtcatgtcgtcgtatgccgtttggtagcaagtccttgtagtatacgtacatacgtgtcgatggaaatgctaatttgacaataataacaactaaatgaatgccagtattatacatgacgaatatggaccattattcctcgctaatgcagccaatctcgggccggacaaaacatatatgcatattgtcaaataaaaaacatagcacaagtacatggaaattaaataaacacattaataaattttaataccacaaaaataacaactaggcaaatagatggttttaccagcacgactctatgttagaccgtggttcgatccccactagcagctactacatgttagattagatttattttgtgacttttttcgtgtactagtttgagcccgtgaaccttttggtatagccacttgtgttaacaaagtgtgcaaccctgcatatatataatgcgatagaaaaatgctgcaggtgtgagagctaaaattgcaaatggcctgaaacaaagaaagctgttgacctcccagctttggttggaaccctaaaatgtaaacattttttttgggccatggcatgatctgctcgatctttgtgttagcttataaaatggggcaaagtagggaaagcaagagaggcactaggagttgattacttttgatgtatccatcttgtcagatagattatggttaaccagggctttggtattaaagatttgcagattcgcatcgtagtttaatcaaaccaaggcgcctgtagatcatcaagtggtgcactaagcaacaaatgctcctttgggtcatgtgtatacatgagggctattattactttcgaaatgctccatgttagtgacattatgaaatatggcgcgcatgagacattgagccccattgttccaattaattacaagtaaaaaaaactgatattactttgcttggcttgctgagattttcttttggaaggatctaggatagagctgcaataattcaaagttaaagctcatgtgtttgaaacaaatgtatcatgaaaagacaatttatcaaaccttgggaaacatatatcaagaggaacccgatacttttcaattcacatgcttgttatggaatctatgtgacttctatttgatatttcacctaaacatcgttgcgagaaatgtatattcatctcataacctcgagtatttttatttgtcttttagaactcattggtcgtgtgaactgatttttttttcaaaggcagctgggggtgtgaacaatttcattataaaaaatcacaaataaattgtgaatcgaattcttttagacttccactgctcttctactcactctgataatactttgacaaaaatgaaggcctggtttagaaaacaaaaaaaaataaattaaaacactcattcgtacgctacatgaatcatactattaaattcttatacagtcaattcctaccctccgaaaaaaaataagtatagttgcaatgttatctacaaatgacaaacaactatattaagcagggatcttgcaatgctaccaaacacatgttttgctacaacttcaatttgtttttacttaggctgtgtttaaatctaaagtttgggtccaaacttcagtcattttccatcacatcaacctgtcatacacacacaacttttcagtcacatcatttccaattttaaccaaaatctaaactttacactaaactaaacacagccttacatttctaaaaaaaaccccaccaaatttatttgaacaaagcgtgtggagatggacatggctgtgcactgtaacttgagtgccaaccgctgcatttgcagcaagtcgtttcttatacgcatcaacagaagagtatacctggtgtgtcctctggttcctagactcgcaagtggtgtcctgcacaacgtcgcactcatgatttggctactccctccatcccaaaatatttgacaccgttgatttttttaaaaatatttgaccattcgtcttattcaaaaaatttaagtaattattaattcttttcctatcatttgatttattgttaaatatacttttatgtatacatatagttttacacatttcacaaaagttttttaataagacaaacggtcaaacatgtttaaaaaagtcaacggcgtcaaacatttagggaaggagggagtacaaaccaaaccaatatactactagtacaagccctattcttcttcttgcatagtgagtgacattggcaggtggggtccctgttgctgttcaagtgtaccaccattcacagtgcaggtacgtggctttagcttcgttgggacacgtaggagaaaatctggcgtgtttgtgcgagccggaacgcccttcaggaggatgcgcacggcccacctgcgtttgaggtcagacgacacgagacacgcatcccgcattggcgggtcatcccctctccacttcgtcatctcgcctcgcacgcgctccctcgtcccaaaattgctttggctcagcctgcactatgtgagttgtggcttggcacctagagaaactcaatagtgttgcttgcactgctattgcctttatgtgtgttgtggtagtattctggaggggggcatatgcttttcatgcaatgctgaaaagtttttggaggttaattgctgataagtcctattggagaagatactaacacattggacatctccaaagaatattcaggaagcagccggtgaaatgtggtcaatgtaccttcaatactctttaacaacttccaccacactttgtaggctcctccagttagcatacaccctggactcaaaatttttagccctattttagttgcaaaactatccttttaccattatgaagttgtggatgtatatatataccttcgtaaatagggttcaaattataatatccataattaaataacatatatatacacacacacattacggttgatatagaggtcggaagaaacttctgttacgtagaaaacaatatggcttgtgaggatcggcggagggtaggatgtcgccgcccgctgccgcagccgtggcccgcgagacgggaagaggaggagagggcaggggggctgctgctgccgccacccaccgccgccgccgcggcccgcaagaggggaaggggaggaggccaggagagccgctgccactgccgacgccagccgctcgccaccgcggcccgcgagaggggaaggggaggagggcaggggggccgctgccactgccgacgcccgccgccgccactgcgggacaccggctgctaccgccgcggcccgcgatagggaaaggggaggaggggatcagaggagagggaggaggagtggaggaggagggtgtgaggagatagagataagggagatagagtgtgggaggcgtgcggcagcggtttccgaggagataacggtgagtgggaggtgagcggcagcgttttttttttaaattttggtcctgatttgttacacttacacttagatctttagtctcggttggtattacaaaccaggaatcccctcccccgccccccgcgacaatctttagtcccattggagttttaaaccaaactaaaaaaatatttttaatgtggttttcggccgacccagtaaagatcagttctatcataatggtactcggaccaaatgccctccaaagaagggaaaacaaaaccgaaatgaactgatgccgtgttagttccaaagttattcttttaaactttcaactttttcatcacatcaaaactttcttatacacaaacttctaatttttctatcacattgttccaatttcaatcaaacttctaattttaatacgaactaaacatagcctgaattgaaagaaagcgagaaaggaactgacggcatggcaatgatgcgacgatgcaaatgtttgatcacgatgcaccaaagatcttcctccggccggattcacggcctacgcatgccgtacgcatgaggtggtcagcagcgcagaagtgcagagttcatggcaaaaccaaaggcaacttctgctagctctcccataacgtgggggccacatgcattcggtccctggcaggtgggccctatgatgccacgtacatcaccacgtctaagttccaaagtagtacgtgtagtgtagttcaccctgagatgcaggatatacagggccataaatgccatggccataccatagttttcggaatatggtgtggcgaactgacgatcacacgcgagagacacatgtttttttttctttaagccgacgcattttgtacgttttgtcgagagatttgggatccaacgtcaaacgacatatttacattacaaataaaaaataatttatgaataaaacttttatgtacgtattcttagcaacctagaagcaaaggctgaaaaataaacttcgatgaaaaaaatcttaaaattagcttcaaatttaaagttgaaaatttaaattttgactgagcataagcatgaagcatcttcatggatcgtaggttcaatgtgaaatataaatgaattttcttgagttatagaattttctgagactatatgaacctatattaaaaaagcaaatattaggaaatgacctaatatcaaataattagaaggtatgagacttcggcgtgaatattaggaaataatctaatatcaaaaaattagaagggatgaaattttaaaccaaggttgtctaacccaccacttatgtagctagccggaagacccctggatgtttcttgaacctatatttatccaatgaaacaatgtctacaccctcttacagaaggtattgcaaagaaaactagagtttcatttgttacatgatatcttgcgatccgccgccaatgaatttttttttgtgtgtgtgtgtgtcccctatgaaacaaagtatttttgttgtctgattcacctaagattttgcactccagcttacatagagatcatttctgcgatttcgaagaacaaaacaaagtgggaatgaaaagaggaggaaagccggctagcatgtcggaaaaaggtaacccaaaaaaaataagggagaaaataagaagcagataagcaccaagtttctcagtgcatagatgatgttcagataaaaataaatataataataaaatggagaatagaagtgcgtcatgcccatgacatctccagccgttgcaatctggggtttcaacgctacaagtgcactgtcacattggcacaatgtttgcttatcttatcctccttttctatatttttgttgaagacctgatatacggcttattatgacatgctaacaaaatgaatgagtcaggataactctgtttacatactggtccaaaattattaaaaatcaactagataatctataaaacctaaaagagcttcttaatgaagaagtgaccatatataggaatagtcaacgacccttcattcttccctgtccctggtctctatgactctacctatccatttaggcctccttttaaataattcatatgaaaatattgtaaacctaattcatatgaaaattttatgaaaattgaactaattcatatgaaaatattgtcaaattcatgcattccaacgggtcctttagcaataaaataagctataaatatcgacatattatacatatgaacctacaagaggatacaaccttattatacctatattataaacctattacttgcctacttggtaaggtaataaaaccatcacactagtcgtatgatatgactttaccctgcagtaacttatataacttgtgtcactctctgttacgctaagcaagtgctcgagtgtgattgtctcctgttaaacacctaaattgtaattgataaatataaatttactttaggcatgtttgataggactatagcttcggcttcacttctcctatagcttaaatctaaccaaatagcttcaacttcagctaaataagagtggagtggactaaagtgatatgcaaaaaataaactaaagaaatgaagcagggttcgagccactccataactcaactccagacttcactcttagagttatatttagaagttagagcccggtaacagaggcggatctacagtactagggccggtgtcaggcaacaccggcggctttcgacaaaacctatagcaaaactgtttatccatatgttataatatcatgatttaaacataattagcgtactatgacaccgatatacatgttatgacaccaacgaatcgattttctggatccaccactgcccgctaaacacacattttaccgataacggatcttaattgataataaacacactttttaccggtaacggatcttaattggatgattaacccggatccaaaacaaagcccaatccaaaactaaaatctccactaaaatatgagagcccccccccccccttcccccacattacccccgctccttcaccgcatttaacaccaccacctcaaaacggcaactgcatgacctccaccacctccacctcctcctcttcactcccaagaactcgcaatcgccaccgccgccgcggcggcgcagcttgataccggcggcgcgagaggaaggcggaggagggagagagaaatgggcaactgccaggcggcggaggcggcggcggtcgtcatccagcaccccggcgggaaggtggagcggctctactggcccaccaccgccgccgacgtcatgcgggccaaccccggccactacgtcgccctcgtcatcctccgcatctccgccgacaaggccgcctccgccgccgccgcgggggacaacaagaccaacgccggtggagccaccggcggcggcggaggcggcgccaagatcaccagggtcaagctcctcaagcccaaggacacgctcctcctcggccaggtctaccgcctcatcacctcccaaggtcagcacccatccgttcttgcgcttcgattcgccattctcgttgacgcggcaacctgaaatccgcgcgtggtggatgcgcagaggtgacgaaggcgctgcgggcgaggaagaacgagaagatgcggcggtgcgaggccatcaggcagcagcacgagcagctccggcgaggcgacccgctcgctggcgtagccgaggaggaggaggaggaggagagcgcctccgacgatcaggtcactgtccctgcattttttttcctcatgtcaagactgaattctccgccttgcaagaaagctaacgcctcgagatgttctcgccgccgcgcaggacgggaagagggaccggcaccggagctccggcgccggcgcgccgccggccgccggcggcagaggccggcactggcggccgtcgctgcagagcatctccgaggccgcgagccagagcggcggcggcggcggcggcagcagcatctctgaatccgccgcaagatgattcccctgtttggtgctgtattgtctggttttcttttctttttttttctttcttcttcttttcttttttttcttttctctcttagtataaagtgcttggaagttggaactacctccaaaagaaagcagaaaaaattgtaaatcagagtaatcagagcaggatcaataggaaggaaagcttgtttcatctctcatgtaatttgcatggtgaaaaactgaaacttcagtgtgcaattggggttcagtgatttgcaactctgaagctttacctgaacagaaggagattcagaaagcatcccaacccttttccatcaacatatactactatttacccagtccagttacttcgcaaaatttaccagatttttcagtttgaaatctgcagagcaaaatatccaaggtaccaataatgcatttcttcgtctcgaattcgcgccgtccgaggcgtctcggttttgaattccaggagtgaaactgctagatcaggtgctgggcacatgctatccagtgtttcggtgtaaaatactcggcagacgaggacacaacactgctggttctgattcttctgaagtgttttggagttgctaagctccatcagtccacttggaggctctggcaatgccagcccggatcagggccgccgtccacggctgccagtggagctccagcgagcctcgccatcgacaccccacacgtgtggtggctctctgcgcatcgtcgtcgctgctccggtggctggccgtccactgctgtgttctcctgggattcagtgatgctgtcctgcaggctgcacaagggtcagtctgaaatttggaagaacagaactgaatttactaatagagtattcctcacagtacagaagatgcagatccataggcaatggccagtgatcaagtatggtttagcatagtttacaaggtgacttctgaagacagtattgtattgagatgtcatgtatcaatatctcaaacatattattgtcagttgcacgatgccatttatgcaacaagattatctccagttagatgtccagctcgtaaattctgttgccttggtccctcagatgcttcagatccagatctttacagtgcaaatggtgggggattaatttgatagtttggtatgtgatccatgcatctcggctcatgattatggaagaggcaaaagcctgattagcagcgtgcgtgcgtgctgaaaaggcaggcagtgtatcattgttcagacttcagacagtctgaacttttttgaccagcaaatcaaactgatgcatgaattagcagaagaagggactatattttagcctaactaaaccataagaggactgaacattaaatgaatgaactcaacaccagaacaggatatgagtgaaaacataatgataaagcatcatcagatgaaatgctaagttcaaagtagctgacattagaagtaggaaccactgacaagctatcctcaactcgtcggtaaaaaagcctatttacaactccatcagtaacaaacactactagtgttaatcatatttggcaaatgaacttggcattgtgcccaaaattgtctgatcaaagtcgttttctgtgcatttttgtcatagatgaatcctgcattcctgcatctcaaaataaaactaatgagccattgctaacaacatattttgaagcgtggataagttaagaaagcagcttacatggaaccgttctccttttgagatgtgaagattaacttcactcagtactaccattcgtcgacttctggctagcagaacctgttaattcatgataactacagtaagtacaacaatgtaatgggagaacaataagagaacgcaaaggtataatcataccgtcagttgtgagccaatcctgcaaacaaacgagcttttcaatatggtgtttacgtgattcaaatatagcaaactttgcagttcttattgctacattgcaatcagtacgacatggctgtgaattgtgctaaaatcagtactgtgtattccaggagagcactagcatatacaatggtatatgggcctcatgggccaacagtaaaataagtctaagactacatcgctatacacatatctaacagcccccttcaaactcaaggtggatttggagaatgatttggaggatctatcacattgagtttgagaatgtaaagacggtgttgctctctagtttgagccttggtaaagaagtcagcaacttgaagttcagatggcacatatcgaagagaaattgttgactgctgacaatgagagcgtgtgaatgatgcatccactccaatatgcttagttaactcatgctttacaggatcattggcaatttgtatagctcctgtgttatcacaaagaagaggtgttggatccttgcattctacaccaagatcagataataaccaacgaagccaaacaatctcagaagtggtagtagcaagtgcgcgaagttcagattcagtactggatcttgacacagcagtttgcttcttggacttccaagcaatgagagaagtaccaaggaaaatacaatatccagtaattgatcgacgatccattggatcactcgcccaggttgagtcagaatatgcatggaggtgaagctgactcgagcgtgcatagaatagttgtcgagatgcagtccctctcaagtaacggagcacacgaagcaaatggctataatgaacagaggtaggtgcactgacaaactgactaagcacatgaacaatgtgagcaatatctggtctggttatagtgagataaacaaggcttccaacaatttgacgatatcgagagggatcctcaagcaaaacaccttcagtagaacgaagttgaacatgtagctccattggagtagtggcagtcttggtatcagtaagaccagagcgtgttataagatcatcaatatatcgatgctgagaaaggtagtagccatcctctgtattagtgacctctatccccaaaaagtagctaagagggcctaaatcagacatcatgaattgctcacttagacattgcttcacaaaagcaatatactctaagtcatcccctgtgattagcatgtcatcaacataaagcaacaatagagtccgtccatggtcagaaacatgaatgaataaagccggatcatgatcacttggagagaatccagcagcacaaacaacggagctaaaacgctcaaaccaagcacgaggtgcttgctttaaaccataaagagcacgattgagacgaaaaacataatttgcaggggcatcaacaccaggaggcggtttcatgtaaacctcctcctttaggtcaccatgaagaaaagcattcttcacatccatctgagatatggtccaggaacgagcagctgccacggctacaagagtacgaacagtggtcatgtgagcaaccggagcgaaagtctcatcataatcgcgaccatgttcttgctgaaaaccgcgagcaactaagcgagctttgtagcgctcaatagagccatcagagcgagtcttcaccttaaacacccacttgcaagtaattggaatggcatgacaaggaagaggaacaatatcncaggttcttgttcgctctaaggcagcaagctcctctgtcatagccaattgccactcaggaatggcagcagcctcttgatatgtactaggctcctgaacaccatcaattgctgcacacatatagcgaggatgaggcattatcttgctgcgatctcgaagaccatatcgtggtgtagcagactgtggtgatgacacaagtggatcatcaatgagcggagcaacgggtggatcatcagattagcattaatggtactagttggaacatctgaaggaagacaagagggaggctgagactcatgtggagttcgaggtcgacgactatagtggaaaggaaaaggtgacatctctgaccttggtgttagagtggatgatggtatatccaaagagggtgaaggaatggaagatggagaaggtgtctcactgatggtagttaggtcttgagaaggaata

SEQ ID NO: 43390 - DNA, 3162 bp, Oryza sativa
  unsure (1)..(3162): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcgttttgttttcagtcacgtgcatttgtacgtagggaaagacaagaagtagcgtttgcatcgtgtagcgcttgtatgttaacatgagaaaattatttttttaataatagatctaatctaatggtgtaaaataacaggtccaccaatttaaatgaaaatcaacgataagattatatagtgccatgtggcgacttaggagtgtttgtaggggtacacgtggcggcttgagagcgtttgtaggaagtttaatggacttttagtatataataactaggaaggcagcccgtgcatatgcgcgggcatcttatttaatgtgcatgaaactttattacgaatgtcatgtgtgggtggctttctatcaaaaatattcttttactttatcctaaactaaaattgaacttatttaatgtactttgaatattggttatgatttttcttctaattacccttgcaacatataaattgtgaactaaaattactttaaaccgtgtagtttttaatttatgataaaattttgtgtcgaaacaatagatgtgtttactgtgaatgtccattttttttgttagattctgtttgaaattttagatatattcattttattagtcctatcaaaatgtttgaatatttctatttaagatgggttttaagcccagcaaaaaaatttagaattagataaattttgttcaattttaatttcatttcttttcatctttatcttttatttttttgggggagaattccactctatgaggcatccttaaaatgctttgatatctacaattcgggatgaaaatataagtgagttgatcctgcaacctggcatggggtaaaggcatctattctaaattatatctctctaattaagtaaaaaaaaattaaaatagaggtcgtagtatttttttggcaaattaccactaaattggagtgtcatgtaacaaaaacatgtttattgttctatgctagatgtcaggaattcacgatgtatcggagtaagttttaccaaaaagaaataaatatacatgatcttttaattactgtctaaaattgccctttatattcctaaggcaacatcatggttgtttcactgttaagattccaccgacgttcttagtacgatcggtatgttcaactgaccacgtgacttcatagagaacatatataatttagatgctatgatcattttaagattatttatttatctctaaaaagacaatttattgataaaagcatcaatatcaaattgtatggatgaataactcctatatacatgttgagagaaaaaaataattaagtcgatagaaagtcgttagatgtctaacaggatataagtaatgggtctaccaattttgtgaaaaattaaggtgcgatattttttatttttagtgagaaattttagtattttcttatatttagtggaggcctcaatatggatgcgggttgcagaatgtaacttttttgttagcatttaaatatagtcaatatggttattaaattattgatttcacttaaaaaataatgtgtagttcaaacagatcataagagacatatggtggctatacctaataggtgaaggttcgtttgtggtcttctctttgcccactaagataattttaattttaattatcaagaaataaaaaaaatatagaaaagtaacacaccgcgcacgggggatgggaatggagggagggttgggatgttttttttcttaaaaaaaagcttgatctaatgacctaaaataatgtgttcatgtttaagtcaaaaccgatggtcgaatgttttatttttttctcagatttattaggattttctataatttaagcgggacaaatagcaacttaccatagcgtttatgtgctttaatgcctatagggatggagtggaagggaagaaggtttgtgatgtttttttaaagaaaaaaaaatctaataacgacgtaaataatgtgtccattgatttaagtggataccagtgattgaatgtatctctaatttaagagtgacacacaacggtttagaaatatttatagaatgtttaatggattttaatgcgtatgatgtctatttgtgggttttggaaaatttaagagtgacacacaacggtttagaaatatttatagaatgtttaatggattttaatgcgtatgatgtctatttgtgggttttttccaaagaagataattttaattttaattgtgataagctttcacatggaaaactgtatgtattataaagaagatgaaaggatcagattaaattcatttagaaatggtagttttaatcttggcctgggtagttaatagccttaaattcattatttaagatgaagagcaggaaccgtaggatggatatatatatatatatatatatcaggttgaatgctccatcaagcgaccattgatgatcctattcattgttaatttttcttccagttatattctgatttgcattcttggtctgggctatgatcaagtaacggtagtagcgtattggccgctggtgccgaaggaaccgatatcagatgcgagattatttaattctctccaaggacgaacataccctttctaattgattttcagactgttaagcaccttctaatcttagactctcatctttaaaattcgtgcagtttttttagtggaagagcgaagcgcatctcgatatgaaaacagagaaacggcataaaaatcactacgtgcggggacagtgggaggttttggttttctaaaatagatctaacgatcttaaataatgggtccaccgatttaagtaaaaatcaatggttagatttctctattttattaaagtgccacgtggcgacttgagagtatttatagtagcccgcgcattcacgcgggcatgcgtcgaacgctaagtttgagacacatttgccatgatttctccataatttttttcatcggtattaattaattatttttataagtttctaacctattagctttatattatatcatatttaagtaatatttataagcaattatttacaatcttcttcatcatttgaaaagaaggtagacttactttcttctttagaaaacatgtcaacgaaagt

SEQ ID NO: 43391 - DNA, 749 bp, Oryza sativa
ccgccacgtggcaatctaaaaacgctcctaagccacctcgtggcaaaaagtccattaaacttcctacaaacgctcttaggccgccacgtggcaatctaaaaacgctcctaagccacctcgtggcagaaatacatccaacccttaattttcattaaaattggtggacccattattgtggaccattagattagattaaaaaaatcccaccccttctcttccgcctatgtatgacaggtgcgagggtattgtgccggtcaaaaatgtcatcagcagatatacgtcaaagaaaatacgtatatatgcactgttcaccggacgaaagtagaaaataaacatacatattacctctgtacgcgtgtacgattaggaaaaaaatgttaatccttccgtcctaatatggaatacgaggttacttattattatgcacatgtttcgatgctaagtattaattagctttttcttaaaaaaaaataaggccatgtttcgatgctgtaaaagtttggcaattttttttagatatacagacacacatttgaagtattaaacgtagattaataacaaaagaaattacagattccgactgtaaactgcgagacaaatcttctgagcctaattacgtcatgattagctataagtgctacagtaacccacatgtgctaatgacggattaattatttctttaaatgtaatctcgtgatttacagtcggactgtgcaattagtttttctttttgtcacatttgatgctcc

SEQ ID NO: 43392 - DNA, 3631 bp, Oryza sativa
  unsure (1)..(3631): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgcttctcttttaaccattatgcatatcagagcatcaataagcatataccttggtaaagtgtcttaacatcagctgtgattctgtaccgacagatctccgtgtcttgaacaattatggacagatcgaatcattctctgctttcagcagtatttacaacaattctggcctttttggaatacatgcaaccactgtaagtctcttttggagcataaccaatgatatgttttcccttctatattcaagcaatgaacagaatcaaatctgcttgtgaattctttcccttttttttttgaatatcattctcaaactactgtaaatataataccctttctattctaagtaatgtctgtccctcttaccacaccattacatttgtcctacctgaattctggattaatgccttatacaaacaactgtaattttatcttactgtttaaaataaggagttggtggcttatgctagtaagtagtagtaactaaaaccgaagttatattgtacctcagtaagaaatgcagaaagcactcactgaaactgagtatttagtttcttcctatgtacatcaatgctcatttcatctcgtgtacaattttgtggtttcaaatgtttcaagagggtagtaactaataaatgcacatttcaggccagtaattatgccctggtctttaattataaccatccgaacagtcagattgaaatacaagtcaaaggctcaatgatttactcaagcttctatagaagtttctgcatttatcatggattttcatacattccactttgcttttgactgtcatgttaatttaacagaacccagattttgtatcaagtgctgtggatttggcagcaagggaactccatgaagttgcaactcctggaaaaggtttctttaattttttacctcaaagttacaatctattttcagattagactggtcattatgtgttgtcctttccctgtcttttactttgttcagttacacaagaacaacttgatcgtgctaaagaggctaccaagtcttcagttctgatggacttggaatcaagagtatgttgttcttactcctgatcaagttccaatcgcatgaatttcatgcttcttccctgaaatgtttttttaattgtacttcctccttatcgcagatcgtggcctctgaagatattggaagacaggtactgacttatggtgaaaggtatgcttataagtaatcgctagtacattaatggagtcaatttcctattaatccctatgttcctaattaaatagcatatttccatgtcatgtttatatgcatggaatgcaaatctttttactaatgtgcgtaaaataatgagtcatcaccatgaactatcacaatctatgtacgcttgcgtaaattattatgtttccaagctggttgggcaatatatgttgaccatattacataggcaactaaagttgtcttgtggttttttcctgcaatcatgtcccaaagtttgacaagtcacctataatactgtgttctggacacacttactgtggttgtggtgttccttttccaaagtgatgctgtggttatggtgtggtacatgcttttttatggtatcacccaaagtattttgggtgtcagactgccagcacgtccaagcatatattcaggatttatttctatagtttcttctgcgtgcccattggtgctataaacttattgtcatcaccatgccgttgcatctagaaaaggtgcacatacatggtagaagtgagccataagttttagtaccatgagcagaggttcatacatttgacgcatgcagcagtgctaaatctgttaagctagcattttttctaagtaatccaccaattgcatagggtattaatttagatagtcacttccatttgccagagaaccttgtttatcttggagtgctttgtgttgtgcaggaaacctattgagtacttcctgaaaactgttgaggagatcactttaaatgacatttcttcaactgcaaagaagattatttcttcgccgcttacattggcatcatggggtgatggtatgtcgaaacttggaagttaaagcatggccctatgcaagctctgagagtctgagcactgactaattgaaacgctcgtgttgcagttattcatgtgcctagctacgaatctgtcaggcgcaagttccattccaagtgagcattcagcacctggacctgcgtgggttgttctggaatttcaagccgcagctttgcagtggccaaatggccatcgactggaataaatagagcccatacacaatttttgctggacagatgaggggtgcatgatcaactaccctccctattcatgttctcaactaagcatgtgatcatgctgccacaattccgcggcccctaaatcattcggcggcatgctgcgttttgttcagtggcatgctgcgtttttgttcagacgcacgccaatatcgtccttcctgttttacattttaatatagaatcagatgttatggcctcatggttaagccatttgcctattcatcggtgtcaggtgttttttttattagcgtgtttgcccatttgtaccaacaagctgtaaacatatacgagtaaaaagagtatttctatttgtcagtctgtgtgttgcgtacttgcgtatggagcttagtcagccaacttcccggattaatagcggaacacaaatttgatttcccctcggaaatgaaaaactgtatgtatatttggtagtaacgttttggaatttgagaatgcaaacaagatgaaaacaaactctgagtttataatcccctcatccgccgcctattgtgctgtttcgtaagcaaaggtcaataaatgatctgtctacatgggatctgcagctttcgtttcctgcggcgcaagccagttacgcgacgccgggaattgactcggctttgcttctggacgtggacgacatggcgggcggcgatgcggtatggggccggccgaccgtgccctcttcctaaaaccagcatacgtatgcctgtcagcctgtgggcgacggcactgggatttgattttactgaatttatcctgcctgattccaggtggttgatccgtagagctaatttttcttttcctaagatatgcatacaccgggtgcaaattcgaagcacaccagaacgtgattcacaatcacagctaaaatatcattttcacgtatgacataccgataccgtattttttttcttttcctaagatactctctttaaatttaactcaattctcttgtagagggattaaatgaaggcctaaagaaacaggtaaatagatagacctaaaggccatctcgcacgggatggcactggcagcgcatgatgtgcatccatgcgaatcggatgctgctcgacggctactcgccgtgcccaccgccgtttgccaaaccgcagcgtaaaccaaaccaatgcccgtaatcccatcaggggggacaggtttccacggcgtcaaacttagcccaaactcggaaaaaccgccacgcgcggctcacaaaaccagcgccg

SEQ ID NO: 43393 - DNA, 6897 bp, Oryza sativa
aagtgatctgggtggggatccctgattgggggctgtcatttgcgatgtttgcgggatttttttctatcagattttctggtttggaaatccattttggatactgtgctgattttagactgtcgaatttgagcttggacatgcagtgagccaattagtctgttaggagcgaaagggggcatgatagaacagagcaattaagttgtcaaaatttcgctgcaatgctattgacgctttatgttatgtagtaacagaataagttgttgctttgggctttttggtctctgcttttgggataggaaatttgattgagtagattggaggatatctccactggaagaactgtcactattggctggttgcttatcactgccaaagcatgagttagttatagccaattcactgtgctggattgaattgtttctggaaaggtgaaaccatggtccatgtgaattgagctgatgatttgctattttgttcatatgtgcagacttatcccaatccactacaagatcatccagcctattcaactgtcaagtaaggctttgatcttccactttttttcttcttctaatatctgagcttgtaatttgtgccatgtgtaatcctgaaacttttgttcttatcgttatcaggcaatattttgttaatgaagatgacactgtaccccaaaaggtaaagcagtgttaattatggtttacactgtgatgttgtagtcgatggtgaatttacaggtagctatttctgtgcttacaggtggtcgttcagaagaacagccggcggggggttcacttccgtcgtgctggacctcgtcagaaggtatgatatgctgccccctcttttaactattgaaactcatcacttgcgcgtgggctaacagaaacatttggacttgaacctttaggtttattttgagtcagatgaagtgaaagcatgcattgtaacttgtggaggcctttgccctggtcttaacactgtcatcagagagctcgtctgtggtttggcgcacatgtataatgtcagcaaaatctatggtatacaggtgtgggcccttctctaaatggttacataatacttcaatagatagttaagggcttgttcactttgctaccattttcaaccttaccaagttttggcattgttaaattttggtagccaaaattttggcaacatttcatatgcacttactaaaatttggcaacaaactaaacgtagccaaaattttggtaactttgccaaaaaatagtatggttaaaaatagcatcaaagtgatcaggcccttacagtatcatattttttcactgagaaagacagcttgcgcatgttaaggacctgttcactttgatgctattttcaaccttaccaaattttggtaaagttgccaaaaaagtggctacatttagtttactgccaaattttggtaactatataagaaatcccgccagttgctaaaatttggtaaggttgaaaatggcatcaaagtgaataggccctaaatactctagttaaatactactcttgcattttccagacatgcttgatccatctttctaatttttctttggtccagaaaggatatgccagcttaccataagatcttcagattcttatcactgcttatcaatcattttgtattgcataatgtccatttccataaatattcaaaccttatagtattattctactaaaatagtggcaaattgaataagctgctttggattgttttagtaaaatgcaattataaatttgtatacttgtattataagtttagaacaatggatatgtgttctgacaagggcttgccatggcaactataaacatgaatcattactgcgttcagttctcattatatttccagatcttctacctcttaataccttatattacctatcatagaatggatacaagggcttctattctagcaattaccttactctgacgccaaagagtgtcgatgacatccacaagaggggtgggacagttcttggcacatcacgaggtggccatgatacaaaaaagattgttgacaacattcaggatcgtggaattaatcaggtaaatgcggttgtttgcacctatgtgatatagctcttctgattggtcattgtctcatgtgcttatgtacattacccaggtctatatcattggaggagatggaacacagaagggtgcatatgagatcttcaaggtaatttaccactgtggtacaaccgtacaagtgctatgtatgctgtttgctgaaagaatgtgataatagatcctattcatcaatgcattgcagtagcatacggtatatctatttaaatattattttatcgttacctcattgttttcatattggtggcaggaaatccgaaaacgtgggctaaaggtttctgttgctgggattcccaagacaatagataatgacatagcggtattttttttgtgcgatgtgtctatttttgtgtagaaatttgttgtacgcatgctgttcagttgacggttcatacgagattatgacttattgcttatgttacctttttcttgattcttagatcattgacaagtcatttggttttgatacggccgtagaagaggcccagcgtgccattgattcagctcatgtggaagcttgcagtgctgagaatggaataggcttagtaaaactgatgggccgttatagtggtacgtattttagtattccttgccatctctctgagtgtaatgctgttatgtttcttccattgttgaccttgctgaaagcacctatcagtttaaaaattacaagaaaaaacaagccagcattttggccttttgcctgtgattgtactcatgcagaagatctcttgatttttctgtatttcaagcttgaatgcttgattactctgctatctgttctctagtatgtatttcagtctattgcccttaaactgttatattcatcttgcagggttcattgcaatgtatgctactcttgcaagtcgagatgtggtaagcagatgcaaccattctgtctaattcctgtatattttatcccccctcttcatacagtagtgagattcctacttttctggtttaccccacaaatctacttctacctaagagtagttttttttttccgaggtctacctaagagttgtacttatttattttttggatctcaaatctccacaggactgctgcttaattccagagtccccattttatatggatggtgaaggtgggttgcttcaatatgtagagagaaggctgaaagagaacaagcacatggttattgttgttgctgagggagcagggcaggatcttatagccaaaagtttatctacttctgagcagcaagatgcatcaggaaataagctactgcttgatattggtctttggctgactcacaagataaaggtacacaaaacacttaattttgcttctgaattcaggtctgctgctcttgttaatataggtaactaaaacactaagcaattcccactgaaaactgtgatgacttttgccatacagttcactttgactttcaagtatcactccttttactcacttcttgcatgcatctttttcttctactcactattcataacttctattgtaggaccacttcaagagcaaaaagatggagatgactattaaatatataggtaactatgtttgcttcacacaggataaggttgttacacatcttattactggtctctattgtactaagttgtgaagttccctattattatttgcagatcctacctacatgatccgagctattccaagcaatgcatcagacaatgtctactgcacgctgctggcccacagtgctattcatggtgcaatggccggctatagcttcactgttggaaatgtcaacggcagacatgcctacatacctttctatgtgagtaacttcaagtgatcttatttgttcacatggaaaatgcagaaatgtagtgctcgttacacccgggcatcccatttttttcctgattatccaagagctgttcttactgcattctcatactaagcatcagttccaacttaacgtgaaatcttcccttgatggcagagggtgacatccacacggaacaaggtcaagatcactgataggatgtgggcgaggctgctatcatcaaccaaccagccaagcttcctaagccagaaggacatcgacgaagccaaagagaacgataggacggccaacaagccaccacttcccaccggcctcagccatcatgtggcaaactctttcgaccagtctgcatcatcttcgtcgaacagccagatatgaactccatcatgtggcaaaccctttcgaccagtctgcgtcatcgtcctcgaacagcgagatgaatccaatctgtagttctatatagaagctgttgctattcccgttgagaaacctgggccacgctacgcagttttgatttaatatgcataatatcacctgtatgaatccacggatactctcctggattgctggtaactacaagcgtaataagaaaagcgctattgatgaagctatttttcataagcaacactcgtgttgtgtcttgtatatgctgctgatctgaagatatgtttcgtcagctgatcgtatattgaccttttctgtctctgtcactgcagtgcaatgcgtttatgttgtggtacccaaattaggcctgcttggttactggaatactataccacttactactaagtattctgcgcacaaacagcagatcaggagtttgtcagagaatatcatcatatgctgcgtgtctcccgtcagtcccgtgccgaactgccagatgtcccggataagattcagacgaattctgggacgagccacaagatcaacaaccaacccggcaaaatcgttgatgataataagaaaccaattaccagtacgcagtacgcaaaatgcagaacgagctctcatgaaatcatggccaatgatttgatctgcacgaactgcccacacagaatgctggtcgcagtttccggcgcggcgaaaaagtcaagagtccactggccaatcatgcgcccagctgcactgaagtcaactccaacccatgtgaatatgtgatttgctcgtcaattccccagttagttgcagggtcattttatttgggtaaaaaaaattccagggccatagagggtcgaggcattgacaaagaggtggcctactgccctactggccttggtaaattcagaataggcccacccgtcagaggaaacagtccatacatatgcgacgcgtcgactacggcgctcgacaattggcaagcgacgactggacagatgtgctgagtgctgacgtggttaaactaacctcgatggtgtgataaaaggctagttgtagtaagtgatattaagaatgttaaatttgatacttatttactgggcagattaacgctggatataaaaagagcacgtacgtccctattattatgcttcagtagttcagttagctcgctgctgcctgcatgtgcaatggagcgttcaacgccgggaacaatggcggcacggtcgtggttgcttctcctctgcttcgtcgccgtcgccaccgccggagtgctccaagctcgtgcccaacctgacagcaacggtacattccaccatgtcctgtctttcaagttttgatccgcaactaggtagtgctgcttcacaatgaaatcaatgtgctagcgtgtgtaatatgcttggctgcaggtttcatcagcgtagactgtggcctcccggggaagacgggcttcgtggacgacaagaccaagatatcctacgcggcggacgacggcttcaccgacggcggcgcgtgccacaacatctcggcggagtacatcacgccggggctcgccaagcgctaccacaccctgcgcagcttcccggacggcaagcgcaactgctacacgctccggtcactcgtcgccgggctcaagtaccttttccgcaccaccttcttttacggcaactacgacggcctcaacaagctacccgtgtttgatctctacgtcggcgtcaactactggacgatggtgaacatcacgggccccggcgacgcggtgatcgtggaggccatcgtcgtcgtgccggatgacttcgtgcaggtctgcctggtgaacaccggcgccgggacgccgttcatctccgggttggacctgaggcctctcaagaacacgctctacccgcagtcgaacgccacgcagggccttgtcctcctcggccggctcaacttcggcccgaccgattacaccgacgtcataaggtaaatccaagcctcaatttaaattcatatcttacgttaaccatttccattatctaaaaaaaaattaagatcttagctgatcgattgatcgagctgcattgctgcaggtacccggatgatccgcacgacaggatatggttcccgtgggtggactcgaccaaatggagccagatatcatcgacgaagaaagtgcaggatctagacaacgacatgtacgagacgccgacggcggtgatgcagacggcgatcacgccgcggaacgcctccaggaacatcgagttctcctgggaccccgtgccgctgcccaacgacccgacgcccgggtacatcgccatcttccacttctccgagctgcagctcctccccggcaacgccgtgcgcgagttctacatcaacctcaacggcaagccgtggtccctgaccgccttcaagccggagtacctctacaacgacgccaccttcaaccggaacccattcctacggtacccgcagtacaacatctccatcaacgccaccgccaactcgacgctgccgccgctcatcaacgccgtcgaggtgttctccgtcatccccactgccaccattggcactgacccagaggacggtacgtgcgtgcgtgcacattggttgcagacacatgtaagattaattatcaagcatgtcatgcgtgtttg

SEQ ID NO: 43394 - DNA, 8144 bp, Oryza sativa
ccagcaaaaaagaagagcaagctagctatctacatagttattccaatagttatagttctggttgtggtgataatatcagtggcagtactactttgttgcctgttgagacggaaaaagcaaggtgaggtttgttataaacacagtaattgtccatctacttgttcatccttttaacactagtgatgcttattcacatattttagcagcaatgagcaattctgtgaagccacaaaatgagacagtgagcaatgtgtcgtcaaatggcggatacgggcatagttcatcactacaacttaagaatcgtcgatttacgtacaatgaacttgagaagataacgaacaacttccagcgggtgcttggccgtggagggtttgggtacgtttacgacggcttcttggaggatggcactcaagtggcagtgaaattgcggtctgaatcttccaatcaaggtgctaaggagttcctcgcggaggtaaaatttcttcagctgcagttgatattttgctttgcctatacttacaccaagttgttgctagtgggatataattggttaatttcacttgttaggctcaaattttaacccggattcatcacaagaatcttgtctctatgattggttactgtaaggatggggaatacatggcacttgtatatgagtacatgtcagaaggaacactacaagaacacattgcaggtatgcataggatgtttatgatcaacttgtaggatacattgtaatacttcatctaacgtatcatttcacatgactctcatgatcttcaattctcattctatacctatttataggtaaaaacaacaacaggatatatttaacctggagagagaggcttcgaatagcactagaatctgcacaaggtaactacttgaattctagtaaagtgtttggaggtatgcttttttacacttttccctagaagttgatcatcactagtttaattatttggataactgataatggttagggctagaatacctacacaaggcgtgcaacccaccacttattcatagggatgtgaaggcgaccaacatcctattgaacacaaggcttgaggcgaagattgctgactttggcctatccaagacattcaatcacgttaatgacacccatgtatctacgaacacgcttgttggcacacctggatatgtggatccagagtatgtaaatctcatctatatttctcgaaaccgttgttcagtgttttctattacaaatgttaagtgaagcttgtggaactggatgaacatgtaggtaccaagcaacaatgcaaccaaccaccaagagcgacgtctatagctttggtgttgtcttattggagttgatcacagggaagccgtctattctacgtgaaccagggcccattagcatcatccagtgggcacggcaacgtttggcacgaggtaacatcgaaggtgtggtggatgcacacatgcatggtgaccatgatgtgaatggtgtgtggaaggccgcagacattgcccttaaatgcaccgcacagacatcgacacaacgacccactatgaccgatgtggtagctcagctgcaggagtgcctagagctcgaggataggcgatgtggcatggaagatacatataacaacttctatgccggcaacaacaatgatcccaactcaagttataacatgtacaacacggaccagtccactgatgtgagtcaaaacaacacgatggagcataattttgaaagagtgccaaccatggctacagggccagttgcacgataaaggcctttgccaatctgatccgagactgctagtcctaaaatagatacatgcagaactgaaacaatattgttgctttaatttaccaaagtaaatgcaagcgcataaagtttcaaacaatcaagatctagagcttttaccgtgtggaatttgtaatcaatacacttatctattctttgatatttataactcttccatactattcttcaagaagagaaaagtcaatatacacctaataattttttttatcttggaatatagttatcaagaatttagaatccaaattttatgatttcccacaataaatgtactttgcttgataatgtaagatgagatatcaaatggaatccatgtcacttagtggactagcaagcaatggaaatcatgtaacatgaacaagggtcacatccattgtattcactcataagagtaagtgtaataaaatgatgtgagccgatgacgatgggggtgagaggagagagatcaagcccgcgaataatttgctgccgactcatcacgcactccaagaagccataaatgacttcaagaattcaggagcaagcataacacggaagaggttaatattttgctcattactgctactcagtagcctcattcctagttagagtttctaaggtcgttttgttagacaaaaattcctgataaaaggattttctactatttactttttctgctgtccacagactccagctgcttgccgttgcttcctccccgtgaggggttgctccatccctactcagccatctctgccggcgaccacatggccgcctccgctagtgaccacttgtagttgctccttccccgcgcctccaccttcatcaattagggcgtatttgaatgggtgcaccgcacctgcatcgcatcaagccagcaaaatccaacttgtttggttggctggaccggcccgcgagtcaggctaggcggattcaaaatcgccgtctgggccaagttgagcagaaacgcgaggggggagcatcgctgcgcatccaggctgatccggtgcagcgcaactgcacccacacaacccctcgttgcaggcgagggttacctccccgcacggccacatcccctcctcatttcactccccaggagaagaagctagggtttggggctcctgtgcaccgtcgtgggtgctccctctgctgcgaactctcgtagccggcgggagtgctcgttgctgagcgggtgtgctcgtttgcctcaccttccctcccgcagctcctcccaaacaacatctcatatcatccaggataaacccatgcaagtaaccaaacacaaccaattgcattaccctagccaggctgagggcatcctggatgagggatacggccaggctggggacatacgagaaaccaaacacacccttaatgacttccgtagccttggatgtgctcctttcttgtgccgccagctccgccaagacttggctgcacattagataagaacaaatcaagaaacaattgccattggttgaaaatatttttttttaccaagtcactggaggggagagattccccacctgaatttcattcaaactgtcaataagcaatagcacttgagtacaagatggattacagtccagattacaactaatttagagcatgaacagaggatgaaattacatttttccaagccagaataatatcacggtctttcggaccaaagcgaaccgcccagaggttaacttcctattggcattttgacagggctgaaagcagtgatggttgagcattgcggaacaccacgtcgtgtctgtgaagccagagacaccaaaggcacagcaggatgaagatcttgaaatgtttctttggagccctattggttgaaaagatattacttacatagcaatcctattactaaatctcatgcatgattgacgaatacttgcataaccggtgtttccagtttccggtatgcgagatgaatattgtcctggttcttttaacgccgttacagctgagcctaaaactgaattgtgttgttctagagtacctgcatgcaagttttaattggagatttagaaaacaccaaatcatttaatccaaagagtcgtgtagatactcctactaaaacttttaggtacctaattatgtttagtactaattagccgcagtccgtcagaggcaaaatatatcttcttgcgctgcctgtctcttgtgcaaaactgccagatcagattcagatgcattctctgacagagagaacaaattcttttacgtagtgggcaagtgcataataatcttgttgctcatagtttccggcgcggaaaataaggtcaagtcgacgggccgtggccaccgatctcgggcctccaagtccttcgcccagcaaagcagttgaccagcgggctacaagtcaactcccggcccatgtgatacactcgcctcttccctcagggtcattgacatgccgggcccacaaagaggtggccagtgtaaattctgaatagccccactcgtcagtggaagaatatctatatgacccacaaagcgaggcgctctttgttactggaatctggatagatgcgctgacgtagtgacgtggttaaattaatcaagattgagttttgtgatgatcaattggctagttattattagcttgtgacagtgagattattagcttggtcacttgtttactagctggaatgctggattacaaatagatggagcacgtccctagagagtagcagctttgctacctgcatgcatggctgcatgtgcaatggagcgtcgttcatcaccggcaacaatggcggcacggtcgtcgttgtttcttctctgcctcgccaccgccaccgccggcgtactccaagctcgtgcccagcctgacagcaaaggtacgtagtacaatcctagtatcctacctcatagtaatgcgcgcaatgcttcacaaatcaaaaagacatcaatgttcaatgaactaaaagagcatatgtttttcatgcttttgcaggtttcatcagcgtagactgcgggctcccggggaagacgagctacattgacgacaagaccaagatatcctacgcctcggacgacggattcaccgacggcggcaagcactacaacgtctcgccggagtacatcaagccggcggtcacggcgcgctactacaacgtgcgcagcttccccgacggcgcgcgcaactgctacacgctccggtcgctcgtggccggcctcaagtatctcatccgcgccaccttcatgtacggcaactacgacggcctcaacaagctgcccgtgtcgtttgacctccacatcggcgtcaacttctggacggtggtgaacatcacggacccgatccagccggtgaaccgggaggccatcgtcgtcgtgcccgacgactccgtgcaagtctgcctggtgaacaccggcgccgggacaccgttcatctccgggttggacctcaggcctcttatgaacaagctctacccgcaggtgaacgccactcagggcctactccaactcgccaggctcaacttcggcccatctgacgaaacctccatcaggtgagctaagttaaagtttcctacgcgtatagactgtttatatttattatcatatcatttatttatactatcatcagtattactggtgataattcaaactcgataaattttaactaaaagttagtctcacaatatagggtaattttactattcttaagaagttatcgaaaggtatcatattttttagtgtaaaatttggtacctcccggtactaaatattttgaggtatcaaaattattggtgtaaaatcttggtatctttaggcactttatcaaatatcataaaattttccacaatatataggtttagtgatataaatagcgtaatattagattcgtatttacagatactttcatatattttttctgattaccaacatgcaaaatgaggggatatctcttaaaggatgaaatcacttttcccgataagagccagatatttagctaagagcaggtacaatagcaggctataagccagctgcaaacatattttaaggaaatagatgaggagagagaagggaagcgggctacagatttatagccagctgtagcatggactccaatacacagtgtgtatgacatgtgggtccaggtactaatagtgtagtatgtaactattgtatgaatgagctattagattggctatagataaattggagctaatagttggctatactattaaacttgctctaattctctgtagataaattttacggtttttgagaaagtaccaatttttaaattagaaaatatgatatcttctaatattttttttaaggatggtaaaattacccttatctgtaggaaatgcaactgatcgattcaatggccaggtatccggatgatccgcacgacagagtatggtttccttggtttgatgcggccaagtggaacgagatatcaacgacaaacagggttcagaacatagacaacgacctgttcgaggcgccgacggcggtgatgcagacagcggtcacgccaatcaacgcctccaacaacatcgacttcttctggaactcacagccgcagcccaacgacccagcgccagggtacatcgccatctttcacttctccgagcttgagaacctccccaacaacgccacacggcaattctatatcaacatcaacggcatattgttcgacgatggtttcacaccatcgtttctctacgccgaggcctcctacagctccaaaccctttgtgcgacacccgcagtacaacatcaccattaacgccaccgccaactcgacgatgccgccgctcatcaacgccgtcgaggtgtactctgtcatctccaccgctaacattggcaccgactcacaagatggtatgtgctcagggttttcaatttcgatttcatctaaaatttcagccatttcggtagaattaaaatttttaaaattttgaaaatttcagaaatttttggaccgaaattttctgaaattttgacacaatttaacagaatttgactaaattcataaaaaatttgagaaaaactgaaatatgcacatacatgagctagctgatggtcaagcatgtcatgtgcattgatgaaattttttggtgattgacagtatcagcaatcatgacgatcaaggcgaagtaccaggtgaaaaagaattggatgggtgacccgtgcctccctagaaatcttgcgtgggataatttgacctgcagctatgccatttctaaccctgcaagaatcacgagcttgtaagtaataattcattccattagccaaaaacaacatgactattgtgatgaaaaaacaaaactattacctccatcccaaataaaaagagtgcaaacgtgtatggctattgttaaactattgtaaatatgaaaattttaattgtatacacaatgcatagttaatggcttagattaaaataattaaagagaacccatcaattataacttgctaattattaatttaaagttcaaaattaaattaataaaagagatgatatacttgttgcttgtgaatttagaaattattaagttttaggatactaatgaaactaaagaggccatgcatggcagtaaaaattaattaagaccccatgttatttccaatagaattttttatttgatatgaaattttaatacaatctatggtggtcgataccaccatcaatcaccagcctgatcttttttattattattattagcaccctcagaatgccaaatcagcacatgcataaatagcaagaggaaattaaatctaatgggagctaattaactgtgcaatgaaattgggctgatcatattctctttgcagaaacctgtcaaaaattggtttgagtggtgagatatcgtcctcttttgggaatctcaaggccctccaatatttgtatgttatgagttcatgatgtcggatgtattaacttgtttgcgtaatctgagttaaaatttggaaaatcttgctccatatcttgcagggatctatcaaacaacaacttgacaggctcgattccaaatgccctttcacagttgtcttcattgacaatcttgtaagtttggcaattcttttatcaacttttacctagagtaaagtacacggtcggtccttaaagttggagcgaggtgtcacttaggtccatgatcttgaaaaatcgacattaggatccacggtcttgtttaagtgactcattgaggtctaaaggatctctgaccgggttgactagcttatgtggccatccagagtggcaacatatttgcatgtgagctcctccacatccgatccaacccttcttccccaaatcttctttcagcactggtggtgaggacgacgacgggtggctgatggtggacaacaacgatggcgcagctggtggtagacaacgacagcgatggcgg

SEQ ID NO: 43395 - DNA, 4858 bp, Oryza sativa
cgtcgagagacggcggcttgcagccgtagggatctggccgcagctgggacgggatccaccggtgtgcgcgccgccgcctagcgcggtgatgtccacggccttagtgcggccgtcgtcgccggatccgatggataactcgatgacatcaccgtcattgaggctccgatagctgtcgaacttgagggaggaccgtggacgaagaggtcctcaccgccgttgtcgggagtgatgaagccgaacccattggtggcgtcgaaccccttcatcgtcccctcaccctctccgacaccacctcgccctcaccgccccaagtcgaaccctccaaaaccctaaaagctgcccgccgtctcgctccactggccagccgccgccaccgccctactcgcccttctccctctttgcgcatgctcgccaactcgtcgccgtacccgtctccctcctcgtcgtcactgccgccgccagcccctgcaaccgcaaaccatagaaatcatactgaaagaagatatggggaagaagggttggatcggatgcgggggaggggggcgaaatgcaaatatactgccactctggacggtcacgtaagccagtcaacctggtcagaggtcctttggacctcaatgagtcacttaaacaagatcgcggaccctaatgtctatttttcaagatcatggacctaagtaacacctcgctccaactttaaggaccgaccatgtactttactcttttacctacgtactctttagaatccttttgaactaatatcctactgtatgtcttcttttagagatttgacaggaaaccaactaaatggaacaattccgcctggacttctcaagagaattcaggatggctttttaaatctaaggtaatgacaccacattcttcttatagcagtcttcttcagcaaaaggtgcagatcaatttttcagaaaatggacataaacatatttatgtcattaatatatagatatggaaataacccaaatctttgcaccaatggcaactcatgtcaaccaccaaaaaacaagagcaagctagctatctacattgttgttcctatagttctggtcctcgcgatagtatcagtgacgacactactctattgcctactgagaagaaaaaaacaaggtgggtcttgctatcatttgtctgctctacttcatcttcttgaatactactgatgctagttccattcttcacgtacaaaggatcaatgaacaattctgtaaagcgacaaaacgagacaatgagatatgggccaacaaataatggctccgggcataattcatcactgcggcttgagaaccgctggtttacatataatgaactggagaagataacgaacaaattccagcgagttcttggacaaggaggctttggaaaagtctatgatggcttcttggaggatggcactgaagtggcagtcaaagtgaggactgaatcttccaaccaaggtgataaggagtttcttgtagaggtagaattttttaagctgcactttttcttgctatgtaaaaatttctatcaagaaaagtctccatgggggcatcattaaatagacaagtttcaccactttaggctcaaattttaacccggattcatcacaagaaccttgtctctatgatcggctattgtaaggatgagaaatatatggcacttgtgtatgagtacatgtcagaaggaacccttcaagaacacattgcaggtccgaactaacttcatctaccagcttatttttttagtcctttcatgatctccaattcttatatttgcaggaaaaggaaatgatgggagatacttaacctggaaagagaggcttcgaattgcgctggaatctgctcaaggtaactacttagaatttctaatgctatttttagtttgattttacattttttctctctctagaagcttgatcagtatttcaattacatggtgaattaatgatcagggctagagtacctacacaaagggtgcaaccctcctcttattcaccgtgatgtgaagggaaccaacattttgttgaacacgaggctagaggccaagattgctgattttggtttgtccaaggttttcaatcctgagaacggcacccatgtatctacgaacaaacttgttggcacacctggatatgtggatccagagtatgttgtctttcttgaagccctttttttaaagttcttttgttagagaaatactaattgtaagacttattgggactgaccaaatgcgtaggtaccaatcaacaatgcaaccaacgactaagagtgatgtctatagctttggtgttgtcctgttggagttggtaacagggaagccagctatcttgcgtgatccagagcccatcagcatcatccattgggcacaacaacgcttagcacggggtaacattgagggtgtggtgaatgcaagcatgcatggtgactacgatgtgaatggcctatggaaggttgcagacattgcactcaagtgtacggcgctttcgtcagcacaccgccccactatgaccgacgtggtggcacagttgcaagagtgcctcgagctagaggataagcaccaggtcagtgatataaacaatggcttttataatggcaatagtggcgatctaaactctaacttctacaccacttaacaatccactggtttgcgtcagaacaactctacattagagatggagcaaaattttggaaggataccatcaatcactggcggtcctgctgcacgataaattattttgctcatttcgattgaatgccatttcatggtagagatctctatggaactttcacatgatgttacaccaaagcaaatgcaaatgtagaaatttcaaatattcaagattttttagtagaacttttttcagtttggaactcagaatcaatgaacttcattcataatgtttttacaacggggtttaatcagaacccatgcatgttttctctatttttttttctaaatgctactttgcttcaatgttggaaataaacccataagttcagtacaaaaagatatggaatctgcaaattaagcttagtaggctagcatgcaatggaaattcagagatggaaaagtgtcttacacattaccaggctttctttggccatgtgcgagatgagcgactacacagggcaccagaaatttgggcccccaaaatttgtgagttcaatctatgtcgagacgttctaatatgtgtaagatctcttcactcctttttttccttttgattttctctctttctgcttcactgatctggctagaatgagatttttattcttgaatccagtaagtgtttggtaataatcatggctatctcaaaaatgtgtagttcatgacgacgaggtgaacgtatgttccaagcaataataattccatttttcacttaataagaaaaactaaattagtgcaatggttttttttctacttaattagccagatcgtcttactcaccacatatgtagtggcgatctggctaagtagaaaaaaagagtttcttcggcatagctctagttgccgttgatcgtgaatgattcctactcgtctgactatacctttataaacatataagcattagattgatactgacttttctggcgtggttagagtcattggctgtggtgcaattgagtaaaaagtagtggtagtagaaacccatcccattgcattgtaaactatccgcatcaagtcaaaatgcatataaccctgatctgttatgtaattttctatgagtatattttataaatataaggcatcgttttatatttagtgttgggtccttagattttgagggacgactctgcacgttacatgctctactaagaggaatcgcgcgagaaagatccatttgaaaaaaaaaaatcatccatcaagtagatggaatcgtgtcaatttcgcaactgcagcgcacgcgcttgaagaaaaatgtaaacatttcctgccaataactaaagttaaaaaaaatagataaatgatgatcaataatacaacgagaactttcttgttaaaatggactccctccagtcatgtatataccaaaaactactagtacaaagcaaataatgcggcatatttacaataaaaaataatttgtgaataaaatttttatgtgcgtactcttaatgatgtaaaagcaaatgctgaaaaataaactacgataaaaaaaacccaaaatcaactccaaatagcttataagcataagtatatacataaaaaatatgaggctatatacttcttgtgctacagtctgcgccggaatcttgctaactaggggaatttgtaaatttggaagtattttgttgaatcactgcctcactggggaacagattcttctacattgtaacgcaagtgcgtaataatctttcatggtctaacggacctatctttttttatttgagagggcaaatgattctatctgcacgaacgtatctttttttatgctgttctcaagaacaagtcaagagtactctacgggcctccatgtcgtgcacccagcagatgagttgaccagctgccatgaaagtcaactccctgcccatgtgatctctttttgtctcttccaagctatagttacaaggtcactgacatgacgggcctacaaagaagtgaccagtggaagttcagaaaagtctcactcgtcagtggcaatctgtgttacagccttacagaggatggatgtgttgacggcgctaaactaatcacaatggagtcgttactcgttagtgatcatcgatagtctaatatagtttaacttttcacataacatttaaaatattctttttattggaaatttagtataaatatataaaaataagtgaagattatggttttaagtcgcaacaaaactaataatacatatgtaaatttt

SEQ ID NO: 43396 - DNA, 1296 bp, Oryza sativa
gatttctaccacgtatcacgtcatactcatgaggtatcagacgatttctaccatgtctcacgtgatacttgcgaggtatcggatgatacttaccaggtatcaggtgattcctactagatatagctgggcataccgttggggaggagcaccccgacacacgcggtcgccccctgcagccgtcccttgtagacgaggacggcgatggtggcggtagaggacgggcgcggcgacggtggtggtagcgggggacgggcgcggcggcggcggcggcgtcgacgacaggggacggacgccgcggcggcgatggcggcggcggagaatagcgacgacggcggtgggggatgggagcggcggcggcggtggcgtcgacaggggacgggcgcggcggcggcggacgggcgcggaggcgacgggggacgggcgcggcagcggcgagggacgcgaatcgtgttgtggagaggagctatcccgttgggggacggtatcccgtcccctagcattcccgatattaaaacatggagacggtaactatttgctagtgatagtgatataattatcttgattatagaaaactattttaagcacttggttggacgttcacccttttttacatgtcaactaaatggttatgaatttttttaaaaaaagttgacaggataggtattaataatatgtaatgtatcactctacgaatatgcaacttcaaaatcgactagttatttttttcctacttagagaagtcaaatttaaacttgtatgttaatttgtgaagtaatatattacataatctatcttgttatttttttaaaaaattattttataaccatttagtttacatgaaaaaaaaaagagtgtacattcacatcacatattagaatccatctctccttgatcggaagaaaattacagagcaggaccgaagtcctacacctcgttcaaaggacttgtctctctacttgacacatgtcttacacaattttattttcaacgatcaggccattgccgacgttttatattaagaataaggtgccccaatttaaggagtaaacaggaccaaactttacagtgtccagttaattagggaaaattgaacgaaaaccacaactacaacaccacactaacagctaacataacctaaattacaacgacggagcccgacacaaggcatcgaccaagcttgtcatagtggcgacacaacagcccacacatgttttcgttactgagcttgccgcccaaacgacacaacagcttcgacttcactgcaatgctaccctaacgccaaaagaacaagcataa

SEQ ID NO: 43397 - DNA, 1507 bp, Oryza sativa
aaggacatggggaaggcgctcctccacttcccggcgtccctccgatcccggcgtcggacatgccgcacaacgtgctcgactgcgcggacgtgatcggtgcttcgctggtctatcactaccgccgcatgccggagccggggcatgctgatcaacacctacgaatggctggaggcgaaggccgtgacggcgctcggggacggcgcgtgcgtgcccgaccgccccacgccgccggtgtactgcatcgggccactgatcgtgaagggcgaggacgcggcgaaaggagagcgccacgcatgcctcgcgtggcttgacgcgcagccggagcggagcgtcgtgttcgtcagcttcggcagcatgggcgccgtctcggcggagcagctgaaggagattgctcgtgggctagagaattccggccaccgtttcctctgggtggtacggagcccaccaccggaggacccggccaagttctccctgccgcgttctgaaccagactgggtgctctgctcccggaggggttcttggagaggacgcgggacaggggaatggtggtgatgtcgtgggcgccgcaggtggaggtgctccggcacgccgcgaccgccgcgttcgtgacgcactgcgggtggaactccgtcctggaggcggcgtcggccggagtgccgatgctgtgctggccgcagtacgccgagcagaggatgaacaaggtgctcttggtggatggcatgcagctcggagtggtgatggacggctacgatgaggagctggtcaaggccgaggaggtggagaagaaggtgaggttggtcatggagttcgaggaagggaaaaaactcagggatagactgacaatggcgaaggaaatggccgcgaaggcgctggcagacggcgggtcgtcgtcgttggcgttcaccgaatttctgaaggatttgaactttggaaacactacaaaggaaaaagcgtagaagacgaacattgagcagtgcaaacgatcaagcacaaaagatgaacattgagttggaatgatttatattgctgctggaatgtgacaaaatcacatatctgcattatttacccgctgtgaactgtgctatttttctgtatttctgatgtgagcagaaggtgtgagagtttcttcaggctgattagctgcttcagcagtcagcacttgtagattacactctggagccgtgcttacatgatggaatagtattatgctctatcacaatatgcaagatcaatgttcctcttctactttcggtttgttaatatctggcaattaagctgagcgtgtagagaataccacatggtgcaaaagctctgtctcagtaggctggagacttccacacttcagtagactcgtgtgtacaacggaaactattttcaccctcgaggggatatctactcgttgtttacatgtcactcaaatggttataaaaaaattaagaagatgtattaacatgtgatatatcactctacaaatatgcaagttcaaattcaacttctacaactcgta

SEQ ID NO: 43398 - DNA, 851 bp, Oryza sativa
atcaaaactccacacaaccatcctgtacaacgaccattgcccgaccaccacaccatccctttagcacctaagcccaatccacgaccatcgccggtcaccaccacgcctacacatcccgccgctggtcacagccactcgtcgcgctgggcgtgccccgccggccatggatgcacttgctcatgcctccgcccgccgcatcgcatgccacgccgacctcccgctgccgtcggcgccacctgtgccgcgccagcctccctccgtcacccctcatcgtccagcctccccctacacctcaagcaccgccgtacctccacacattctccttttcactgcctccggcgccactcactgacgtagacgcgggcctcacaggctggactccccatgcctgatgccgtcaccgagggccacatctgccgcctgccccttcaccacgtgccaccgcgccctcaaccccgccgccactgcctcctctgctgtacctgtctcgtcgtcgggagctggccttcctcgccggagaggccagatctagtgggagggagggaggggggcgccggatccggcgagaaaggagccagatccggcggcccgtgtgcaggcgagccccgcctcgccgtcgggatctctacggctcgccgccgcctcctacgccccgccgcctgccggtcacctcgccgccggcacctcttgcgcaaatctttgaataggctaactctcttttctcttcaattccccatatttcctcttctcgctcacgtccgaccagcagccttggagctcgcggctggctgccgttgtcaccggaatcgagtggcatccacaatgtgtcagaggaactgggctgcaggaat

SEQ ID NO: 43399 - DNA, 16381 bp, Oryza sativa
  unsure (1)..(16381): unsure at all n locations
caatttcactgaggcaaactttttgcggttcatggagatggattcgatctaatcgataacccagcttattccaaaccaaagatttttctcgcggcaggtcggcaggcaaatttgactctaattttcggctgtcctcatgagcttgatgccacagggcacgagcgcgttgcgcttggtgctcgggcttgagtgcttgaccttgacgcctcgccgacgataggaagatagataaatgggaactggagagatgagggagaaaggctattctgagattcatgtgggacaggtgtcgtgcagaggaatcaagtccttcagataagggtaggacttcagtcctacgcaattttcttccaacttgattacctgcatggttacgctcactggattaagactggctataaataggtagagcacgatcacaaagagagttcagcctttattatgttctagtgcctcgccctcgccgccaccgccggcatactccaagctcgtgcccagcttgacagcaaagctacaagtacaacccatgccaatcaatgaactaagatctagcatagattgtccataatttcgcagttatcgctagctaatgtgtgtcgctgtcgccgactcgccgtaggtttcatcagcgtagactgtggcctcccggggaagacgagctacgtggacgacaagaccaagatttcctacgcggcggacgacggcttcaccgacggcggctcgttccacaacatctcggcggagtacttcgcaccggcgctctcggcgcgctactacaacgtgcgcagcttccccgacggcgcgcgcaactgctacacgctccggtcgctcgtggccgggcacaagtacctcatccgcgccaccttcatgtacggcaactacgacggcctcagcaagctgccaatcttcgacgtctacatcggcgtcaacttctggatgatggtcaacatcacggaccccgccggctcgacgctcctggaggccatcgtcgtcgtgccggacgacttcgtgcaggtttgcctcgtgaacaccggcaccgggacaccgttcatctccgggttggacctcaggcctctcaagaagaagctctacccgcaggcaaccgagacgcaaggcctgtccttgttcggtagatggaaattcgggccgaccagtaataccgaaatcatcaggtgagtaacgatccatccgagtttgagtcctttacgtgcatgttgatttaaccatttaggtgaaatttaatgtgacatcccgacccagggcttaatagaattaatagaatactcataccaacaagttatagtttttttcggaagccgatctcaaaagaactctgaggttaatctggagtaatttcaggatgggtgaccgactggaaaatttttcccaggtgcgcacgagtgaaaattgattttagatcatcgaaagtttacgtttttgattccctggtgcgcacgagtgaaaattgattttagattatcaaaagtttacgtttttgattctgtagcacctaaagtatgccgtttttacttccgttacttctctctcttctgccgtcaaaagaacagccgatcacatctttccagatcaagtaacccaacagtggcagacccagcattttaatcctgggtgtacccgtttcacaagacaaatcaaagcctctctacacgctaatacaattaaggcatcagtttatcaagctattagtacgaatagtatattggtgttggaccggtaatgcatcctgagatggaattgaagaagaatggaacgacacaaattgcaactaattcctgttttctttagttattattcctccatgttctgaatttgctcatcactatgacaagagtgaagcgctggacatgctagtgtctttaggtatcttatagatcgatttcagggttcgaaacccgtctattcattgggccatgttgcaccacagatagagtcccggccggattctcggctggagaagcatgccacgtgttcgcacctatccgcagccgtccgatgatatattaacggtgaaaaaacgataacagacctaaatgtaaatcgatagttttgagaggttttttttttttacaaaatacgtaatctcatctagaacagtcgtgggagggtgataatgggcgggtgatcgcccccatccccccttatatgctcccccttcctcctccccttcttctcttcctactacaccataaattttaaaaaaataaaaaaataaaagttagaaaaggttatgtatagaaatactatatataaaaaatatttgaattcaaatttaaatcgggtatataaatttttaacttataaactttggatctataaactttaggtgtatgaactttagatgtatagaaatactatatataaaaatatttgaattgaaattcaaatttgaatcggatatataaacttttgacttatgaactttgggtctctaaactttaggtgtataaactttagatgtgtaaacttgaggtgtacaaactttaggtccataaatttactaaaataggaaagtaatgtagtaaaaaaaagaaaccacgtggaggagagggtgatcgatgtggggagggggaccgatcgtgcccagcgatcgatcgcccgttaggactttcgacagtcgtgagcagaggaaaaagtacccgagaaatgaaaaggaatccaactaaaaaagaatccacgccactgtacctgcttcaagcgacgatgaggagggggtgatagcgggttgatatacgcgggctgcttcgcctaaacatgagccgtataagggggaggcgagaggcggtgacggcggagggagatggaagccctcttgcgcctggtctcctcaatctgatcgcgtcgcctctctacgtcctcagcggtgcctggatgttgaggccgacggcgaggggtattcactggatcggccagtggcgagcggagtaatcaagcagccagcctcgttcgcttgtcgattacattcatgacgaatgccaagccctcccatgggcatggcaccgtcggtgagaaatttgataatttaatactttttttcgttgtccaattgctctaattgatacttgtgaggatgacatgtaagactatctgagtaaatgaaattaggtcaagatgtcaaataatggaagcccattttaataaatgttaaattatcaaatagcaacgatagtggtggtggaggttgtcgtccctccaaacacacgcgcgcgcaacaaattataaatatgcatattttccccataatatccatataatatttataccgatggtgtactataataccgataaaacaagtgtcaattttaatagaatagaatggaatcattggatactacctctgtcccagaatacttgtcgctttgagtttttatttataacttttgatctttcgttttattaaaaaattatggaattttttttatgatttgctttattatcaaaagtactttttaagtatgacttctccgtttttatatttgcactaattttttaaataagacgaatggtcaaacgttaaaagaaaaaaagtcaaagcgattactaggacggaggtagtaattagtatgaccaccctaatatacggtagtatggtatagtataaatgacctcagtttgagtttcggatgacagaaaatggtttacattttcagcttttgcctgttggccggtatacactggtgaaaataatcgatgaatagtcaattcaaggtgctatattttcaagagattcatgtccaggtaccccgacgatccacgcgacagagtatggacaccttgggactcgccatcaaattggaccgagatatcaacgacgaggccggtgcagcagacatacgacgacctgttcgaggtgccaacggcggtgatgcagacggctattgtcccaatgtttgccacagacaacatcgagctcgcatgggtagcctacacacagcccaaggacccgtcgccggggtacatcgccatcatgcacttctccgagctggagctcagcccccccagccgtgatgtgcgagaattctacatcaacctcaacggcaacatgatgtacagcaagggctacaagccagtgtatctctacgcccacgccatctacaacaccaaccccttcctacgatacccgcagtacaatatctccatcaacgccacctataactcgacgatgcgaccgttcatcaacgccatggaggtgtactccgttttctccaccaccaccattggcacatatggtcaggacggtatgtacatagacgatagagaacacacacacacacacacacacaagtgaaatggcctaattgttttggcgcgtgttactgatcgaaatcatctttgcacttgacagcttctgccatgatggtgatcaaggaaaagtatcaggtgaagaagaattggatgggtgatccgtgcattccgacagaatttacatgggaaagtttgacatgcagctatgaaaactccaaacacgtaataaaaatgtaagtaattgagtccacacgtactgaatattggagttgcataacggaagtatgaaacagggtcatctgatcacattctctttgcagaaacctgtcctccagtggtttgagtggtgagatatcatcttcttttggggatctcaaggctcttcaatacttgtacgttctgagttgaataatgttaatttgttaaccttgtttgtaagaattttgcattaaaatttgcaaagtcttgcttcatatcttctagggatttgtcaaacaacaatttgacaggttcgattccggatgcactttcacagttaccttcattgacagtattgtaagtttcgcaacttctgtcaaattttactttattgcctagcatcatttgtattaacaaacatctacatataccttatgggcatatggcttctttagagatctgacaggaaatcaactcaatggttcaattccatctggacttctcaaaagaattcaagatggtaccctaaatataaagtaattaagtacaccacgttcttctcacagcaatctttgaatgtctaaactcaaccattttgagaaaatagattgatttgactaggcgtcttcattccatcaacagatatggaaataatccaaacctctgcaccaacgacaattcatgtcaggcagcaaaacacaagagcaagcttgccatctacatagtcgctcctgtagttctggttctggtgatagtatcagtcacaatactactcttttgccttctaggacaaaaaaagaagcaaggtgagggttacaaccatagcaactatctgctctatttctctgttcttgaacattactgatgctagttgctccattcttcgcttatgaaggatcaatgaacacttctataaagccgcaaaatgaggcgaactatgtgccgacaaatgacagcgatgggcatggttcatcaatgcagcttgagaaccgacgatttacatataaagatctggaaaagataacgaacaactttcaacgagtgctcggccgaggagggtttgggaaggtctacgatggcttcttggaagaaggtactcaagtggcagtcaaattgaggtctgaatcttccaatcaaggtgataaggaatttctcgtagaggtagaatttcgtcagttgaatttgatcttgctacatagagatttctactaagaaaagtccaagtaattagttaacatttgcttgtttaggctcaaattttaactcggattcaccataagaaccttgtctccatgatcggttattgcaagaatgggaaatacatggcacttgtctatgagtatatgtcagaaggaacccttcaagaacacattgcgggtacgtatttatgtttttgttcccgatcaagttgcagagtactccttccattttatattttaagttgtttgacttttttttcttagacaaacttctttaaatttgatcaagtttatagaaaaatatagtagtattttcaatacaatacaaacttattatcaaaatatattcaatgttagatttaaagaatctaatttgatattttagattgctaaatttttctataaacttgatcaaaaagtaaaagtcaaacgacttataatatgaaacagagggagtacactgtaaaacatcatgtagtggatcattttatagtcctcatggtctcacccctctttgttctctacctatttgtaggtaaaagaaacaacgggagacatttaacctggagggagaggcttcgaatagcgttagaatccgctcaaggtaactactttaaatttgtagtagtgctacttgaggtttgattttacattttctctaaaaggttggctagtagttaaattctttggttaatggtcagggctagagtacctacacaagtggtgcaatccgcctcttattcatagagatgtgaaggctaccaacattctattgaatgcgaggctagaggctaagattgctgattttggcttgtccaagtcattcaatcttgagaatggcacccatgtatctacgaacacgcttgttggtactcccggatacgtggatccagagtatgctaatttatatgtatttcttgatgttgttctttagtattttctatgaggaacacaaagtttaaggtttgtggtactgattgaatgtgcaggtaccaagcaacaatgcaaccatcgaccaagagtgatgtctatagctttggtgtcgtcctgctagaactggtaacaggaaagtcggctgtcctacgtgatccagagcccataagcattatccattgggcgcaacaacgcctagcacagggtaatatcgaagaagtggtggatgcatgtatgtgtggcgaccatgatgtaattggtgtatggaaggttgcggacatcgcattcaagtgtaccgcgcaggtatcagcgcgacggcccactatgactgacgtggttgcgcagttacaagagtgccttgagcttgaggaggagcattgtgccgtcaatgatgcaaacaacaacttctacaccagcaataacagcaaacctaactcaagttatgacacatacgccgctgaccactctatcgatgtgagtcagaacagtgttgcatttgagatggagaaaaattttggaaggatgccatcaacagcccccggtcccgccacacgataaattcttttgcccatctgatctgaatgctgccatttccagggagatatctctatggaaggtttaaacaatgttgttttaccaaattaaaatacaaatgtacaaattaatttcaaaaactcaagattttggtttggaactcagaattcatgtacttgtctcctctttgagtggaattattgtcgcctactattcttcaggaagagaaacaccaatgtacctgttcattcatgtttttatggtaaccagaatccatatttctaaatgctgctttgcttagagctgggatccaaaacttttggaatctgcatagcttaccacaatttgtgtgcatgccttttttcggtttagctttgatgcaactgaaggtaactaggttttctcaccattttcttctctatcaatattttttttatctattaacttattaaaggaatagaaaaaagagcctccacgttcactctcacagcctagaaattctcatattaatcggagaaaagaaaaaacagagtccatatagaaatataatttagaaatagttgaaattcggaattaacaaaaaggaatattggaagaggagactagagtccatatagaaatacaatttataaataactgaaattcggaattaaaaaataaagaatattagaagaagagtatagagtccatacagaaatacaattaaaaaaataatagaaattcagaattaaaaataaggaatattagaagtagagtatagagtcgatatagaaatataactaagaaataataaaaattcggaattaaaaataaggaatattagaagtagagcacagagtccgtataggaatttaaaactaactaaaattcagaataaacataataaaattaaaagtagagtttagagactgtataaaaatacaatttacaaataactaaaattcaaaattaaaaaaatatgggaagaagaatctaaagtcaatataggaatacaatttagaagtaactgagattcgaaattaaaaattaaagaatatgaaagatgagtttagagtacacatagaaatacaattagaaaaaaaataaaaaatcagaattaaaaataaataatattagaagaagagcctatagtctatataaaaatacaatttacggataacaaaaatttggaattaaaaaaaaattgaaagacgagtctagagtccatataggaatataatttacagatatctaaaatttgatattaaaaataattaataactaacacgtatataaaatacaatataaatattacacgcattagtagtttcgtaaagctagtacagaatttaaaattatgttgtccttttaatatattttaataatacattgagaaaatatatatgttattacatgagagaaaatataatgatactagtcgcacaatctgcgtgggccaccatgctagttttgtaaagagtattttttagctggcatctacatccaaccgatgtatgcagcttttttaaattgggaacggaattcgctcctacgaagatttgaactcaggatcttggggtgctactcagataactgcaagtactagactacatattctctatcaatgatggatgctaaattccttcttagtactctaacacttcttttcatttttttaaaaaatagagtaattttatagttctttagaaagtaccatgagttaccactttttcaattataaatttggtacctaggtaggtatcaagaggtaccaaactttacactaatttttttatctcatgatataaaacttctcaagaactgtaaaattgctaaataaaactatatgtatgtctacgaagagagtactagtttatacttttctgcaccgaaatcttgctagctaggggactttcaatttcgtagtactgcttttgttgaatcagtggagaacaaactcttctacctacctcgcattctcgcaattgcataataatctttctttcttttagataatgattatattaaacctgacctctaacctcatgagaatgtacataagactatcatgttattataggtacaacgtaaataagttttaaaaggcagacaagcaagaggaactaaatctttcatggcaaatgattctatctgcatgttttccagttcagagcggaaaggctaatgggcgggtgatcgctcccccacccgcccagcgaaaagttagaaaaatttatgtatagaaatattatatataaaaaatttgaattcaaattcaaatttgaatcgggtatgtaaacttttgacttataaactttgggtctataaattttagatgtatagaaatactatatatagaaaatatttgaattcaaattcaaatttgaataagatataattcaaattcaaatttgaatcgggtatataaactttagatctataaacttttaggtgtataaactttagatgcatagaaatactatatatgaaaaatatttcaattcaaattcaaatttgaatcggatatttgaattcaaattcaaatttaaaatgggtatataaacttttgacttataaactttaggtctataaactttagatctatataaactttaggtgtataaactttagatgtatagaaatactatatataaaaaaatatttgaattcaaattcaaatttgaatcggatatataaacttttgacttataaacttttggtctctaaacgttagatgtgtaaactttaggtgtataaatttactaaaataggaaagtaacgcggtgccaaaaaagaaaaccaggttgagggagggaggggggaggtggagagcgaatctgatcgctaccctatctccacggcgatccatagcccatcaggggtacccagttcagagaacaagtcaagcgcctatgggccgtggccagtggccaccgatctcgggcctcgagtcgtgccccagccaagcagttgaccagctgccatccaagtcaactacgtgcccatgtgatctgctcgtctttgctctcttcccgggcttgcagccttgctgacttgcagggtcattgacatgccggtcctacaaagaggtggccagtaaaatgtcagaaaaggcccactcgtcagtgacagtccacatatatgtgtgaagacggcgcttggcaagctatgttactagacagatgtgctgacgtggttaaactaatcacgatggagtctttgtgatgatcattaggctataatagtagtactagctggagtaagtgatagtaataagattattagcttgattacttggttattcactggaataaggctgcgttatttcaaatgagattggagagattgtaactcgttttccgcgcgcacgcttcccaaactactaaacggtatatgttttgcaaaaaaattctatatgaaagttgctttaaaaaattatattagtctatttttgaaatttaaaatagttaatactcaattaatcatgcgttaatggctcacatcgctttacgtatcttcccaatcttctcaatcacctctccctcaaacacagcctaaggttgcgttcgtttcaattaggttcccaactccctccatctcattttctgcacacacatacgcttttcaaactgctaaacggtatgttttttcaaaaaaaaaattatgtacgaaagttatttaaaaaatcatattgatccattttttttaaaaaaacaatacttaattaatcctacgttagaccgtttcgtttttagtacgtgggagatgggttcccaatacccaccaacgaacatagcccgaaaaaaaaaaggctagctataaatagctagagcacggtcacatagagattacagttctagtagctcaccgcctgcatgtgcaatggggcgttcaacgccgggaacaatggcggcatggtcgtggttaattctactatgcctcgtcgccgccgccaccgccggcgtgctccaagctcgtgcccagcctgatagcaaaggtacaaacacaaattttcatcgggcattaagtagcgcttcacagtgaaatcaatatgcacaagctatcatactttcgcagttgctaattaaatgtaaagtgaactccaggtttcattagcgtagactgcggcctcccggggaagacgagctacgtggacgacaagaccaagatatcctacgcggcggacgacggcttcaccgacggcggctcgttccacaacatctcggcggagtacatcacgccggcgctctcggcgcgctaccacaacgtgcgcagcttccccgacggcgcgcgcaactgctacacgctccggtcgctcgtggccggcctcaagtacctcatccgcgccaccttcatgtacggcaactacgacggcctcagcaagctgccaatcttcgacgtctacatcggcgtcaacttctggatgatggtcaacatctcggacccctccggcgcgacgctcctggaggccatcgtcgtcgtgccggacgacttcgtgcaggtttgcctcgtgaacaccggcaccgggacaccgttcatctccgggctggacctcaggcctctcgagaagaagctctacccgcaggcgaacgacaagcggggcctgtccttgttcggcagatggaactttggcccaattagtactaccgagttcatcaggtgagtaattaaaagattcatccaagtttttttctagataatagaaatggtttacatctttgatctttaccattgggcacacacagttgaaaaagaaagatgataaatagtcaatccaagagggtacaatgaattgatcaaacggaacacaaccgattaatggccaggtaccccgacgatccacacgacagaatatggatgccttgggtctcgccatcatattgggtcgaggtatcgacgacgaggccggtgcagcacacggacgaggacgtattcgacgcgccgacgaaggtgatgcagacggcgattgcgccgctcaacgcctcgagcaacatcgagttcgcctgggtaccctacacgcagcccaaggacccggcgccggggtacatcaccgtcatgcacttctccgagctgcagctccgctccagcaacgccacgcgccagttctacatcaacctcaacggcaacatggtgtttagccagggctacacgccggcgtacctctacgccgacgccatcttcaacagcaacccgttcctacgatacccgcagtacaacatctccatcaacgccaccgccaactcgacgctgccaccgatcatcaacgccatcgaggtgttctccgtcttctccaccgccaccgttggcacagatggtcaggatggtatgtagatagacagacggtagaatacataagagtaaaacgtacggtgtgatggtttgtgcgtgttactgatcgaaaacatgggtgcacttgacagcttccgccatgatggtgatcaaggaaaagtatcaggtgaagaagaactggatgggtgatccgtgcgttccaaagacgcttgcgtgggataagttgacatgcagctatgacagctccaaacctgcaagaatcacagacatgtaagtaattcagtccacatgtactccctccgtccaaaaaaaaccaactagacacggatatgacactacatagtacaacgaatctggacatgagcatgtccagattcgttgtactatgttgtgtcacatccgtgtttaagtgggtttttttttaggacggagggagtactgaatattggacttgcataatggaattatggaagtatggaactcgcggtcatctgatcatattccttttgcagaaatctgtcatccggtggtttaagtggtgagatatcgtccgcttttgcgaatctcaaggctcttcaaaacttgtatgttatgaggttcagaatgttaatttgttgaccgtttgtggaattttgcgttaaaagacttgcttcatatcttgcagggatctgtcaaacaacaatttgacaggttcgattccagatgcactttcacagttgccttcgttggcagtattgtaagtttggcaactcctgtcaaattttactttattgcctagcatcatttgtaactgacatatgtatataatttatgggcatatggcttctttagagatttgacaggaaatcaactcaatggttcaattccatctggacttctcaaaagaattcaagatggtaccctaaatataaagtaattaagtacacccccactcttctcttagtaatctttgaatgtccaaattcagtcaatttgacaaaatagactgatttggctaaacatcttcattccatcaacagatacggaaataacccaaacctctgcaccaacgacaattcatgtcagccagcaaaacacaagagcaagcttgccatctatgtagctgttcctgtagttctggttttggtgatagtatcagtcacaatactgctcttttgccttctgggacgaaaaaagaagcaaggtgaggcttgttacaaacatagcaattatcaactctatttctctgtccttgaacatttctgatgctagtagttccattcttcgcttatgaaggatcaatgaacacttccgtaaagccgcagaatgagacagcgagctatgtgccgacaaatggcagccatgggcatggctcatcaatgcagcttgagaaccgacggtttacttacaatgatttagagaagataacaaacaactttcagcgagtgctcggcgaaggagggtttgggaaggtctacgatggcttcttggaagatggcactcaagtggcagtcaaattaaggtctgaatcttccaaccaaggggataaggaatttctcgcagaggtagaatttcttcggttgaatttgatcttgctacataaagattctactaagaaaagtatgattaattagtcaagttttgcttgtctaggctcagattttaactcggattcaccacaagagccttgtatctatgatcggttattgcaaggatgggaaatacatggcacttgtctatgagtacatgtcagaaggaacccttcgagaacatatttcaggtatgtacttaagttgttgttcccgatcaattcgcagggtacattgtaaaacttcatctagtggctcatttgatagtcctcatgatatctcccccttctgtgttctcttcctatttgcaggtaaaagaaacaacgggagatacttaacctggagagagaggcttcgaatcgcgctggaatccgctcaaggtaactactttaaaattgtaatactgtttcgtgaggtttgattttacattttctctagaaggttgatcagtcattacatttcctaactaataatcaaaactaaactacctacacaantagtacaatccacctcttattcacacagatataaaagctaccaacattctattgaatgcgaagctagaggctaacattgctgattttggcttatccaagacgttcaatcttgagaatggcacacatgtatctacgaacacgcttgttggcacacctggatacgtggatccagagtatgttaatccatatgtatttcttgatgttgttatttagtgttttatgtgagaaacacaaagtttaaggcttgtggaactaattgatgtgcaggtaccaggcaacaatgcaaccaacgaccaagagtgacgtctatagctttggtgttgtcctattggagctggtcacagggaagccggctgtcctacgtgatccagagcccataagtatcattcattgggcgcaacagcgcctagcacagggtaatattgagggagtggtggatgcacgtatgcatggtgaccatgatgtaaatggtgtatggaaggctacggacatcgcactcaagtgtaccacacaagtatcggcacaacggcccactatgaccgatgtggtggcacaactgcaagagtgcctcgagctcgaggaggggcgttgtgccatcagcaatgcgaacaacaatttctataccgacaataacagcaactctaactcaagttatgacatgtatgccactgaccactctattgatgtaagtcagaacagcgctgcatttgagacggagcgtaattttggaaggatgccatcaacggccaccggtccagctgcacgataaatcattttgcccatctgatctgaatgctgtcattttctgggaaagatcttcatggaagttttaacaatgttgttttaccaaagtaaatgcaaatgtacaaattaatttcaaaaactcaagatcctcagtataaaccctttcggttatgaactcagaattcatatacttgtctcttctttgagtggcattattgtcctgtactattctttaggaagagaaacaccaatttatctgttcattcatgatgttttgtagtaaccagaatccacattttctattttttctaaatgctctttgctttgatgttggaaataaactcataagcctagtgttgggatgccaaaatttatggaatctgcatagcttagtaggctagcataccacaatttgcatgcattttttttcctgaagggtttagtttcgatggaactgaagctaactttattcgccaagatggactataatctagtgactttactcatcttctattggtagtctaccacctgtctatttgcggtacatttagctgttattaaaaaaaattcctttgggtggatttcaggtggatggagtcacacattgtataccttcctaagaccttgttcggtaatccccatgagatatggattaaaagagattgatgaggaataattccacatgtattgaggtgtgccccccctcaatccccttgttggtgggattaaccgaataaggcctaagggagaacacaaaagtaagatccatttgacagaactctatgtgcatgtacttgaagtgaaaatgctaatattttccttcaatagagttataaaaggatgaatgctcaattattgaacaagaactttctagccagcctttgacttctttaaggagcccatcccttactagggttggtatgcttccagatccagtcgtggggaactccatgacgagtggagtagtggtcccatgtgcgagaggggtcggagggggatctagcccttttgagttctgactagtgtgatggtcgagctatgctaggtcgtgagatgtcgttgtgcagaggtgaagtgttgaaggtggcccgggggggggggaggggggggctgacaaagaggcgtatggtggtgcgatgtcacgcccagccatttagcccaaatttccagactattt

SEQ ID NO: 43400 - DNA, 2220 bp, Oryza sativa
gcagacgtgcaaggggaacacaaggacggtttgtggctatttgcataaaggcggttgtaaaacattttattgagcgaaacagtaaaacagttgagtaattaaagtaatattgaatctccactgatcaacgctacaccacgttgaacaggcccaaccaacccacctgaactacagtgcattgggtcgatttattaaggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaattgccatgggtgcgactagcaaaaccatgcacccacagcccaccattcagttgcattttagttggataattacgaccatgaagcatggccagatgtctcgagcacgcagctcatcaagatactagaatgtctaatactgcaattatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaaaaccctgaccccatgtaattagcaaaacatgcatatttgtttgcaaacagtaaaacatttgtaaattaggatcaaaatgctcaaggggaatgtgtgacttgccttgcttctccactttgatctcccgaactcttttcctcgcgaccgcggacttccgaaacgacggaaactacacgctggcacgcaaaacgaggaaaaactctaataaaaaccaaagaaacagtacataaaaagtaaacaaacatgtagagctcaattttagatgaattttgcaatttgaatggctcaattcggagttcgaatgaattagatatgaattttagaagttttgagccatttaaatgaatttctagaattaaactcgatttattgcgcaattattatttatttttacaaaggaaatggtccttgctgacgtcagcaaggggcggccggcgccgacacgcgggccccacacgtcagcgagtcaaagggggagggcacacggtggaccgcgtccaccgcgacctcgggcgcgcgtccaccacgtggacggcccagatcggccaaggccgatcggacggcttggggacagccgggtggcgcggcccggccagcgctcacacaaagcgggcggcggcggcggccgggaccgaagcgacggcggcacacgggctgggcggccaccggcggcggcacacggcgcgcgcaagcacgggaggcggccggccaaggggagaaagagggaggggagaggagtgctcaccgagggcggcgacggcgagacgaccacggagaggcgaccggcggcggaaaggatggcggcggtcggcacgggaggcgacgagaacggcgttccgatgacgcccgaccacggcggagccacggccgagggacggtgggatgcagcgaatgcggtggaggcggtggcgcggcgtgaggtagatggggatggcggcaagaggcggccgacggagggaggcgagatggcggcagcgcgagagaggtggtgcgcgaggcggcgattttccggaggcggagaggggagatggagtaggggccggggtagagcttggcacggcgttgccgacggcgcaagcggcgaggtgcggcgacgactaacgtggcggcagcggccggctgaaggcggtgtgtggcggtagtggctcggcctcgcgatgggaaggtggttccggcggtggaggagggagatggagtggatgccggggtgcggtcgggtgctgtgatgctataggtggcggcggcacagcgcggcagcgacgggagcggcggtggcgggcggggctgcagg

SEQ ID NO: 43401 - DNA, 27930 bp, Oryza sativa
  unsure (1)..(27930): unsure at all n locations
ataggggaggggaggcgggatcgaggccggacgtggcggaatcggccggcgaagtggggcgccgacgtggggtggtggaggggttaaccggcgccgattttcgcggggagagtgggggaaatggtggagggacgtggaggggatcgtgcccacgtcgttggatgcgagctcgggtgcgggagggcgccggattttgcggcgacgtggacggctatggcggttggcgtcggccggcgagaggtaggaggaggagctgacgggtgggaccgccggtcccacctgtcggcgaagggagagaaggagggacgcaaaacagacttttgcgagcgggccaaggaagaagggagccggcccgagagagggaggaggcgcgcgggccgcgggagaggaaggagggggaggaatttgggccgaaaatggcccaaagagatgaaggaggattttatttgttctctttttattttaattgattaaatgatcttcgtgactttaaaactatttctcgagctccgaaaattcacggaaaattccggagagtacattagggcacaaagaatattacaaaatattcccggccaatgatttttaagggaaaattttaattctcccattattttacttgattaaattgatttaacttttatttaatttctagaaaatgcattatttaatgatttttaaacccgaacgaaaatcggggcgttacatgcgacagggcacattgttggtgcaggttggatagcgggagaacatggggttacgatgttagggtggtcgcaatgccttaatttgggtgcctcatttcccccatggggcattgctgagaaacatccatctctcccttcatggtgggatcctccaggtaaaaatcttgtctaggtcttgggtgggcgggtgggcgggcgggcgggcgacgtggcgacgtcacgaccttcatggaagcatatattgtctaggagatcacattttctatctttctagtctccaatcgatttggtctacgatggtactctaggatgtcttcaggttatgcgagggatgagttgattctcttctttctgactctctcccataactacctttttcttggggatgttcagaagcttgaagatgatattttgtttagagaagagtagggcgatgcgtttgtcccccctttgaagggttgacaacaacagatcgtgcacaacggtggctagctggtattaataatttgtgtgtataagtagccagcatggggggtggtgtgtttttcttttttattttcttagattatagcctcacaggatataatcttaggatctcatcttttcgcttatgcttatacttatcagccacaattttaatttttaaccttaaatttgaagttgatttttgaggtttttttcatcgaagtttatttttcagcctttgctttcagatcgctaagaacacatatataaaagttttattcacaaactacttttcgtttgcgaatatgccgtataagcgaaacgatgggaccgttatattttttcctactgtatagatacgaaactttgcaatgtctagtatggaggttgttttgaaaaaaaaaaggctgaagtgataaactagagtagtagagcctgagttccagctaagtcgttgactaactcccagcaaagtcaactacaggatcatccatgtgatttcctgcttcttctgactataaggtttattagtgcaaattacacaaagtggcttcttagtccactctaaaatcaaactgaacagagggattgccatggttacctacagttgtaccatgttaattaaatggcagagccccactaatcagcgttcatttgtctacttaatttgttcttcttcgcgactttgaccgtgttcggtgatgtccaagctgtccactggccgatgcagttagcgaatttgttcagagtcaatctttgttgtttaacacatactatgtcaagtctaattgcaactggttggtggcatgcatgtgcgcacaacgcacgtagcggaatggatcgaccaacaatggcggctcggtggtggctgctgctgctgctcggcctcgccgtcgccggcgtcgttcgcggccagggcggcgcgcctgacacgtccggtgagctttaaacttcgatcgccaactcgccggcattttggactcgtgtacatgctgttcatgcatcgggagtaccgcgcaggcttcatcagcatagactgcggcttgccggagaagaccagctacgtggacgacgccacgaagctgaagttcacctccgacgacgccttcaccgacgccggcacaatccacaacgtctcgtcggagttcgccacgccgacgacgaccacggacaggagcctgtacaacgtgcgcagcttccccgccggcgcgcgcaactgctacacggtcccgtccgtcgtgccggggtccaagtacctggtccgtgccaagttcttgtacggcaactacgacggcctcaacaagccgccggtgttcgacctccacctcggggtcaacttctggcagacggtgaccgtgccatccgccgactggctggggaacgccgaggtcatcgccgtcgtgccggatgatttcttgcaggtctgcctggtgaacaccggcgccgggacgccgttcatctccggcctggacctgaggcccctgccgagctcgctctacgcgcccgccaacgcgacgcaggggttggtcctgctcgaccggaggaacttcggcgcgagcgggagcaccgtgatcaggtaccccgacgacacgtacgaccgcgtgtggtggccgtggagcaacccgccggcggagtggtcggacatctccacggcggacaaggtccagaacacgatcgcccccgtgttcgacgtgccgtccgtcgtgatgcagacggccatcacgacgcgcaactcctccattcccatccagttctcctgggacaccaaacccaatcacgtctaccctgatcccgggtacaagtcaatcacttcttaaatttgtcccaaacttcacggcctaatgagcaattaacgacaatttttttttcaaatttcaattgtaattgcatgctgaattcgtaattaacccttgggtgtctctacaaatataggtcgatttttaccttgtatgtcaccgagctggagctcctggccggcaatgccgttcgccagttcaacgtcaccatcaatggcgtgatttggaccaaagccccatacaagccggtttatctgtccaccgacgccatgtacaacggagatcgaccctaccggggcatcacccggtacaacttttctttgaacgccgcgggaagctccacgctgccgccgatactcaacgccgcggaggctttctccgtcatctccacagccgaccttgcaacagacgctcaggatggtaaatatttttctttgtgcgtgatgatctgataattgcgcctctttgtgctgtgttactgaacaaagataatgcatgcagtttctgccatcggttgattggtacatttagttgtctttatttgtgatttgtgaatgatctgataactgtgctccactgctcctttgcactgtcactgaaacaatgcagtttctgccatcactgcaatcaaggccaagtatcaggtgaacaagaattggacaggtgacccatgcgctccaaagacactggcttgggatgggttaacctgcagctatgccatttcaacccctccaagaatcacaggagtgtaagtttcatttcagtttctgcacaaacgcaaacaatgctatttcaaaaactctgctttctaaaccattgtgcatttctacagaaatatgtcgtatgccggtttaagtggcgatatatcatcttatttcgccaatctaaaagaaatcaagaatttgtaagtaagaagtttttaatccatttttacaatgattttggagttaaatttgcactttatatgcgcctatattttatttcagggacttgtcacacaataacttgacaggatcaattcctaatgtcatttcacagctacaatttctcgcggttctgtaagcagtccgatccatgttgacatctttctctaataatttagtcatacaattttattgccataagtcataatcaccactctaaaatctcgatgttctgtaagttcataaattttgagtaagcatgtgcctgtgaaaatcaaatattgacttcaacgttatgtatatgtgatccagagatttgacaggaaaccagcttaatggatcaattccttctagtcttctgaaaagaagtcaagatggctccttgaccctaaggtttttccaatatttcttttgcacttgatcaaaattgttaaaccatcattcaaaaaacaaatgttcaccatctcttctttttgataggtacggcaataatccaaacctttgcagtaacagcagttcatgccagctcccacaaaagaagagcaactctatgcttgccgtctatgttgctgttccagtagtggtgataggagcagttgcagtgttcctgattttcttcatcaggaagaagaagaacaaatgtgagctttggcattaaagcgcatcaataatcaagtagtactaatcaacttcctacatgtaaatgcaattaacagtcgataatactggtttcattttgcctggacagcaaagggtgctgtgaagccacagattttggggaatggcgtgcagtcacacagtcagaatggcagtggagggagcctgctggaactgcacaaccgtcagttcacgtacaaggacttggcagtcataacgaacaacttccagcgagtccttggcaaaggagggtttggccccgtctacgacggcttcttgaaggatggtactcatgtggcagttaaactacgggatgagtcttccagccaaggatatagtgagttcctgacagaggtaatgcttgatcaagaatagtatatctatacagcttttaaatgatctagtgatgatgacagtgaatatgttatcccactaatgctttttacaattggcatattatatattctgatactatggaatagttcaaacatgtgaatacagaaattcatagcaaagcatcagcattttgcaagtgaatgatgaaaactttcttccgactctagaaggtgatcttttttttccttgttcaggctcagactttaacgaaaattcatcacaagaatcttgttgcattaatcggttactgcaaagatgagatacatttggcacttgtgtacgagcacatgtcagaaggaactctggaagataagcttagaggtttgctaagtatttcatttgtatattctttttaactaaggaaagagactaagtcatagcctttgcacaataaaaggtacagaaaaccatttttcataaacaattaaaacacatattcccgaatttcaatatgaatgatattttctctttggaagaaaaatacatttacgatcttctgatcgacaggcaaagatcgcaaaggtagatctttaacatggagggaaaggctccgtatcgtattagaatctgcccaaggtacacattctagcacaatagttctatgttagtattattgtatatggatcatactgatattgagaaataacaagaataccctttttccctttgcaaaaatgttgctcacaggactagagtatctacacaaggcatgcagcccacgcttcgtgcatagggatgtgaagtcatcgaacatcttgctgaatgcaaatcttgaggccaaggttgccgattttggcctgacaacggcttttaaatgcgacggtgacacacatgtatccacagtcagggtggttggcacatatggctaccttgcacccgagtatgctgatcttactatgcatattaccacgttctagttgccttgatgattattgaccaaatagtacacttcatagtgatatgttttgtcatggcacaggtatgccacagccctacaagtttcagagaagattgacgtatacagcttcggtgtggtgttgctagaggtgatcacaggacagccgcccattataaagctcccggaacctactactatcatccaatggacccggcaacgcctagcgcgaggcaacatcgagggtgtggtggatgtaaacatgccagacgaccgctatgacatcaactgtatctggaaggtagcagatgtggctctgaaatgcactgcacatgctcctgggcagcgacccacaatgactgacgtggtgacacagctaaaagagtgtctagagcttgaggaaaccagctttaaaggcgacacgagtagcagttatatgtcagggagcagcatagacccaaactcgagttataacacatataccactgagatgagctagggcaacactattttgggatgaagcataatcttagggtagtgccaactagggacattggtcctgttgcacgacaagaagcctgctttacccatttctatgggttcttactacattgatttgtacgtgtggtcttcaatgatggtcttattatttggcctgaggaagtacaaaatgtacaaatgatcaggctgttattgtgttaagttgaaggtttgtgaaaaataagtggacatgcatgcatgttgctcataattttttttaataatgaaagctttattaagactcagtcaaatataccaaaatgatagcaactactccctccgtttcacaatgtaagtcattctagcatttcccacattcatattgatactaatgaatctagacatatatatatctatctagatttattagcataaatatgaatgtagaaaatactaaaatgacttacatcgtgaaacggaggaagtaaatagctttatttatgttgctcataaatagtgcctacaagtcaactccaacatatgttcgtgctatatctcgtggtttcacagaatttatatcatatatgccaacctagtgcaacctaggccactttgatgcataatgccaaaatttgggttagaacatactcccaatttgtgtttacatagtagactaatatgcaatattctgaataacggggaaactatgaaatttgtggcgtatatgaactgtgactttattgagttatatggagagtatatttacacttggtatttcaatgcacaaaagaagacatcagagatggatatagtaaaattttaaataattgtagggatgtttatgccagttgttaaatacttgtcacaacagcttgcaacgcttactcttttttattccttctatcctttgaatttctctgttctattttcctcgatttctttcttctccccttcttttatggccattttttttttgtgaccacatgtccacattccctgcccctgtactcatttttaattaattgttgtaactctaacgggatcttcaaaataagagtaattttaaatagggttgttcatcattatttttgcgggttcattaagaaaatgtcaaccttgtaatgttaatatgcttagttcattccactgccttgattagtggggcagcagtaccttgttatgcctatatacgttctaaagtatacaatccacgaaggcacgaacatcacttttcctggaacaattaatatcactatgtgacaccttcttcttgtgtactactgctacattatatgcttcgcctcaaaaatggagaggaaacgagaagaatatacattccactataccatggacagagatctttcaaaagaattatatagcgaagtggctagcagctgacgagctgtcatcgttgtcaactcgctgacgattaactcagctctcattgttgtcaactcgctgactattcctctcttagttggcatggcgtcgcggtcccacaaagaggcggccaaacaggatcgtgctatcccccaaattatctctgttgcttgtttagttaaaggctggctatatatgattggggcacctatagtcttattatgtatatgatctctagtagtagtagtagctagctgcatgcttgctcggatgctctttggagcaatcaacagcgagagcaatggccgcgcgatcatggttgtttatcctctgccttgccgtggccgacgccggcgtacttcaaactagtgcgcagcctgacctcaaaggtatatgctccactcttcgtccgccctcttgatctgcacgctcgcacatgtgcacagtttagataggcaagctagcgaatgacgatttgatgagcattattcatagctcagagtttgcattgcaggtttcatcagcatagactgtggccttgaagggaagacaggctacctggacgacaagaccaacctgtcctatgtcccggacgacggcttcaccgacgcgggcacaaaccacaacatctcggtcgaattcatgacaccgttaatctccagacggaactacaacctgcgcagcttcccagacggcgagcgcaactgctacacgctccggtcgttgacggccgggctcaagtacctcatccgcgccgccttcgtgtacggcaactacgacggcctcaagaagccccccgtatttgacctctacatcggcgtcaacttcttgacgatggtgaacatcacggggctcgacggtgcggcgctggaggaggccatcgtcgtcgtgccggatgacttcgtgcaggtctgcctggtgaacaccggcaccgggacaccgttcatctccggcttggacctgaggcctctcaagagcacgctctacccgcaggtgaccgagacgcagggcctgtccttgttcggtcgctggaactttggcccgactagtaataccgaaatcatcaggtatcgatctgagtgttttttttaaaaaaaagtaggtatcgatctgagttgatcagataaatagtcaacccaagatgctgaatccttatacgtgcagtgaatcaacgtactgattcgattgtgactaggtaccccgacgatccacacgacagagaatgggtgccttggatcaatcccttcgactggaccgtgatatcaacgacgacgatggtgcaaaacatagaaaatgacatattcgaggcgccgtcgcgggtgatgcagacggcgattacgccgcggaacgcctctggtaacattgagttcgcttgggatgcctacacgcagccgaaggatccgacgccggggtacatcgccaacttctacttcacggaggtgcagctcctccccagcaacgccttgcgccagttctacatcaacctcaacggcaggttggtgtataatgagagctacacgccgttgtacctctatgctgacttaatctacgagaaaaaacccttcctacgataccccgagtacaacatctccatcaacgccacctccaactcgacgctgccaccgatcatcaacgccatcgaggtgttctccgtaatgcccacaatcaatgtcgccacggattccgaggacggtacgtgcacatatatgtactctttcagtgacggatcattaaattttcgagcaaacttaataataatagatacacgctaatctaatactaaaagtccatcaaattttctctgaacactctcacgccgtcacgtgacgctttaattaattggagaaaattaaaaaataatctgagaaaaaatatatccctcgatctttcacttaaatcgggtctaatattataaaccgttagattagattaatcttaaaacaaaccaaaaggcgactacaattccacctctccatccattatgttccataggtacgtgcatacgttagtacacaacctttatattttttttatatactagaaaagatgcctgtgtgttgcaacgggtaaactaaaaaaatattagatgattaggatttagtttttcatgatatgagcccttcaaaaaaatatatccttagaaataaaaaaaaagttgtaaaaaaaggggaaaaaggcccattagaccctatcggcctgctattgcgcgcccggactatgaagcgtgcatggcccagtagtgttgcggcccgatatggaggccggctcgacacgggatctatatgagccattcggtttgatggacggcttggatcgattctaaatccatcaaaaccctaaccctaatcacaccttcccctcccatccccccaccgttagctcctcccctcctggcagcgcctctccccctcccctcccctctcccgaccagtggcgccgctcctcctccgccgccccctctcctcctcccctcaccggcgtcgccagtccctctcttcctctccctcctatctcgccgacacggcacgaagacaacgaaggcacaactccattcgcgagcggaaaagaagagagaggggtggagtgcggtagcttcccgcggtggatttgacggcgacgacgatgccggtggcgccggcttcccgcgtcggatccgacggtggtggtggcttcccgcgccggatccgatggcgatgacggtgtgagcggcttcagcgacgtttttattttatttttcctatttcgcttgattgtcctattggattttgtatctatgtctgtgataaattttcgctagatcgctcgggcatttggttgttgatgcggactctagatgattttcttttggtcttcgactctcatctcgaacgttgcggaacgactaggattttttttggagggggggaggggtggacggacgaaaaatgagtgcattgacggatgaggagacgatcgaaaagttacgaatattttaattagttgatatatagttgagataacaacaacaacaacaacaacaacaacaacaacaacaacaacaacaacaacaacaacaacaacaattagtgataataaattttaaataaaagttactttacaaacatagaatatatcagcatataactctttacatgtagaaataaatgaattagctctacaatatttgaaaataaactttacaccattatattatattatgtacctattattttaaaatatttttaataagaatatttatccatcgattttcacataaaccaatggacctactatttagaccattagatctatcttttgtttaaaaaaaagtcttggaagacctctctctggacatctgcacaatgcacatgtgtatctttgccgtcgagacgtatgatgaaatgtcatacctaaggcagctaaggtgatcatgaccactgcaagtctacaacgctactgcttttgccgaggcgaagatgtatcaaatcatcaatggatagttattgtttttttagtaacttaaaaacaaatcaaagatgtaatgtagcaagaagaagaatcaagcaccgcgagtttaatataattaatttctctctacacgtatataaacggggtgaagctagaaaaaaaacatgtgtcgcatacatatatatatcacacatgcaataacctatttacatgtgttaattaagaacatgctttgggaaaaagaattttggacgttgcgccctatacacgagggagtagaagcatggcgttgccccttatgtaaaataaataagtagataaattttgataaaatatggtctataggactatcacaagatgatgggtgaatagaggataccaccgagcaatgagcgggccgaaactaatgacaaatagtttacatctatatatgaccgagtgatgctatgatgtgtcagttgtacgaagagtgtttctttgattatgaatatgtgcttatttgaattttaaaaaaataggcaaaaaaatttcttttgttaagtagtcatggttgcatttacaaagtttcattcattatggtgacataaatcatattgaatttaatgattataatttacatgcatgacaaaactatattcttatataaccgtattacatggtagaaataaactttactataaaacacttcaaaatttatgagtaaactgcacatactaattaaatttatatagttatggttttatttcaaataaatattgtttcaaacaaaataacctaacatgcgaaaaagaagaaattaacttcaaactgatattttgcactaccaagctaagcaattgtgtaggtgtttgtgtgcaccaaaaccctttaaagttatataaaactatggagaaaatattgttgaatttatatagagggaaaaatccaacttttaatctatctttaatttgtttgtcacacgtgccttcatgaggcgatttaatcacaaaaactttgagtttgctgatctcgtaatttttgtttgtagccatatttacatggtatgtgcacaaaatggtatgcatgataattagcttgcggttgtttaatatttactcgatacaaaagttgtatgaacttaattcatcttctattcaaaagtcgatgaatggtttttgagatatgttaaaaaaatagatcccctttagtatgctatctattagacaatctctgaacaaactaaaatgttacctttcaacaatataaatgctcgcacataggcgcgagccacctttctagttcatatatctctataaattatttactattgacatgaacatatgtggtgtagtgaggcttatacttttctagtttgctggctaatatggttttcattagtttgtatatggttttgattagctaatttggtaaacaactaaggagtacttagtacttcctccgtttcacaatgtaagtcatgcgcatctagattcattaacatcaatatgaatgtgggaaatgctacaatgacttacattgtgaaacggggggagtagtattcaaccagttgcatgcaacagagtccatgcaccttcccgggagtccatgcacctgcccattgtggccaggcctcggctctgctgctgttttcttctaaggtcatctccagtcctaagttcgatatgcaccgctaatagaaacgaagttcaaattggttcggtagttctagcgttagcatcgatttgccaggaccacgtaaaatcagccatatcatttcttcctcatgcaaactgatgaagaaatggcttttttaatcggctaaatcgactcctcgactgagagtttcctctctaacaaatagcagccacatctcacggtgtatttggttcgggtttttttcttttttgccgcatgcacgcgtcgacacaacttcacgctagagatgccctaaaagaatgtaatggtggtgtcagcggatttgccacaccacatattgttttatatagttttccagctacacctcaccaactcttttatatatcttttacaaaccactccttgatgtactttcaaattacaaaatcgtctttctgcatattatggttatatgttatttatctctaaaatacaagtttattgtgcaaagacatcctcagggatgagttgttctaaaaacctcacaatatttattcccaacaatactaattcatatttatctatagcaagacataggtatttagctagtaggagtataagaataagtgagatcgacaggatgatggttaatgtgtattactgaaaacattgggcgcatttaacagcctctgccatgatggctatcaaggtaaagtatcaggtgaagaagaactggatgggtgatccgtgtgttccgaagacacttgcttgggatagtttgacctgcagctattccacttccatccgtccaagaatcactagcctgtaagtagttcacatctatatagacttgtcttcaccacaaagataaatgagaaaaaaataaagcagaatgcactgattaaatgtacaatgaaattgatatagatatatttgctccatgcagaaatctgtcctcaagtgatctaaggggtgatatatcgtcttccttcgcgaatctcaagggagtccaatacttgtatgttctaagctctttataagctttttttggaggggatttctgtcataaatatatatgggggaaaaactgggtccatgttttgcaggaatttgtcaaacaacaatttgacaggctcaattccagatgccctttcacaattacctctattgtcagtcttgtaagtaaaacatcaagatttgcctaattccaatttttatagcaccttttgttgtctcgtactaatactatatgattttgtttagagatttggcaggaaaccagctcagtggatcaattccatctggacttctcaaaagaattcaagatggctccctagatctaaggtcagcacaacccgtctcccaataattaacacaccaaccacgacaaaaacatagtgcaaatatttatcttatctttgagcttctttgaggtccttgggaagtactaagatgcacttaaaaactcttcattttttggtagagacggaaataatccaaacttatacaccaatggcaattcatgcaagcttgtgaaaaggaacaacaagttagtgatctacatagttgttcccatagttctggttatggtgatagtaccaatatatctaatactcttttacctgaaaagaaaaaggataggtgaggctttctacaaatccctcatcatgtggtttattaatagctaaggaatatccccaaccaaaattaacccatttcataggcatctttggcatatcaaggaccaaggagcattccacagacccacaaactgagaaggcagagtatgcttcgaaaactcgtggccacatgcatagttcatcactacagcttgagacngtcgggtcacatacggggaattagagatgatgacagacnacttccagctagagcttgaaagggaagggtttgggtgtgtctatgatgggtttttggaggatcacactcgagtggcagtcaagttgatgtttaaaaactctaagcaaggagacaaggagttccttggagaggtatatgttgttctcttttgactaattgttgatctttctagagtgaaaattgaaagttgcaaccgatcacttaggcacagattttaacccggattcatcacaagaatcttgtttccatgattggatactgcaaggatggggataacatggcacttgtttatgagtacatgtcagaaggaactctacaagaacacattgcagtacctaaaatatttagattctacgtgcatggtatggtacaacagctccaaaattgacccaaaaaaagaatgataatgataatgataatgataagccattgatattttacttttatttatctctagatcatttgaaatgcttttggttgatatgatacacttcatttactttgcctgcaatagaagaaaacagcaggagaagattcttaccctggagacggcggctccagatcgctctagaatctgctcaaggcaagtaatgctaaacctaatgctgctattgcttttcttggagacttgattttgctaaaaaagtgaatattgacatcgtgatgtgtagggctagagtatctacacaaaggttgcaatccacctctcatccatagggatgtgaaggcaaccaacattctattgaatgcgatgttggaggcgaagattgctgatttcggtttgtccaaggcttttaatcgcaacaatgacactcatgtttccacaaacacacttgctggcacacctggatacgttgatccagagttcgtaatcccatctaccttatttaatttggtcttccaaataccacttatagtttttctattgtttttctagtgcaagtactaatatgcattacattggctaaacatgtaggtacttaatgacaatgcaacccacaaccaagagtgatgtttatagcttcggtgttgtgttgttggagttggtcacagggaagccagccctactacgggacctagataacactagcattatccaatgggtacagcagcacctggcacgaggcaacatcgaggatgtggtggatgcacgcatgcatggagaccatgacattaacagtgtgtggaaggttgtggacatcgcactcaagtgcaccatgcaggagtctatacatcgacccacaatgactggcgtggtggcaatgttgcaagagtgcattgaacttgaaaatagacatctgaaagactacgcggccaatagtgaaaaccacaactcaagttataatacatacggtgttgaccaatccactaatgtgatccagagtaatgatgcgtttgaagttgggcataacattgcaagggtcccaacaatggccactggtcctgttgcacgatgaagttactttgttttcttatttgtcccaaatgccaattgttttttacggatatgtattggccttacgtgtgctacattggcaagaaatataaagtatttccattataaaaagttgtgtttaccatgtttttgtcatatggagttctacaagtttcctcgtgaagttatttttaagagcaagtgcagatttaaggcttttgattataacatgtccaattaagatgttcgagcatttaacatgtccaatttaaggcttttgattataacatgaatctataatgtgttttctatttatcccatatctactaacaaattgcccgtgtgttgcaacggaataaacaaaaacgaagattgcaataggtagggacaagttagatttgcgaggcaagtgtgggatatagggttttgtttagtctcatcaatggatatttttttgtcaaaattcagcaatgcagtgatgagtgtatgatggaagatgtcaaactatcgaaccaattacagactttgaatcgggatgacagacaaaacatagtgtaaacaaataaatgctataccttttatatgtagtatttgtataacagatagtgttggctcgcatagtagttggctattgtgtttcggtcactttaacctgattgtcatagtcacttcagcctaaataccagaagaaaatcatatgttgtaatcactaaaacataatcagacacggtcttatatagttacacgagatacacacctagatacgttgcacaccaggatactagcctattagaatttccacgtgatgaaagtcttaaataaggccagattcggacattaataggtatatggttccacgacacaccacaaatagtgtatcactccttaatatacatggtgtatatgattcctaaataatttgaacatatcattcagcgaaacgttactaaagagacaattccaactccaatcttgaagtctttgatgctgaataggaagatacaacataaattatgaaagtatataacactccaaggtaaagttagcataatatatgacatatttcggtgtgtttcacatttcaagtctactacctgctaagcgctaaccactaggaacattgctaagctcgcaatgcattgcataccttgccgaataacacttgccgaccgggccaggctgccgaagaacgagttttctccctgaccacctgaatcaggcaagacgtcgtctagcagcccatcaccgtggctgacacgatccaattgttgaatgttcttggtcatcatcttactacgggtagtcctcgtctcctcagtgtccctagagcatcgtcattcttcaggccggagccgaatcaggagtggaaatcatcgtcatcattcgtcgttgcccccatcatcgtagtctcgccgatctagtccagatctaatgccccagggctcggtgcagctagatccaaggggaggcggtggttctcggggtcgcatgactcttatgtgatcggcggtcagccagcgacacgcaggaacgccagaactggattcggccacacgggaaaagggagagagaggcggactcagtcactcagaattggaggcaacagacatgggccgggaggaaacgtgagtgatcgatgcgatgaagacgcactcacgggtaaaaagagaccgacggatgaaaattttcaggtgacaattgaaaagttatttttctataagtagagcaagtgcatatgttcgaacatttaatttcaatttaaggcatttgatttaaacatgaatctataatatgttctctatttaccttatgtatattatcactcatacaggataaggggggtatatctcttcttctaattccttcgatttgatcagttcatcggtaccatagtacctttgtcattgaatagatcaacgttgtacgttaaacaaacatgcacctcgtcctccacttctggacatataacatcccaagaagttattaaaaaatcatgttattattctcattcagaagagaactactccctccgtcccaaaatatagcaaactaggatgggatcccatcctagaactatgaatctgacgtagttctagaataagtctcatcccgtcttaggttaagatattttaggacgaagggagtatgaaacaattttgcagtccatcggacggcgctatacgttcatagcttagaaagtagcctgtatcgtgatctacaataacatatgtcctttattttagtctcatctcataaaacacaaacagggagttttaatctcgtcttggcatatcgcaaaccttggttacgcaacagagctaaactgtaggcggcctgtaaccatgccattggactgtctctcacgtctagtcagtgtcagcaagagtccggcaacccggctgaacaatggtaccgttggccatcacgaaagcgttgtcggatggtattggtaccaccacggtctcttttcccctggatgcatgcacccccgtaagatatttccgccagccaataaggaggcggattgaactctctaacatcgcacccacagataataaagcggctcctccggctaggaatccagcttttcagaagctccagagacggtcaggccccgcatgtcatccagtgcaaagcagttagtactccccccgttgtaccaaccaccagggccttgtcgtgacagcacaaagcgaagttgaaacgggaaaagggtaacgcacgttgcagcccaacttggtggccgaacaatgggaactcgccacctgaacgcaaccggatcggcgtcgtgcccgcacgcaaagcgacggcacacccgcacacaccccctccgttgcgccgggggcgagccaaccgaagcgaagctggtgtggctaaaccgtggtcgcgcgtgggcgagaccacgagagatccggtgaaaaagtggctgccgacttggacttccgcctcggtcgcgcgcccgcccgccaagttgccggtggtgccgcgcgtgggcgtacgagtcaaagggggccaaagggcgcacccgttgtttttcccctaatccggcggcgtttcgttttcagggctgggctggctatccggcgcaggctgatctgatctgatcggatcggatagctctcgcgctcttcgactagtcatgcgtccgtcccgtggtccttttgcttgatcttagccgcaaaaggccagcctgcgtcgcgtcgatgagtcctttcggacgactacgcacaaaccgaacgaaattcagctgaaaccgccaactgaatcgtgtaatctgaatttagaagccacgctgttaaacagtggatttttgtaagatatttttaggtagtgattaaaaacgattgacgctggcaacatgaatccgtgcactccctgttctctttttcagtagggaggaagctggttggcaggagataggaatcgagacaacttcgcgaagcctgcctatgatggcattgtactatgttatgccggggaccatatgggttatctcaaatttcttcgcttttactccaaaaccggaaccgccagggggaatgtttctcgtaccttgtctgactcagcgatggtgacattgatagatctctatcgatagccaagccgaagcaagaagaactatcttctccgagcaccaatcgtgtattccgtcgaatcgaattcgatcaagacatgcagtaaagcagctgatgactcgaaacctggtgattaaccacaggaagatagataaaaaaaagcatcgaatttagcataattaagtacatcaaatgtgataatatcacgaaacaggcagaggctattagcatattacactccatatctacactggtagataataataataataatcgaaaagcaagggtgctactagctccccaagattttcgaaaaaaaaaggcaggcaaacgcacgccacacttacagttacggattgctgtgttcagattaacttgcaccatatttgtttatgtacagaagaatgatgcaatttgcgaaatgatcatcgaattgaagtgaacttaattaatgaagctgttctgcgaggcgcctctgcatcttaatcgtcgccgccgagagagatgatgtctttgagcttgtcgggtgcttctacatcacaagctcggacacccacccgaaatccggcccgtcctcgtccgtcaccggcggtagcaccggcgttacggacgatgccgacggcctcaccttccggaggccgagctcccgcattgcgaacatcaactcttccatctccgcgtccgcgtcgcattcatcgatgccgtccacccacctccgcccctccaccggcgacaccggcggcgactcccagagggaggccagggtcgacttgggggagagcgacagcggcgagtcttccttggacccggcgcggagctcgccggcggtgtgcgcgaagaagcagacgcggcggcggcacgcgacgcccgcgcggcacggccgcgtgcggtagcgcgacgggtggagccagagctcgaacgtgccgtgcgcgaacgggcacgtgctgcccctcgggcacgcggcgcccggccggcggcggaagtccgggcacggctcgcccgtgtacgccacgcgcctcgggtcacgccgcctcgcggcctcgccagggtgcgcgtacgggcacgccgtccagtcgtggctccgcgcccgcgcgcaccgccgcaccttgaactcgtacatcatgaactcatcatcagcctccgcctcggcgtcggcctcggcctccccgtcgctacgcctggcggacaggtactcacccagcgcggcgaggagctcgggcgggatctccaccgcagcggggtcagcccaagagacggccagcgccgccgggtcgagcaggaggtgctctcggctcgccatggtgctcactactcactcacactaccttgtccactcccaacaccaccgaagaaaaaaaaaagaggaaactgtactttgaggtgacacccggtgtggtgggtggcgagtggcctttatagcaagcgcggcttggcgagaagcgccgttgggtttcggcggggagaggaggaaggcaaggcggtattgcgtagcatccctttgttggttgccgagctatcgggttagcgtgggtggttttggcgcgaggcgagggggtacgtgggcgcgcggggccagtacgtggagggtcgtggatgcgggtgctgcatgcccgccgccacgtcgcgtctcgggtggttttgtacggaagttttatcggtggcgggcggaggctcgctcatacagtcatactgaaaagtagtagtcaaaccttcgtgcctccgttgctttggggctaatcagaggtggtttgtttcactttccctaatgaggcaagtcggcacagtacagctagcagaggatgggggaaaagcagggggcagcttgcatcactgcttgtgtcgagtcgcgcctggtggcgagacacctgggcgtttccctctttgtttatgccacggcgagcctgtatgtgggacctaaagtttagcccctctctcccaaacacccatgtatatactactgtattgtactgcaacacggtgataaaaagcggctgccacgattacatcagctgagtctgtgagctcccggtgacccggtcgacaggaccacttcctccgtgagagcttcctcttactacgatttaacgttaccgccggattgttcggcgattggagcgcttcgctggtcggatatctaccgcacctgcggctaccttgacgccaacgacgggaaacgcaccaagttgccgaggcaagggacggataaagacggacgacctggcgcgctgcagcgccgcgcgggccggtgagcttgggtgggggcgtctgccttatccatggcgcgggggccgcgcggcctgttccgacatagctgatgcgtgaagcgtggtgtactcgcccacgtacgggcgccacaggtggttgggcacacgggaacagcgggaggcgggcggagccgcgcgccgcgcgggaggagcggataagcgagcgatgtgccgtgacgtgccgtgccgagcagcgggaatggacgcagcgcacggcacgcgtggtatggatgatctcgtctgcctcaaccgctcaaggtcccgcggttttttgctgggctgggttatgattaatccctcttttatcgcgtcagttgtaggctcatctgttgtgtgtgctgtttcacatctgacgaaggatattgttcataatcttcccggccctttgtcgattttgccgtttcaccgtgtctagccacttaccccgtcgtaactagtactcctacgagtgagttagatcattcattcagacaaaggatctgaatgttgcaggttgattctttctaccagtgcccaagggaagaatggatgtaccagattgccaatgcccagccacttgatgtgaaatggaccagagtacaccattatgagtgtatgaccaacaatgaaatgattaagaataacgattacctgtgctcaaaatggtccttaccctgaaaatatctaaccatcctgcagcaaactgtgatgttccggtgtcccctaaagctcaactgctcaaaacgtgcaagcctgttcaaggggccaatttggaactgctcagatctgggtgtaatcgttcatcgcgtactggtaggagtactaggtgaaaacaaatataataaaactacatatattttgattaaactattataaaaaatacatatttaaatatgtgtatcacagacctacaaatttagtgtcaaatttatcttagaattacaaattaaagtatcgtatcacaaaactacagatttaatgattaaattataaaagaactatatattttagagtttatatccataacatattaaagtttcaaaagttatagttttgtaataaaactgattttaattctgtagttttctaatataatatctaaaatctatagttttgtgatacatattttcaagaaaaaaaagtacgaattacccctctcaacaatagcagtcgtccgatttttaaccctaaacttcaatactaatttttttatcctgaactttacaaaccggacgaattaccctcctagatcgatccagggtggtttcggtcctacgtggatgcacacgtggcagtctgatcagccaaaacaaaagaaaaatatatgggacccacttgtcagccataacaaataaatatggtggggcccactatcagccaatcctcttcttctcccccctcctctttgcccctcccccctctccatctctggcgcatcaaggcaagtagtggagctcgtcgtcgatctcgccgcctccacggcgagctcgcaacggcgggcgatccgcgcacacgctcgccatataggaggagcacgagcgcgcccagcatggaggcggaaacgagagaggcgtcgccgctcacacgctcgtcgggggaggagtgcggtggtcgttcacggcgccggcagggagagtcgtgggagggtcgccgagggatctcgagacggcggcgagcagaaccgcctcgacttctccgccgtcacgctcgcctcacctcctccactacgcttgcagagccaacctcgccgccacctcgcctcgcctcctccaccgcctgttaggatccgccgcctcctccttgctcggctctcccgacggcaccacagagaaagagagagggaacgaggtggagagagaacctcgccgccacctcgcctcctgcgccgcgaccctgcccgctgcccgttcacgcacgcccgagagagaagagaggggagggggaagaggggtactaacaggtgggtcctatattttcttttatttctttttgctgattgtattttcacgtcggtgcaacgtgtagaagaaaaaccgctcaggattgagtcaaggggtaatttatccggtatcaatagtttgaggtgtaatatgtccgattttgtggttcggggggtaattcgtgttgtcgcaatagtttagggaggtaattcatactttttcctatttttaaatctgtagttttatgatatattgatcaaaatacatgtagttttgtgaaattactcaataaaattcaatgattgtgactgttttgcgtgcaaattaggagtaccgaaccaactaccacaagtgtagcgcagtgtagcacagtagcgaagccaactagccaagccacccccaaagtccaagctggcttcagtcaagcaggcgcatgagcagataaggcgcgcgccacgtccaccacacacaatggggacgttacccgtcgcccacaggttctcgctcgcctcggccttcctgccgcgccaccgccggccatcgccgtccgcccccaaccggcgccggcggcatggaacggtggtggcgtacatggagccgaaccccaactcgccgtcctccatcgcgggccgcctcatcggggctctccccgtggtgggcctcgtggcgcgcatcctgagcgacgagggtggcgtcggcggcgacatgatcgacttcgccgagttccgccgccgcgtcagcaagaagtgcaccgtcatggactcccaggccttctacgatttcaacgaacgccgcggcaaggtacccgtcgctcctctcgccgtcgatttcttcttctcaatgccaaaaatgatgcaaaaccaagcagaaatgccaaaaatgttcttttaattgatttggtgagcatatgttccgttgtttgacaggcaggagatcccttctacgttctgctgtgctgctggctggccgccgttggtggcgggctgctgaaaacggaggagatcttggaaggcgtcgcgcggctccgcctctccaacgacatcgagttcgaggaggagacgttcctcgacatgatgaagacggcaaaggaggtagccatgcttaattcagcaacttttctggaagaacatgtccctgcactgcaaatttgaatgcatactatatgtcctataaattggtccctaagagaagatgaattttattgcagaaaagagcaaagctgaaggctccggcgccacagataccaatggaagcgcgggcggagaaggccctggaggccatctacgtgtgctgcttcgggcaggacatggtggaagacgtggacgtgaagctgctgtgcaaaatgctgaacgccgtcttcccctccgtcgggaggcaggcggtcgagaggatagtgacctccatggcgaagcaggtggctgccggcgagaggaagggccccggcgtcaagaccgtgtccaaggaagcagcgcagcggcaactcaaggacctggaatttctcaagcagaacaagttggattcggcatgagcattgtgcagaacacattgggaaattttgtcagatagacgtcgtttttaggccaagaaacagaaattgcatggcttacttggccgtgtttgtcatagaccgagttttctcctaagatgtgctaggaaggtcagctatcgtagggaaatagaaatcagcatagattgcaagtttgcgacacagttgacgcaggccaaacaatggtctcggttcattagaattgcaatgtgagtgagctcagaaccttgtaagatgaagttgtacgttgtgacatgctcagaaaatgtctactgctacagtactttttaatgctacatgtgtttactaagaataaaaatgtaacagacgtggcatcgtttaagatggcaaaaccaacaggtgcattactttctactatcatcaaatctatattatcgtctgtacttactgtaatttaagccaaatatttttcaaaatgactctctaaacgtataatgaagtactttttgttatgcatttaacattatcacttttatgctatgtaattaaacatgaatttatatcagtcaaagtttacactaaaacacgtacaaagattagtaagtcgagcaacattttgttctaaactgggtcatcctgggccgcctaacgggccaaacatcacggtcagcgaattccggaagcccattacatcacacccatccatggaagcctgacacgtgtactccggtcacgcgcgtagcccaaaccaccacaagggccgcgtcggtggcggcgtccaggccgcccggaacatctcgccgtcggaacgacgaggcggcgcggcggctcgcggtgtccgggcggatccacgagggaacggcccctccgaggtcgcagcgatgccggtgaggcggcggcagccgcggcggagggagacgggtgcggcggagaggtacagggagatggggatatcggccgcgctgtcgcggccgtgggactacccgacggcgtgcggcgagatcgccgcgctcctccgaatcgggtacggcgacctccccaaggccgcccaggctctcgtcgccggcgacgtgctgctcgcgttccggctcctccctgagtaagcccctttctcttccaagctcgtgccgctccccagatgtgcacaattctgacgaatttccagtgattttgcactgtttctgtctagtggaaccagctctagccctctagcaactcgtgaagaggcattgctttcttatgttgatctgtccaattatgaaactttgtttgagcgggtaggcaccaagctcgatcaattaaagcaccgatcccttacaaattgtgattttgagcatacacgcttatgcgcaatttctccagataatgtgtctgtcgatggctatgtctataacagccgcgtccacctcactatcccactgacctgttgaattttaaggtcatgactcgtgcatagttcgaatttgttggaaaattgtgtacttttaggtcatgcattgttagattttttttggaaatgtgtcgtgcttgtcgctcataaattcatgatgtctgttaggacttgtgattatgtgttctattatagaaggcatagaactaaagacgaatggcacgcaaatgctcacttagcatgctatgtttctggcttaatgtcattgttctattatattggcagttggcacacaggagcttgtattaactcattttacccggtagtgtacagacaggatatgcgttaagcgcagctaatggtcttctccaagctgtagacggttccctaccaaagcaaaagaaggcgcatgctgtttcagagatcaagcggtctgttgatgcacataaacggcgagctagggttcaacaagatccaggtatgtgacaggctcctgtcaagtgtgttgtatgatgtgcatttacactatcatgcttactgatctgttaggatggtaaacaacgatttagaaactggtaaatgttgtctgtgctttcaaccttcatcatttttcaattgctaggatagatttcggcagttttaaactaatttacctactgaagctgcagtgtcctgtcaagatttaaaagaacaaatgtacaaatatttactaactaatggcagtcatcgtgatgcgttgttttgtgcccattttgcaggtgtaccacatataccatacgatgtgcttgttcatattttcagttttcttgacatgcgctccttggtagctgctggtcttgtctgctggtatttcttttttctcttgtccgtgtaattcattaagcattactttattgttgacaactatctatctttcttagaaggccttggaattctgctgcaaatgacaaccacctgtgggaaatgaattactcccttttcttcggcatctgccatataaactgcaatagcacacctacagctggtaatgtacagaacactgattatcatgtacagaatagcatttatcaagtatctccggatcctggttttaactggaaagaggctttccacaaaaagtatgcaggtaaggctattctattgtagataaatttgataaactacctaacttattcccaaaggctaaaatatcattcattaca

SEQ ID NO: 43402 - DNA, 5530 bp, Oryza sativa
taggacctctattacctcatacagtaagtacttttatttattgttaatagtagtgttttatgatagttttgaacccaacagatagataatgaagtctaaaattcactgctcatttcattgcagcaacaatttttaaatgttaaaatttaatgttttttcccttcttcactacaatgtgctgacagcattgttttatactttcctgaacaaggttgctgactacatattggacatcgctgatctagcagcttcatcgacagaaagtgatgatacagatagcgattctgaaaattatccccaggcacgcttttggtcgttgtcatagtaaaaggaaaacaatgtatacatcgacttgagatgtggattgtgaacttgttataactctttaatttctggtagttttctgagtgtggtatgtgcatcgttggtagcgactgaatgaaacggcacaccgagttaaaacttagaagtataagctaatagaaaagctctatcattataaggtatacccaccgtacaaaatggaagccaaataactgtatgacgcaccacgcaccctatagagccttaagactattgtttttgaagaatggatgctcactatagtacttaaaaaaactcaggtagcataacccatccataagaatcgtgcatttggacattatggaggccaaagcaaaacaactcctactcaacggtcaaacctctggattagcctacatcaaacaaccactttaccataggtcccaagcctttcaaatggaataccataaagataagtcacatattgatagcacttagtaccaacagcttccaggggcggaagttgagttaaacatgagtttgaaaacaggatatagatagagcatgctggcataattcgaattcattgaagttcagcacatcgcaactactagccacaccaaaatgtaggtatttactatcagtaaaggcatggaatcgtagccatcctttaaaaccgacaattagtgatcaggctggatgataaattagcatagtaccttctacggctcatcctacaatttctaatgcttcttgtttttcaacggacccttggggatcttagagaggcatttctcatcgaaaatagcatagtacttcttcagttcgatcatggccttctctccaaaagcatcgatttggtcctcatacttctcatacagaacaggcacggtgtacagtaccataaagactgcaagaaagaaaactgtagttggtaacagtgctaaatgtggtaacttgtacagttgttgtaccaaaataattacctatgtagaacaaggtcaggaaattgcagcagctcccaagaacagagagaacccagagacccacgacaaccttaataaagaggaccagcataagcaaattgagcatgtcgaagagataccattaaacaatgaaggcttaaaaaaaggtaatcatgttgccaatctgacatacaatcagaaatttcttcaggtcatgcccttgaccaatctccctcaaggtagcaaagcccctattgatctcaaatctcagtgagcgagcaacattaacagccaggtcctctgggatcttcacttcaggaatgttaggaggggacctaaaaaaattgcaagacagaaattacagccacaaactaaacatattcaccatttatgcattccacaaactcaacatattacagccacaagcttagaacgtgtaacattccaggcattgtgaccatcgactacagatccacaaagtaacagggcgataaaagtaagtcccaaggagcattatcacaattacacaacatccatctacaggccaataaaaaactactaatacattataagttaacatgccgataaaaggatgtcctaagaagcgttatcacaattacacaacattcatctacaggccaataaaaaactacatgaagttaacatgataaggtatcacaattacacaacattaatctataggccaataaaaagctagatcaagttaacatgccactgacaatttaagtttgatatgttgtgaataacagttgaagttacaggaagctcacttgttgatgaaagttgaggcattggaccagaggaagagcatggccagggtgaggatgatacagtggcacaacagggtgaggagatgataatccatgacttcaaacagcagccagatggccgtggcgccagcgagtaccccaacggagattttcttgttcctccatagaaagagatcagcagctgcaaccacaaacataagcacatcagaggagagcaaatccccatataaacaataagatacccagctacactaccaaacaaagaatctcagggtttaagcataaaggaatatagcgcatcaacatcaccgctcagttactattctattgcatttaaatcccaacctagatgcgaaatctacacgaacaaatactaatctgatcacaacctactcacattgtggcgaaaacgcagcataaatttgacttcagaaatcacggatcgcgacgttctccacacgctcgtagttccgggagaaagtacaacaaacgagccccactcagaaaaagcggagcgaaaaccccgatgcggtcggatctacacgctcgcaagaacacagacgcctacaagcgaaaaagagctttaagctttgggtcttacgcttgccgccgccgaggacggagtggacgggcttctcgcggccgaagaggcggtagatcttggccttcaagtcggccgtcctctccccgtcggagtccgacgacgacgacgacgagcccccgcggccgtggagcttgtcggagatcttgtccatcaccgactccaccaacgactcctcctccttgtgctccgccatggctagctgctggctctctctctccccctcttcttctccctcctcgctcgaacagtcgaactcttctttcttttttttttcgcacgaactctttttgcctttttgcttttctttttcctccttttctccgtagtcgtggcgttgggttttatgcgcggagtgaggcgatcctggccgttggatcgggcacgatcaaccgcgtgattaagtcctgcgttaacccggcgaagtaattggcgcggttaagcgtggtaataactcctcgagacgacgggtaattagcgctaatcggcttgcacgcgcagggagggcccacctgtcagcgatcgtgtgggacctctgttggggtttagcacggggaagtaatgaagggggtggagatcacgaggaggttactggcaccgtgacgagtgacgacgcgtggcgtgcctgcgctttcgccggcatccgtccgtggggaggggtcgtgggcgcgtccgcgcgtgttccttccaacaactccaaagagtccaaggggaagggagctagtgggcgagttagaagcttctagacgaaggtgcggagtttgaaaaggaggaggattttgtggtgtgggcctggctggctgattcttgcgggccaagtccaggttaggctcaagtgctctcgtaggctcgtagcccagtgtctcttcggaaggcatcgcaaaggcaaagggacaaagtgtaccatcagttgtgtgggcgacactgttacgtagtccctccgttttatacattatacggaagatgttttagtctctctatgtttcatctaaactcactaagagcaggtacaatagcaggctataagccagctataaacatattttaaagagataaaggaagagagagaaaagcagcgggctacagatctgtaactagctgcagcacggactccatgacgtaatgtgtgtatgacaggtgggaccaagtattaatagtatagtaagtaactattgtatgaattggctatagaagatttggagctagcagtgggctgcactattgaccttgctctaacatttatccaaaatatcttataatgtaaaacaaataaagtacgatttagcttttttttaagtataatggtgtatatagccggcctagatcttattatactcttttgtgtcatctaattgcgacgataaacacttaaaacccttttgtgttacatgcaaatacgtaatagcatatgctattactccaggctggcatggccgatcactagtctatcatgtcatatttacaaacgaggcaaagataccgataaataaatatgtgcctatcgacaactgaatatcgaagtcgttgtagtgtagtggtgagtattcccgcctgtcacgcgggtgacccgggttcgatccccggcaacggggaattttttttttccccaattatcatgtgctatgctatattgatcttctcatcaacgcgtggattggaatgcgatccctctctaaaagccatggtatatcctcatgcagtcaactagtggaggaggccgagatatatattaggaaaaatcttattttgcttccctttacaatagcccaaatctggtttccatttcttaaccgcaaatcaaatatgaaatctcccacaactgttaagactggaccaatttaagtatttaactctcgtcaatttgaaaagcggtttcatcccatgtgtcgcctgatttccatttcttaagactagaccaatttaccactatcgttaatttgaaagccgtttcatcctacgtgtcagttatatgatacattgaccttatctttatcctatacggctacgtggtgtttatgtgacactataaagaaaaaaaaaacactaatgtgacacacatgtcaatggcagtccgattgaaaaaaaaatcaaataaaaacaaaaaatatggccccacatgatccactagtggcaggagagatattgaggaaggggaggaagaaatagagtcccggccatgtaggttccactgttttttttttctaatagaaatactatgtactccctccgtttcaaaaagaaaatctagcacatcctatactacgagtatcatctagatgccacatcaaatgaaatcgttgtcccctgtccaaactaccccaagagagggaaaacgaaccggttgttaaatgaataaacctccgcattcgattgtatggataaacgatgaaagttggagtgggggagatcaaacggacgttttgcacgatattacgacatttccaggtttctaagctctaaaaaggcccaatcgatcatgtgaccttcgtacatagcctactaggaactaactactcgatcccgacccagctaacaaagtctgtttccctccctcatctcttctcccgattgaatcgcatccctcaaccgtaaaactaggtataacgcctcctactagggtttcccaaactgccggggctagggttaccgcgccccggcggtaagcacggttaccgcgcggtaaccgtacgaaaccgtgcaaaatttatcaaaaattcaaattattttttaaatttatttgaatttaagaaggttaccgcggtttttctattaccgtacccccgcgataaggccggtaacagtggtaaccgcgcggttaccgacggtaagtcgaaccctacctcccacattttcaaaaaccggtgcaaatc

SEQ ID NO: 43403 - DNA, 6145 bp, Oryza sativa
tgctgttcttggcttcgccatgggggatgattgcaacgtgtccattggtgctcttggtgtgcaagtagatcaaggacctgcggtgggccaatcgtcctcagatctctaggcggagagcgatctcgctagccgttaggtcctacccaccactacctagcgagtcgacatgagggttggcgaggagaggggtgttggccgacacatgctgggggctcatggcattgtcaaggctacctaccccgctatcgtcccctgcgctgaaacgttggccctcatgagacgaggctccgtcgccagccctaggagggttcacttgtgacatcaccccccccccccaacaatgatctccagtccaatgcctagaaggttgacctccttgcacccttctcctctctccacgacatgctctgctaccgtgaagattgtcgtcctcttcggctcccataccgccgacaacacccactactccttcttccctgagctctcgcgtcctcctgcaccaccacaacctcccaagctctcgtcccgacctcgtcgagcgcctcgccggactgccttcctcaccggctgctactaccgccttatcgctgccttgctaccatcgggagagatggaaaatagagtagtccctgacacgtgggtcttacactcttatcttacttgcttactcaccgagtcaatcatgaccaacctgtcacattagaaaaaaaaacgtttcctaaaccatcgaagaagtcgatttgcaccagtttttgtcttggagaggcgttatacccggttttgcgcttgagccttgagagatgcgattcaatcataagcaagataagaagggagttaaaatagacttagtcaaccagcaaatgtatgtccctttgtcagacttggatattcccagcccattaatctctagtctggtctcctcggtccgcgcgctgagaatcgccaaaacctatgtggcccatcatccgccggtccgtgtggccttccaaggagagcgacgcggcgaaagcctcacgcgtttcgttccccccttggccccctccccgctcactcacccagccgctccctcggctcggcagcgagcggcagaggaaaccggcaaaccgcggtgcgcggcacggcgcgcgtcctgcactccagctccgcgccataactgcgatcccctcctcctcggcctccccctcctcaccggcaattaatgccgccaactaccagatccacccctccggaaacctaaaacaaaatacccctcttcccgttttgcccctcctcggctcttctcccaccccagccgcgcccccccgcacgccatgccattccgccccacggtctcgccgccgccaccgccgccgccgtcatggcgtcgttcctcgactcgttctcctcgctcggcgtcgggtacgcggtcgccatcgcgctcggcttcctcgtcctcctcgcgtcgctgctcctcgccttctacttctgctcccgccgcggcggggccggggtcgtccgccgcggcggcggccagggggtccactccgcgcgccacgccgtgtcctccgcgtccagctccgggcacatctccatcaccgtcccgcgggtcatcttcgtcgcggacgactccgactccccgggctcctcgtcccgcggcggcgccgggggcggcgcggcgtcgtcgcccgtcgggctcgaccccgcggtgatcgcctcgtaccccaaggtgcccttctctagggcggcgacgggggcggacgccgaggccgcgtgctcgatctgcctctgcgagtacaaggaaggggagatgcagcgcatgatgcccgagtgcaggcacaggttccacctcatgtgcctggacgcgtggctgcggcggagcgcgtcgtgcccggtctgccggtcctcgcccatccccactccagtctccactccgctcgccaccccgctgtcggagctcgtcccgctatcacagtacgccgccgaccgccggcgccacaggtgacggaattgggtgcatcatgtcttctcttctatattcgttttttggcaccattttctactggttatcaacgatgggatggtgtatccattgttttattgttcagatgaggtttggctgatccatggcaatattagtatatttagccatttaggtgagattgtggactaggacagccttgactttgaggaagttttgcttagtagcagtagatcgttgcactgaagcagacatgcagtgtatatacattgttttttccattcggatatagtagcttttaccaagtaaggttacttgccctacagttgtatgtgcaagatcaatatctgaattgcttcattccagttatatatatatatgattattgcacttacattacttgtatgttggttaccattctttggcggcaaggacatgaaaggaaaaaaaaagttatttatcacaggatatagcattttatcatcataatgattttcatgctgtaacggaaggggaatatcctaactaacggtctttgtcgggactcgacatatttcttggttttaaatacagttggctactggattatcgataattttgcgcattgatgtatgtagcgtggacttttttgaattaatgtttggttcctgagtcataaattaagtagcagagaacatttattcgcttttgtagatcacttgccttgttaggcaattgtgttttcctcaacaggatcagttattttgaacttttcagggaggtataagtaataacatttgagataactgttatgccggttgcttctccagatcagttcatcctgttttttaagttagcttgaattctgaactgttatccttattgggtgaaatggtcatacttccccactttggtcatttgatttgtgtttactagtttagttcatgttcggtgttaatgttctttgtttctatggaggtatatataccgctgttttccatgaattaagctagtaacagctgtaatgaacttgtatgtccctaaatgtgagaatgtgtgctatgtcattcaggattctttaattgcagagtaagaaggttttttcatgttaactggaaagttgtgactacccactagtttcatatttagacaactacctattgaataataacccttatactgttatgaatagtcgatgtcagagttattttgttttagtctgaatttcccatctagcactgtgctgttctcatggtgacattctgtttgggtgcactattttaacttgtcatttccttgttattctatttgcactgtgaggttagacagcttgcagattttgacgccatctgaagatggttatgtgagttggaacttggagggactctattatgaccccactttcattcatggaatcttgagggggtgtgtatgtgttcataacttcatatggggttgaacaacaagagctaatgtggaacatgttatcatgctctgcacatgccttggtatctgttggctagttatgcctgaactttgagcagcaaaaacttggaaatttttttttcattttacttgatgtagttacgaatacctcactgattagaatgttttgtgtgctaaactcaatgcacttgtatgagtacctgccagctacacctctaaattccaattcactgactgtgatagtctaggttgatctttttctttcatgtttgatacatgcagtttgtgtgctgtgctgttattattttctaattactgtatggttgtacctaacaattttctttggcacgggaccttacccaagtcaatagctaaaatcgttagggacaatcggtagttcaagttctgaattatttttttagccacattaccttttgttttgcttttcccccctaatgtaatgtatgtgattcttgaaacttttgtgataatttttgttttatgtaaattgataagttttatgtattgtccagtttcattagttacattcccttggtcgttcatttctaggcttctagcacagtagcacggccatctgtgctggtaagaagctagttttttttttctatagctggtatctacagaggaaacctggaatgctatcagaatgctatctactgtatatcacctttaattggttattttcctgtctgttttatacatactctgaggctgttgtggttgacaatgcactcctatcttgctggcagaggtatatggtgtttcattttcatgcagtctattcaaatcaccattttactggcgttgcaaaggtttctttacatccttttagctaattaatccttatgcatcgtcagtaaacatggtagtgcgtctgcatctataaagttcatgtaactcagggctgtgagactgctacccaaatcgggtctacccaatccatcaaacacaggcatataataatgctattgggtattatttcctagagagaattcgatctgtgaacacacgaaagtagcataatatatatccagaaaaacatacatacgagagtagcagaatatacatccagaaaaatacatattcatatgtaatgaggtgctgtaatgacaatgcagtactcacacaagaaaaccgctgatcagctcacgattgcaacgcaatccacgctcctagtctgcacgcccgacttggccccgtccccgggcagcagcacgccggcgatgccggcgacgtccaagatgaccgagcagttcatccgaacgtcgaggctcttcttgatgatccccagcacgctgaccctcgccctcatcgccgtgtaggtggtcaggtcgtactcctgcccgagtatcagccccgtgccgttgagcaccgacgcgaggcggtcggcgagcaggtcgagcgtgatgttcatccgcaccgtccggtcggcgccgacgctgccggcggggacgtacgccacgctcaccgtcttccccttgtagtacacgtccgtctcgctccgggagaaccggagcgacgcggcgttggggttcttgaccgagacgtcggcggtgagcgtcgcgttggtcgccacggtgctcccgatgccggcgccggtgccggggccggtgctgatggccgtcacccacacgccgttcatggtgatgcgggggtccttcaccctgaacacggtgagcgcgaggacgaggatgacgaggccgacgacgaccagggtggtcacgcagcagccgcagcagcagagcgcgcgccgccgcttccggaggtactgcatggaccgccaccccgtcgccgcctgcgcctcctcctcctcccccacgccggtcgccgccgggtggaccgacggggatggcaccgcgaatggccgcgccggctcgttcttgttctccgccgccgtcgccatgggagctggagctagctagctatagcaaatgtcacgaacggacacgaccgtttttgttagttacttgtctgaatggatcacaccacctagctcgaacctgctccgctgttcctggtcttggtcttcgatttatacatgtggccgagcaagtccactgtcgtggctgcgacactgtcatgcgccggatttgacacgtacgcttgactcgtggaagcttgagatgatgactacgtttgctgctgagtccatagccgtgtaattttcacggactgtgattggtccgggggtctttgtgagttctgacttctgaataattatttcttccttctagatgggaaagattgtatgtatcatctttccaaactgcgtgaaaagaaaaaccgggtcgtcctgactgaatgattcttgatatcgtttaacgcatgattcttctagatatactgatatttcttttctcaatggaatccgattatctggtgcatataatcagagcaccgattgatgatggttcacttcgagactaaacaaatgacatgagaaacacgtggagacggcaaaaaaacatggggttgacaataagctggcgattactcgtttccgaggagtaatcagagttgatattgagcgcatgaattggaatgtggccacttggcacatgacactaattcactggcattcttcccacttttttttggggggggggggggggggggcaaggataacttgaattcttcctgaatgaaatggagaaaaaaaagtattattcgtattgtaaaatattgtttcattggaaaaagataatgcttcctctcaggcgttcaatgagggagaaatatcat

SEQ ID NO: 43404 - DNA, 20849 bp, Oryza sativa
  unsure (1)..(20849): unsure at all n locations
aaacaacgagtggatatcccctccagggatgaaaattcactccctatgtacaactgtacactcatggacactcttgggctggagaatacacgataactgacagcaatttggcaggaatgaaaattgaggtcagcaatgagcgatgtgtatccccttttctgtagaatccacggagtagtactcttgtaagcttaaatcatcgggaatgctaggggacggtatcccgtccccgaacgggatagctcctcctccacaacgcgattcctgctcactcgctgccgtcgtcgtcccccgccgctgccgcgactgtcccccctcgcctccgcctctgccgccgccgccaccgccgccgccgccgccgcgcccgtcccccgctgccgccaccgccgccgtcctcgtttacgagggacggctgcagggtactgaccgcgcgtgtcgaggtgctcctcccccaacaggatgcccagctatatccagtaggaatcacctgatacttggtaggtatcatccgatacctcgcaagtatcacgcgatacatggtagaaatcgtctgatacctgacaagtatcacatgatacctcgcgagtatcacgcaatacgtgatagaaatcgtctgatacacgacaggtatcgcatgatacctcgtgagtatcacgcgatacgtgattgaaatcgtctgatacctgacaggtttcacatgatacctcgcgagtatcacgcgatacgtggtagaaatcgcatgatacctgataagtatcacatgatacttgcaagtatcacctgaaacgtgtgtagaatcgtctgatacctgataggtatcacaccatacgtactcgggatcatcctattgtgtagaatcatctgatatctgataggtatcacacctgatacctgctcgggatcatcccgtttgaaaacgggattccgttatatagcagcgcacagtgcgagtttcaaacctgtaggctgagcattgaagttttgtagaaattatacgagcaaccgaggcttaaactctcccctcaagtggttcgcgagaaggcacctcccttaacactcgcatagactcaccgtgtcgccggctcgctctaatggagcccaattcaaaacagagtcagaccgtggtgctgcacaccatccttggcgccggccatctcgcccccatggtggagctcgccaagctcttcctcggccgtggattcgcagtcatcatcgctgtcccgacccctccggcttccaccgccgacgtcgccgcctcgtcggcccccgcggtggcgcgcatcgccgccgccaacccttccatctccttccacaacctcccgcctccggactaccccgagccggaccctgacggcttccagcagctgctcgacgtgatccgcctcaccgtgccaatccttctgaccttcctccgctccctcccgcccgtcgccgccgtcgtgctggacctgttctgcgtcgacgccctcgacgccgccacggcggtcggcgtcccggcgtacttctactacacctcctccgccggcgacctcgccgcgttcctccacctcccgcaccacttcgccaccacggaaggcagcttgaaggacatgggtaagacgcccctccgctttcccggcgtccctccgatcccggcctccgacatgccgcacaccgtgctcgaccgcgcggaccggacctgcgctacgcggctggggcactacgggcggatcccggaggcgcggggtattctgattaactcctacgaatggctggaggcgaggtccgtgagggcgctcagggaaggcgcctgcatccccgaccgccccacgccgccggtgtactgcatcgggccgttgatcgtgaaaggcgaggaggcggcgaacggggagcgccacgcatgcctcgcgtggcttgacgcgcagccggagaggagcgtcgtgttcgtcagcttcggcagcatgggcgccgtctcggcggagcagctgaaggagattgctcgtgggctagagaattccggccaccgtttcctctgggtggtacggagcccaccaccggaggacccggccaagttctccctgccgcgttctgagccagacctgggtgctctgctcccggagaagttcttggagaggacgagggagaggggaatggtggtgatgtcgtgggcgccgcaggtggaggtgctccggcacgccgcgaccgccgcgttcgtgacgcactgcgggtggaactccatcctggaggcggcgacggccggagttccgatgctgtgctggccgcagtacgccgagcagaggctgaacaaggtgctcgtggtggacgggatgcagctcggggtggtgatggacggctacgacgaggagctcgtcaaggcagaggaagtggagaagaaggtgaggctggtgatggactccgacgaaggcaagaagctcagaggaaggctggcaatggcgaaggagatggccgcggaggcgctggcagacggcgggccgtcgtgcacggcgttctctgatttcgtggatgatttgcagcgctgcaaatgatgaagcgtcgaagatgatcagggatgatcccttgtgcctgatcggcgactcgacaagattgctgctgagaggtgacacttttgctctgaattatgctctgtccgatttggtgttttattgcaggttgtcacagttagtcaggttagcagattcagtgcttcagtttcaacttacacccattatggactagcagaaacttgtttaggtttcgttcaataaggttaaaccacgcagcatctggtgctagcggtctgttacttccagatttcctaattgacaagtatggccagagaggaagacatgattttttttttcgtttcaaaaaaaaaaaaaaagaagacatgatttttaccttctttggtattcccaggcacctgaatttcagtgatggttccatcctcttgtaagttgtcactgtccatcctgcgctatctctattctctagcctactcaggactattttggatgactaacaattagcgtagagaatttgcatttgactagagccagtgatttccacgctagtgggttcatgttgtttgtgtggctctgaataattggtcgttagtattggtcaggtttgaagactgcattattttaatcttcttatacagaaatggttgacactgcaacttttggacacgagagacaatggcatccgtcattggaggatgaaaagaacatcactatgcgcactactgtgcttctgaacttaatagcaattccgtagcaaaaatcgcaaacatttcatggtaactgacgccattgatacactaatgcaatcgtgagccttactctgcttaatcagctacgaactccattctccaagctgctctcctccaaatctctcatgaacttatcaaatgccatttcagaagatccaccttccgtgatggcatccaacgccatgtccctcgtctccaccagtttctccctgagcttcctcccttcctcggtctccatcaccagcctcaccttcgcctccacttcctcagccttcaccaaccctccttcctcgtacccgtcaagcgacacggcgatcttcatctcctccaccatgatcaccttgttcatcgcctgctccgcgtacagcggccaacatatcatcggcagcgccgacatgatcgcctccagcgtcgagttccacccgcagtgcgtcacgaacgcgccgaccgcctcgtgctgcaccacctccgcctgtggcacccagttcttgaccaccatgcctctgtccttcgtcctctccaagaaccccgccggaagcagtcgctccaggtccggctccggtgatgtggactgctcctccggtgggctcctcacggtccacaggaatcggtggccggagctctccagcccacgagctatctccaacagctgcgcctccgggaacgcgccctggctgccgaagcagaggaacacgacgctccgccgcggctgggcgtccagccacgcgaggcacgcgtgcctctcgccgccgatccttgatttcctgccggcgtcgaccagtggcccgatgcagtagaccctcggcgtgggcttgtcgggaacgcagacgccggcggcgagcgctttcagggccttgggctgcagccagtcgaagctgttcaccagcacgcccttcgcttccgtcatccgcttgaattgatacaacctaaccttggtcgcctcgctatccttgtcccgcaacatcgccggcatgtcgacggtgcggatcggcggcatcccgggaaagcggaggagcgccgccttgcccatctccataaatgtcggcagattggggtagtaatacgggaggtggagaaagacggcaagggcgctggcctgggatgggaagaagaagtacgcggggatggcgagctcggccgcgacgtcgagcgcgtcgacgcagaacatgtcgagcaggagtgcgtcgacggcgggcagcgagcggaggaactcccggagcacggggttggcgagcttgagcgtgtcgtggctgcgcttgatcgggtgcgcgccgacgtcaggactgtccggtgccggcaggaggcgaaacgtgatggaagggttggccgcggcgaggcgcgccatcgcgtcggccgacacggcgtcgttgttgggcgggtcaatcaccgcgacgacgacaccgaggccgcggcggcgcaggtgcttggctagctccaccatggggttcaggtggccgacgcccagcgacgggtacatgacaaacgtctttgtcgtcatggctacgagttgttccgatcaaacagtatgcataaaaacgtagcaaatgctctcaaattggcttaccaatataatctcgcaacccacaagctaaatagtgcgagcggcgttgaatggtaacccatttcttggcaaagaaggccatggcgagcaacattgaaacgtttcacggtgagttgcatgatcgacacaaatttcacatgggctttgtagaagtctacgtgaggaaggagagaccaggtagctcacgtcacggccgttttcgtgagcaatgacgaagaaaagaaagtttttattctgtacggtgtaacggaccagatccatataattagggatgagttaaaaaattaataagaactagtatagaggtttgcgcaaattgcgaggctagcattattatattttctttttttattaaaatatattaaaatgataacataattttaaattttgtactaactttaccaaactatcaatgtgtaatattcatgttgtactgtatatacgtgatagttattaattatttttaatattaaattttagttatttctaaattgtatttctatatggactgtagactcgtctttttaatatttcttattttttaattctgaatttttgttatttgtaaattatatttctacatagactctaggctcttcttctaatattatttatttttaattctgaattcaatgatctctaattgtatttctatgtggactctaaactcatctttcaatattctttattttttaaatttcgaatttcagtatgtctaaattatattcctatatgaattataaactcttcttcccatattatttttttaattttgaatattagttatttgcaaattttatttctatatggactctaagctctacttttaattttattatttttattctgaaatttattcaattctaaattcctgtagggattctatactcttcttctaatattcctttttttatttcctattttctattttttaaattgtatttctatatggactctatactcttcttctagtattccttattttttaatttcgcatttcagttagcttagagaatttgcatttgactagagccagtgatttccagtctagtgggttcatgttgtttgtgtggctctgaataattggtcgctagtattggtcaggtttgaagactatgcattattttaatttgcttatacagaaatggttgacactgcaacttttggacacgggagacaattgcgtccgtcatcggaggacgaaaaaaacatcgctatgcggacaactttgcttctaacttaacaaaaatcgcaaacatttcatgtggtaactgacgccattggtacactaatgcagtcatgacccatactctgcttgatcagctgcgaactccattctccaagctgctcttctccaaatctctcatgaactcatcaaatgccacttcagaagacccagcctccttgatggcatctaacgccatgtccctcgtctccaccagcctctccctgagcttcctcccttcctcggcctccatcaccagcctcaccttagcctccacttcctcggccttcaccaaccctccttcctcgtacccgtcaagcgacacggcgatcttcatttcctccaccatgatcaccttgttcatcgcctgctccgcgtacagcggccagcatatcatcggcagcgccgacatgatcgcctccagcgtcgagttccacccgcagtgcgtcacgaacgcgcctaccgcctcgtgctgcaccacctccgcctgtggcacccagttcttgaccaccatgcctctgcccttcgtcctctccaagaaccccgccggaagcagccgctccaggtccggctccggtgatgtggactgctcctccggtgggctcctcacggtccacaggaatcggtggccggagctctccagcccatgagctaactccttcagctgcgccgccgggaacgcgccctggctgccgaagcagaggaacacgacgctccgttgcggctgggcgtcaagccacgcgaggcacgcgtgcctctcggcgccgctccctaccttcttgcgggcgtcgaccagtggcccgatgaagtagactctctgcttgggctcgttgggcacgcagacaccggcggcgagcgctttcagagccttgggctccagccagtcgaagctgttcaccagcacgcccttcccttccatcatccgcttgaactggtacaacctgatcttggtcgtctcgctctccttgtccttcaccgtcgccagcatgtcgacgttgcggatcggcggaatgccgggaaatcggatgagcgccgccttatccatctccctcaacgacggcgcgttgcggtagtaatacgggaggtgggaaaagacggcgaggacgctggccggggagggaaagaagaagtaggcggggatggcgagctcggccgcgacgtcgagcgcgtcgacgcagaacatgtcgagcaggagtgcgtcgacggcgggcagcgagcggaggaactcgcggagcacggggttggcgagccggagcgtgtcgaggttgcgcttgacatggtgcgcgccggggtccgggctggccggcgccggcaggatgcggaacgtgacggaagggttgcccgcggcgaggcgcgccatcgcgtcggccgacatggcgtcgttgttgggcggatcgatcaccgcgacgatgacgccgaggccgcggcggcgcaggtgcttggctagctccaccatggggttcaggtggccgacgcccagcgacgggaacagcacaaaggtctttgtcgtcatggctcgctgctgttccgaacttccgatcaaacgggatgtaaaaaagacggaaacaaatgccctcaaatcggacagccacaagtatatatagaggggttgtatggtaagccatggtgagcaacgttgacacgccccaatgtgacctgcataaccaacacaaatttcacgttggctttataaagttttggaggaattatgaggactactctttcactaaagtcagcagttcagtaaactggtagacgaggaaggaagagagctcacgtctggcgtatactacttccttcgtttcacaatgtaagtcattctagctttttcatattcatattgacattaataaatctagataaatatatatatctagattcattaacatcaatatgaaagtgtaaaatgctaaaatgattatattgtgaaacggatggagtactgcacaagatgggatcacagtatgatcatcacacgcaggcaaggcaggatacacatcgatggcttctagtcgttcgtctgtgccgccaccaactaacagatgtgattaaattaattggccggtaggcctcgagattcacaagcctgattgtttttaggaaccgccgtcagtggtgatgtctacaggagtaaaataaggacacgacgaatcagatagagatcgtgatagagtttattattagtcgggaaagtcaattagtccggtgatcgtgatacagagttagaaataaagtcatacgggttcacatcctctgcctttgtcccatactacagcaccgagccccgtaggacaatctttagcccttcttttccaagaagaaagaatcagaaatgcatccgatcgaaggtgaccgaccacaacaaaagcattcaatggacaaaggcaaacggcgttttccctgtaggctgtagtccttcctccaaccaaagctcgaccgctgtatcatttttatcctggagattaaaaagaaaatcacatcttcccgtattactacaaacagcgagcagttgaataccggccgggtaacttgctacaaaacggatccgaaccgagctacaacctctatctcaaaataaatatggagggaataattaagacaatttttggaaaccgatacggaagtatatccaacgaaaacaaaaaagacaaaaaaaaactattcggagccattaacttgcagcagttttttttaagataatcccttcattttttacacggtttgtagccccggccgttacatgccccatgtcgccttgttgggattggcttcgttatattgtattgggaggattgagggttacgtgtagatggtgctggatttttttttcatatgagacattactcgttttgtgcatgtcgattaaaaagtcattattttttttaaaaaaattaataagatagattcatatgtgatatatgactgactatacacgagcaagttcaaattccatctatacaattagaaaccaaaataataaatttgaatgtgaaaatccacattaaattcatagtgtataaacaaaataataattttgaatgtgaaaattcacattaaatacaaagttaaatatgttatttttgtatcaacttgtataagttaaattagttggattggacattttctaatacaacaatgaatctagacagacttttgtctaaattcgttgtacttaaaaatatcacatctaatactaatactagattattttttttggacggaggaagtatatggtactacctccgtcccatattaattgtagttgtggatttctgtgttcaacgtttgaccgcccgtcttatctaaaaaatataaaaaatttaaaagaaattagtcacacataaagtactatgcatgttttattatctaataacaacaaaaatacgaatcatatttttttcaaataaaacggacggtcaaatgtggtatataagtagtgcaaaactactttttgagacagaggtagtattcaaatagttattatatatatatttaaaaaactgacatgatatatcaatataatatatgtcattccataaacatttaaattcaaatttaatatatgagtaataaatataaaataacaaatttaactttttttggggggaaatttaactcatctacatgtactatcttctgagactggtggtatcatttctgatcctggagattaaaaaaaaaacgcatctaccgtattacgaacagcgagcaggaacgttcacgtgtgagtactaactggcctgctgggttagggacaaaaaatctgaactgaagtgacaattcctgaaacggttattctgggacggagggcacatgtagatggatagggtgataaataattcctccgttttaaaatgtaggtatttttaaggttggtactggtatttaaaaaagtatgtgagaatgattagagaaggtgtgtaattggttgaaaagaaaaagtaggtgaaggagaatgattgtgattggttgagaggaggtagttggaaaaatagcttcattttgggacaaggtactgtgctaaaaatagctatattttaggactgagaaagtactatagtgatgaatttttaacctaccagaggatatcttcttgtttatatcgtgtgtatgaagatagatgaatatatgatatgccactgcataatagttcgcgtaaagaaaaatttttgggtgtcacatcggatgtttgaccgaacgtcggaagggcttttcggacacgtatgaaaaaaataatttcataacacgcctggaaaccgcaagacgaatctcttgagcctaattaatccgtcattagcgtatgtgcgttactgtagcacttatggctaatcatggattaattaggctcaaaagattcgtctcacgatttcccccctaattatataattagttttttatttatctatatttaatgcttcatgcatgtgttcaaagattcgatgtgatatttttgggaaaaaaatttaggaactaaacggggtctaaacctataagctaaaattggatctgcacgttagaaaaaaaacaatttttactggaactatgcgttaaattgggagtcaaatttgtttgttttttaattgtataaattaattttattttttcttatttgtatagtgatatatcacatatatcgatctaacttattaaattaaacgataatttttttatagtattttagacaacacaaaaaattaaaagacaaatagatgttggattgagatcctctgacttaaaagccaccgtgcctttatcatgttgatacgtgaattcatggtttatcacatcacgtgtcaatgataaaatacttattttaaagtttatcggactcatataacaataacaaagatacatagtatgtttgaattgaaggtagatgtgccagatccataggtgccctagtgagactgtcggctgtctgcatccaacaggaactcggcaaacgccgcgcgcgacgatccgccgtcgccccatgcaacggctgcggcttccttgtgcgtcgtgacccgcgccctgagttggttgcctgcctcggattccatgaccagcctcaccttggcctcgacctcctctgccgtgacaaggccctgctgccacccgaccatctccacagcgatgcccatgtcctccaccatgagaaccttgttcatcttctgctcagagtagagcggccagcacagcattggcacacccgcggtgatcccctccagcaccgagttccatccagagtgcgtcacgaacgcgccagtcgcccggtgatggagcacgtccacctgcggcgcccattgcttgactacggcgccctggccactggttcgctccaagaaccccgccgggaggagcgcttcgaggtccggatcggcccgagggtcgtatggtttctccggatcgttattgacgacgatgggggcgcgcactacccacagaaaccggtggccggatttctctagcccgacggcaatctccttgagctgctttttggagtggttgcccgtgccggtgctaccaaagcagaggaacacgacgctgcggtccggttgccggtgtgaaactatattgtatacatgcgtgtgagatctgttagattggataagatagagtttgttaggttgttagcctcttctatccatcaaaacagactgcatgctatatggatgtaaaaaccacggtgatggttgttatcaccatatattaacaaaggtgcggcctctaacgaggttcaacgcttctgcacctctgattttcacatggtatcagagcctatccatccacaaaatcgcatctaatccaactcatggcgagttcgtcgaagacggcggccgggaatcctctcggcgggaacgcgatctcggagaaactctccaaatcaaaccatgcgctatggaaagcgcaggtcatggcggctgtacgaggagctcgccttgaggggcatctcaccggtgccaccaaaactcccaacgccctgatcacgacgacagcaggcgacaagggagagaaagaagtcactgttcgcaatccagaatttgatgattgggttgcaaccgatcagcaggttctaggattcctgctctccaccctagctagagacgttctggcacaggtggccacctgcggcacggctgcagcagcatggcagatgctggaggagatgtactcctccgtcacgagggcgcgcttcatcaacactcgcatcgctctctccaacaccaagaagggcactctctccatcaacgagtatgtctccaagatgaaggccctcgctgatgagatgacggctgccggcaagatcgttgatgacgatgatctcatctcctacatcatcgccggcctcgacgacacgtatgaacctgtcatctccaccatcgttggcaaggacaccatgacgctgggagaagcctactctcagctgctcagctttgagcagcgtctcgcgcttcgtcacggtggagactcttctgtcaatttggcgaaccgaggacgtggcggtggtggaggacaacaacgcggcggcaacaccggcaacggcggccgcggccgtggcggcaacaacaatggcgctaaccgcggcaggggacgcggcaacaatggcggcgcacgaccaccgggaggcgtcgacaacagacctaaatgtcaactctgttacaagaggggacacacggtaatcaactgctggtatcgctatgatgaagattttgttcccgatgaaaaatatgcaggatcggcaacatcttatgggattgatacaaattggtacgtcgacacgagtgcgacggaccatgtgactggcgaactggacaagctcacggttcgcgatcgctacaaggggcaagatcaagttcacaccgcaagcggtgcaggtatggaaattagtcatattggtcattctactgttagaaccccaaatcgtgatattcatcttcgcaatatcctatatgttcccaatgcaaataagaatcttgtttctgccaatagacttgtctctgataattctgcttacatggagctttactctaaatattttaatcttaaggatctggccacgaagaaacttctgtttaggggaccatgccgggggcgactgtacgctcttccatcttcatcacctcatgaacgtcctcgtcctctaaaagaagcctttggagccatcaagccatcctttgagcgatggcacagtcgcctgggtcatccagcctctccaattgtggagaaagtcattagcaaaaataatcttccttgtttagctgagtcaaataaacagtcggtttgtgatgcatgtcaacagggtaaaagtcatcaattgccctattctagatcttctagtatgtcgagtcatcctttggaacttatttattctgatgtttggggtcctgccctcacttctgttgggggcaaacaatattatgtgagctttattggtgattatagtaaatttacttggctttatttgattaagcataagtctgaagtcatccaaaagtttcatgaattccaagctcttgttgaacgtttgtttaataggaagataatagccatgcaatccgactggggaggtgaatatgaaaaacttcactccttctttacaaagataggaatcacacatcacgtttcttgtccacatactcatcaacaaaatggctcagctgaacgaaagcatagacatatagtagaagttggtctcacccttcttgcatattcttccatgcctctaaaattttgggatgaagcttttcaagccgctgtgtatcttattaataggacacctacaaaactacttcagttcctcacaccgcttgagcacttgtttaatcaaaccccagattatagttctctccgggtgttcggctgtgcttgttggccacatctgagaccctataatacacacaaacttcagttcagatcaaagcagtgcacttttttggggtacagcacactacacaaggggttcaagtgtcttgatccctccacaggtcgtgtctatatatcccgtgatgttatctttgatgaaacaaattttccctttgctaaacttcacacaaacgccggtgctagacttcgttcagaaattttattgcttccttcacatctcctaaatccaacatcaaatcctggggaacaacagctagatgacaatatggctaatattcctgttaatcctgctaatcaaatttttggaagcaatgtgcagcctgtttctgcagaaaatgatgaagcagatgattcttccggtgccacagaaaatctggctgaacagatccatcaggataccgctgcatcaccgtctgcatcagataccgctgccagtcaacccggcgctgccacatccctggacgtggtacattttcctgcctctcctgacgtgatgacgcatcactcggccgacagctcttcgccgagccaacctagtcacgccaccgcgacgcctgccagcaatgatgatgtcccgtcaccatcacacatctctgcatccgagccgttcgcgacaggggaggaagtgactcaagcgccgtctcgcccaactactcgtctgcaaagaggtattcgaaaagagaaggtatataccgatggcacagttaaatacaagaatacctttcttactgtgactggtgaaccaaaaaatttaactgatgctttgcaaaatacaaactggaaaaaggctatggatatagagtatgaggctttgatgaataataaaacttggcacctagttccacctaagcaaggtagaaatgttatagactgcaagtgggtctataaaattaaaagaaaacaagatggaagtctagacaggtataaagctcgcctagttgcaaagggatttaaacagagatacggtatagattatgaagatactttcagtccagtagtcaaagctgctactatcaggattgtcttgtctattgctgtgtctaggggttggtgcatgagacaactagatgtacagaatgcctttcttcatggattccttgaagaagaggtatacatgaaacaaccaccaggatatgaggatgaatcttttcctggatatgtgtgcaagcttgataaagccctttatgggctaaagcaagctccaagggcatggtattccaggctcagcaagaaattatatgatcttggttttcaaggatcaaaaggggatacatctttattcttttataacaaaggaggactaatcatatttgttcttatctatgttgatgatataatagtcactagctccagacaggaggcagtgtcagctcttctgcaggatttgaaaaaggagtttgccctgaaagatttgggagatcttcattacttcctgggtatagaagtaaacaaggtaacagatgaaataattcttacacaggataaatatgcttgtgatctcctgagaagggtaaatatgtttgattgtaaaccagtaagtacaccgttgtctactagtgagaaattatctgctcatgagggtgacttactagggcctctggatgcaacaaattatagaagtgtagttggtgctcttcagtatctaaccctgactagaccagacattgcctttccagttaacaaagtctgtcaatttcttcatgcaccaaccactggtcattgggcttgagttaagagaatcttaagatatttgaaacagtggactaaacttgggttgaaactatgcaagtccaagtctatgcttgttagtgcttattcagatgcagactgggcaggatctcttgatgatagaagatcaactggaggttttgcagtttttttgggagataatcttgtatcttggtgtgcacgcaaacaagctacagtttccaggtctagtactgaatcagaatacaaagctcttgctaatgctacagcagaaattatgtgggtacagactttattgacagaattacaagtgcagagtccgcctatggccaagttgtggtgtgataatttgggagctaagtatctttcttctaatcctgtttttcatgccagaacaaagcatatagaagttgactatcattttgttcgagaaagagtatctcagaaactattagagattgattttgtacctacaggagatcaagttgctgatggttttaccaaggctttgcctgtaagacagttagagaactttaagcacaatctcaacctgggaaggttgtgattgaggggggctgtgaaactatattgtatacatgcgtgtgagatctgttagattggataagatagagtttgttaggttgttagcctcttctatccatcaaaacagactgcatgctatatggatgtaaaaaccacggtgatggttgttatcaccatatattaacaaaggtgcggccactaacgaggttcaacgcttctgcacctctgattttcacagccggtcgagccatgcgaggcactcgtgcctctcggctgtctctctcctctcgccggccttctcgatcaatggcccgacgcagtagaacggcggcaacgccgccgggtcgccgtgacggcgcgcgtccctgagcgcgttcaccacccgtgcctcgagcgactcgaacgtgttcatcaggaagccattggagtcttgaatatccctgtgaaacaaatccacgatggccttgtacacttcgctctccgggtcctcgagaagttcctcatagaggtaagaaaccggaatgggtgggaggccagggagctcgagaggggtgtctcctagctccctgaagcttggctgaccctctgcacggatcaatggaagctggaggtggatggcgaaggcgctggcgttccctgggtggaagacgtagccgggaacgttgagcctcttggcaacgtcgagggcttctacggacagagggtccacgacgagggcgtgtgcaccaccgggaggcatggagcacaggaagtcatggaggcactcattgtgtcgcctcacgaggtccaagtacccgaggagggagaagtcgttgtctttggtggtgatggccggagggagctcgacgcgtgggagcctgtggaagcgtatggcgggcttggatgagatggcacggtcgacggtggcagggaaggcgatgtgctgctggaagacggggtcgatgagtgcgacggtgatggcgtagccgcggtcgatgagctcgtcggcgaactgcatcatggggaggaagtggctgacggagaggccggggtagagaaccatggtcttcttcatggtggctttgaatttttctggctagtttgtactgtggaggcactggagggtagactgtagagtggtctcccgacctacctctggctcgtttgattgaggggagaagagaactagattgccccatatatactccctccgccctaaaaaaagttaaactctggatttgcgtgtccaactttaactatccgtcttatatgaaatttttttataattcgtatttttattgttgttagatgataaaacatgattaatactttgtgcatgacttgtctttttattttttttataattttttcaaataaaacggacggtcaaacattgggcgcggataccagggtttatctttttttgggacggagggagtacagcccaattaaatcagccatttatgatgggggtctgtttggtgaggtgggtagtggtactatactctcctaggagcaagtttaatattacctccgtggctctatcctagaagagtatagttttaaactgtttatatccaattatattcaatatttgaccgtctgtcttatttaaaattttgatgattaatattttttttattagatgataaaacataaatagtactttatgtatggctatttttttaattttttataaactttttaaataaaacggacaatcaaacgttggatacggaaatccataactgtacttaaataggtaaacttatttatatttattttagacaatcactacatgatggcccatcttcaccaactgactactactgttggcaaaacgtcggtacacagaacacatcatttgtaggcaaatatgtatatagcactgccaacgtattatgtgtcggcgattctagtcttttgagacaaacaaaatgtcggtgattcatgggcaacgtattatctgtcgacaaaacaattgccttcacgccaacagtcggcaaagggtacatcacgggggcagaaatttagattagctcaccaagtcgagcgcacaataggctagaaaaaatggattgcacgggctaaaaggggacaaaacccttctctctacccttcttctcccagtcaaaaacctagatccacagtcacatttctcctcctttgaagtccattgtcgccaccagcaccaccgcacatcgcccccatcggttccttcccttcccctcgccccatcgctcccctgccaccaccagctccccttcccatggagaaaatggacatttggccacgttcaaaaagcggtttcgctgaaatgccatcccaaaaacgcatttcgctaaaatgccaatctaaagcgcgagatcacagctactttgccattttctccattttcgtcattttcaattccattttcgttggaattctacttgatgagaccaaattgcccctgctcgtcggctgaaaggggattgagatcgagcgcggcgagtagataatattaacacagactccaatcgcgcatttcatcaccatatgggaacggtggagaaacaaggttggtggcctcttcacagagcacatgctgaatttaagggaaatagtggattgtttttagatggaatcacttaacacgatgtagttcatattgtaggattaagcataagaagcaagactaccagagaaggtgaacaaggagatcataaaaaaaaatcttttttaagttgaaagaaccgagctctaaaatatagaatggaccctaagggttgggttgttcatccattaatacgttccttgagctagcttcagaaagttggtagaccggtgttggaattttagtctgaccatctttacatcgttggttcgactgttgatgggatctcgatctgacagtcagtgttcctccagtctaaccgctggtgctcgtgcaagacaactggtagaagacaaaaacacaactcgacaaaataagctgatcaactttatattacatcaagatgtgtttataaagtgtctccaagcacttctctctcaactttcaaactcaactcgagagtcaagacctaaagataaccctaatttttcaccttaaaaaagtgttacctcttgatgctcaaccttatttatttgtacataaaggcactccacaaaagccaaaatcctacttaaattaggaatcctacttctatatatagaaaagcctcccaaaccatgtattattttatctctttgtaaattcaaaccctaaatcctacttcagctagtactcttttcaactttgactttttcttttatctacacacatctcgcttatgccaaacaaaaactccatctccagtttattgttcaatctttagccttagcatattgtataatcttcttgatcgttaggacaactatacttaagtcaattccaatccaccatagacagttctcagccttaagcaacacttatatatgggaaacgaagaaaccatatccgactttcctaacttaaactcacattagcataaacacaatacacatacgaaataattggaagccataaacatcacggaattaacataaaaaaataactcaaaatccaatataatcaagaatgttctggtctaattgcacctcagccatcagttcggccgcccatgcgcatccggtctaatcggacttaagctctggttggaccacctgtacaccgacccttcaccaacacaaccacaacaattcaacaatcggactaaccatcaccatggccaattgttcatcacgacatataactcaagacaatgattcctacaacgatttcacacacatatgtacacaacaactccatcgagctggtgggtatgagcatctccaacagtctcttcaaatttgactctaaatattgatttggccagtttgtcaaaaatttggatggccaaatttgtatttcactccaatagactctctattacactgtccaacctaaatagtgagtcccatatgttaggctcactaccctttttcaacccctcctctccctctctcatattcttctcctctctctccataccaccgcctttatcatccccaccgccacactgccacccctggtccccgcccacgccgccatagcattccccaatgcgctcgaggtcggtgcacccgctgcctccaacgaggtcctccgatccatatccgtggacgccgacagcgaagttggcggtggggatggcggccccgatgacgatggtggcggagaggtgagcacgggaggtggtgaagatgaaggtggtggcggatggcggcccagacctcagcgacgataggcaactgagtggatggcgatccagaccacggcacaacggcggttgtgcagatggcgaacgaggcgagcacgggagatggcgcaagagggcagggaaagggagggtaggggcagcggggcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 43405 - DNA, 3855 bp, Oryza sativa
  unsure (1)..(3855): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaccatccattatttcttccaaatctttctgttctttccaggggatggtcctaattcatttgcgcaccagctagaaatgaatcaccaatattatatagaaaattagttcaaatatagtggctacttttgttgtgctcaactgcttttgcaatataataccatataagtttagcagttaggtacttaagggcaaaagatctatttacaacttatttgcttttagcagataactcacaaaatttgtcaattggcaagcatatatagctagacttcctttctatatataagttacaaccacttgggctgttttctccaggattacaacagttacacacactttaagattgaatggagcatcagctgaaaataactgcaaatggtaaggtctcttgtgtcatatattaacagttcttacaaagagtctgtttaaatttatttatcgttttagctttgtagcaatcacttgttctccataattcaactaactatatattaaaattgtggtccatatatagctacaaatcatttagacgatggcagcatcttagtaatttatagagtaaatttcacaaaactataggtatttgcacaatccatcataaaactacagatttaagaacatgcctccagagccgtctctagaaatctggggtccagaatgaaatgtaaatggggcccttaaattgtgaaaatttcatgtataaataagcacatattttgtgtcaactatataattttaatgtgtttttacaatatttaaaatacatcacataaatattaatactaaaagagagtaaaggtagtactgacctcatattctattaaaaagcatcacccgtctagtgttttttgaaatgaaatcattaattatatcatcataattaagataattatccaaggcatcattttcaacacccaaatcatacttattatttctagaagacatgccgatgagaggaaataaatgtcttcctgttttataaacaaaagaaaagacaatcacattactttggtccaataatcaatctaatcggccattcaaaacactgtgatttaatttgaatgtaaatgcatacggatatatatctatcccagtcaatgaatagttgcaacgaggagaatatataaacgtagttgaatggattgataggcccgtagatgcagctagctatgcaactagagaaagcacacgacttcagaaaagaaaagaaaatgctatgagtagaaatggccttgtgaatgatgattcgagcctttgaggagattggattgaggattcaaggatgaggaaatgaggatggcgactcgacgaggagggagagccacagaggccgcacagccagcccccagaaggtagccgctagggctcgagctgctcagtgctcgcctcgccgccactcatcgctgcggccgtggggcatgcttggcggacagtggatcgatggtgttgcctgcgatacccacacgttgctcgatcatttgtctgctgagtgcctacgtctcaccgcatcagcagtcgcgacttgcaacctcacatcgttgtctcaattgtcgacctcgcaggcgcatcagcatcagttggaaattggactcacgagtcacgacggctcaacacacgctagcggcaagggaaatgacacctttgaccttctgtccctttgctcctctctcactttgtaggaggccaggcatgcatgtggccaacaccgaggtcgaggccacaaaaaatcgagggccctgtgcagccgccacgtttactcatggccatcgacaaccctgcttgtctcacaaaactacatatttagtatctatgttattccaaaactagctttacctgtttgatgcaccaacagctgatgtgtgggacctacctgcagacataggaggcttgaagatgcgcagttgttgattgccacactagaacttctttgaatgaaaaagctggttttagaggtagaaatatgaaggaatacatgcatacatagtacgattggaaggtttccatggaggaactgaagaaaaaagaattaacaagaagggttccatgcataatttgggatttttgatgtggcaatcaacaatgatgcatgttgaaacttcttggactgcagtggtcacacatgtcaggtgaccgtgaatctaacgggtaaagttaaaacttgcagtagttttgtgataatgaatatactaaatctatagttttgtaactctatagttttgtaactgtagttctatgatatattatgtagagtgcatgtggttttgtaaaattaatttactctaatttatatatgcattaaaatttactctaattatattaacatatgcatggctggagcatggagaaagggtcaaaggaaatttccttgtatacaataaattattattgttagttactgatgataacactatcacttgtcccttcttttaattttggctttgtttatcataaaaatgcacatctaagctgaggctggtaatcattaggctactctttttcagatatgattatagaggttttatatatgacatctctataggctaattaatagggttgtagctaacctagctagccttaaagccattaaggtagttagttacaagcgtgcacttgctaaaacccaaaaatatttccaagttggtaatttgttaatcattctttaacatgagttgcatgcatcattgtgtttgtacttgctacacgagaaaaagctggtcttgaaagcgatcgggaagctacaggccggccgcaagcatgtactaattaaatccctactccattagaagatcattttctaaagcaaagctccaacacttcttgtctctagaggctccatccatcgatccaagtagtttcatcttcctgttgtaaggtttcatatagcacttttaaataatacggaagatgcacaaacatatcgctatgcgcacgcacacatccacgagtgcatcctatatatatcttagcatgcacttaaaatatttaatataaaccaatgacaaacccatagttaatattaatttttttttggaaacacggaccacatatataatatttataaacagtaagatttaaatcttatatttacatttacgattacacgagtataccactgattcctcctctcgtgtgtaagcttactactatactacactaggacactaggagatactacctccgtcccagaaagatcacagttttgcaccatttttgtccaacgtttgaccctccgttttatttgaaatttttttattattagtatttttcttgttattagatgataaaacataaatagtactttatatgcgactaacttttaaaaatttgtttataaatttttcaaataaaacggacggtcaaacgttggacgcggaaacgtacaactgcacttaaaatgggatggaggtagtactacataatcctgaactgttaaaaattagttaccaacactacgtacgtgatatgaagttatcttgagccaaatctcaattgcttttataggggctgttatataaagatctaagtgatgtcaaattaatggttctcatcaaaccattagagattagttggttattatgtaagtagtacgtagtgtgctaattaacaacaggat

SEQ ID NO: 43406 - DNA, 3061 bp, Oryza sativa
agtcaacggtgtcaaacattttaaaatagagggagtatatttcactactttgaaggatttatttatacagggcctcagagcgaagatttgttaagacaaaaggaagttatggccacctccagctttaccagaattacaataaagttttttaaattttaccactttaggataaatcagtaaaatatcctctgatttaaaaaaaaatcacattgacctcctccaagctatacagctagctcctccactgcttacaatcatgaaatgtttacaataatgagatatatttatactaccaaacgaaatagttaaaaaaaagtccaaattaccccctccctccccccctccccctcttccgccctaaaaaattaccggacatttcataccttaaaactctttaaatcgtacgaattaaacccctagaactattttgagtagttttggtccaagctggcacacatagcatcacacaatagtaaaccaatcagaaaaaacacacacataagggccacttgtcatctatctcttccctcattccctctcctctctctccctgcccgcccgttccccctctcttttgatggggttaagtggcagtcgagctcgcacgaaggcaatgacgagcacattgctatctactgccaacgagcaccatgcgccccctcttcaagctcccgcctgcgacaaaggcttgggcaggctaatcaacgagcacctcggccctcgcggttaattagctccatgttcttcgtctccgcgcctctagctagagcggtcgtcagtgctgttggagggataagacgtcttgtgtttggatgaggtgggtaattcggacgatctcaataattcaggggtgatttagatttttttttctctatagctattgcttgagagataagtgtttcaagagatagataccatgggtacaaaatgatcaagtggagagttgtataaggagatcagcgtatgttcgtgctctctagcttagcttgtcgtgtcattgccatcatccatataacactggttgatgacgttcgagcgagagctaatcgttagttagttagcaataaaattatgtgcgcatgcatgtgtagtgcgtgtgcacgcgtggctgcagtctcgatcattaatccgttagaaagccaatccatgttgacatgcaatgtgtctcaaaaatgacccatacaagcatggtaagtactacaacttttgataggataatgtaatagtatcatgcatgcttatgtaagagcagatacaatagcagactattagccagctataaacatattttagtgagatacaagataagagagaagagcagcaagctacagatctgtagccggctgcagcacggactctaagacacaatgtatatatgacaggtggaaccatatattaatagtatagtaagcaactattgtataaattggctattagatcggctatagatgaattggagcttgtagtgggctatactattaaacttgctctaaggaccagtaccgtttgccattttgtaccaagacaagaattggacagtgtgcatatatctagttatgcagaggcccaaaataattatctttcaacatggttttgtataatcttcatgtaattatcttggtttcaaagaaactaactttatcaaagaaagaaagacacgaattagattggagcttgttcggtttggatgaaaagcaaaacattttgatttctaagaaatattttcctgtaagggtcatttcgttttaaggaatcgagtataggaaaaagaaacaaatctttgttcctatgagctgtaaaaagaaaacatagggaatttttcaactcaaatctgttgaaaaattctgcgtgcacctattccttagcttttccatttcgtacaggttcaaattcctcaagaccttcctcgtggtactgtgccaatgagcccaatgagctttcacaaacagttcaaatatacgcatatgtaggtaacttcaacacttaccaaaattaaaaatgggttcatatatacactgaatttatcaggattccttattaattagtatattactccatccggtcaaaacatgccatttaaaatatcaattgtcccctaattaaaatgtaggtttgaccactaatttctattgcagtatatttgattttaaaatctgaatttctacattaggaaagtatgtatttcaagacaaatctccatatgatttacatataatcaagttagcgaaagcggagaaaataacgagatgagtcggtgtcccttaaacacctttttaatatcattttctttatggtggcttcatcttaaattgaagaaggcctttatcacacttatgttttaaaacccagaaaatgttgttatcacgccaagtgaaatagttgttttttttcttgtctacctcctttcaacctactgaagttgcgctcactgctatcctaagccctaatgttgcttctcttaccatatattctaaatcaactgccctccattcaaaacatttgataagttttttatgtttaaagtattcatgctgttaagagggactagcccttaacattcaaatatatacagcatgaattgtttctaatatattcttcaattatttctgtatagaaacaaagttgattaaaattatacctacagaaactatggtacagatttataggatcttatatgcatgagaggtcaattgttggctgaggcacaagtatgcagttgtcctgaaaatgatgcttgttctctcatttgcaatagcaaagatagatcccctcccatacatttaagaacatatagatatcaaaattataatttgggaggtggaaaaagatttgtacatattaatttggctgtgcctcccttatcaaggatggtaaaaagatttttagaaaataagatatgctctaattaggagattgaatatttgaagctatctgatgcctcaagctagacagctgtgggtttttcaaatgcttatatgccaattttgaagttatccctttcacacagctaaaccctgggatattgttctaaaaggcaagttggaagaactgaagaagaccg

SEQ ID NO: 43407 - DNA, 2592 bp, Oryza sativa
ccactcattaaatttctattagaaacacatccgcgtgtatgtattatttatggacaccagaattaggaccttagtgggtgaaatattgtagacatgattacataaccacacattcggtgctttcccaattatcaaatgatgtattgggataaatctacttgtatacagtgactatagtcccattcacacagtttactagtactacctctacttctgttcacaaatataatcattcaaactgcttaaaatttgtctaaacaaatataagcatttcaaaagtactacttatcccatcaatcatctctcatttaacttattttccatctttatatccaaccatatccatcatttaataagtagcatttgttctctcatcttaatatctgccaaatacctataattaaattattatatttgtggacgaggggagtacatgctacttgaatgattatatttgtggatagagggatttacatgtgttcgacgatacaacaatgcatagatgagggtgatatagagcaaatgagaagatagagtggccgtacgtagcattcgtacacaagtgacctttgcagtcacctgttgtaattatttcatatagtgatagagtgcaaatcctctttccaaatattactacaaaacaacaattgaagtgttagataattggaaagaagatcagcactgaacttagaagcctgcatatgtgttttttttttaaaaagtcagccttctgttgctcctagtcctgctaaacagcaaaagtctcctaggattaaaaagcaaagcactcatctgttgcaatgagtttaatggtttcttaattgggtgagtcttttcgtttgtggctttgggtgaatgactttgacttcagtaacttatttttatttttcatgctcaatcatgcatccaactttggcagtttataacaaatgcactgcttgagttaactcacacacataagttttccactgatcactaccagaaattaattggcagtagttttgacaaaaaaaaacacaagtaagagaaggtacaatagcatactataaaccagctataaacacatttcgagaaaataagagaggagagagaagagcagcgggctacagatttatagccagctgcagcacggactccaagataaatgtgtatatgataggtaggaccaggtagtaattgtgtagtatactccctccatactcgtaaaggaaatcgtttaggacatcgacacggtctccaaaacgcaactttgacttcttaattctataaaaatatttattaaaaagtgatatatgtatacttgtatgaaagtatttttcaagaccaatctattcatataatttttatattttcaaactcaataacttaagagttattcatgatttatattcccaaggtttgacttaaacattgtcctaaacgacttcctttacgagtacggaggagtatgtgtataggtaactattgtataaattgattattaaattgactatagataatttagagccagtagttggctatactattaaacttgctctaatactactccctccttccctaaatgtttgacgcagttgactttttaaacatgtttgaccgcgcgtcttatttaaaaacttttgtgaaatgtgtaaaactatatgtatacataaaaatatatttaacaataaattaaatgataggaaaagaattaataattaattaaattttttgaataagacgaatggtcaaaacattttttaaaaaagtcaacggcgtcaaacattttgggatggagggagtactatttttcctctatatgactaatgcccttgagaattaatcaaattaaccttgatctcacagatttttcatgactggaaaggttattttttcaaaataagaacataagtaaatattaggaataaagtcagtgtatctttaaataaaatatatagccaatggtgatatcggtgaacaaataatagagcatatatatatagagctcaaatataatgttctccacaaatagtgtgaaaaaggctgctagctagcgtgatatatatttattaattctccaacatacaagtatagttttaacctaccaaattaaaatgtcaaataattaatataccttttaacatgtgtacattaattgcaggcattaatatatatgtcatgcaaaccagtgttaattaatttgtgattcatgcattgatgctagttctagaatttaaacctatacatgtatagggggttacattttatagaagcactcagaaagcaatcagattatcacatgaaggaatcacctttcaggggctgtaatgttcgacattagcacttctagttgcctttggttttatcctaagcctttaatatgcctatattatcttatcatcactgcatgcatgcatctactctcctttacaaaggtctatcctttgctaaacctttcatcaaaaaatacagcgaaaaaaaaagatctccatactcctgattcttgtcttagctagccgacattgcatatataattttgccttaactcctctcttatactgattgacgactggccagcaacatgtttttacagctttgagtttgttataccac

SEQ ID NO: 43408 - DNA, 10760 bp, Oryza sativa
cttaatatatttatcatcaaaccgagcatataccatatacgtaccaaactttgctagtagtaccaaaattaccaaacgggtcctatatatgtttctgatggacgggagcgtatcctatacacacaggccctcgcgtgtacacaccgtgtataccaactaaaaattatcacaaaaaattctagaaaaattcatacatgtactttcaatagtattacatttacgtgcaaagtcgcatcttcaaattcattctacatagagaataacaaaaaagataaaattctgacaaaattgcaaccttaaagctgtcagattttttgttttttttgttacggctaaaatataatgaatttgatgttaagattttaaccctaggtgtaatacaattgaaagtatgtgtatgattttttctagattttttggtgatattttttagttggtgtgcacatgtgtacacgtgagggcctgtgtgcataggatatattgccctgatggacaccacataataggtttcagaatagtcggctaatcgatccaagtggtgactggtgatgagcggtgacaaattaagcgaaatgtgacatcaacatatactcccttcgtctcacaaagaacacatttttaggtttctgtgtttaacgtttgatcatctgtcttatttgaaaattttataaaaaaattattaaaaaatagtcacatataaagtattattcatgttttatcatctaataacaatataaatactaatcataaaaagaatttagataaaacgaagagtcaaaaactaaaatatataatatttatgggacggagggagtaactgtcattatcttgttggaacatgcaggtgttgcttcccagttctagaccaactatatatgattggtggttgagttgactgttttctaccttcacttccagtgtttgatactccaccaactaaggtaggtcccgtttagaacacgagatattatccatcagtcttgaagtgattgaagttcaatcattcaactgtttactttgaagcagcatgtaaattaagatggcttagcaaatgggtagtgcaccttatcttaatatagtttacggcgatgatttatcattttgggaattttatgtcacttgtcgagatgcgataaaaccaccttggccttgcatattgtctttcatttttacagagatgatttatatgtaaaaaaaatagtaatacaaaaaacaacaaatagtaaactaaggcttcatagaactaagaacaaacaaaaggcttgaataggctccaagagtgtaatttaaaaatcatcagttgatggtcgagttgacaagaataataatctatatgtctatcaaaactttggaaatggcatggatcaattattcagattgtaaggtagatagatatatattgaagaaaaaataatatatagacaaaattagataaataagtaattgtaataaaaacagagtaagtgggcatatagaagctatgtggtagctagagtatatttgaataaataatggcacattttccccattaaattatatatatcaaccacatatttcgccttccttaataggggtaaagaatgccaagccattaccggtagggatatcaggtcatttaggatgacatgaggagagtgacattgagtagagagagtgggaaaagagcgagaggtgtgatgtattcatctacaaaacactgtaaggactgcataaagaatcaagccattaattatacaaatctacctgcgtaatatataaaattaacatggaaattatattatccaaatatgatatgaaaaacatatgtatgagttgttatgcgtattacctaaatatgaatggagaacatgttttgtttttgaatggaaaacatgttgtatgagttatttacatatagatataatgtaaaagatttacaagtggcagtacaaaatgtttttatgcatgatgaaatcatattattttgctaaatttctttggaaaaccgctattgtttttgcttgcaaccaccaagtagtttctctcagatgtttggtagttagtttgttggtatcaattaaaaaaacaaaaaaaatacatatcttaatagggacatatgttttattttaggctctatggtttaagtaattaagaatggtgtggttttggataaaattctaactaaatcttatatgcgtacttttcaagacaacacatttgttttggctccgagcccaactacaaggatatgatgagaacaaatacttcattcatgttgcatgtcagaatttagagacaacaattatgcaaatattcgttaacttcggatggcgatttaccaatagaattgttgtctaaataagttgtatctactcactattgttgatggttcatcactaaaccattgatcacgccatacaacttcgaaggcaaatgatagacctgtgtgctcatcatcagctgaacacttcctttcatggtttctcttttcctttcggcttattcggctgcctattttggacgcctttaggctctagctagtgtgctccatggtcaaccaacttgcagtgccttttggcctgacctcgtgatcatgaaattcatgattctccaatcatgtcactgggtgcaattagctagaaccatggcatttctatagacttttaccctacctacctagctaccacccccactaattcgatcgtgacatatattcagttactcgtacactgcctagattaagcagagatccatgcatgaacaaattaaagattgttgcatctcaatgtgcttcccagctttgccatgatttgcagtttaagatgtggacacctgacttgactcgatatcaatctggtaatcggatatgtgcatcacttcatgcatgcacaaaattcggctcatttgtttcgatgaaaattggctttcggcgcaccttgattaattccaaagcaatttaagtaaataatcattacaaaggaatatcatcatactagtacccaataggacaaattaacctttttcttttgcagcaccagaagggaatgaatgagtgaaggatcatgaaattattgtcttttcggcctttttgggctagaacatgtaaggaaaagagagtaaagtgtgactcacataaagaccagtaatgatgatgaatctctaacaattaaaaataagatttattataggtcatgaaaattgtacaaagataacagcaggaatatggaactattgcccaacttttttcttctggaataaggatagttcatgccgtcacgcatcaagtgtgcaaaacatctgcacgtattatcaaattccattctttttcaacaaacggaaaaaaagttaatggccatggaattcggattacccgagaaatatatgtggctgatagagcgtgaacataaacagtctttcaatttctagatgaatttctttcataagtgtcaattcagccgagtataaccaaagtcttgattacaccgtttaaccaatgttaatttgacaaagagagatttgagatagtttcactacaatttacaaattcaagtattgtacataaatgtccacaaaataaacaaaagtgtctcacaatgcttactaaggcaacaaagcaaaacaaataggaattattactataaaaaaatgatcaagaaacatgtaaaaacaagacgttttgctaggggaggaaaatgggatagacatgttacatatggctgttgtatctagctccatggatcgtcccaacctttgggcccctctctcttaacaaaatctacaatggcccgaactgcttcttgcaccctattggagagagcatggtttccccattctatttcaactttctccgcgttgcccaatgcgcgacataatctgcagtgaaacatatatagagcattagagcatgatgatatcatatcaaaattgtatctggtatgtttggatttctaatttcacctgtccacaagtgcctccttatcaacgtattccgggacatattcatcccccattgagaaaataacctgcagccaaagcacttgcaagatataaaattcagcagctacagcataatgtcatcgtagcttacctcatttggcaacctttaactctacgaacaaaaagtcttttttttgtagaatgcattatacagtatgccaaagagaagcttctgggatgtttgttatgctcaaatttcgctaatttccttaaggttattgattttcacattctaatgcagattttaaatgtacttcttttcctgatttctattccattagcttgcttaatgtggtcaaaaagcaaatagaaccaaaacagcccactgggaaaattaccccatttacaatctatgcatgtataaattacgaaagcccaatgctcaaagttaggttcaggacccccatcaatatatatgagttcttcggttctttctgtttttgtatcttcacacctttcaattacttaacatgcaagtcaagtactaaacgtaatcaagcctagttttattacattatagcattgaggaaaccaagtctaatatatctatgcatatatggccaccaatgcaaatgcaagcattcaacctacaagctgtaaacagattcaaggaacaacataatttaactacttggtgaattaggcattaagaaaatatcaaatatctgatagtgaaacggttatttttcttagatcgatcagcttgaaattgttgctttaagtagatacagaaacaaaggaccataaaaggataaccatcactaatccctgtattcatagtcatcagaacagaatgataatgaaaatgtgaacgcaatatttaccaccaattctgggctctggctatgaccaaaaaaagtggtgtttccatgtgtgttgacaaagtcacaagtagaaagggacaatacctggcactgtgttgttgacatatgaccaagtctctgcctcaactgatcttcactaagatctgagctgaacatgtcatcatcacccatatatgcacaaagggagtgatacctacacattatttctatggcattagagtacaactgaagaaaaaatgatgtttgattcgttgcagataattttttaagatcacactgactaacaaaggatactaggagatatgctggtaaatagatctaataaaataaaagatatggaacaaaaagaagtaataggatattggatcatttgaaacaatacagaaaggttaactttgcatcatttgaaaagaaaaaaggactaagaccccactaagagttggtcatgagaaacataagtgggagacaaaaacatcaggtttgttacatagtgtttcattcttatcatgtttgttctattcatgtggttcaattttcatcatccatgattttaacttgtatttgcgagtttctttgctcaacataacatagataactctcccatgctacatggtccacagagtctacgagcaagaaattttgtatcattggtcatcatagccgaaggaggcgcaacaagttgtgtcttaggtcatcatcatcacaatctagagaactataagggattctacaaaattctcaagtcccaactaaagtttttcagaacataggttaaacatccaatagcaataacagcttgtgactcctcatctaactctttacgtagtggttgaagaatacatgatcataaatcaaaatactgaatcccattaactatcatttttcagtaatcatagtatgagcggttattgaaatttttgttgctaacagaggtgtagatcttgcgacatctttattaatcccagaggaagacatcactgacacaaaagtatatctgagcatctcaggcatggaaattgatacctgtaggcagtaatcggagcatctggatttgcttccctgggcatcaaatccattccacggccctcacttaacatttttgctgccaaatctatcatttctgcagtttctggaagtgttgctctatactccctgtcacttactggggcctgaatatcatagaagttgaatcaagataccgtttacatggatttacacataaaaaagcaattattctcaacaggttacaaattcatcagtttggtctgttatttagggaggaagtccctaacttcctatcatagttcacattcaaatattttcacttcaccccttcgcatccaaacaagaagatagggacagggagaatacctgcaaaatgaccccagaaactgccttggaacatgcaaaatttgtccgcatgtaatgcacaatatcctggcattgacggaaaaaattgtgttatctttttctatgataaaaatacaatgctgaccataaacttgtctcaagtggtcaagatgtctaaactttagaaatgcatataagagcctctgaatttgtttaaaatggaccactcaaggtcccaaacatgccaaaaggagcacagtacctgacctgacaaaccggactaagttcaatgtggatgttttgcccacatgagtcttccatgaaaagtgaatttgagatgaaaatgtacacataaacccctaatatggaatccatgggcattatgtgtgccccactgaaaataatgaaagtgctcttggctaatgagaatatgagacccagacttctaggattctcgagcaaagttcacaaattgtgtgttttctgaatttcagaatgcattggaaattggatagctaaacagcaaaaaggctggttgtttagagcgggaagacagacagagatagttgagtaaatcaaaatgggagctggtcaaccaaaagtgagataaggggaggatagaaagagggcttatgataagtgattcattcccttcttcacatgctttaatttctactatgaattaatactaaactccctttgtccaatctgaacatgataagcttgaaactcagctacaattcagcgcacggagaaggaaattatgataggcaagtgaaaaggggaagcagaatggactaggacaggtttggggcaaggtggaattggaagggatttgcatgcaattggactagtatggggattaatatcaatacaagtgcttatgtacctacagttttaacaatactggatgaatttgctttcgtatatgtccatggcatggctggtaagttcctacagtagtcagtaacactagacatggtcaccactcagcacatcaaatcagaaattatattaagtgtggcacatctgtaatctaaagtgaaacacaggtgccaagtccagtatgcaattctcaagtttagggatccacttgaccactggggtaagtttataaacctatgaagcattactatttagactataaatagtaccaacatatcagtgagcatacctggcaaccagtactgtgaccaagcaatattactccatcagaattttctttgtttatcaagtaactgatgagttgatctagttccaatgcatcctttgacaagaaaacatatattcaatacttgattccaaaaaagtagggttaaaatgtaaagcacccaaaaaaacgaataaaatggacaatccaatcaaacgtcctgcagtagaataagaaaaacacagaagggaaaaaagaagtttaccaccaaactagcagatagctcaagcaaccacattctgcatacagtactttcggatggcaagtataaattaagatctcatgactactttggtggtcattggaaaatacaaatgagattctagaactagcttcctgggtatgagtgaatgtgtagtcaaatcatgtaagtaagtcgatcaaagtgcggaatgacaagattgaaaaactgaacatattatgtaaaaaagaatatgaaaattaacttgagaacattaaaatcattcttaagtacctcaattcttctttcagcatgccactaagaccatgaacacctcaatgtatgcaaatgcggttcttaaactctaaggatgaaaaggtccatgttacagatcatacctgctctaagctggaaattccatacccagtgtatgatgaagaaagtaacggctgtaccagtgaccatttctcgacctctagtgcaagtgacaaaggctccaagtagctgtaatgttccaacatggattagaataataaaattagttccagtcttaaccaagagaaaaaaaaatgataacatatgtattatgattatatacttacagaacttattgtgttatttttcctatccttctccaattcatcatttttcagatttttctcatgtttgttactctcaacatataatgaattataacttgaaattttatacatatgccgagtaaataataacaacaactagattatctcatactgatttggtgagagggaagtgattgcatgaatgcatcatgaagtactaaatggtgattatatagtatatatttccatgtttccatgtatgcatcatgctatgcaactcagtacatcagggcagcttccatactgaggagtgacatggctgaagggaaggcactttaggatagggaggagaccacagactaggatgaaagaactttcagggagaaaggcatttcactccatgcttcagaacaactattttatagactaatcaaaacaataacttgactaactaacagtaaagataccaaataacgttgttactgaagcgcttggacagtaccctaattggaaactcatgagaactttcactatcaatagtgtcttctaattcaacaaatgatatggaaaaatatttaatggaactgcatattgccaacttactcggttgctaaaaacccatccgtcaaaccaccgatgaagatcacctggtggttaaaatcaccagttttaaatgcgacctgcaagaagaaatttatagaagaaacaaaacagtaatgacaagccatatctaattagaagttaatatatggatggtgaggctgtgagggtttcctttgtatatgcaaatcatcagaaaatgaagggtgttacagaatgtacacaacataacaaagcatagtgcatagacatctgggcctctgaggtagttaaaacaactaggttaaagaccatgtttggtgcttgaactattctagaagtcctttttcatgctaaactcaataaccagttttttttttcattttttcgccctcgactctcaaaagcaaatcaataacactctagaccatattcacagtgtttttattgacatggtgatggttttcactagtgcagactcctactatacatgtcttgctaatgtggatgccacttaggtccacagttccacaccaacaaagtttagtacctgaaggctatgtcagttgtcatgtcaatcaaaactaccatggaatcagcttttgggtgttatttttctggttttgaaagttgagtgtgagaaatgactgggttttaagttaacggtaaaaaatggaatccaacaagttttgagtgccaaaaatggactttaccttagaattaaaatgataaaacttccaagagatttcaaaattccaaccagattctataatgtgtaaaagggtacatcttaccggcagaataagttatctagaaaccacaatattgcaaccacatcctggcatgatataatgctgatgttctataggcttactaccaactgatcatcttaataaggtcacaaatggcaatgtggcactacgtggtccaaacaaaggaaagaatgcaggtacattgtgacagattatcccattcagagttgagaccctcacttttgtactacaacaaaaggtgtatataaacaaccttgcttgtagcaacaaaggatcataacaaacatagctggcagagatttgtacacttatttcgtcgcaatttcaaagtagaaaacaaatcctctacacgcagcaaaaggaactactatgcaaaagggaccataagcctagatagggtcaaacattgtatattcattcagtaggctttcttccacgcgagaaatgatacagaagcaaggagacaagacgcaaaaggcctagctagccgtgttaacatcagcaaaagaaaactaagagaagaaaattattagcacacaagttgggctcccaaaagtgcaacccctctaaagaaagaatcgcctgcgcttatttccattacaagccctggatcatgagtagaaacacggctatgctacagaagcttccttattccataagcctctatctctctctctctcaacaaccgcacgcacccagcggaaaagggcagaaggacgaatccaacgaggagatccccgcatcgcatctcgaaggctgggcggcacgaacgcggtaaccttctagaagattctagaaccatctcgacctagggaaattcctcctcgtcccccgctcaaatcctacaccatttcaaaccccccacgacgcaatcgcaggatttctacaatgcaaagtaataaaccctcgaatccatcatcccgagcaatcccaaaacgatcccccacagatctcccgccgcaagccgcacgcgcgcgcgccccagagagagagagagagtacctgggcggacttggggccgtacttgaacagcgccccctgcacctgcctcctcttcccgcccgcgccaacgccagcaccagcgccaggccccgcagcaaccacggcggcgaccactcctccacctccacctccacctccacctccaccgcccctcccacccgcgccatcggagaggggagcggccgcggaggcgacgccgccggggggcatggcggaggaggcgcgggcgatgccggagaaccaggagggggaggatgtcatggcgcggccgccggcggcgaggtc

SEQ ID NO: 43409 - DNA, 9158 bp, Oryza sativa
agagggatgagctgctgctggtgcgggaaatttcgtcgggtgattttttttctttttttttttttttgggttgacgggatgtgggttgcgagaattttcagggtgacgcgtagccgcatgatttaatctcggcggttggtggccttgctgtcatcctctctttgtttgtttgtttgtttgttggtgttttgacttttgagcggttttttctttctcaaaccctcctctttgaaacaaaacttatgagcctgttttatgattaattaattattagtaaaaaaggaaaaagtatattaatatgactttttaaagtaactattatataattttttaagaaaattgtaccgtttagcagttcgaggggcatgtatgtgaaaaatgatggagttttaatggcatatggttaggtggcagtctcccatttattgaaaaaattattgccacacatattggggaaaatatgtggtggaatatatatatatatatatatatatatatatatatatatatatatatatatatatattggaaacttggaactaccgttggatcgaaaaatagacatccgtgattcatccatgtcatcatgagtaaaagttttacttgcgataaaatttttacttatgactaaatccgtgagtaaaatttttattcgtgatgacgtgaacaaatctcaaacatctatttttcgatttaacggtagtttccagatttccactacatatatggtttccaccacatattttccccacatgttgaggggatattttgctagttggccatatttggcacttccatcctcgctcgatgagtattatcctcgatacttctaccgtcattatccaacatgtaatacaggttttttaccatcgtactaaaaccaaaagtacctttttaaataatataaaatctataaaatgactaatactacctccattttagaatatatgacgccgttgacttttcgcacaaagtttgatcatttgtctcattaaaaattcagtatgaatatgtaaaactataggttaatattatattttatttgatgataaaacaagtggtaacaaaataaattaaatttatatatttttttaaaataagacgaatggtcaaacatcgtgtaaaaagtcaatgacatcctgcattttgaaatggagggagtatatggttagcccaaaagtacaattttggaatatataatattgactaatacatagtccaaatagaaattacatcagtatttctttttgaaaacagaaattacatcagtatattgtcactatggctgcgtttagatccaggggtgtaaagttttggcgtgtcacatcggatatgctgacacacatttgaagtattaaacgtagactaataacaaaacaaattacataatccgcctgtaaactgtgagacaaatttattaagcctaattaatctgtcattagcaaatgtttactgtagcaccacattgtcagatcatgtagcgattaggcttaaagattcgtctcgcaatttacacgcaatatgtgtaattagttattttttcgtttatattcaatacttcatgcatgtgtccaaacattcgatgtgacaaggtaaaaatttttgccaggggatctaaacagggcctatgtaatcttgatgtagtgtagttaatcacaacgtgcttatgagcgcgtaaacttgaaacttaaaattctatctactatatagacataaggaggaagagatggaaatatttttattaaggttacattgaaattggtattgatctattcccatataatgtcaaacatcaatgatataacctacctagtattgataacataacaagggtgttctacattgacatggatgcaatcaagtctcccttgctactttgtacaatctgattttatattccccaggcatgcacatagaacaaaagtacagtacgatagaagatttaaaaaggatgtgcatcaatcatcttgggtaagtatgatgtagtagtaatggattcatgatctattttaatgccctgttgatattatttttcaggcagaataatacatacaggtagactttcttcaaattaagttgacaatacctcaccgtagatgttgatttgttaaaaaaaatcgttttcttttatagaatattcagatcaaacttgataaataaagagacaggaaacactagaatattcagatcaaacttcagtgattgaagtggcaataacaaattcaactttccatcgacaggttcttgtgcttgtgctgatttgtcacatcatcaaaacatcaactcacacaccatctgtttcacaaaactcatcattcacaccaaacacatataagattaaagcaatcaccttccttctattgttgcaactcatcatgataaagcctacaatatttatcaaatatgaaacaaaaaatacagttccctctttcaaataccatgtaatgtaaaagtaaaactcctatatctatactacgaattttaacaacagtagctcaaaaaggatcattcttttttttttaatctcggcaccacaagccaaaaatcaatatacaacaactaatcaacctatgaacataaacaaaaagaaagaaagattacaacaacaaaagaacttatattattcatccagttggtcattggtgtgtgcaatcgaccacacgcccttgaacatcccagctgactgaagtgagaaatccgacacaactctgaacagctccggcaaattcgtcctgagaaggctgagggacttctccctgaccaccctgcactgcttgacatacatctcctccagctccttcatagaaagctccaacttttccatggcagccttccgttccgccatcggatcggggcgtgcaccgtcagggttcctgtcctcaggaaggatacccgcagtttggtggatgtacttttgtgcccagtcatcgaattgcctcctcttcttcccataatccctcctggtatcctcgatcttcatccggagcttcagttcgtcttcctgatgaaccaggattgtctttacgatctctgcaaacgtgtttatcgccttcttggcagcctcatcggggagctttccgaggatttcatgccaagcatgcagcaccctcttgatgggaggtgtggtctcatgtggctgtgatgaatttggcttcaagttggtgtcgatggggatcacattcagcttgatccaggtgtagagggatcccacatactgcttctggtatgtcatgaacttgtcgaactgagtgtgccactcatgtacaacattccacagctgcacggtccggtcatggtgttgctcgcttgtttcccgcggggcgaccgagatgtccaacgacttgagctccaagatgatcttgagctgtgttttgtgatgaaggtacattgcatcccacatgtgccacattctgccaatgtaagaaaacaaaacaattaagttctcttgagtctatatctattgttcttttttgtttcgttagcaatgttgttattcatagtagaaggagaaatcattgaaaaaggcttaccccttcacaagttcaagaagttttgggtataattgttgatctctgagacggttgatctctgcaactgttgactccattgtttgcagatcaactacatattttgtgtgcaagtgactaacaaccgacttggtcttctcaagtgaggaagaagtgacaccacgctgcttctttttgttgagaacagctagcttttgttgatattccctcctgataacctcaaaatcctggctcagatgtacaaacataacagtttagatcaagaaacaagtgacaatatggtgttgcttcaatcattttcacatcctaggagtctaaaacatggaagcaactgtcctttcaaaggaaaaaacaacatggataggtaatgaaattggattaaaatggctagaaaggtttacagatcagatgattgcatgaacaaaaaattccacaagaacaggaaaataacttaacaggaagaaagaaaatactccagcaaactagtagcagaggtcgtctttatgtgctgaacaaatcatattgcaaaattattgtcgtaagaaagtgctattgaatttagcaatctataagattgtaccaataaatgagtgggtggttgcaaagatttatattttgaactagtggtaaacaaaaaagaaacaccatgtaccttgacttcatggtatagttttttctcccatgcaagcagcttatcaagagtggtagcatgtgtctcccattcgtcatcgtccatttcattcctcacattttccggttgaggtatccctttaaacgagcgattccaagtgattacttgcatcactctggcagaatggtccacaaatcctagcaagaccgaagagggatgccatttaacaacagaaggaactcaaatatgtaattcctatttttttcgaggaatggttctcaaatcctactaagataggatgcaaatggcatttacgttaacaatggaaggaaaccaaattaacctgagagttctcaaaagaagaaaaaaaagaatgctgagtatgaagaaaataatcacagcgagcactaaaaaacaagcaagacagagactgctcaactgaacttgaaagtgaatcatgagaatacaggtcatcaacaatttaaatgtgaaccccaaacaactcattcccctgtaccctgtgacccatatgtgattagatgctctgtccggttcttcgctttacccgctaaatgcggctccactaccataaccattccattggcccattccaataattaaaacaatgcaatcattctgttgttcttgacagtgcagattagtaatctattcaaagtcttaatacaatcgtgtggaacgggttaacttcttccataatcaccaagtcaccattaataaaacgtatctgaacttctctatccaatcttgctaaagcatattccccgaaacaagtgtactgattattttactcattccaatgagtaatctgaaatggtagataagcagcaagtgttctatctatctagtatcacagtgaaaaattgaaaaagattgtaaagaagatattttaattttgctgttggtttgaaagtaatctgaatcgtgaagtgaattcatcgtgttggtttgaaaattgaaattacctcgcgtctcagcgaagttggagtggtagtgcatcctggcggcctcgagcagcttggacacctcgtgcgcgctctgcgacgccttgaggaagtgttcgtccagggcgcggaggatgtcgccgacgcccagcttggccggctgcggctgcggcggcgccaccagcatcaccgccttcgccttccccttcctcgccgccttctgcgtcatcgcccgccgcgtcgtcgccgcctctgccgcggccggcctcttgccctccgccacctctctcgccgccgccgatggctggtgttcgtccggcgcggggggtggtggttctctccgctcggccgacgccgaagacgatggctcggcggcggcggtgtccagagtgggcggcggcatggagtcgaacaaggagctgatgaacccgccgggggtgtccaccttgtggtcattctccggcgggaggggaggcggggagcgggagggaggggggcgctgcgaggggagcggcgggggtggcttcagttcggcgtcgtcgtcacctcgccgtcctcccgcgtcgccgccgtcgccgccctcgtcgtcctcctcctccatgatgggcgcctcgccggacggcttcttcttgatcggctgctgcaggtgcaggtccggcgcgctcatcgacctcgcgagcggcgccgcctcaacgtcgccatgcggaggcagcggcgggggcgggggaggcgggggaagctcgggcggcggcggcggcaggatagccagcacgggcttgccatcggaggacgccgtgacgagcgccgccgccgcggccgaagagtcagccgaccccgaccgcagagccccgccggcgtgggcctcgccctcgccggaggcgtagtcggagagcgcggcgccgacgttcttgagcgcggcggcgtggcccgcgtgcgcgcccgccagcgcgtggcgggcggcgacggcgtcgcgcaggaggtgcttccgctcgcggcaccgcgccacggggccctcgccgtcctcattggactgcgcgcaccccatggggtcgccctcgccggcggctggagtgggggtctctggtcggtggtggtggtgggcgagtgattcgatggaggtgttcgtccgatggatcgaaaggctggcgaatgatccttttgggggaaggggagatggtggtggggggcgggtggttttgtgctttggaataaaggtgggaatgggatgggatcagtggagggccacgtcgttgcgacggtgaagaggaccccggatgtgtcatgtatatgtccacttgtcccacacgtttaccgtgtcagacacacaaatttcatatgaagaaaatttaagttcagttcagttaacctcagttttttttaagtagtatatccatcccataaaaagttcatttttcagtttttaatacaacatttaactcttcgtcttatttaaaacctttcataattaaattttttattattagatgataaaatatgaatagtagtattttatgtgtgacaaatttttttaaataagacagacggttaaacgttagacagagaaactcaaaaataaacttattttgagacagaggtaggactcatctttcttgttttccacgcatacgtttttttcaaactactaaacggtgtgtttttttgcaaaaattttctatacgaaaatagttttaaaaatcatattaatccattttaaaaaatattaataattaattaatcacgtgctaatgagttgctccattttacgtactggagggattagttcccgtcccctaccaaggaaccttaggggtggttggtaagaacaggtataataatagactataagccatctataaacatatttttaggagataagagatgatagagaatagcattggattacagatttgtagctagctgtagcacggactctaaaacgtaatatgtgtatgacatgtgggaccaggtattaatagtgtagtatatgtttatagctaactattgtatgaattagctattaaattgactatagataatttagagctggaaattggctatactattaaatttgctttaacccttctttcctggcaaaaaaaaaaagtagatcattagcacatgattaattaagttaaaaacttgaaaaatagattaatatgatttttaaaataggtttcctatattatttttttaaaaaaacaaatcgtttagcaattcagcctagtcaacctagtcaaaaaaaatattcatctaaaaaatagtttaatatgggactcaaccaagtcaacaaaaaaaattcatctaaaacatactagggtggatggactacgcttgtttatttgtttaagctctttcagacacatggccgaatgcttaaaataatagataagatttctgtacttttattcttaagctgttgtaaagccaatgcttaataaacgaatctgatggagaaaaccttaaattaatttaaaagtaaagtaacataaaaaattggatgtggtttcggtgatataaaaacttcgaggatatagcgaacccatttcctggctccaaccaatgaattgcacctttgattatgtctttcaaagggacttgatcgtaatttaacattttcattagctcctctctaaagcttttctagtatggatccagtcgcttgttcaagcctttcaaatccaatttatggatcttactttatcatgattttataatcatccatatttcaaaaccaacactttgtgtcatgctcgaaagttagtcattctttttcttgctaaggggtgaaagaaccagcgtgataatggtcctgtttgggggtgtttggggagtttataacaattgcacctggtttcagaacctccgagtaatacagattttcattaaagttgtgaaattcgtagcaataggtctatagtgttatgaaacctatcttattatcgacgaattaaattataagtgggaagtttactacagaagaaaacttacgccagaagccagcttacagaggaagccagtttacagcgtaagccggcttacggcacaagccagaaggtccaaggcttacgatgtaagcctccaccctccgcctataaatagggcccataaggtccaaggcgaggacaaccgatcttcggtctcctgcttctcctcttgtagcttgtactcaaatccagaagaaataaagcttccactcgctcatactttttgtgttccacaactctgtgtttggtttgcttgtgtgctgatcagtagaatcgactggtttctcaacacgttatcagcacgagactctaccaagctaaaaaggtaaacatgtgagaaatcagtttctactgatcatcttgctctttatgtgcaaatcattcttctgttatagttgaaataagcagaagaacatggtacctgaagtaccatcccccgatatcctctcagcaatacacgataacatgatggcggctctgccgccgttatcattcaattgctagagttgatacatcctcttagcaacgcccggtaacatgatggcggctctgccgtcgttaccgtccaaaggcttgagatggtacatccccttagcactatttgataacacaatggcggctctgccgccgttatcgtccaaatgctagaggtgatataggtgcctgaagcaccggcatggcaacttaatggacggctctgccgccgttgccgccaaatatcggaggcaaacgaaccttctacacgaccctgaagtgtcgttatggatgtcccttgatttatggacatcatccatatgggcccttgatgccgctaaggtcggctctgtcgccatgaagcgtgggctcatagtggggaagtactatatggtttatcttactttttacagtctgcacaatatgcatgaagtgcccatgtatgctcttcattttgttttacatgcttactttgctgtttgcatgactttcataacatttattttattgttatgaaattgatttccgagcatgattaataatagttaatcaagcaatctgtaatcctgaagattactta

SEQ ID NO: 43410 - DNA, 17629 bp, Oryza sativa
  unsure (1)..(17629): unsure at all n locations
actaaatgatgttgcagaacatgtcggacatagtaaagaacgaatcaccgagcttgccttggatggtagtaactacctcacttgggcattggacgttgagattaaactcaactctatgggtctcgatcatactattgtgttgcccgaagttggcactgtggagtctacgaaggccgagaaagaaaaggcattgcatttcttgcaccaccatctccacccaaacctgaaatctgagtatatgaccgagaaagatccactggtattatggcaatccctgaaggatcgctttgaccagcaagggtcaattgtgctcccacaggcacaacatgactggatcaccctacgcttccaagactacaagtctgtggcggcgtataactctgccctccataggatcatttctcagttgtgtttatgtggcctgaagatcacttacactgagatgatcgagaaaaccttatctacctttcatcccaacaacatagtgctgcaacagcaatataggaactcaaagtacccgaagtactatgatcttatctgagtcctgttagttgcagaaaggcagaatgaggttcttctaaagaatcattctgctagacccactgggtctatggcagtgcctgaagcacatgccaatgttgttggaaactcgcgtggccgtaaaagaggccatggtgagaagaaagggaaaggtaagtgaagtatcatattcatgggcaagagcaagggtaaacccagaggtaaaggcgaactcaagaaggttacaggtgaatcatctggggtaaagcaggataactgctatagatgtggaggcagagggcattggtcccgtaattgccgtgtccccaagcacctggttgagctctaccaacaaagcatgaatgagaaaaagagccaacatgagtcccacttcaccattgagcctgaagctcaaattgaaagcatgatgacatgcttatcaatgttaaggatggtggggacgttcgtatggacgatgattgggacaaccttcttgaaaaaagatgatgacatattcggagacgtgaagtaatctcctatatgtcagtcatatgcagtgttccgcatgactagcacatgtagaactttggtcatgaataatgctcctgaagagcacgcttagtctttaactgggcctaaagtccttgtaatgtttcccttaatagaatcaacttactccatgtttaatttcatttatgtttatgttccataaacagacttgggtgggaatcccatggcagaagaggatatatgtctagtagacagtgccaccactaacacaatcttaagggaaactagatatttccacaccttaaataagaaaactggaaatattatgaccattgccagaagcaatgctcatatagtaggcaccggaagtgctactctagttctccctatgggtacccatatctttgtaaaggatgctctattgtatcctgattcaaagcgtaccctcttaagctttaaagatatccgtgcaaacggtttccatatagaaaccgagattgagcaagatgctgaatatctgctcataacaaaaatagatggatatcaaaagcaagtggtggaaaggctcccttcatcgccattgggtttgtactacacgtacataaaacccactgaggaatatgtcgcgatgaagaccatatttagaaacccagagtcatttagagttcagcatgacagactgggtcatcctgggttgggtatgatgaggaggatcatcaacaattatgctggccacaatgttgaaactaaagacttccctaaccctgaagattttagttgccctgcttgtgcaaaagggaagttgatcactaggccatccctcctgaagattagggatgagtcacctgttttcctggcaaggatacaaggtgacatatgtggacctatccagcccctgtcgggcccgtttaggtatttcatggtactgattgatgcttctaccaggtggagccatgtggacctgttgtccacaaggagccatgctttttcaaagctaattgcccaaatcatcaggctaaaagctagcttccctgatagccgcgtacaatccatttgaatggataatgcttatgagttcaggtcaaaggcttttgatgattattgtttagccatgggcattaaggtagaatattcaggaccacatgtccacactcaaaatggcctagctgagtccttgatcaagaggatcaagttgattgcacggccactgttgcaggattgtaggctgccaaccagttgttggggccatgttgtgttgcatgcagcaacactaatccaactcaggccaactgcatatcatagtacatccccccttcagctagtgcgtggaaaagaaccaagtatttcccatctgcgtaatcccaccaccacagcgtacttctatgggacccaaccggaagttggggatatacgttggttatgagactttgtccataatcaagtatcttgagtctatgactatggatcttcatacggctcggtacgctgattgtatctttgatgaggactattttcccagcatttgggggagaaaggcatccagaagaatgccgagatataatatggaatgcaactggtatgcagtccttagatccacgcgctagtgaagctgaactggaagttcagagaatcataaatttgcaaaatattgcaaataagttgccagatgccatcactgattacaagggagtgacaaggtcgcatatacctgtagtaaatgcaccggaaagagtagaggtaacccagaaggttactgactctgctcttaccccccatcctaggaagagggggagacctccgggtgctcgggacaaggttccgcggagacaaggacctgagccacttgttccactcaaagaatcggttgaagaagctcaacctgaagttgagaaagccccagaagaggcaactcaacctgaagttgagatggtcccagaaggacaccatcctgaagatggagaacccagtgccttacgcgcgcaccttggcactggaagatcggaacactccaactcggtcgttatgggaaatcacgatgagctggaggaaataaatgaggagatttccactaactatgctgatacaggagagtaacatcatagaaagaccactattgtcgacattcactttacctcaaagattgctgtcataatggatttggatccagaaccaaagtccatggctgagtgccagaagcgctcagattgggacaaatggagagcagcaatagaggcagagttgcgctcgctttataaaagagaggtttttgggcctgcagtcccaacacctccaagggtcatccctgtaggatgcaaatgggtcttcctccggaagaggaatggctaggtggtgaggtataaagcgaggctagtggcacaagggttcacgcagaaacccagtattgactatgatgaaacttactctcttgtaatgagtggaatcacgttccgatacttgatctcaatggcaactaatatgaacttggatatgcagttgatggatgtagtgaccgcatacttgtatgggtcactagattcggaaatttatatgagggtccttgaaggactcaagattctgaatctgaaaggaaatcgcaacatgtatagtgttcgcctgcagcgatcattatacggattgaaacaatccggaaggatgtggttcaatcggttaagtaactatctcctgaagagaggttacttaaacaacgatgattgtccctgtgtgtttataaaatccctgaatggattttgtatcatcttggtctatgtcgatgatcttaatatcattggcaccacagaggacattaaagaagcaatggcttatcttaagaccgagtttgagatgaaggacttcgggaaaaccaagttcttcttgggcctgcagctcgagcacctccctgaaggagtgttcatgcaccagtctacctataccaagagggtccttggtaagttcaatatggataaatgtcatccattgaaaacccccatggtggtccgatccctggaagcggataaagacccatttaaacccaagaaagatgatgaggaaatgttgggacctgaagttccctacttaagcgccattggagcactaatgtatctagccaattgcacaagacctgatattgcttttgcagttaatctattggctagatatagtgcaaccccaaccagaagacattgggttggcgtcaaaactatcctcaggtaccttcgaggtactcaagatcttgggttgtggttcccgaagaaccaatatccatccatggtgggatatgtggatgttggctatatgtctgatcctcataatgccagatcccagactgggtttgtatttctttgtggtaatactgccatttcctggcggtctataaagtagaccctagttgcaacgtcaaccaaccactcagaaataattgctctatatgaggccacacgagaatgtgtgtggcttaggcggatgatcggtcacatccagaagtcatgtggtctaaacattgataacacccccaccattatctatgaggataatgctgcttgtgttgcacaaatacatatgggctatgtgaaaagcaatttcacaaagcatattactcccaaattcttttatccccatgagctccagaagagcggggaaataaatgtcctgcaaactaagtcatgcgaaaatctcgcagatttatttacaaagtctctgccagcatcaagcttttacagatgtgttcgtggcatcggcatgagacgacttagtgaattgcaaggatcagggggagcaaacaattagcccatgattgtgatcctgaagaatcacaaacaagtcctgaagacttgatcaactgttgtactctttttcccttggtgaatttttttcccattgggtttttctcacgcaagatttttaacgaggcaacaggtgcaacacaatattcaaagtgccatgtactcttttctcctaccattttttcccattgggtttttgggaggagtttttaatgaggcatgtgcataattcaaattcgtccaagggggagtgttatgaaacctatcttattgtggacgaattaaattatgagtgggaagcttaccacagaagaaagcttacgctagaagctagcttacagaggaagccagcttacagaggaagccagcttacggcacaagccagaaggtccaaggcttacgatgtaagcctccaccctcctccgcctataaatagggcccagaaggtccaaggcgaggacaaccgatcttcggtctcctgcttctcctcttgtagctcgtactcaaatccagaagaaataaagcttccactcgctcatactttatgtgttctacaactctgtgtttggtttgcttgtgtgctgatcagtagaatcgactggtttctcaacttatagaatccagtttttttagatttttataagccggttatcaaccagatactctctaaacaggaccaatatcctatttgaaatggcgattcttttgttaaggggcgcaaagcgatggatagcacctagtctctcctaccaattggttgccacagacttgacaattagggaacaacttaaagctgaaagagttgtaccccctaaaccatggctaatgatgattcagttaaagtgaattatgccccagctttgagccaagtgctgctcctactagaggattcagactacaaatcttgttaagttactgcttaattagtacaaacagctagaacctacaggaaattaaaagaaatcgataaagagccaggacgactctagtcattgctggattcttttgttaggtgctgctttctgctgacctggaacaaaaggattgatgtcctctcttccaatttgtttttttttttcttgtccttcctataattcgtttcttcggaagaaagcaatatggacaattgcaacacgtctccaatcccaacagcactacaaactgtatctggctatgcaatacgaacggtctagtttaggtcgatagtgtgaatggattatggggtgtgctctggggtgtggcaaaattggcgtgttccatcttttggatattggttgtttcggatagacctgttagtttttccttctttttttttcgaactttgggtgtctgaatatttttatttaggtagattttttttggaaaacatgtcgaaaacatttgacgtgtagaacatgattttatcgaacttttaaaattttataaccattaataattttatatatgattagttttcttaagaaaaaaatgagttgctccctgaaataattactgctataaagtagtagattttcgtaagtatccctaaaccatacagacggttcgatcagaagggaaatcgcctgggcgtcggtcaagaaccacctgcaaacatgatctaccacatgttaaaacgatcgaacttttattggataatgctctactctgggtgaccgatgcgggggagccggatcgggcgctccccggcgcgcccctgccccacatgcgtatctactggacccacctacttctccttccttttttcacaaaagatgtttcatctagtatatttacaatgtttcactatttatacatctaatgttgcagtgaatttaaatattcttttgcaacaaaaaaacccatatattttagaaactctctattaagggaatttggtttatttttttgttccatcagaaatgttttacctaaggtactcacaatgtttcactatgtatagatctaatgttgcagtgaacgaaacattccattgcaacaaaaaaaacccatatattttggaaaccccctattaagggaatttggtttattttttgttccaccgaaaaatgtttcacctagtgtactcacaatgtttcactatgtatagatctaatgttgcagtgaactgaaacattctttcgctatttgctgaaacattgtttttatataaggtaaaacaacacctgatttaaacgagtgaaacattttcgatctacttagttaaataattccgatatacatggtggaatatcgtgcaacatttaaaaataatttaataataagctaattttttttcgtcagaatatatccatgtgtggtcttgttttgaagatttaattacaataaatttaatggtataatcggatcatgatttgaataagtaatttagaagaaaaatcagtttaaagtagtgttacccgtaaatcggacgccgattttactacaaacggataggtcgcccgagctcgtccacttttatttacacaagcggccgatttcattatccgcctatatttatgttaatcactattattaccccagtgaacggtggaggcaccgaggcccgagaggatcaaggttattttttttattttctgtggttctggtttttgtgtgatgattttttttccgatacgtactaatataagctgttgcacgtaggggctgatttagttttcatgactttgagcatttcgatgatttcttcttagaaaatagatttttcattaattcagtctctatatttataaaagatatacacagccaaaaaaaaaaacatgcacgagttcttatactccaaacctcacacagagcaatacacgcaaaacacaaaagaagaaaagctagaagacttaggggggagtccctatcacatcgaatgtttagatgctaatttagagtattaaatatagattaattacaaaaatcattccaaaatcctggactaattcgcgagacgaatctattgagcctaattaatccatgattagcctatgtgatgttacagtaaacatttgctaattatgtattaattaggcttaaaaaaatcatctcgcaaattagctctcatttatacaattagttttattatttgtctatgtttattacttcaaattagtgtccaaacatctaatgtgataaaaactaaagtttagtctctggatccaaacacccccctaaccctcaaccttcattgatgagttattctattcgtcccagcatgagaggggggaataggagaaacggaactagtcagtgctaattgtcgtcgcaccatctccgcctctatagaactcaaccaccaattgctgccaactgctaagtctgttttctgtcgtcgccattgaaaatccccttatgcggttgctgcatttcgaacggccatagagcaccgggaagccgcttgccaccctaccaccgtcttccgcagactattgaactcaccatagttcctaaagcatcgtggaaccatccaacatgatatacaccttgtcttttctgccatgagcttgctgaaagatgcattgttgtcattcgcacctacctgtaaccagaccttgacgccgacactcacgtgacagttgccacctctaggacgcctccgtcaagagcctccgttgccatcgtccttatctgcatcagtaaagtcaatggccatcgcacaccatcaacccagcctcgtcacggagccatcgacgaccatcgtccactgccctcgcctgaccatggtcagaacgtggcaccgaagctcaccaagttaccgctgcccctaggacaccgccgctaagaacatccaccgccatcgtctcaatctaccgtggccgaaccaaccgtcaaccacaggcgctatgctgctgacccgccatcacaggtgcagggctagcctccaccgttatccgtcatcgccagtgtctgagtaagagaagaaggactagtctcgttactgtccaacactaccatcagcatcctcagcaccgccaaccgccaatgggcaccatcgccccgccattggcgcctccattgccacgctgccaccatcgaaaaaataaaggtatgcagttccattagaaaaaaaaaatcaaaatcacctactcccctggttctacaatttcttacagttttggataataacatggtctcgatgctatattttttctattataatacatacaatttgtatatttattacaatatttttagacaaatctatatacgtcattcaagtgtctttaagataaatatttttaaaattattgatagttaaagttataaaagtttaacattaactttatctaaaacatgcagaattataaaactggtgggagggagggagtattccgtttgagtgcaacaacgctagacgttcgttccttgagttcaatctccgattggcgcgcgcgggaaaatcacgcgaagccgttaaataacggcctcacagcgccgctcccctccctatcctgcgtcccagtgcccaccactcatcacctcccccctctcatcctctcctcctcctccaatggccttctcctccaccgccgccgccgcctccaccgccttcgtctctgggcaccgccgacgcggcggcgcgtgccacctgctgtcctcctctttcctcatcgcgttcccgcgcgccgtcgcggcgaggaggtgcggcgaggcggccgcggcgccgaggagggtgggcgcggtgaccgtgcgcgcgcaggcggcggcgggggcggggaagaagagcgtgctgatcgtgaacacgaatggcggcgggcacgccgtgatcgggttctacctcgccaaggacctgctcgccgcgggccacgccgtcaccgtgctcaccgtcggcgacgagggctccgacaagatgaagaagccgcccttctcccgcttctcggtaggtaacattatgggggttcgagggctcacggcggcgatggtgaatgaatggatgcaattaataatgcaggagctgacgagtgccggggcgacgacggtgtggggcgaccggcgcgacgtcggcgcggcggtcggcggcggcgcctcgttcgacgtcgtcctcgacaacaacggcaaggacctcgacgccgtcaagtacgtcgcctccctcgattattctcccccctcgctccgagcaagcaggcgnnnnnnnnnnnnnnnnnnnnncgttcccgcaggccggtggtggactgggcgaaggcggccggcgtggcgcaattcctcttcgtcagcagcgccggcatctacacgcccagcgacgagccgccgcacgtcgagggggtaaagaaacataacaaccagattcgccggaggattggctcgatgagttgagttcactgactgactttctccggccatgtcggctcgccggcgacgtgcaaatgcaggacgcggtgaaggagagcgcggggcatgtgggcgtggagaagtacatcgcggagcagttcggcagctgggcgtcgttccggccgcagtacatgatcggctccggcaacaacaaggactgcgaggagtggttcttcgacagtaaaatcacccaaatccccccaaccaaattctcccaaatttcaaaccgccccaaacaacattcttcaatttgaagacaaaattgtcaatttttttactgtagtcttttttaaaactatcgaattaagacaaaactgtcgattcttttttctttaacttttgaactatttcgaaatatgaataaaaaattggcaattttttatgtaaattatgaattgtttgaatttgaaaacaaaactttcaaatttttaactgtaagttctgacaaatccaaattatgaggacaaaaccatcaattttttttttgctgtaaactttgaataaatccgatttgtcaaattgtcggtgtaaatttccaagaaatattcgaattgaagtcaagttatttttttggtttcaaattgtttttgcagggattgtgagggggaggccggtgccgatcccggggtcggggatgcaggtgacgaacatatcgcacgtgcgcgacctggcgagcatggtggcgctcgccgtggagagccccggcgcggcggcggggaggatcttcaactgcgtctccgaccgcgccgtcaccttcaacggcctcgtcaagatgtgcgccgccgccgccggcgcccagccggagatcctccactacgaccccgccgccgtcggcgtcgacgccaagaaggccttccccttccgcaacatggttagtactactaaccgttttttattcatgcagcggcacattgctattttgctcgaataaagaaaatgtgatttttttttatctcgggggaatatcggatgaaaactatcggataagcaaggactcatctgtcttataaaaaacccaatcctgaggatgtatttggacaatgtgtatgttcagatatatctttaggattgaattttttttagacgcaggaagtacgtgtgaaaaatagacttagaaaattttttgaatctattcatttcgcaggaaaagaaacaaattttagacgagtagagttcctttttcttacttcaaataaagtcgaggttggaaaacgtggttcattcttgtactgtctctagtaatttctttttatataaatttagaaaaaagaacttttaggcccgattcttaacgggttttcacccgatattttggatgtgaattttatcttgatatcgatgttttttttcccaaaaaggatgtgattttgatatgttaatggttgtgtgaaaattgttagcacttctacgcggagccgagggcggcgaaggaggtgcttggatggaggagctcgacgaacctgccggaggacctcaaggagaggttcgcggagtacgccagcagcggcagagggcagaaggagatgagcttcgacctcgacgacaagatcatcgccgccgcctaacaacacccatctcatctcacctcgtcatggtcaaatacaaatacaaagtgctcggggatctcttcttctcgtgatttattttcttctccctctgtttctttggttcctcttctcataccggaagcatagagaaatgcaaaactgaacaattatatatgtaaatgctaggaaaatgctgttacaaataagtgaataagatgagttttcgcttttcgtttttcatttttccatcacatatccaatatgagaatggaactttgcagagtcaatcagattcagcacattttcttggtcttacctcttttttgtctgaatatatagctgagtaattttgtctaactattcgagggtataaaaaatgaattaactattataaagttgaaaaaatggatttgaacagtttcataagaaattcatatatattaagttttcttttccgaaaatcgcatcgtttataagcgctggaaataaatggttgcattccttaagaacagatactcctcaacaagatctgtgttgtgaattgttcaccttgactcgttcttaacaactgaattcaactttgattctgacagaccagaacagacagcaatgctgacaaagaacatcaggatttctttaccccctttctgcaatattcttttggagaccagtgctcacgaacaagccaactcagaaggagcattgcagcacattgatccacaaagccttctttgatttcaggtatttttgcgcacacacaaggggcaacacaccagctgatactgcatggtgtaaaaagaaataaagaaccaagaggactgataatggtagcagcgagaatcaattaaaacttacaattccagcgattctcgacatttccagaactaagattggtcccatctcgacatttccagaactaagattggtcccatcctaggtagtaatatagggcgatcggaactactgaagcatcagggagcacacatacgccgaaatggtcatgtttctgaaaccactagcatggtaaaagagagcatgacccctggccctgatgcttgaggtgcggtcatcttgaacttgggtcgacatggtcgtccccgttgctccagttctcatgccaggtggtgaaacccgttgtaagggcctctcgcacccatgggtaacggctccgctccaccgcctcactgagagtgagccaggtcctcttgcgggtgctctgctcgggccaggaggcaagctcttccttaactcgaagcgcgaacaccgcagctctgcacatcccctcggggcagaacttgtcttgatgcgtcttgctcttgaagtcgtagaagcccaataattgcttatgcacagaaagaatcgcaaataagtagagtttgatggcagaacacatggaagggaataagtgatgttcaataataagccacacgcaagccacaaggactaaggaatcacagaatctatttaaacttggctacacattaaatgtagactatgcaagtacaacctagcgacacaatattcctttgacttagcttgctttcctaaataaacttcctataaaataatccatttataatgcaagattcaggtcaaggtttattggctgcactatgtcgtgtgctcttatgctctgtctagtaccaatagtttcattaaactttcaaacaaacaacttgaccagatgtgcaaatgagcaaaatcagtgtcaacacagtagcagagtagccagcattaagcagttcaggtctggattacaatctaaagtgcgagttagcaacacaagaatcctcccttaacttacaagtgcccttcaaagtttgtgtttactgaaagtccaacaagtgctatttacacaatgaatcttataaaacagtatacaatgatgaggtccaaccagcttgtttgttagtcaagtggcacctaacacttgtcaaatgaccctagttctttaatgcacaaaaaaaaaggcctagtaaagaacaagcagcgttgcatattcatatgctaaagtatgaacatattaacacttaacaaaatggatgctgactctgaatgaacagataaggccggaaattccatagcccagactcagactatgcttaaggatcaattttcaggttaagtgaaggacacagctagttatcagaaggtagtaggtctccataggaaagaagattatatctaattgtctatataaaacacaaaatcgcatgcatacctcaaaaaagacctgaggtcttggacacaaggttgaacaacaaacatatggctataggatataataatggggcttttttctaagagaagatcaaaaagtcaaggtaaaagtgccaaagggtctcaccactaaatctcctcgaactccagcttcttcaatagcttcacgagcagctgcctcttcaacagtttcatcattctcccatcctccctaaagcagtatggcacatcaaacaaaagaccgcatgccacagaatcatgtactatataataaacaaacagatatatttatcccaataactaactagtacacctcgcagacaaggttatcataagattaactctactaatgagtcctgactggctcaaaagtcgactctacggcacctgatttcagtacctacttaatcaaacatttcggagggatattgattatcttgctcatgcccgttatgttagagcattgaggttacaaatcaaggaacatatctttatgtaatggtagatggataacggatattggattatagcctaaataatttcccatcaattactctggaaatctaaagcacaaacagaataacatcacagatgttttcatataccatgttctgagaattgagtgactcttaggcatagatgtttaaaatgttaataccttaggaaataggagaccagatccactctgggagttgatcatgagaacttccacaagtttcttgtgtccatcatcagaagtttcatcattgttatctttatatctaaaaggtatgcacctacatatataagaaacaagtatcagatgaatttaaagcatgacaacattcttctctagggtctttaaccatgttgtcttacagcaaagataagagcagcacgctcacagatacatactaatgtagacagtactgtttaattgagttcataaaatcctgttctgaagtgagtttaagtagaagcttgactatcaagcactattcagatgagtaataactttactaatgttggtaaaatgtttaactgctactccaaataaaatttgacctcaaattttgaaacaaataaattaattctcatatagcttatatcactaacagtaataagcacttaatgcaacaacaccagtatttggaacattgtgacaacaggacaaagcagcataaacaacaggtacaaccagctattctcctagttcggtttttagtctccagttaatacaaatatcatttttcgtatttgttaatacaaatatctaactgcacacatgggaacaagaggaccctggggtcatctctatgatcctgaaatccatctccctgtgcccatctcacacatatctatgtttttatcaccactttcttttcttggaaaaatcaaataaaaatggaacctctcccttgaacaatttaagccaaagggaaccaagttttggcaagcaccctttggaagggttttaattaagggcccaaattaatccccccttgaaacaaaaggcatcccttatcctaaaaaaaaaaacttttagaccctcacaantgagcctagaatccttatccgcgaaaatttccctatcgacgccggcccaccaccgatgccgaatcaatatcaatacaaatctttaccaagattcacctaattgatggcacatcctgggaccaaacagagataccccaacctccctttttttccccacacacaggcacaccccaatcatgtggagccggtaaagaacaaagcacactgagaatcagtaaagaacagaaaacgataagcaggtcgccatcagcaggtgcctacggatgaattaaaggagctaaattttaatggtagccctgctcactgttcattgattaagaccaccccctcccctcctcccataatctagccaccaaatagtcctcctacttcccctccacagcagcagcagcagcaagaggtgaaaatttgattccaatcaagcagcatatcaaaacaaacctaaattacggcaagataaaaataaaagtgatattttttcttggtggtgggggatacgaagatgatgatgatgcaggaggaggagaggaatgggggagtaaaaattggggctttgaggatgtcccacccggccacgagtcgacgcccatgctcgtagcgctgctggtgccgccccgttctcgccaccaaatcgcacatggcttcttcctgtccccgccgccgccgccactaccggaaaccgcctccgccgccgctcgagagggagagagaggggtagggttggtcgccgccggcgacgagcaatgcggcggaaggaggaggaagaaggggagggtgaggggctcgagagatgtgcgtgcgtgcgtgcgcctaagcgccttgcttcgttccttcctgggtctctcgctgttcttgccctttttattttgggaattttttgccctgttttggtcccctttttaccccctttgtgtagcttttttaggactttttctctggtttctatggtttttggctttggtatgtggttttggtttggtaaacattttcaacttcatccctctttccaactcaaggttgttctctgattttgtaatacaatgtgccgtttagttatgaaagtgctttaccgcttccgtctatgtcggttgtgtctttcggtttaactcgtcgacaatatattgtttggaccgatttacggagagcaagaaaacgtacacggtactatgttttaaaggtattgctttacttgaaaaataaactaaataggttgagcgccgttgaaagacgccgacaaatcaagtctcacacgagggggaggaggcaatgctatgtaatgcttcatcgtgaaaggaaaaagaactttacaaataataccttgataaaaatttttgttttcattttcgtcacgttttctgtttaacttggcgacgatgtgctttagcggagcaggcgtgtgtgtttagtatcgtgtgttgcatcatatgaaaaaaaagtaaatgaattggtcgtacataagaaaagagtgaaatacatgactggtccctaaagttgtgtagtggtatcacttaggtccgtgaacttgaaaattacacgtttaggtctgtgaatttggtttaatgtaccacccggtccaaacgtcctttgactgcgtttgatcgctaacgtggcatgccacctaggcaacacttttgctctcagccccctccacatcacaacacgtcgcatatatcttcttatagttatatagtgacaccagaatcccaaaaaaattctcacatcgttcttccatctcattcttctccttgcatgtatagaaaatgcggttctgattagcaattgccattgctctgcactccaaaataaccttatccttgcgcaacgggcacatgattaacaacactttcttccagcgacttcaagacgaggacgagcttggagaatccatgggatgcctagcgcgcaagccgtattgcactgccttccgccgctaatacggccgccttgtgctaccgctaaccccactgcactgcgctgcctcctgccactaatcgcaccgccgaggccaccacagctgctacctctcggcctccttcccctaacctcaccgtcgaaaccctagccgatttagggatattttgagggatttgggttgaaatgcacactggtcatagcaagttatgtgcgaaagtatatgtggagggggctgagcacaaaagtgttgtctacgtggcacgtcacgttggcagtcaaacatggtcaaag

SEQ ID NO: 43411 - DNA, 2480 bp, Oryza sativa
ttctcttctgcttcattagaatccgtttgcaaagggtctacaattacaagattgctcaagcgatcccatgtgggctcgggagtatagacactatattttaaaagcaccacatggataccttgatttctcaaaatttacaattatatttttattctctataaaattataaaaaaataaaactatatgagttcataatggaagtctattaatatcattttcatatatcaaatactaatatttttacttctattaatgaaaatatttcaagttggacttatctattgaggaggattgaaatgatgttagaatttcacattttacgcaagtgtcctcacttccatcgatttgattaatcgaacacttatcagtcaatatgtgcacaattaacatatggtaacgactagaagtttatattctctgccaaatcttcatcttttgagtcaatatctcgatcacaatatctcacttatcgatttctcaactaaatcttcatttaaattgatcttcaacccaacccaacacaagttagtgaaagaaaggtaacagagtgatcaccatcctcaactaataagtgtatatgttcggttgtgtttttcagtttaattcgtcggtaatatatcatttggctggatatacaaattaaagtgagagaatacgtgtacgtggctttcttttaaaagcattcttttgcttgaaaagggaaattaattaaataggttgagtggtgttgaaagacatatacaaatcgagttagacacgagagtgagaggaggcaatgctaggtgatgctttacgatgaaagaaataaaatctttagaaagaatgctttaataaaaagttcttttttaaaaaaactttcgttacgttttctaactcactaacgatgggctagttgggtactttagcaggtaggggatgtgttcttgttttgtgtttgaaaagttttgcttcatatgaaaaaagagattaaatgcattgatcatgcatacaggaacaggaagccaaacgttttcatttatttcatttaaggaaagtagggttgttaatctgtataggcccttctaaccctagctcgaggagtgtcttttatgttcatatcttgtttttaaccaacgaaataccttcataagagcactataacattttaagaatcaataaatttttaaatggaccaatatatacaatctttgaatgggatttgactttggttttaaggtttggcaaaaagaacgaattggctctcacttgaagagaggaggttttggggactccaaaactagccaaggacagctttgaaaggaaataaattcaaaacacacgaatatgaaaaatatacccttaacctaactaaatttatattgaaatcacatccacatatgtaagcactaggatttcattaaatgtagtgggtgagtaatcatacgctgacagctctatcgccataccttttgtggggccagtcagtgctgagaggtatcaatatgtaacgaggaagattattgtctatcagtgtgagctcgaggggtaccgacagatgttagataacaacatgctcgatcgtccagatgtacgttcactgattaattttcaatttgtaacttagttgactgctcgatcgtccagatgtacgttcattgattaattttcaatttgtaacttagttcactgcaaaaattcgtaacttagttgtctgcaaattaattaattaaagtatttgtataaaagaggatatatactatttttataatgaaatgatagaatagaaatatgtaacagtccaaccgttgtataaaaaaggatatataatatttttataatgaaattagaaatatgtaacagcccaacccaaccgacgggtggggctatttacacttctatccttgcttcaaaggcccaaacgtccccgtcgtccctatcggtccaattcacctatgtagccacacgacatataggctgacgggtgggcccacttacccacgccaccccactgcctataaagttggatctgagaaatgtgtactaaacatactgcgagggtcggctctgagcccactaaacatactgcgagggtcggctctgagcccaaccaatggacggataccactccacttacaggctctgagcgcaaccaatggacgggcctacgaacctacttatactttcgtcctcgcttcgtgtaaaagggttaacctagaagtgatatgattggaaggaagatgtcttataagttggttccaaccttgttaaactagtaaggtggtactaaacatgagcacataactcaaggtggtactaaacatgagcacataactcaaggtggtactaaacatgagcacacaactcttataagccacacaggctaaattctaattggactgggatattaaaaaaccatactggcctacaatggtaataagctgtctgaatgatgatttcaattatgttccttggtaataatagtacactataattgacgatgc

SEQ ID NO: 43412 - DNA, 5559 bp, Oryza sativa
ctgtaatgcatctgccattttacttcagcaaatgatatttaattctttcatttatcattttctctctgctttgcatttctgttccgatacccatgggccatggggcgtcgtcgagcagttcctcccgcgcgtagaaaaacggaccccactttttcttcaagggcgcgtgtaggcgggcgacaatttagtcgcacgctcgtcctctctctcatccgcgcttagcaccaggtcatcttccgaacctacgtggactgcttatagccatttctagttctgtgcatgctctaaagtttaccccatacccacacggcatgtatatccgactaggtataagggtaccatatacagatagaataaatttagtaaaggactcggttgttatgttaacttgtgtatcaaggaaacatccgatagttctagtcggttacgattgtaatttatcttgtccgttaggaacatgggttgtatcttgtaattccggctcctcctcctatataaggaggggtccgggtgcctctaggggcataatttttctccctgatcatacgatcaataatacactcggcggatcaatccccggacaggagtagggtacttctcatcgagaaggcctgaatctgtataaacctagtgtctcctaacccatctacttttccagcttgatagccaccccttttagtattgccaaaatattgtttcgacagttggcgcaccaagtaggggtagcgtcaagttcttcgccgattagtgcaatgggatttgtttcgggcatcgacgacttcgccttccctcccgggcaggcataccgatttggcagcctcaacttcatcaccgacgacttcgacaatatttctcttctcggctcagattcgaaccagtcgggaggggatgccatctttgctccattatgtctcccaaactcggctgaaatctattctaagaccatctcatctgagttggattcaaaccactcggatgaggtctcgtcaacttcttcgcaatcaaatcaaggagaggcaacttatccgtcaatcttgatgtggcttcccgacgatctggctgctgtttttactacaagagcgtcttctccccgtaggtccagattaaactcggcttcgacctcagttcaatctggctctagggaagtcggcgtgatacttcaacgactcggaactcactacaagaggaaccctctttagcaatacatatatgtattgctaaaagtctctataagtattgctagggtctgcaccaacgcatttaatatgcgttgcctatgctgccgttgctaggatcaattacaacacatagacaaccgttgataacaagtggaaataagcgttgctacttagcaacaattttaataggtttcagcaatacttatatatgttgttcccttgagagatgaacagttttatataatcttagcaatggatataatcaagttgctgcaacatgtacaaatattgtaatttgagctatccactgtaggtggcctttgaccaattattttgtcaggcaagagacccatgaactcaaagcatgcacaagtgacaatagtccaatcaatcatgataatcgattatatattaaatatagtattttgcattacatagacaatcatcagtataattcatggcattaaacctttgttcagaacattaatgcagaaaatagaatctaaagtatataaaaaaaacacatcttgttgcccccattctccaccttgcagccatcatcattccgtgacatgtacaggtgacctagttgcgtactagcagtcacaaaatttcccccacatcttcacccatttatcttgtcaacctataatagaaaaaatatataagcattaatataccattatgaagacgaaaagcacatctccgaagtaagaagtaagagataggaacatataaaaattgcaggccacgcaatttcaagtcctacaacatgaccaacaattttgtagcctttgtatggcctaatcaaatcttcggattttgccaatgcaagatcgacatgaaccattaaaaattcatttcctagctcaacacctccaactctgcgtgttggatcacagcttacaatagtggcaagagccacgtttgtattccgatttttccaactttttaagaatactttagttccaacctgaagtgcataatacatccatcaatattatcaatatactttaagaaattcaagtatcataaataatttcacagtaaaatacctccattgaattgtcagtgataaagtccattttgctgcactgttgtttctataaaaaaaaattggatcatggtttgcaatttaaccacaagatagaaagaaagaaagaccaaacagagccaattattgttctccaattcaatcataatactagtgaatcatgcatgttatagtttgaatggactgatatttgtaaacatggtgaataaaaaaacaaccttgtatgcaccaccaactttatgtgcatgtaccatatggctgtcctgattgtcaggtttcttgttctataggggagggcaacaaattagtgctaaaattatatatattaagaaattttactttcaaacttttctatcaaataatttttgaactcaataagaagtgaaaactaaccttggcacaaataatctccatctgtttcccatggtcatttaggccaaaggttcgtttgttctagaataaaagaatacatcacattgtcatgaactatagtaaacattcatagttagttacaaacaataccaaataatataatgctatgtatccatgataaccatataataggatgcaaccatggtgagttcagaataaaaatataaattgaaagacaaggaccttgtgtgcagtagcatgcttggttggtggtgtcttatcctcatcttgagcatggctttgtgaattctgttgtcaaagagagcatatattcccagttacaaaatagtgcaactattcccatgtataaaacaatgaaatttatgtatattaccatcacaatgttttcctgttcaacatgacaaatttcttgcaagggaccgtcaccatacactttctatcacagtggaaaataaaaggacattaagaccagattttattaaactatttagactaaaatgttagcaaggtttaccactgttgaattgtcagttaaaaagtctattgtgttgcattgccgtttctgaaaaaatagagagaatttacagtaaaaaccaacatgctgtgtgtgctattttagttgttgtgtagtgttcaataaacagaaatagcattttgaacttgaaacaattagactaaccttagaagcagtactatacttgtttaggcttggtctaacaagcttgcgggtaaggttctctttgttctgcaatacaattattataactagtaaatcatgtgtgttatagtttcaaagagcttatatctgtagacatggtgacttaaagtgatgaaaaaataaccttgtgtgtacttgtaactttgtgtgcattcaccatatagttgtcctggttgtcaggtttattgttctacagtggaaggtaacaaataaattttacaaatctatatatacatttatatatcgaaattaaactactttcaaacacttattgactatggcattgagtttgaaaggataaagagagaacttaatcaactcaccttgtatgcactagaaatactcttccctggttgcataagctcattatggtccaaatttcctttgcgctgcaatggaataggtcataaaattggcacaaactataatgttccaattatttgtttatgtttgcacaggaagtaatcttcctttgcttcccactgtgattctggcccaaagactgtgtattctagagtaaaagaaggcatatgattataatgaatgctatgtaaataatagtgaatatatatataataatattttaaatgcaaaggcaaggaccttgtaaacagtagaatgcttggttggtggttgcaaattctcatcgtgcacatggctttgtgtattctattgtaaaagagagaaaataaatgctattcccaagtaaaaaaacacagctattcccagttataagatggtgctatatcacattaccatcaaactgttgtcctgctgatccataatgtttccctcctcaaacatacaaatttcttgcgaggggttgtcaccatacactctctgtccataacagaaaatgaacagagatctataccacagtttatgagataatgcagaaaatgttatgatatttcttccataaagatacataccctcctttttgaattaggtacgtcatcacaaatagcttttttatttgtagatgctccatctaaacctccctgtaacttcaattaggtaagttagatgcattcattgggtcacacacaagttcatataatttttttaagactcaactcccttaaattcacctgattcttttgtgccttttccaacttggttgccttctcttttaattgtaaaagttcagcatcattattctcaacatggcgttctaacttttccatctgcagtctaatagccattacatcttcactggagttatcctccactgtagtaagatttatattctgcaaacgtcgggaagttggcacatcaagcacttgtttaggctttggaactagtccaagaccatgcacacgcccaggcttgtcatctcctagtatttggttcaatgcatctcctttccaagcagtctttcctttactagcatccgctaaagctggttgttcagctataagtctcttcaaattatcctaaacatatgaaaaattaatacgaataaaacaacatatgagaataactgaaaaatatctatggttgagtgttaatagtataccacatgcccatttatattcttgtcacttttgcgcttgtgtgtgtggacataaacaacagctctatgtgggttcttctttgcaggatctttttgtctctatggaacacatgaccaaatcagtaaagtcctaatagtagctatacatgcttgaaatggaaatagatgaatactattcaagacatgttttaccatctcttctcttgtgcgagcaaaactctttgtccctgctgtgtgaattgccttcttcttttggcagtttttcttattctgctcacttattctctgttatggtctcgtagagttagcaatcaaaaaagaatattgcattgttttgtttagtacagagttctaatttgtaagaccattacagaaatgaatatggtatatgtaccttcgatttctcgttcatccaatgattgacaagagcaatccactggtcagaaagcacaccttctgggacattgttgcaattagcttccttagtctcattcacatcaaaatacaaatctttagttttgctttatattgccgccatctttctccaattttttttaatatgaactcttccatccgaggagcataaaggaatctcatctacatatagcaacacagaaactcatatggccatatggggatatgcataacataatacaagaagttagcaaaaatgttgatctgaaaaggaattacctttact

SEQ ID NO: 43413 - DNA, 5132 bp, Oryza sativa
attttcctctctcttccctataccatatttccagtctgggtagcctaagctacacagactaccattcctagatatcattccaagaaatttacccaaaattccatcttcttcccctaccgcctgattgagatcattgcattgtaccacaattctaagccctttcggaaggttccaaacatctttcagttttgtcttgccacgtgtttcaggtgctccattttcaactgttcggtgttaaattgcgaagacaaaagtgatccttagtaatcagggatacgagtaataatgtcattatttgttaccattaggactattaaacttagcagttacctcgaacattaatatcaacatcagtatcttcattgccttcatcatcaatatcaacatcgtcattagtgtcttcattgccttctccatcattgatattaaaatcgtcatcagtgtcttcattgccttctccagaatcatcacatacagttttttgttcagatggtgtggcaagctgtggaagggtattttcttcttcagtctgttcctctgacaaatattcctcattgctctgaacaatacgcctttttctactccttgccatatctcttgcacccaaaaaaaacctatctgtcatttatggcatcgaaagtatatcattctcatttcagaagtaggactgtgctgtacatagtttcaaaaagaataatttcagaattgattataccctgagccattttggatttgtttttgaagaacaacagagtactgttgtcccaaaagtaatgctataatatggatctgtttgtcatactcactaattcatttgtccattttataggccaacaatttgaaacaagtaatgggtagaaataacaaaatttaattggctgcaaggtaaaactagatcacatatttattgcttacagttgtgtgaagcctagctgtacgtagaccaggctccttcagctatggacggtcagtgcatctgactccaaacctgaaaatacaacatatcaaattggtaagtattgtagtcctggaagggaattagcctccattgcaatttggcgactcagagaggtagtaagatgtgcagagggaggcagagattccggggcttggaaacattgccgccagccgcgcagcgtggagcagagcgaagtggacagccggtgtcgggaggtataacccgcatcaattgcagtgccccggtcacccggcacatcggctgggggcgtctccggcccgccgcatgccctacatcatccatggggcatgggggtcgcctgctcgtggctgttaatcggcaggaaggtgcggcagcagtgatggctggtacagcagccgacggagcggagcggtggaagatctaggagcgcctgcttggggcggtgggtcagtaaagcgcccggcatcttacctacagatcaacaccgatgaagacgaggaggagaaccgtagaacgacaggagagttcgtaggaaaggggaatcccacaacagaggaaagagatttactcagggagtcaggatagaggaaagagatttttaggggcagttggcttgcttttctcgatggggaaggtgggggcaaaaaaaaaagttggcggcaaaaaaaagaaaacagaaaaaaattgcgggagcaaaaaaaaaaggagggaaagagtggagggagaagaaaataattttcggagaggcataaattgctaaattcagatcgatttggggttgatttgtccgtcaaactagttatttaaattatattagcacaatcaaaaaatcacatgttatttcattgtcgatcttgtccggacagaccgcatgaaaaattatatataattaaataacagtgatttaatttttttagcacgaccaaaaaacaagtgttttttcattgtcggcccggtccggacagactggatgaaattcggacgtaacatattttggttagttatttaatttatctaagcacgactgaaaagacacgtgtttttccattgccaatccggtccggacagaccgcatgaaaaagacatgtaatatatttttgtcctaaaatatagttatttaaaaaatgttagcacgataaaaaacacgtgtttttcgttgtcgacccggtccggacagaccgcatgaatatatatatatatatataattaaataacagtgatttaatattttaggacaaaaataccacgtgttttttcgttgtcgacccggtccagacagaccatatgaaatctggacgtaaaatttgtgttaaaatagtagttagttaatttataacgaccaaaaaaaattgttgacccggtccgaacatacgggatgaaattcggaagtaacatatttttgtcttaaaatagtacttatttaatttatattagaatgaccgaaaagacacgtgtttttccgttgtcgacctggtccggatagactgcatgaaaaagtggcataatatattttaggtcttaaaatatagttaattaaaaatgttagcacgacaaaaaattcatgtgttatttcattgtcgacccggtccggacaaaccgcatggaaaagagatgcaatatatttttggtcttaaaatatagttatttaaaaaatgttagcacgaccaaaaaaatcacgtgttatttcattgtcgacccgttccggatagaccacatgaaaaatatatataattaaataacagtggtttaattttttaggacaacaaaaaccacgtgttttttcattgtcgacacgatccgacagaccgtatgaaatctgtacgtaaaatatttttttgtcttaaaatagtagttagttaatttatcatagcatgacaaaaacatgtgttttttcgttgtcgacccggtccggacagattggatgaaatccggatattcttaaaataagtttttgaatggtttatttttaaaattttaaaataaaaaagttcaaaaaattaaaaaatttctggggcaacagaatttttttcccgttcaaggagaggaaaaagtttttaggaattgacactagagaagaaatgaaacgattatgcatttgctagttctcgaactagagttgtcaatacagtagaagaagctaagtaccactaggctatgtccccctttatttattttttcacgttagctgcaattgagaatgtaaatagacttctcgaggtatttatataagatggaaatttaaattctgttagcacgaccgaaaaggcacatgctatttcgttgtcgacccagtgtggacagaccgcatgaaatttttcattgagacgtaaaatatttttggtcataaaataatagttatttaaattatgtttgcaaaactgataaaccacttgttttttcgttgtcgacctggtctggacaagccgtataaaatcatgatgtaaaataatttttctttaaataattgttatttaatttatgttagcacgaccgaaaaaccacatgttttttcgttgtcgtcttggtccatactgactgatcgcatgatcaaatccagacgtaacatattttgtcctaaaataatagttagtgtggccaaaaatatttatattgaaaaaataagttttcgatcagtttaattttaaaattaaaaataaaaagttcaaaaattctcattatctggccagctaagaaggatagggaaaaaaaattaggaatcgcccctagaaaaaaaataaaaaaaatctaggctggcatatttgttttcctcgttatctagccagctaaggagagggaaaaaattttaagaatcgccactggagaagaaatggaaaaaaaacgcatttgttaggatttgaactacagtcttcgatacggctgaagaagccatgtaccaccaggctatgtccacttcatgttggagttgtccgttcgacttacttattcacgttaggtgccattgacaacgtaaatagtttccattcacaacgtaaatagttttctccaggtatttatataggtggaaatggaataactgaacacaatagatgcaaagattataaacgcccattcctttttctcatcatataaacaatatgatatcctagatatttaaaaataagatctaaccaccaattctgtatataactaatgtagaacattattacaggacttatgtatgcaaataaaaagttgaatcgatctggctcaatcacttagacaatccaaggaaatatacgaatgacattttcatccagaaaagctattgtggtgaagaagccttcatcgcagtaaatctccatccaaaattactgccataaaaataaagtgctccccaagtgaagatataaacaatataaggaaatcattgataatggacagatagatagtgaaaaaccttcataacctcacctttaattagttaccatgttattgacagttgttccttctatatctcttcgaatccatgtctgaccatcatgtgcactgtcaaatagctccccaagattattgacatggtatggttcgcattccacatcattccattcttcgcccagttcaaatacatctctaggtttcatcttccttacaatagaccaccctggatttaaatggttttcaatgtaaaacacttggtcgacttgatttgcaaatacaaagggctcatgctcaatcttttcaccggtatgaatttatttgagaaattcacaagtgtgcagccaaacatatctattttcactccttttcctttagttacatcgacccattcacatttaaacaacacaactgagaaatttccgtagtagtctaactcaattatattaagtatccttccgtaatacatgatatcaccaaggacagggttagtatcactggcggacgtgtagctcgatgtttttgcagtcacaacaactccactgttttgagtcaccctgtcataacgctttgatatgaacctatacccacgggtattgaatgctctatgtcgttttgctacctcaattggtccacgtgccagccatctaatatcctcatcaatactatcgatacctctttgattctccaactgcaagatctacaccaaaccaaaagatgtattagttgtactcatatttgaaaaagagaaacctaaattttgagacttacatgatctctgaaccaatcagggaattgttcattttgcatgttctca

SEQ ID NO: 43414 - DNA, 25458 bp, Oryza sativa
cgccgatggttttcccaatggttttcctactagaggaaacaaagtggattcttgcctactcatgggagtctcaaattgatctggtttgtcattattccttgatggtatgttatgcttggtagggaaaccttccaagtatcgcgaacaaaatgccatgcactcatctgccaaatatgattatgcaattgaaccttctggacgcgctttgttgcgaacatacgacttcaatttacctaggtacctgtaatatacatacaaggcacaaaactaataagttagtattgtatcatatgacatatgagaaatattataaattgtatgctaatatatttttagtacctttcaataaagtacatccatcgatagcaaactggcccaacaatcttacattcagtagctaaatggacgactaagtgaaccataacagtgaagaatctaggaggaaatatcatttccattctacacaatgtgattttaattgcttcttccaaacggtcaagctcatcaacatggagaacttttgaacatattcctcgaaagtaagcagataagtcaaacaagacagatgtgacttcattgggaagaatacccctcaaagcaattggcatcaattgttgcattagaacatggcaatcatgtgttttgagcccatgaatttttccttcagcagagttcacacatctagatatgtttgaagaatagccatcaggaacttttatatccctaagaactttacagaacaattgcttctcacttttggacatagtaaagctggcaggtggtaagtagaacttgcttgaagttctttgttgtggatggagctcccctctaatgttcatttccttgagatcaagacgagcttggagattatcctttgactttccttctaaatttagaagtgtaccataaatattgcatcacatcaagattatgctgaagaagattgacatcctagtaaggtagtgtgaataaactacttactgccttataagtttttgacttcttaaaatcaccgatagaatttatttcatccaataccggacgcccatagtaagtcataggctctgtactaatctctgtggttccatcaaaagaatttctatcaaaacgaaattcatgattaggtggcaaaaatcgacaatgacccataaaacaagatttcttcccatgtgccaaacgtttggaccatacatttggaccacaaggcgggcatgcaaattctccatgcaccatatgtgaagcaagcattcctaaagctggcaagtcatttatagtccacagtacagctatcctcaaattaaaagtttcatttctaaatgcatcatatgtggaaatgccattggcaaatatgtctcttaaatcttctagaagcggctggaggaaaacatgaatgttatctccaggacttttgggcccaggaattattaatggcattagaagattaggttccttcatgcagagccatggtggaagattatatattactaaaacaactggccagcaactataggtagagctcaacataccatatgggttaaacccatctgtagctaacccaaatcgtatattacgagaatcagatgcaaattgcttgaatcttttatcaaagttcttccatgccggagaatcagctggatgttgaagcacaccatcctctactaagcgctcttcatcatgccaacgtgggagcgatgctgtttctctacacatgaacaatcttttcagcctctcctttattggaaaatatcgtaagactttgcttggtgttgctttctttctttctttcttcgttaacttggtttctggttttttatctttccatctagaagccttacaagttgaacaaaaatcatcattaaccttctctttccaaaacagctgacagttattgggacatgcatgaatttgttgataatctagaccaaattttgaaaccaccttcttagcctcataaaagttttttggcaattcttttccatttggaattgccatgtgaagaatatcaagtagatctccaaatgatttatcactccatttgttcatggatttcatattgaacaaaagcactagtagagataagtgtgatagttcacatccatcccataaaggcttctttgaatctttcaccaactcataaaatgcttgagcttctaaatttggtccatcagtgtgtgtgtatggcgaatctgcagaatcactcataggcatgtcgtcatacacagtcctaagtgcatcattaattaattcgtgcatgttagcacgcatgtcttcattgtgaggctgtggttgttggttcctaatttgctcctctgaagactcaccatgaaaatcccattggttataactctgaagcattccattgcacaccaaatgatcatagacatcattttttgaaagtagcatagtatgtacgcatgtttcacatggacaataaatctttgtatcctctaacttatctttatatgcaaattcaagaaatccatctactccagctaagtactcaacagaacctctagggtagcgcaaaagaatcttgatggtttctaaatccatttcgacctatataaaaaaatttgatatttcaggttcttgtagataataacaatgacaaggaattgtctcttatgatcatgatgtagcaaaaatagggcaattagaaaaataccagtataaaatcagtgtcagctaattttgtcacaacctaatagacctcctttatacactgaaacaaaagcttttactctgcaaaaatagagaagagttaaatcaatttacagaaaaaacatccagcaatctaatgtcaaagctgtcatctccaagttaaattccttactataaattacctctagttaatctacagatgatgactctagaagcacatgcgtttaaaacctatgttccaaatatccgttcggatgaacaagaaaaatctgcaggtgttattaaactcaatcagatagactcatgatgcaacaaacctgaataattaaaaaaaaagttgacattgacctggatctgacactgacctggatttggggccaaatggggaatcaacctatgagaagtggctaagaaaaggaccgtgcttgccgttgacccgctgtcgtcagcctcggcccgtcgccggcctgccgcggccgatcccctcgcgggctcaccgccgccgctgctgagaacgcgccgctggccgtcggtgtgcgccgtggcagtgatgtgcgagtgcgtgagaagaaaatgagatgcggtgtgggaacaagatggggcggcgctctcgtgcgtgttgggtgaggtgagagacacgagaggagaggagagaaagtgggagactaaggttgcctgctaaagtgctaatttcacagatcgtattttagttgttatgatataaacacctaaagaaatcatttaataagaaatgtgattagctcagttggttgggttgcgcacattctatccttgagacccaggttcgaatcctctgtttgcatctttgcccccctaatttattcctatcaggtatcagcagctcgctcaattattattattttttaaaaagcatgcttagtccaaaagttttaacaggaaaaaaaagcaactcacttgataatttcttttaaaaaacagttcgctagaggtccgaaatgaaaaataaatatctcactcgattattttaaaaaatacaataagttcgcttattccaaaagtttttacagggcatcaagaccattgcaacgcatgatatctgttgtaaagtggattcggccgttgcaagatactcaatctctgcaacgcatgttctgcaacacatattatctattgcaaattgggctcacccactactaagcgttgctagggtcgcattttggcaacgcatgcttaatgcgttgccaagcatgtattgctagaggggggttcttgttgtagtgactgtctccacggaagaactagatggctacctcagctctcccggcgtcgactcccgtcaaccaaccgagattctcgactatgacgacttcggctacaactatgacttcaacaacttcgacgaccttgatgaagactacgaagacaactacactcctctctttttggcgtctttatggccgacaacgagacagaagaacaacgtctggcacgcgaggccgatgagctgtgcacatgataggaagccaagcgccgccggttggaacaagagcggcaaacccaagagcaagcccgactgctgcatgagcagcaggagcccgagcgattgacatgggaagctgaggagcgacgacagcgtgctttggaatcagggcatcgagcgtgagctaatcagacaacaagacatcgaaggcacatcagtttttcgcaccccacagcagaatgcggttgcggcgattacaattttggataccctccttgtcgacgggtgatacccgtagaccggatatagagggtattggtgtacgctggtacaaggatccacatagtacgacatcgagcaatcaaaagacaagaattatattggttcaggccccttgacaggtaatagccctaatccagttgatgtgggattatatggtggaaaacacaggttacaaaggaaaggatggaacttgtcagatccgacgagattgtagtcgagctgattcgactagctcttgacgacttggctcctcgcaggctccgacttcgtaggctgtgtgggttatgttggcactgagattcgatgatctatgccctccccggggggtcccttttatatcgcaggtctggtgctctccgagtgggactcgaacataccagacctagcacgatacgtaggtgacccagttcttgtccgagaaggacttttcccatctattgatctcgtgaaaggtttccttagatcataaaggaaatatccgcgtgcgcgtgggtatgccatgtcaatacgtaacgtatatcgaagggtagggggtatgcctgacccgtaaccttgacagtagccccccgacttctgctcaaaaaatgaactcgtgcgaccattcgcgacttcgggtgtcgagaacgttatcattcctggtgcaagaaccgcggagatgatgtgtaatcgagcataccgtttgaaacccaacggtcacgagtgaattttgaactgaagtccaaaaactgccgcgcgtaatggacatataaatttccggcgggaatttctctcagttccttggaattcacaccatcgggggtgcgcctatttaaagggattttgggtgcgcattttgaaatccgccaactccgtcaaacacaccgcctgttagcactcctcgccttctccgctgccgtaaagaactctagcttcgccagctctaggtccatctccggcgatcttctagcaacgatggatctcggcaaatcggcttccaccagcgcaaacctgaagaagctccaggaggatggcgcccttcctggccgtgaaaaggcggagaggaaagcaggaggtactaatcctcagcccatcttaggtcgcatggttgcgatcaaagattatattgtctgcgggtttctccctccaccctccgaattccttctactggttttgaatttctatgggctttctcttctgcacttgaaccccaattccattgctttccttagcgtctttgtgcatctttgcgaggcctacattggggtagagccctttcttaatctgtttcgcttttattacgagttgcgctagatggaacccaatagggtatccggttgcgtcgggttccgacttcgtgatggcatgaagtcgcgttatgtccccttccagtgtccatcttctcgcagcaaatggcggaacaggtggttttaccttgaaatcaaggattcaaatcctgtcctcgttgttcccgaggaacaaccggacaagattccggtctggaccgccaagccccccttgaccccctctctccaatcatttatcgacatcatcgatgatctccaagaacggggcttatcgggatatgaagtcgttgcagacttcgtcggtaggcgaatccagccgctccaaagtcaggcccatccagcttataactattccaggccagacgacgcgacccgggtttctcctcggtgtatctttctcgcattcatttagacatgcttgtactcgcgttcctcttcgacttatcaaaaattgattcctttttgacaggtctgagcagcgaaaccgtggagcggcgtgttggtcaggtgatgatcagcggcccgaccacggtgagcaacatccccacgcccctttgtgaaaagggagcgacggagcgcgacgaagcgatcaatatgagttcattcgatagcgtcccgccttctctgctcgaaatcagcttacgacatgatttagcataggcccttcctttgactgatgtcgtcggaacgctcgcggatcatcaggtggcggcatctctgaaggagaaagtcgtcaaggaggcgtctgacgctgccaccaccagtggtggcgaagctccgaccaaggcgaggaagttctcgtctgtgctcagacatcgccgcaaagcagcgactccctcggtaatttcaccttgtcgctaggttatgtagcaaggaaggtttattctcatactacattggttgtcttgcaggcttccgacgcgtctcctccacctccgcgacgtcagagcattgtgacgatcggcgagaagttagtacacagacttttggattctcgtgtcttctgttcaaatggagttttgattcgtggtcgtttgtagggaggcgcgggcgaaggctgctcgggccaaatctgggggaacgtccagcgcatcccctaccacggtgtcgacagatgtcgcgcccgtggtcgggagtcaagaggtgacgccaagcggccctatcagcgatcccgctgggggtcctagtctgccagaggccgtcctcacctgggaggagctccaagtcgaaatgggccgccttctcaaagctggtgctcgtggcatcggccgcgagatctcagaggcgagggcggagacggcagcggcaaacgcgcttgccgagcggttggtgcgggaactagctgaggcccgcgaggacctcacgaagatgagggagcttgtggccgggaacgagcgccaaagcaaagggctcgaggaccgcatgtcggaacttggagacaatctctccgagatccgtggttcgctgcgggtcacctacaccggcctccaccagctcgccaaggagtgcggcgtcaagtccacgatcccggtgaacctcgatgagttctcgttgacttcttctcttgcggagctggcgacagcaatgggggaaatcccctccaagcatacgtccaggatcgcggaggagacgtccaacggtatctacaccggggtgtgtcacgtcctcgcgtgtgtaaggttgtcgcgccctgaactcgatctgcgtgagatcttggatcagggggcggcaagcgacacgcgtaaggaggtgatggaagaagtcagtgacctgggggagtctgtcctccccctttttgaagagtaggacttcttgtattttttataatttgtaaatcttgaactctggttgccttcgtgcatatatgattaccacccttgttcaatgttgatcttggaagtttttcttgtcgattgtagagatgctgatgacgaggatgtccagcagcgcgggcagcccgagtcactggcgataattccggtactcgaatttgaaccacacgtctcacacgacgtcgaggaccatactcttgatgtggaggtcgagatggcgacagccacctcaagtgagtagcctttttaactccgttgggttagtggtttccagcttgtcttagtggtcgttatgtttagcaggtctcaagaatgcccttgcaacccaagatcgtcgtatccaatattggaagactaaattttaagtggcggaactcgagagaaccatgctagccgtgaagaaagagcaagccgtggaaacgctccgaggccgcgaggtgtggtttgtgtcatatttaaagagttgctgtacctcaatggcctgggtatgcagggagcttcgagtagtccacagcgatcctgaagagtcggcggccgagtacatctcgtggctcaacggggcctgtgcccaactcgatggcatcggcaatcgcattgacgaagccttgaagcaagagtgtcgtcgaacgagccgatatgccggaggacatgtgctagcttgcctgcgagatcaccgcccgcgcctggatttcgaattcctccatgaagggtttgctcgttctcggaggacttcggcggagatagaccaccttgcgaggtcgatgtcgccgttagccgagaaggtattccagtctatgaactggcattggccctcttggtagtactcgtggcctgctacagatgtcttaggaaaaagtgtaatgtagtgggagatctatgtaaaaaacagtaagaattattatgtgaataaagaaatattccttaaacaaatgcatcttactctggatgttatgtgttagagtgtgttatcagttaacgacctcggccgtttgagtcgtacactctccctagcccctagccttgtcgtcggagaaattttctcggatgataaggctcttggacacttgatctgccttggttgaataagctctgatcctagcccccagccgtgaagttggaaagctcggtttccagttacacggcttggttaatacgcacggcgagaactcttacatgaccagatcttacatggtctttcgtctctgaaggatctgacaaggccttatcggctttgggcgtccccagccgaagatcccttaggttccttggaggccttgtcgagacggcgtaaagggtcctaaggataggtttcaacgctaggtattatcagagtaagggatcatcgggtgaaaacactttggtcgtggtatgaagcctagaaataggctttattgatactgtaagggtgcttacaggtacggcgttattgactcatacatagaatttacgtagttggtcaatgttccacaaatttgctaattcgcggccgtcgccgtctgcgattttgaatgcacctggccgcaagacttgtgtgattgtgtagggtccttcccattttggtgagagtttgtttcgtcctgcttggctttgaactcgtcggaggacatagtcgccgatcgaaagtatgcgtgctcggatgcgcttctcgtgataacggcagagggcttgttgataactagctgctcggacggcaactcgctcacgatgctcctcgagaaggtttacatcgatgtctcgctgttcctcctggttctcgtcgaaatgcttctgtactcgtgtactttgatgtcgtaactcgctagggagcatggcctcagagccatacacgaggaagaagggtgtttccttgttggatgttgtcggtgtggtgcgtacgacccatagtactgatgggagttcttcaacccattttttgtcatgtgacatgagtttgtcgtagacgcgggtttttatcccttgtagtactatgccgtttgccctttcgacttgtccattgctttgagggtgagagaccgaggcgaaacatattttgactcccaaaccgatgcagtaatcctggaagtcggcgctgatgaattgagagccgttgtcagttatgatgcggtgcggtagtccgtatctgcagaatatccctcttcgaacttaatggcgttgtcggccttgatttccccagtgggtagtgcttcgatccatttggtgaatttgtcgattgccacaaataggaatctatagccaccctgtcctcgtgggaatggcccaagtatatctagcccccagcgcaagaacggccaagtcagagggattgtctggagcgcttgtgcaggtagctttgtgtgcttgctgtggaattgacaggcttcacatcgctggaccatatcgcatgcatctttaagggcggttggccagaaaaacccttgtcgaaaggccttgccgactaatgtccgactggcggcatgtgacccgcatatgccttcatgtatgtcgaggaggagttgtctgccgtcgtcggtagagacgtatttgagaagtatcccgtttggcgcttttttgtataaatcgttaccgaccatacagtagatctttgctttacgggttattttctcggtctctgtatcgtcctcgggcaattcctcgctgctgatgaatttgattaatggggtgcgccagtcgtctgtggtttcgatgtcagcaacggcgcgttctgcctcggtgtccttcgagctaatgtcgggggtgctcgggccagattcaccgttaacttctttcaccgatggcttcatcaggacgtcgagaaaggtgccggtgtcgagcggttctcgtctggatgcgcatcatgctaggtcgtctggctcgacgttgtccttgcggtagacgtgtcggacctcgatcccgtcgaacctcttctctagcttcctgacctctgcaagatacttggataactcggggttggagcatttgtagtcattgtgcacctggtttgcgactagctcagagtcccctttgacgattagtcgcttggccccaagtgcggctgcagctcgtatcccagcgagtagtccttcgtattctgctttattattggttgccctgaagttgaggtggattgcgtgcttgaattgatcttcggagggtgatgtcaagataaatcctgcccccgctccttggctgttgagtgcgccatcgaacgccattatccatgtctcattgtcgccttggttgtctgacttgttatctggcatggtccaatcggccatgaagtcggtgagtacatgagatttgatggctgttcgcggcacaaagtggatatcaaattggcttagctcgactacccatttcgcgatgcggccgacaacgtctttgtttctcacaacttcgccaagggggaaggaggggacaactgtgactctgtgggcttgaaagtagtggcgtagcttccttgatgtcatgatgactgcgtagagcagtttttgaatctgtgggtatcttgtctttgcatcatggagagcttcgctgacgtaataaactggtcgctgtactttctctctctcgactacaatgacagtgctaacggaatatggcgtggcggcaatataaaggaataattcttcattaggttggggagcaacgagtacaggtgggtttgataggtagcgcttgagtgcaataaattcctcttcggcttcctgtgtccatacaaatttgtcttgtttcttcaacaaagagaagaaaggctgtcctcgttctccgatcctagcgacgaatctgcttaatgctgccatgcatccggttagcttttgtacctccttaagtcttgtgggcgacttcatgttctcgattgctttgatcttctcgggatttgcctctattcctctgccagaaacaaggaatccgagtagcttgcccgacggtactccgaatgtgcacttctctggattgagcatgaggcgatatcgtcggaggttgtcaaacgtttcccgcaggtcgtcaattaatgagtcgcttgtcttggtcttgacaatgatgtcgtcaacgtaagcctcgacattgttgccaagctggttgctaagtgcgccctggaccgtgcgctggaaagtattcccggcggttatcagtccgaaaggcatcttaacgtagcaaaataccccgaacggtgtgatgaacgctgtcttctcctcgtccttttttgccatgctgatttggtggtagccaaagtaagcattgaggaagcttaatagctcgcaaccggctgttgaatccaccaactgatcaattcgagggagaggaaagtgatccttggggcacgccttgttgaggtctgtgaagtcgacacacattctccattttccgttggccttccgcaccatgattgggttggctagccactctggatgaagtacttctctgatgaagccagctttgagaagtttgtcgagttcttctcgtatggcttattttcagtctggtgcaaatctccgcagtctttactttactggcttggcatcgtgtcgcaccatgagtttgtgctcaatcacctccctggggacccccggcatgtcggacgggcgccaagcaaacacgtcgacattatcgcggaggaaggtgatgagcgcgagttcctatttctcatctagtgtagccccgattttgatagtcttgtcggggttagcctgttgagcggaatgatcttgatggcgccgtccggcttcggcgtcttgtttggcttgctcactttcttgggtggctcaaacgtggcgggtggggtgggcgtttgctcgaccatgtcgaggctccgcctgtcgcactgcaccgccagctttgcattcccctgaatagtgattgttcccttcggtcccggcatcttgagcacttgatatgcatagtgggatgcggccatgaacttcgcaagtgcagttctcccgatgatggcgttgtaagctgtatcgaattcagcgacatcgaaagtgatctgctctgttcggaagttgttggcttggtcgaaagtcacgggcaacgtaatcttgcccagaggtctggacgatgattggggagtaattccatggaagggttgatcggttggtgtcaactcactttgtggaattcccattgcatccagagtgctggcgaagaggagattgatcgagctgccaccgtcgatgagaactcgcgctaccttgacgttccgaatagtgggttcgaccacaatcggatatcgtcctgggataacagatgtcttggggtggtcttcttccgagaactctattctctgctcagaccacttcatcttgggtgcagcctcctaccacgtcgaacagacttcacgttccactttcttgtattcccgcttggaggagtatgttgtggagccgctgaagatgtgtgagacgtggaggtcggagcctgggtacgcaggatccgattcgtgaggaggtgtctcctcgttcttctcgacaacgcgtactcgcttgcttttttgaaacgccatgtgcttctcgagcgactttttgaaaacaaggcaatcctccagagaatgtctgtccgttttgtgtatggggcaccatgatttctttgtatcgctgccttgtgggtctgggcgcttgggagggttcgcgtattctgctgcgaggacttccgcttaagctttccttttcccgtttttgcgatttttcttcttattcgactcagatgcgtctgcggctggtttcttctctcccccagtcttcggcttgtcgttcttgcgtcttagcgcgtcatccacatgggcgcaccgctcaacgatctcgaataatcttcgggtagttgtgatgcgtcttgtcaccaactcctgggtagtgtagcgatctctgacaccggacttgacttgaaggcgcgagttacagaagcgtcggtaatttcgggaattgtgtttctgcactcgttgaagcgccgaacgtattccctcaatgattcccccgagttctgtgttaacgcgtgtaagtcgtcttcgatcgcgtggcgcttgtatgttccttggaaattggcgacgaactgttgccacaggtctgcccacgaagagattgagtaggggggaagatgcatcagccatgtacgtacagaacccttcaacgcagttggtaaatagttcgccaacgcgttgtcatctgctctggcagcataaaacactatcgagtagacttgaaggaattcttctgggtcggtgctcccatcatacttttcaatggccccgggtcggaatctctcaggccatcggacatcacgttgggaacgaccgaaagccctacacccagcactaggggcggtgggttgtcggcggtcgcatgaccttcgtggatgtctgtctgacgatgaagaggacgcggatgatgacgatgacgatgggtcgcttggctccggcgtacgattacgaggatgacgacctggatcccgggaatcttgtcgttgtctctcgctattatctcggcgccgatctccttcgtcgtcgtcgttgcgacgacggccatgaccagtattgtttggcccccgccgttcgcgatcgttgcattctgggtcctcgtttgggcggtttcctcgatcatggcgccgtgaagaaacatgacgccgagagcgatttgcgtcgtcccgtgtgcgccgtgcttctcggcggttgttaatttgatctcgaagatcgctagtgccacgaggtggaggggtagcctgtcgaggcaattccctccgctccggatcttcaccattggcgtcgccggttggtggctgatcttggtgtgctgcggtagcggcctcttcgaacgcattgctgaggttggtcaccgactcccgtaatcgttctgtccaacgctcgaggtcgtcgttcagaacaggatcgtaaggagtttccctcagtatagcttgaatagccctgatgtgctgggccggagtagtcgattgattcgccgcttctgcgttggcttgtgctgatgtgccaacgtcatcgataactaatacttcccatggcgcacttgttgttgatgacccgtagtcttcgaggagatgtaagaccgatggttcgtgaggatcgagatcgattaccccaacgaatcgatctgaggctggagtcgctccctgttccttgccgttatccctagcggggacgtatgacttaggagacagggttttcatggcgccgaggaggactttgcagctcgagagatcgtgattctttgtcttgtggataggacaatagacatcccgagttggagaaatacactgaattccacgttccttgtaggcgcgaatttcagcacggacgttgatgaatacccagcaatcttgaagggtatgtttcttggttttgtggataggacaccagaagtcatctttgtcggcccgtgatttatgtcggagggacaagatttggccgcatcagaatccgtctcgagtttggatgtagtcggtaatccgttctccgtttcaacgggtggatttttcgacatggagccgtcttggttcgtagccactacgttctcgttttcagtcattggaggaccggttgagatcggcgtcatggtgtaaaccgggaagacgatttcgccgacatgagtccataccagcattgttgaagttgagagtgcttggctggagctggtgttgatgttgttgtcgacgaagcttgatggcatagtagtagaaccttgagtaccaagtccccctacctggcgcgccactgtcgacgggtgatacccgtagaccggatatagagggtattggggtacgctggtacaaggatctacgtaatacgacatcgagcaatcaaaagacaagaattatactggtttaggccccttgacaggtaatagccctaatccaattgatgtgggattatacggtggaaaacataggttacaaaggaaaggatggaacttgtcagatccggcgagattgtagtcgagctcattcgactagctcttgacgacttggctcctcgcaggctctgacttcgtaggctgtgtgggttatgttggcactgagattcgatgatctatgccctccctggggggtcccttttatatcgcaggtctggtgctctccgagtgggactcgaacataccagacctagcacgatacgtaggtgacccagttcttgtccgagaaggacttttcccatctattgatctcgtgaaaggtttccttagatcataaaggaaatatccgcgtgcgcgtgggtatgccatgtcgatacgtaacgtatatcgaagggtagggggtatgcctaacccgtaaccctgacactccttaaagaggatgtgcccaatcacgttctcaacataatcaatcagacaaagacaatgatcgccgcatcagttccagtcaacctggaaagcattcgggtgccaactggcagtcgggttccatccctccaatctgaagattaccatcaaccaagtctcagcatcgcggggtcaagatccaatcacggggggtcatggtctgctcacgggggcagggatcatcatgaacatttagttcattcgccagccgataggcacagagagtgacgcgctgagcagcctcacttgccatgtcgctggcaacccattgacctacgtgacacacttaaccgctgctgtgcagaaagaggtgatcggcggcatcgaaccctggactgctacgaatatgatgaagatggagtcgcagctttcacaagcgacctgcgtcgagtggattggccggctggttttaagccgactggcatcgagaagtatgacgaaaaaatagatcctgaaccatggctcactgtctacggtctcacaatccgcgcagtaggagaagatagcaaggcaatgccaaattatttaccagtggccctagctgactctgctcgatcctggcttcatgggttaccacgaggcaccataggatcttgggcggagctccgagatcacttcatcgccaactttcaaggcaccttcgagcgtcccggcacatgttttgaactctataacgtggtccagaagcccggtgaaacccttcgggaatatattcgatgcttttctgaacaacgcaacaagatctctgatatcacagatgatgccatcatagccgcattcacaaaaggagttcgtaatgaccttctagtcggcaagtttggatgcaagcctcccaggatagtcaagcaaatgtttgagaaggccaatgagtatgcaaaggctgacgaagccgttcttgcttccaaccagtcgggcagccactagaaatccaagaaagatggaccaaccgtaggggcgagtggaagcggcactcataacaaagatcacaagcggaagcccgaggatctggtggcgactacaacacattcttcccgtcaacaatcgcgagtcaacaccttcgacaaaattatgaatgctcaatgttcgcatcacccaaattccaaccatgctgccaaagattgtttcatctataatcagtttgccgaacaatatgccaaacaagcgaagaagctgactgatggagagcaaagcacctcgaagaaaaaggacgacgatgacgatggcccacctggttttcaagattctcgtaaggagctcaatcacatcttggttgggccgcaagcctatgagtccaaacggaagcagaagctaactgataaggagatcaataccgttcagtcggacacacctcaataccttcgggtggtcggagatagcaattaagtttgactactcgaatcaccctgactgtcacaccctaaaaatcccaaatgtataaattgttgtttaattggaattattagaaataattttaaaagcctagaagagaagatctaattttaaataataaattccaatataaaagtgggccagataaaattttattaaatacttcacttgattctatagttcctagatttttctgggatttatttgagccaaggaagcatttttaataaatggaattgcatttcatgaataatttaaattgaaaaaggttttaaaagtctccttttggctttgggccgaaagtcggcccaaaagctctctctctctctctctctctctctttccccagcccagtcagcccacgcgcgtgcgccctcgcccgctgtaaggtggggccgacttgtcggactcgtcttcctcctcgcgccgccgtgccctagccacgccgcgcgtagccgccgccgcccttccaattcgatcgcgtctttccttctccggtgaaatcaatagaggggaaatgatcgccttgatctcctctatcttttctcttttggaatcatcggctaatttcttttggaaattggtggattcgagttcgattcggatcaatctctctctcccgaaccctaactttccatcgccgtcgcccgttgccgtggtccttcgtcgccgccctttagccgctataaaaggaccgccgagccctccgctacccaccgctaccttcgccttcgtctctcgtcgctggtagagccctagcgccgtgtagcttagcgccgccgtcgccgccgttcgtacagccgtgcgtcgccgccgctccggtcgtcgtcgtcgctcgggaaggccgccgtcgtgatcgccaagccgtcgcctacctcgtccacccctccgtcatcgccgtaggtcaccggagcaccgccgtcgtcgtcaagccgaaggtcgccgccacttcttcctcgccgccgtcgccgtctgttgatcttccgtcgctgctttggtccctggtgagttcgccgtgtcgtccgcaacccgtaggtgccgtccgttcgcgccgccgcgccgtcgttcaccggcgagcatgcgtcgtccgagccgtcgccggtgatgacgtcaccgctgacgtcattgtcgccgtgtctcgtgaaccgccgtagactagatcgatctcgaccgtccgatttggttagagtgatctcggccgttcgtttccgtagaccgccgccgtgcacccggtccaccgtgaaccctagccgctgacgcaataatcccctttttcttttcaaaaataattcattattgcgtcataattcaattgatatctatataaatggtttaatctgatttaatctttaaaaattcataactaattcatcttagctcggatttagttggttcaagtctctaaatttttctaaaattgagatctacatgttaaaaatatccacatgtactgttcatgcttgtttatgtgctgttttggtgattttgctcttttctctttagattccgacgttcccggagagtccgattttgcaggagaagactttgaagagttccaaggccagcaaggcaagtcacacagatcccaaacaaccctttgagcatgttgatcccgtttaaagctattgtttctattcaactattgcatttattttcgaatgtcattgggtggatataacctattgcctttgttatagcctttttatgttgattacctattctttgtcacctagttaataattggattagctagaacattatatggttttagctaaagtgattaggatgcttagccatgcttagagacactagctcatataaatgggataacttatgattcactattatttaatgatggcttaatgatagctcacgatggttgatcgtgattggttaattaattaatttgccaactaaaacttgataatggtgggttgtgagcacatggttttgatggtcgtgctcatgacaattaaggaccggttcacgattttcggttgtgaaacattaatcgtgcgaaccacaagccagcgtgggcaacggctttactttctgtatagtgtggttcattgtagagcaccagactgtgaagtggcggagataagcccacgggggtcgctggggagtccatgccttgtttataagggggtgattatgatccaggaacggtgcactgctttgaattgtgttatgcaggaggtattgtcacaatctctattcgggtacttgtcaagtatcgcgacgcatggttgacatgatgttgaggttgtgtcttgtgggtacagtggtacacctctgatcagagtttaaactattcgaatagccgtgcccgcggttatgggcgggtctaacaatgtctttcgtgattagtctcacacttctcactatattaaatgatgatgttaataacttgtttagctcctggtttggaatggtatattcctggtttggagatagaactgtgcagccgggattggttgttcagaatggttgggcctatgcaacacgggtgtattgtatagtgttgatttaatattgtttaattactcaactgttttactattctctcaattgcttattaaatgctgtttatgcaaatgagcccatattatgccatccttcgttatccattgcacttgcatatttgttgcgtggcttgctgagtatgtcatatactcaccttgcagtcattcatcagaggaggagttctacagtgatgctgatggtgtggatgattaggcgtagccctggtcaagctgcctgtggagaggagtcgcctgtgctgtttcttttattttccgctgcttagaactttgttgtttgagaggaactatctacctctgtaatgactttatattcgcttattaattagagtaataattgtactctattatcaatttgttattgtgtgcctcggctgatttctggacgagggtttacacacatgtaagcgtttggaattttggatagaaattccgggcgtgacactgaccgagtggtccacccagggtggtaccccctggtactagacctagtggttcgcaacatcaaacttcggttatccctcatcgatggtggcagtgcactcaatattctttttgccaagactctggacgagatgcaaatcccacgaaccgagttgaaaccgagtggtgcgcccttccatggagtcatcccggggttgtcttcaaccccactcggccagatcaccttgccagttacttttggcactcgggagaacttccgtacagagaacgtttgtttcgaagttgctgactttgagacagcgtaccatgctatacttggacgcccggcgttagccaaatttatggttgtcccacactacacctacttgatgatgaatatgccagggcctcgtggagtcatatctttgcgaagcgacatcaagaaagctgtcacctacgacaaggaaagctgcgagatggcccagactcatgagattacacttgcccatgaatcaatccgactggctgcatcaactacgaccgaaggagtagtgcctgcaactaacatgccaaagaccgaagaaggcgatgtcaaaactaagaagattcctcttgatccatccgatctctccaaaactactgtaatagacgcagagttagattgtaaataggaaagcacgctcatcacctttcttcaagctaataaagatatttttgcatggaaaccatctgatatgcctggtatcgctagagaggtgattgagcactccttaaatgttaaagatgacactatgcctatcaagcaacgactctgctgattttcttaggacaggaaggatgcaatcaacgaagaactgaccaagcttttagcagcatgcttcatcaaagaagtcttacatcccaactggctagcaaacccagtcttagttcggaagaaaacaggacaatgacgcatgtgtgttgactacacggatctcaacaaatcatttcctaaagatccttttgggtcagctttttggattgctactcgggatatcaccatatcaacctaaaggaatccgactgcttgaaggcctcatttattacaccgtttggagcttactgctatattactatgcccttcgggttgaagaatgctggagcaacttatcagcgtatgatccaaagatgcttttcaacatagatcggtcgcaatgtagaagcctatgttgatgatgttgtagttaagactaagcagaaggctgatttgattgctgatttggaggaaaccttttgctagcattagtgcttttaggatgaaattgaaccctgaaaagtgcaccttcggagtactgtcagggaagctacttggctttatggtgtctcataggggcatacaagccaacccggagaagatcaatgccatcctcaacatgaaaccgcctagctcccagaaagatattcagaaactgactgggtgcatggcggcgcttagccggtttatttcaagatgtggcgagcgggggatgcctattttcaagctactcaagaagactgataatttctagtggggtcccgaaacccagcaagcccttgatgatttcaagagactcctcacgactccaccagtcctagcttcatcacatccgcaagaaccattgctattatatgtgtcagcaacatcgcaggtggtaagcatggttttggttgtcgagcgagaataggagggccatgttcaaaaagttcaacgaccaatttacttcgttagcaaggtcttggccgactccaaaacaagatatccctaggtagaaaagttattatatggtgttttaattaccgtcaggaaattgtcctattattttcaaagtcactcggtcacagtagtcacatcttttccactcggcgacatactccataatcgagaggcaactggacgtattgcgaagtgggctttggagttgatgtctttggatctatccttcaagccacgaacgtcaatcaagtatcaagccctggcagattttgttgccgagtggaccgagtgtcaggaagatacacttggggagaaattggagtattggactatgcattttgacgggtcaaaaagactctcgggcactggagcaagggttgttatgttttccccgactagagagaggttaagctacgtgctatggatacactttcaagcatctcacaatgtggcagaatatgaagcgctactccatgggctgaagattgttgtatctctagggattcagcgtctggtggtccgtggtgattctcagttggttatcaatcaagtcatgaaggattggtcctgtcttgatgacaatatggctgcatatcgacaagaagttcgtaaattgtaagacaagtttgatggtctggagttaactcacgtgcttaggcaccacaatgaagcagccgacaggctagctaatttcggatctaaacgggaagcatctccttctaatgtctttgttgaacatctctatgagccgacattatcaaagaaggataaaactgaagatgaagagaccaatgaagtagggatgattgatgtcgagtggagagagccaatcatcaaatttttaactcagcaagagttacctcaagacaagaatgaagcggaatggatttcttgatgtagtaagctttatgtcatggttgaagctgagttatacaaaaagagcccatctggaattctacagtgatgtgtttctcttgaggaaggcaggcaattgttgcatgatatccattatggaatttgtgggagtcacgcggcagcacaaaccatagttggcaaagcatatcggcagggttttttctggcccacaacggtgtctgatgctgagaaggttgtgtgaacgtgtgaaggttgtcaattttttaccaggctagttcatctgccagctcaagagttgcaaaccatccctctttcctggccttttgctatttgggggctcgatatggttggtcctttcaagagggctaccggaggatttactcacctttttgtggttgttgataagttccccaagtggattgaagcgaaaccagtcgttactattacagctgacgaagctcacgatttctttatcaacattgtgcatcggtttggagtacctaatcgaatcattacagataatagtacccaattcactggtggggtttttaaagatttctgtgaagactttggtattcagatttattatgcttccatagcgcatcctatgagcaatggtcaagttgattgcgccaatggtatggtacttcaaggaattaagacactggtttttgaccgacttcgtccctatgctggcaaatgggttgaacaattgtcgtcggtgctttggtctctgcgcactacgcctagtcgggctacgggccagtcgccgtttttcttggtttatggtgctgaagcaatgttgccgagtgaagtggagtttgaatccatgagatttcacaattttaaagaggagcgctatgagaaagaccgagtggatgatctcaaccaactagaagaagctagcgaggcagcattaatccagtcggcctgttatttacaaggacttcggcgttaccataatcgcaatgtcagatcacacgcatttttagtcagggatatggtgttgaggaagattcaaactatacgggatcggcataagttatctcctttatgggaagggccttttatcatctctgaagttactcggccgggttcttatcgactcaagcgtgaagatggttcggtcgtcgataattcttggaatattgagcatctttgtcgtttttatgcttaggcattatttttgtacattatgtttctcttgactgccaacatcaagtatttcttgagttaccagtcgggggctataataataataatggagtgtgatttttatcaattcaatttgcctacttgatttatcattgccctgtttgatttttagcttagtcaataaggactgaaagttttttgacgacttttgcgggttctaggctcagtaaagtttgacaaacacttttaagaaatcagaaactaagtttaaattttcaagcacaacataaatatatcagtactacacaattgaacctccattgtcagtattacatgatcactcgtcagagtcatcttctccatcatcagagttagcaggactaaggctagtgttctgaaacctatctagtacatcaacagcaattctttcagcagttttttgggcatcattaatcagatcatgtgcgtcttcttcacttgtgccagctgcaaagccatcaatagcatcgacattgattttggggtacagagacttggtcattgccaatgccatgcttgctcccatatttccagcctccttgatatttttgaagtacacatctagagcagtccttaacttatcaaaaatttctactgtgtccaaggagctcgtaccactattgctcaaatacatggcctagataattggggtagcagtgttggcaacttcgcctctagcttttttagcaacttcgactttgttgatcaagaagtcgaattgtgcctttgtcttccccttatgatctgcatacaacaccaatcaaggaatttagatgcaacagtattggctaaatttcatttatagttagtcagaagagttaccttcaaattctttgaccgccaaatctttctccttgggtagagcagcttcgtcttctaaggctttgattcgcttttccagttcggagattttggctgcttgaactgtagtgcacacaaaacttatacagttgctaagattaagtttgaacagttgagcaggaataatatttacctttcgaggaaccactcaattcaaagttggcatcctggagctcggcaatcctatccctaagttcatgttctgtattcctggcctcctccttggtttcatgcagtttggctctggtttcttccagagtaccaagatgagggaccagcttttcaagggtatcggtttttgcctcgttccgaagatggattctctgcgcaatactatgttcacctcaacaaattcaatggatgacgaaatatgactggggcagtatacttacgtttaaaagacgagtagcctggttgagagtccttgtcagcagagccacttcaccgtcctctttttgcttgtttatcacaataccctgtggctgcatctcgtcgtcccaccatttaaccaaaataggtggccgagaatcttcagttgatttaatccgaagaatttcttcttcgtcgccaatcattgggccttcaagtatataggcagcaatgaaataataagggaagtt

SEQ ID NO: 43415 - DNA, 2410 bp, Oryza sativa
atttttttccccatctacattttgctgctggggattctctttatcctcacccggctggtttccagtcgggggctcctggctggtgctcgcctcggcagatgccgattggtttccagtcgggggctcgttgtcagcttcagtttcaccagttgccgactgactgctagtcggtggattttctttggaggtattagtcccggcaacagcagcagagctagtcttttcttcttcagccgctcccgagctagtagagggatcagagtttttaccagtcggatcaatgtcggatggtttcctaaggtacaagagggtattaccaattgatctcaacaaacacagatccgaatgttttgatgaactcatacctggaagatcttcggatttttggcattgggtgactggttgttttcttcttcggtggaatagccttttttggctgcttgccaactggcccatcgtcactatcgtcatcatcgcttacgatcatcttcctttttcgagaaaccgtttgactgggcggaatagcatctcttttgggccacgggttgaatctttggacccccggtagcttggccttggtgatgccacggagaacgacgttgagcggttggagggtcggatttcattagggcatttccctatggataagcaattttgagattattcccaagaatagcatgataaaagtccaagcatttagatatttaccgctggaggaggattgaaggcgttgtatggcacgatcggcagcaaatgtgagaagctgaccacaataccagatgagaagattttatacatcctctccttcatgatcttgaattcgagggagttggggtcttctcggttgggatcagtctttccgtcgtactcgaaggccgtgcgagatctctctttgattggagccagtcgacactttatgaagtgctgagtaatctgctcttcttgaaggccttgttcctttagcctcagcagtcggtccagcaactcaagagcttgagaagcttcatcgcccataggaagtgagttctagatgtcttgatatttcagagggcagcatgaatattcgtgtagcgcaggatctggcttttggatgtaaaaccagctagcatgccagcccttattggaggttttgaagggaagagtgaagtacttctggcatagggtgccacgaagctggaagccggatcccccaacgatgcagggcttgttcttattcggttggggtttcagaaaaaagattcggcaaaataaggcgaagtttggccaaatgcccaaaaaaacttcacaaagatggatgaaatttgctatatgaacaatggagtagaggttgaggtgatagatattgatcctataaaattcaaggattcccctaaagaatctggatgttggaagagcaaaaccaccatagaagaaatgggtgaagacgacaatctcgtgagtatcgggggtcggaaaagcctcaccaaatgctggatgccatccgatgttctccttggctggtaacaccccgtgcgccatcatctccttgagggtttcctctatgacgtcagaaggcacccattgactctcaaaattttctctctcttccgccatggatgaaaatggggtggagagatttagagcacgaagattgacagggaaattgggggcaggggttgtgcggaggaattttgccgaaggaagctgatttgaaggaggtggattgcggtacagttgcgaaccctagcttttggcggcgcaagcctgttactgtagcaaaaaatggggaacgcgcggctgttgtggcgaggaagacgatggggtttccttcggtgcgatttttatcgatgggtatcggaaaatgctaatgggcctaggcccaaacagtgttttcagctcaaatacactctcggtgtggctgattgtggtctcttgggacttaggcgtatttttgctcaggcaaaattgcccataataaataaagcccgataccattaaaatcctttttccgcagttagtaaatttcttggaattactacgatgcatacaaaaaggtgcccaacagttaaaaacgccatgttatttttgttgactttttctataaggtcacaaagctattagggtttaatcaggacgagtggtttttaaagctgttgttccttctgagcacttatatgcttcatttttctgatataggctcaagttacaacttaggttggttaaacttgtcggtcagtatttattcagcagttgataaatccttatgagtttttactcggattttttatcacaaatgatgtatttagctctgaaatagacgatagatctttagaatgcgtttatcactcggatctttatatatcttctatgtttcatagggagcttaatgatttaattaaatcagttggcaaactcttcgaatggagtcaca

SEQ ID NO: 43416 - DNA, 16987 bp, Oryza sativa
ctatatgttcactatatgtttagtcggggtgcatctaatcaatgcacctaattttttatttttagctgttcacagcctttgattcaagcactcgggaggccaaggcggcaataattgaagcactcaggatttttgtttaatggctcgggagaagattatctcgtcgactgcgaaggtctcaggggctactgtggagattatggataccccatacccacacggcatgtatatccgactgggtataggggtaccatgtacatatagaataaatttagtaaaggacccggttgttatgttaacttgtgtatcaaggaaacatccgatagtcctagtcggttatgattgtaatttatctttacatgcctagtacgttaggaacatgggctgtatcttgtaattccggctcctccccctatataaggaggggtccggatgcctctaggggcataacttttctcgttgatcatatgatcaataatacactcggcggatcaatccctggataggagtagggtattaattctcatcaagaaggcctgaacctatataaacctcgtgtctcctaacctatccacttttccagcttgatagccactgtaagttcaagtgccttaatttggttttggtgattaatgacaaatctaattaaatgagactaacggttttatgagcttttctttgactagactcattttgatatgaaaataaaaatgatgagatgtatgtattatactttatatattctaacttggtctctcttgtggatccaaaatatagtgtaagctccctcattaatctcgattgattatgtgcatatgtgttcctttatatccatatatatgcacatcttgagggggagcttattctatattttgtttattataagatttctacctttgatttgaaatcatctttcatcttatctctctatattgtttatatcgggttattatctatcacagaagagagaaaagattgaaagatcttggattaaacaatttgtgtaattgttgctttggtgatagatgataaaccgatatttatgggattaacctctcttttacataagttgtcaactaggttatttcccgataatgagatgtggtagatagaccttaatcatgacaaggatgaaatgcatggagaaaaagcaatatgtatcacttcttatctcctactttttgataggttcatatatatgatttccatgttattggtatataagtgtgagactaatgtttacttgagcattatcttatttagtcttctttactttgagaacatggagatcataaaggtttgtgtttttgttggtcttgtcattgctatatgcattctccatgtgtataggataaaccccattagttcttctttacttatacatatacacttgcctctcttgtatatgattccgaaaatgattgcgaaggcaaaagtggttctgtatattttcggacttgtccgaaacagatttttggattttccgaaaatcatcagtagagtcaatttcgcttcggtatattttcggacttgtccgaaagttattttcggacttttccgagaacatccagaacgatgttgttggtactggaaattttcggacttgtccaaaaagtttttggaatgtctgaaaaatccttcgttgaccaaactattggtgctgagctggaattttcggacatgtccgaaaatctttcggaatatccgaaaatctcaattattgtgcataacgggcagaatctgggctgtggctataaatagccccctcccctcacttgtgaggtctgctggttccattccaatcatttgtgcccttggcttgctctctctctctctagcacttttgagccttgctttcttgtttcccctctcacccgtgttcgatttggatttggtgtgtgtgtgagagttgtggattcgagtttgtatgagtgcttgttattgacttcgtgaagatttgtgagcacttgcatcatctccgggagttctttgcttcatttgttactcttggaggttgaggactcctaggcggctaggtgttgctcccgagccaccgatctacttgtggttggccgggagaagtttgtgaaggtcggatctcacctccgagaaggaagagatacccttagtggaaggaggagtgcttagtgcaacctcttgaggaaagtgttagctaagacccggctcttagtgagctcctcaacggagagtagaatcccctcaaggattcgaacttcgggaacaacctcgtgagcttcatctttggtgactttacttcctccctctccactagctttgcttgttcgagctgcaataggtctagttgctgtttgtgctagcatattcttgttgtaggcagctagatctaggatttactttgctatttgtgctgactccaaaaatttttggttatatccgaaaatttcggaaatatccgaaaattactgcttccgcttttaattgatttttgaattagcgtattcacccccctctaggcctaattgacactttcaattggtatcagagcctaatctcctaattagacttaaccgcttggagagatcatgtcgggccaagcgggggatgggaacgatggtgataagggagctaagatcccttatgactatccctctacatctacatcttatgtgagtacctatagcggcaaagctccgtacttcaatggtacggactatgccgcttggaagcataagatgaagatgcatttgaagtctattaacccatctatttggagaatagtcaaaaaaggctatgttttgcagaatcccgaagatcccaccaaggaggacgacgagaacgagcacaagaacgctcaagccgctaatgcaatacttagcgccttgagtggaagtgagttcaaccgtgtggatggcattgagagtgccaaagtgatttgggacacgcttcggaacttgcatgaaggcacggatagtgttcgtgagtccaaggtggagatcctcaaggggcaatttgagagatctgtgatgttagatggtgagagcccaagcgacatgtacgaccggttgagcaagatcatcaatgagatcaagggacttggctccaaggacatgaccgatgaggttgtggtcaagaagatggttcgagcaatcactccaaggaactctaccttgagcgtccggactacaagactctcacacctcatgatttgctcggatgcatccttgcccttgacatgctcgtgcaagagtccaaggatgtcatccaatacatcaaccaaagctcaaccgcaagcatcaagaaggaagacttagctttgaaggcaaaggaagaagaagaagagaatcgcaagagcaagagcaaggcggagatcgatgatgaagagatggctcccttcgtcaagaagttcggcaagttcatgaggcgaagcggcttcttcaagggaggatcttccaagcactactccaacaagtcaagtggaagacactccgcaagagtgtgctacgtgtgcaaagagcccgggcacttcattgcggattgcccccacctcaaggatggttcccacatcaaggaagataagaagaaggatgagaagaaggagaagcacaagcatagcaagagggaacattatggccaagctcaccttgggatgatcttcggctccgactccgagtcaagctcaagtgatgaagaaggagtcgccacgtttgccgtcaagccctcatcaccaccgagactcttcgactactcaagtgatgaggatgctccggtttgtctcatggcaaaggagcctaaggtaccttctcttcttaagtcatttaatgttgatcttgttagtgatgaggaggatgaggttgaggatgaggttatagatgacgaattgttcaagtccataactaaggaatccctaccacacttgagtgagttgcttgagagaattgaggaccaatatgcaactcttgagaggcaagagactttgctcattcgtgagaaagagcggtctcatgaactcaagagtgagcttgctaaggagagagagaaaaatgaggcattggtacggctttacaagcaaatcaaagagtctcatgctaatcttgaggtggcgaacgctcaactttaagagagagtggatggcttggacaaagcatacctcactcttgaagagaacttggtaaccttaaagaatagtgtctctctccctagcgagccatcttgttccaaaattgtcccaagcaatgaaccatgtgtgagatgcaatgatattgatattgaagcttgtgctactaactctatttccttgagtgctttgcaaaagaaaaatgagaagcttatgggactccttcacaatggcctacttaagtgccatatgggtagtaaggccctaaaggagtacctaggctatcaaaagggacaacttcaaccatgagggtcttgggtatgtttctccaccaaaaggaaaggtggacaagagtgtgatgatcaagaggccccaaggtcttagcaattttgttaaggccaaaagtatccttcctaatgattatgcttcatattgttcttttgatgtatcttatgttcttaggaagaatgctagtggtcgtgttgttgctaagtatgtaggcccaaggggcaagaatatttctatcaagagagtactttgggtgcctaaggcacttgttactaacatgagaggacccaagcaagtatgggtacctaaaattagaaattgatctcttgtaggaatatgtctccggtggaagaagttgggtaattgatagtggatgcacaaatcacatgaccagagaagaatcaatgttttcaactcttgatccaaatggcacttcacaagataacatagttttcggggacgatggaaagggaaaggttatgggattgggtaagattgcaatttctaatgatctttccattgccaacattctcttggtaaaatctctaaactacaatcttttgtccgtttctcaattatgttctatgggttataattgtctttttaccgatgttgatgtgaccgtctatagaaggaatgattcctcggtagtctttaagggtgtcctcaagggaaagctttaccttgtggatttttcctcaagtaaagccaaacatgagacatgcttagtggctaagtccaacacggggtggctttggcatcagaggctagcccatgttggtatgaggaatcttcacaagcttctaaagcacgatcacatccttggactaacaaatgttcaatttgagaaagatagggtgtgtagcgcatgtcaagccggcaaacaaattggagcacatcaccccgtcaagaatgtgatgaccactacaagaccattggtgcttctccacatggacctcttcggaccaattgcttatctaagcattggaggtaacaaatatggtcttgttattgttgatgacttttcacgcttcacgtgggtgttctttttgcatgacaagagtgagacacaagctatcttcaagaagtttgcaagaagagcacaaaacgagttcgacctcaagatcaagaacattcgaagtgacaacagcaaggagtttaagaacacgtgcatcgagagtttccttgatgaagaaggcatcaagcacgagttctcggctgcatattcacctcaacaaaatggagtagctgagaggaagaataggactctcaatgagatggcgaggaccatgttggatgagtacaagacatcggacaatttttgggccgaagccgtcaacaccgcatgccataccatcaactgcctttatcttcaccgccttcttaagaagactccctatgagcttcttaccggtaataaaccaaatgtctcttactttcgtgttttcggtagtaagtgttacattcttaataagaaggctagatcctctaagttcgctcctaaagtggatgagggattcttgcttgggtatgggtcaaatgaatgcgcataccgcgttttcaacaaaacctctagtattgttgagattgcgcgtgatgtgacatttgacaaaattaatggctctcaagtatccgagcgaagcaatcaaaagattggctcttggggacgtacgtcctaggaagccccaacaaggagcctcttccttaacacaagtggagccacctacatcaacccaagccgacgatccctctatctcaagcttggatcaaggtgaagaaggcgagcaagtgccaccctcaccgatcaacttagctcgcccaagaatccaccaaagtatccaaagagatcatcctaccgacaacatcttaggagacatcaacaagggagtatccactcgttctcgtattgcaaatttttgtgagcattactcgtttgtgtcttctcttgaacctctaagggtggaagaagctcttaatgatccggattgggtgatagcgatgcaagaggagttgaacaatttcacccggaatgaagtgtggactttggtggagcgacctcggcaaaatgtgattggcacaaagtggatcttctgcaacaagcaagacgaggccggggtcgtaataaggaacaaggcgaggttagtggcgcaagggttcacccaaatcgaaggattagatttcggtcaaacttttgcgccggtggctagacttgagtcgattcgcatattgcttgcttttgctactaacctcaattttaagctatatcaaatggatgtcaaaagcgccttcctcaacgggcctatcaacgagttggtatacgtggagcaaccaccgggcttcgaggatccgaagtatcccaaccacgtgtacaagctccacaaggcactatacgggcttaagcaagcccctagagcttggtatgagtgtcttcgcaattttcttgtgaaaagaggctttaaaatcgggaaagccgattcaaccctttttactaaaagacataataatgatatttttgtgtgccaaatatatgtcgatgacattatatttggttctactaacaagtcttttagtgaagagtttagtaggatgatgaccaaacgttttgagatgtccatgatgggtgaattgaagttcttcctcggccttcaaattaagcaactcaaggaaggaactttcatttgccaatcaaagtatttgaagaacatgcttaagaagtttgggatggagaacgccaagccaatccacactcccatgccatcaaatggccacctcgacctcaacgagcaaggtaaagacgtcgatcaaaaggtataccgttccatcattggctcacttctttacctttgtgcatctaagcctgatattatacttagtgtgtgcatgtgtgcaagatttcaagtcgctctgaaggagtgtcaccttgtggccgtgaagagaattcttagatatttagtgcacacacctaaccttggtctttggtatcctaagggagcgaggtttgatctcattggttatgccgatgaggattatgccgggtgcaaagtggataagaaaagcacattgggtacttgccaattcttgggtaggtcccttgtttcttggtcttccaagaagcaaaactccgtcgccctatccaccgccgaagcggaatatgtttcggtggggagttgttgtgctcaacttctttgaatgaagcaaaccttgagagactatggcctcaatgtatccaaaatcccactcctatgtgacaatgagagcgccattaagatagccaacaaccctgttcaacactcccgaaccaaacatatcgatattcgccaccatttcttgagagatcattccacaagaggcgacctagacatccaacatgtgagaaccgacaaacaattggcggatatctttaccaagcctctagatgaagctaggttttgtgagttcaggagtgaactaaatattttagattctcggaatgtggcttgatctattgcatgcgtgtttgcttagtagaataggtttgcataccactttgtgacaaaatggtcattcaattcatggatggacactagtcatttttttgtggagattttgaatctatgtgtatggggatctcatttttcaatgaattttggtcctagcacaacttcatagattcacacattccctctctcgagggtgaattatcttgtctcatggtaattccctctcttttgatcccttggatcgtccatttgacttgtggctattgttttgtgtgattgattgtgtgctagtcacaaattcaaatggagcctctagtgctcgaccatcccttccttcctaaatcctataaaaaatccttgtaaaaattgtttttgtcaaaattcccggtgcttgtcccttgcaaaattcctttaaaatgtttgaaaaataatttcatcaaaattcccagcgaaatctcattgcaaaactgtgttttccaggaattttcggacattccgaaaatctctgtcctgtccctctttcaattgctgcaatcccaggatttttcggacttttcgaaaaattttcagacatatccgaaaaacatcagaaccgtgcgcaactcttctgtatcctttcggacatatccgaaaattttcggaaatatccgaaaatctcggggtccttatatatcaccccgtggactcccttctctctcctttccacttcttttccctacgggttgactccctcctccctccccattggacctctccgcattcatacccccgagagggatccggcggtgattcgccaagtgtatgattggcggtgcaagtctgaggttgttgctcctcgtcgggatgagaatccgcgctcccttcgctgcaccgccacggatccgcgtttttggaccctctttcagcaagacttttatgagtctgtgattaagtccaaagctcatcccactgttcccatgcaatagatcaattgggaggagttgcaggcacacaacgatccggtgattgactctatgattgccaattgtgatctcatgggtatccgctccttcatgacgttgcagcaaaattggtgcaacgaggtcattgctcagttttatgccaccgtctactttgatcgttatcgtgccatgcactgcatgactcaggggtcctggtattctgtttcttatcagcagttggctgagatctggggcttccgtcttcgttctttgctcaaccttgatgaccttcataatcttcaaattcctgccaacacagaattgcttcccctttacactccaaatgatccaaatgtggtgttgggcaaggtcgacggcctcaagccgtactttgcctacttgaaccggatgtttcgccggtcttttgtgtctatggatagtgatgctaacagcattaaccacctctctagaccgtgcttctccgttttgatccccctcctcatcgcttccatgtctatcactttgtgtgggaggagatccgcatggcttcaattcagtacaagaaggggttggtctatgcccttcacattatgcggatgatcgagactgtgactcagctccagtttcgccatgatgtgactcattctcagcttcacttgcgccttcttaaggccccccgctcctcggctgcttgggacataccctcctcttccactctgccgcctcctgctcctgagcgccctgcctctgtggctcgtcgtgagccgtctcccttattccacaatttacggagtctttttggtctttgctccacggaggccaaaaagaaccgccgattgcggaattcggcgaagaaaacggctcgtgatgtcaagttcctcaaggcaaggtattatgaggaccaccacattgatatccctccttctcctccgggtttcgaggccgagcccgatgagccacaggatgaagcgattgaggatccttttgctgggttgccttacgacttcgacttctttggatatggccatggctatggctatcctcctccaccacctccagaggatccttctcaggcgcccttcgcttgagtcgtcatctcatcgtcctctctttttcgtgtcttgatgccaaagggggagactatctatcatggctttagattatctatcttgtccttagagtcgagcacagttggtttttatctgtatgagactattgtgattttttatgttaggtttaaagctttgtaagactattgtttaattatgaatgcttgtgatgtaatagatctttttatcttttaatgtggtgcaatgccttatcctctttatatggtgcttgtgatgagatgtaattattcctttgcatgcgatgtgttggatgtaatgagcatatgtgatatatttgttctcttgtgagcttcaatgtggatgcaataatttagggggagctctccacttgcttttatgcacactcttagggggagcttccactaaaattttgcacaaaaaaaccttaaattatattcattctcttgtgttctaatcgtattgtcatcaatcaccaaaaagggggagattgaaagtgcatctaggcccctaatgattttggtgattaattacaatgtgattagagaggactaacatttttatttaagcaaatgtgaaggttgttatgtcctcaataagttagcgtaatgcatatcccgccgaatacgttgatgtgatgtgatgcggcaaatgagcaaatggtattttgtacgttttcgtttccttgagttaataggaaagccgcactattaagagggatgatgcattgacatacgaggagtgatcaaagtgctcaaaatctattttcaaaaaaagggtttctcctcagtttggtgtgttctggattttttcggagttttccgaaactcattttcggactttccgaaaacacacagaaccagattttcgcttctggaaatttttggatttatccgaaagtgattttcggactttccgaaaatgactgcgaaggcaaaagtggttctgtatattttcggacttgtccgaaactgattatcggatttttctgaaaaatatcagtagagtcaatttcgcttcggtatattttcggacttttccgagaacatctagaacgatgttgttggtactggaaattttcggacttgtccgaatagttttcggaatgtccgaaaaatccttccatgaccaaactgttggtgctgagctagaatttttcggacatgtccgaaaatctttcggaatatccgaaaatctcaattattgtgcataacgggcagaatctgggctgtggctataaatagccccctcccctcacttgtgagggctgctggttccattccaatcatttgtgcccttggcttgctctctctctctagcacttttgagccttgctttcttgtttcccctctcacccgtgttcgatatggatttggtgtgtgtgtgagagttgtggattcgagtttgtgtgagtgcctgttgttgacttcgtgaagatttgtgagcacttgcatcatctccgggagttctttgcttcatttgttactcttggaggttgaggactcctaggcggctaggtgtcgctcccgagccactgatctacttgtggttggccaggagaagtttgtgaaggtcggatctcacctccgaaagggaagagatacccttagtggaaggaggagtgcttagtgcaacctcttgaggaaaggattagctaagacccggctcttagtgagctcctcaacggagagtagaatccccttaaggattcgaacttcgggaacaacctcgtgagcttcatctttggtgactttactttctccctctccactagctttgcttgttcgagccgctataggtctagttgctgtttgtgctagcatattcttgttgtaggcagctagatctaggatttactctgctatttgtgctgactccgaaaattttcggatatatccgaaaattttggaaatatccgaaaattacatcttccgcttttaattgatttttgaattagcctattcaccccccctctaggcctaattgacactttcaaggttccaccgtaatgaggctaatggatgcatgacaccatgtgttgacggtcaccaagccaaggacatcgccatgttgaaaagaatgaagtcaagcttgtgatgagaagaaagtcttgacaaaggatggttaagacctcggcataaatatggttgaatcgaatggtcacaagtgttgatctcggctcaagcttgatcccaagttggatggtgcaaggcaaaggtataatgtagctaagaatgttttcttagtcttttcctggtcttggtgtttggcgtagaccggatttgctagataggcgccgtactatcaagaggggtctatgaagcgagcatgtggatgatcttgcaccatattagttcatatgcatgtaggtgtatttggtgggcttgtctagccaagtgtggtgagttttctcaagtcccaaacaaagagagaagtgagcacatcctataggtttgggtagcctcatatggttttgtctggtggagtatcttttggagtgtgagccctttttccctaagcaaagttgtgtttcttggatggattgttcatgggttggatagccctttgaataagctttccatagagtccaagaacgtcaaattccgagactcaagtcaagagatatcaccgttttactaatggccgattgagctgaaaagtgccctgtggtctgaccgcagcccttatggaggtctgaccgaagtatgtcgtccggtctgaccgcagatcacatggcggtttgaccgcacatcctgattttgaaggaggtctcgtcttggcaatccagagccactagagccgcagccggtcaaaccgagcccctggcaatctgaccgagctgtggacggtctgaccggccactacactgcgatcagaccggccaggttgactgggctcaatgattgccatgtaatggctagttttctagccgttaagtagtccggtcttaccggccacactatggcgttctgaccgacagagcacagagttggggattttgactccaacggctagtttttgtggttgggggtatatatacccactccccaacagcaagggtaaggttttggcactccattgcattatcttgaacccttgcaagagctctcacacccttgtgcacttagtttatctagtgaggtgttggagagtgagttaagccaatccaagtgcattgattcattgttagagctagtgtggtacttgatcatcctcggcaagcatcctagacttgttactcttggaggttgccgcctcctagacggctttgtggaggtgttgccggtgacctctccgaagagattgtggagaagacccggcgccggttgagagtggtttggagttaaccaccttcggagagaagtaagaactatccctagtgatcgaggcttgtgtaatcctctctgtgggccggcccccaccttgcccaccccttgacgaagggggcgtgcggtggcttcgtggttgagcggtggagttggcctcgcctcaacagagattaggaaaccggcgagtttccgaacctcggtgaaaaattccttgtctcttgtctcatttatttgttgcatttacatttgagcaagtttacatactaagcttatttgtgctattatcaccctaagcttgcaaaccttaacataggctagcttttttgtgcacttacttgagactagttgatttaggttttgaattgtgcaaaaccattttgatttacgcttccgcatacaaaattcggttttagccaaaagttttaaaaccgcctattcaccccccccccctctagtcggcctccttgatcctacagccaccccttttagttttgccgaaatattgtttcaacaagaactacgaggaagccgagataatgtttcgacaagaactacgaggaagttaagtttccaacaggtccacatctgataataaagagactctcaaggtttgctacctcaacttcttatctcttgaaggttattgatactgaagtgctagctgatagaatgttctatatccaaacacttgctaataccattgtggcttcggttcttttggaggctatcctagctaagctcagctcatttgcaatggacatgaccctatatttttcttgcatgttcatctaccaaagtagttggcagcatggtctcttcatctcttcaaacaagtgcaaatcaggtgaacaagaaatctattttgcttcccttcaatatcccaattattttcttctatcatggataatttgtattcttccacctctagggtaccagccaaaaccagctaaataaaactagtgtatatatataatatgtattcatccttcttgaaagaaaatcacataaatatcatgcatgtactattgtgatgtgttttttccatgccactacggcgcagcagaggctatgtgtgttcagatgatgagtagagctgtcacttggaataaaactgacaaatcaattactacatttcaacaaaaaatctggaggcatattgaggtttggtaaatttctagtgacatatatataaggaattttcctatagcatactatagttctcctgttcagttatgggcctgatgcacttcacatcagggattccaattttgttttggaaaaaaaataatcagaactgaaaaaaattaatgaccatatataattgtttgaactcgatttatgaacgtaaaattgtgataaaaaaattcgaagcctaggtaccttggtttacacagataataatatctttcgagtttcacaccaaagagatgttgaaaccacaatagcttacattttcttctctctctctccatgaacttggcgtgcttaggctcgaatgagtcatttataacaatgattcatgtcatactccatccgttcacaaacataagagattctatattgtttagcaaagttaagattgaggttcaaattactttgatgtctgtcacgcccagaaatttagcccaaaatttcatactattttgtggattaaatccttggtcagggattaggcaggggtccccaaacggccaatttatatacaaggtccaacgtaaataaagcgtaaaatacttacagaagaggcacttagttctcacaccaaaaccgaagcagcagcaacggaaaaaggcgatcatagcgaggcttcagctccactccacaggcaaaactcaactggggtctgagccttggtcctctaacttcgtcttcagctcagaagcactacacttctgaaaagggggaataatagcaaggttgagtacaaccaccgtactcaccaagccacaccaatgatgcactcatgcaacgggagacaaagagaggtttgtggctatttgcataaaggtagttgcaaaacattttattgagcaaaatagtaaaactgttgattaattaaggtagtactaaatcttcactgatcaacgctacaccacgttgatcaggcctaaccatcccacctgaactaaaccagttcattaagccaatttattaagggtgagactaatcacggtgaatctggtcgatcgcccattaccacgggcacggttatttgaatagttttactctggccagaggtgcacaactgtacccacaagacacaatccaccggcatgtcaccgtgcccggctggacacgtcaccatgtcgagtgattgtggcaagacccttcatataactccctctgaccaatcgatgccacacctcaggtttcacccctcccccagcaggcagcaggcagtcccccctcgtgccacggtgaatccggaagcagcataggccgtcgcagggcccatccatactcgatcacacccaccctagcctgggtacgtcagccaaaggaaagctatactacaagtcaagcaattacccattcctgcttgtggtacgcgcggtaagtcttccagtgcatccagcgaaccagtccttaatttgctatgggcgcaactagaaaaaccatgcacccacaaaccaccattaagtcatgttttagttggataattacaaccaatgaaacatggctagatgtctcgagcacgcagctcgtcaagatatatactaggtgtctaatgatgtaattatcccattatgtgaactagtggtaattaagtatggataagcatataattctagctaggtcaacataagtaacacaaaatagtcgaattatcacctaagtttgacaaaggacgaacatcaagtaatatggcacaagcgaagaagtagataaaaccctgatcccatgtaattagcatgacatgcaattttatttgcaaacgataaaacatttataaattaggatcaacatgctcaaggggaatgtgtgacttgccctgcttcttcaaaagaatcctctgaactctttcctcgtaatcgcgagcttccgaaacagcggaatctacgcgctggcacgcaaaacaaggaaaaactctaataaaaaccaagtaaacagtatatgaaaagtaaacaaacatgtagagctcaagtttagatgaattttgcaagttgaatggcccaatttggagttcttatgaattagctatgaattttagaagttttgagccatttaaatgaatttctataattattactcgaaatattgcgcaattaaagctatttatggtgtcaaccgaggggattaggtggagccgacaagcaggccccacctgtcggtgactcaaggagccttggcctaccgtggaccgagtccacggaggcacgggctagtgcaccacgtggcgcactcgtggcgccgatggggcaccgacgtgctggccacctatgcggacacacgggcggctcagatggaggccggggccgatccgacggcccagatcggccgcgcgacaggggtggcggcaactggctgcccggcgaggacgcggcgcgcggcggcagcgacccgaccggacggccactagcggcagcggcgcgtcgcgagctggcccaggatgcgaccgacgaagcggagaaagagggagagggaggggagcgctcatcggggaacgacactgtagggaggcggccggcgaagctcgaggcggaggggggcggcggagctccagtgacgagcgacgctcaggaaggggtgtacgagctcggtcgcg

SEQ ID NO: 43417 - DNA, 1501 bp, Oryza sativa
ggcctggcttgcccttgcggcggcgaagctggcgatgacggcggagtagagcggtgaagactagagtggtggtggcgcgcggccaaagctcaccggagggtggcggaaatggcggacggcgtgggcagcacgggaggggttgaagggagctcgggcaaatggggaaaaagggagagggaggtgcgggcatcctttttgtgggctcgggtcaatgggatcgtggccgattaggggcggcaacctgcgaggaagtggcatggcgacatggggaggatggtggctggatttggtgggaaggagtggggaaaatgggcgcaggacggacgcgaggtggaggagaggggtggcatctgggcccacgcgagagagaagcgcggggaggcatgaaaaaggtggcagcgtgggactgtttcggcagccatggagccggcccgaggagaaagaggaagatgacacgtggggcctcgggtcccacctgtcggggagagagaggggaaattggcaaggggaggttaaatagacttcatgggcaagcggaccgagggagagaggccggcccaagagaaaggagggaaggagggaggggaaaatgggccaaggagagagagggagagctttggaatagaaggggtcgaaagtgaaggagggggaaataatttgttttccatttaatttaaatgggtttaatgaactttatgctatttaaattatttcttgagctcggaaaattcgcaggaaaagttcagagagtattttagggcacagagaatattacaaaattatttgtagccatgatttttaaaggaaattttaattccctccttatttcacttgattaaattgctttaatttttaatataatttctagaaatgatttatttaatgatttttaatctcgaacgaaaattggggcgctacaatgtctgtgtgtgtttgaattaggaaagatcacgcctatcaatgagaataaatgtagaggttggatggattgggaaagtagtgctgtaaaatctcctatattcgtgaataaatttaaaccccaaatcccttatttttgtagagagagaaataagtatacgctgttaacgaccaaatttggtaaattctatcactattggcatcggaggtgaagatcagattgaagtgggatccaaaatgaagatcattgcggaaatagagtaagagtcggctgcagtccaaatcggctaaggtcaggtcggcagagttcgagtcggatggggctagccgatacagccgattctgataatatgactcggtgtacgtcatcgggttcaagttgatgtgcttcaagatggttgccatgcatggatagagtcctgggaaggcaattgtatctattaattaggatattctatgtaatttccttagatatatgtttgggcaaaagtctgccgtaaagacttatgttatcttagagtttgttagagataatagtcatgtctgttgtggacgtatcttgtaattctcgggtataaataga

SEQ ID NO: 43418 - DNA, 17854 bp, Oryza sativa
ttaatctatatgttaaatctgccctttatgttaagatcttgtcacatctaagtatattaggcttctgtttggtatattctacttactttaatatcttaatatagagtggtatcggagtattagccaatacatgctagatccatttgatcggctatgctataaatgtatataatcccactattaatatatatttcgatctaagtgatttatactgtctcggcaaggcgaccgatctatcccaaccacttgatttaagtatatatcgatataaggattatatatcattaatatctacagccgattgagtagatttagttctgatttgcttattgatatttgccgatcgatgtacgcatgacatcggcttgaaataaatgatatgtcatcggcacctagccgatcggctatcatttataggattaattgcggtttctttgttctatttcttgttgattgcaggatcaaatcaactagcacgctcatacatccgaacgcgagttttggacctgcactggagttaagcagatctcccaggcctcgtgttttctgtcaacacgcttttggcacgcccggtgggacgaattagaagtcagaaatcaatcttcctcatggccgagaagctgccaccttcgccatcctcggctagcccgggtactgttaaagagaaaatccaaagaccaggattgagcgaagtcaatgaagggaatattgtggctattgatccggaaaagctcacacctgaccagaagaaggacttcgaagcaatgatgcaacaagcacgagaacagttcttcaaatcattcacacagactcgcaagggaaaatttgtttaaaagtacaaggtaaaggtggttcccgatgagcctgagaccagtacctttaaggagggagaagggaaaagagttttagatggctcggctcaagagaatcagggtgacgactctcagggggcacatgcagttcaaggtgatggtgctcacgagccacaacgaggaaatcttaatcagaatggtgagacagcacaagatttcttcaacaatttccaagatcgagtggactacgccgtacacaatgctttgatcaatcaatctggagtgttagtcaacaccttgtctaacatgatgaagacgatagccgatggatcaatagttgagcatcaagctgcaggcccggtttacttgccgggaggtgtttttccgaattatcgatctttgatcactgatgttcagccgcttgctcaggcagttcttccgagtgcaccatcggctcagccgatggcaccgccattgacttctttgcctgctccatcagcgtcgacaccaggccagccgattaatcctcggctattgatgagggagcagccacagcatagcggacagacggtaaatcggccagcacaggatcaggtggctgctatgtttctacccctccaatctactgtcaattcgattcagcagacgccaccaaggcaacaggttgtgcagccgattcaacagactccaccaaggcagcaggttgtgtagccagttcagccaacacttccgggacaacaaactatacagccgattccgcagcaagctttgatgaatcaatcggctgagcaatcagctggacacgccctgaatcaggttgttccagaacatttggttcaccatatacaaccagatggtacgacgatgcctcagattgtgccagagcacttggtgcaaagtattcagccaaattaacagaatttattcagccaaattaacagaattaccaatgaggcaatataatcagtttgaaccaatacagcaacagtcgcaaggagcaggtcaacaacgaccatgggctgatgtaattgccgatgtgatgagagaacaatttgggcttaagccgaaagatactggaaaattgtatcggcaaccttaccctaaatggtttgagaaagttcctcttcccaaccgatttaaaatcccagacttctccaaattttcgggacaagatggtgtgtcaacttatgaacacattagccgatttttagctcagtgcggcgaagcatcggctgtggacgctctcagagttagattattccggttgtccttgtctgggtcggcttttacatggttttcttctttgccgtatgggttagtcaatagttgggccgacttggagaagcagtttcatagctatttctatagtggagttcatgagatgaagttatctgacttgacagcaatcaaacaaaggcatgatgaacctgtgcatgagtatattcagagattcagggagatgaggaacaagtgctttagcttaagtttgactgatgcccagttagccgatttggcttttcaaggcatgattcctccgattagggagaaattctgatctgaagattttgatagcctgtcgcatctcgtacagaagataacattgcatgaacagaggtttgcagaggccaggagaagctctaagagggttaatcatgtctgcccttacatgtatggatcggatgatgacgatgatgactccgaaatagctgcagccgaatgggtaaggagtaaaaaggttataccttgtcagtgggaaaagaattctggaaaagaggagagatatgattttgatattaccaaagctgacaagatttttgatatgctactccgggagaagcaaattcaactccccgctggtcatgtaattccatcggctaaggaactaggcaaaaggaggtattgcaaatggcataattctggatctcattctactaatgattgcaaggtctttagacagcagattcaagtagccattgaaggagggaagattaagtttgatgattccaaaaagccgatgaaggtcgatggtaatcctttccttgttaacatggtgcataccgttggtcggacagccgatgtgggacgagcgagaggtttttgcgtgaattcggctagaattataaataagtatcagaggaaatacgacaaacaacaagagaggcattatgaagaagataatgatggtttcgatccttattggaattgtgagttctttcggttctactggaacgaaggtatgaggctaccatctattgaagactgtcctgagtgcagtgatattacagagagttcaagccgatcgtacaatagaggcaatcggctgaagcaagctagagttcccgttcatcaaaggttgggcccggcaaatcaaaatgattacttggaggaagacgagaacgcgaagactcagtggtgtccttctgatatttttacaaagaatcagaaaagaagggttcaaaggttgaggaatagggagcgctttcaggaggtcgagcaagaaattggtcatcggctgaggaaagcaaagccaaggaaggagtggcgtgttaagaatcaagttcttggagccgatgatattgcagccgatgaagcaaagaggttggcaaaagggaaaagtattgtaacggcgccaattaacatggtctttactttgccagccgaattcgggattgaccaagccgatgttgacgaactggaagaggaattggctaagttggttctatcaccagaacgagcagtttttgaaaagcctgaagggacagaaaatcggcatcttaaaccattgtatataaatggctatgtcaatgggaagccgatgtctaagatgatggtcgatggtggggctgcggtaaatttgatgccttatactacgttcagaaagttaggtagaactactgaggatctcatcaagacaaacatggtgcttaaagactttggtggcaaccaatcggaaacaaagggtgttctgaatgtagaattgacagtcggcagtaaaactatccctaccacattttttgtcatcgatgggaaaggttcttacagcttgttgcttggaagggattggattcatgccaattgttgtattccttcgaccatgcaccaatgcttgattcaatggcaaggcgacaaggttgagattgtaccagccgacaggtcagttaatgttgctagtgccgatctagctctttgggagatggatggccttgattgtttatccaggaagatttgggttggagattttctaaaagtgtccgattctgatatacagccgattgaagatgaagaacccaagctattattttgagggcgtcgtggagggttcaagcgtctacgccaaggacacggtagatgatctcgatgacaagcaaggttagggttttatgtcggccgatgatttagaagaagtggatataggtctgggtgatcgaccaaggccgacattcattagtaagaatttgtcttcagaatttagaaccaagctgatggagcttttgaaagagtttagagattgctttgcttgggagtattatgagatgccaggactcagccgatcgatcgtcgagcatcgattacctttaaagccagggattagaccacaccagcagcctccgagaagatgcaaagccgatatgcttgaacctgtcaaggctgaaatcaaacgtttgtatgatgctggttttattcgtccttaccgatatgctgaatgggtttctggtatagttcctgttatcaagaaaaatggtaaggtgagggtttgcattgatttcagggatttgaataaagctaccccaaaggatgaatatccgatgccagtggccgatcagttggttgatgctgcttcaggacataagatactaagttttatggatgggaacgcaggatataatcaaatctttatggccgaagaagatatccataagacagccttcaggtgtcctggtgcgatcggcttgtttgaatgggttgtaatgactttcggcttaaagagcgctggagctacgtactagagggctatgaattatatatatcatgatctgatcggatggttggttgaggtctacattgatgatgtggttgttaaatctagagaaatagaggaccacatagccgatttgagaaaggttttcgagaggactaggaaatatggtttaaagatgaatccgacaaaatgtgcttttggtgtatcggctggccagttcttgggatttcttgttcatgagagggggattgaaatacctcagaggagtatcaatgcgatcaaaaagattaagcctccggaaaactaagacagagttgcaggagatgatcggcaaaattaattttgttcgaaggtttatttctaatttgtctagaaaactggaaccttttacaccattgttaagattgagagctgatcagcaattcacttggggggcaaaacaacagaaagctttggataatattaaagaatatttaagttctcctccagtattgatccctccacaaaaagggattcctttccggttatatttgtcggccggtgataagtcaatcggcttggtcttgattcaggaacttgaaggaaaagagagggttgtgttttatttaagccgtcggctcttagatgcagaaacaaggtattctcctgtggagaaattgtgtttgtgtttatatttctcttgcactaagttgaggcattacttgttgtccaatgaatgcactgtggtatgtaaagccgatgtgattaagtacatgctatcggctccgattttaaaagggagagttggcaagtggatattttctttaacgtagtttgatcttcggcacgaatcaccaaaggcgattaagggacaggctgtaaccgattttattgtgggtcatcgtgatgattcaatcggcttggttgacattatgccttgggtattattctttgatggatctgtatgcagtcatggttatggtatcggcttggttataattgcgccttggggggcaagttttgaatttgcctatgctatcaaacaccgtgtgactaatcatcaggctgagtatgaggcggtcttaaaagggttacagttgcttcaggaagttgcagccgatgctattgaaatcatgggtgattcgttgttggtgattagtcaattggcaggggagtatgaatgcaaggatgatacattgatggtttattatgaaaagtgccgaacgttgataagtgaatttaggatggtgactttgaagcacatatatcgagaacagaatatagaggctaatgatttggctcaaagagcgtcgggatataagccaatgacaaaagatatcgagatagagattgctacaattacagccgatgattggagatatgatgtgtttcagtatttacagaatccatctcaatcggcttcgcagaaattgcgttataaggccttgaaatatactttattggatgatgacctctattatcggatgattgatggagtgttgcttaaatgtttgagtgccgatcaggcaaaagttgcaatcggcgaagttcatgaagggatatgtggtacacatcagtcggctcataaaatgaagtggttgctccgacgtgctggatatttttggccgacaatactggaggattgtttaagatattataaaggttgtcaagattgtcagaagtttggagcgatccaaagggcgccagcatcggctatgaatcctattattaaaccgtggccttttagaggttggggaattgatatgatcggtatgattaatccaccctcgagtaaaggacataagtttatattggtggcaaccgattattttaccaagtgggtagaggcgattcctttaaagaaagttgattctggggatgctatacagttcgttcaagagcatataatctatcaatttggtatccctcaaactattacgactgatcaaggttcaatttttgtatctgatgagtttgttcaatttgccgatagcatgggaattaaattgttgaattcttcaccgtattatgcacaagctaatggacaggccgaggcatctaataagagtttgatcaagttgattaagaggaagatttctgattatcctcggcaatggcatactcggctggctgaagcattgtggtcttatcggatggcttgtcatggatcgatacaggttcctccttataaacttgtttatggtcatgaggctgttctgccatgggaagttcgaatcggctcgaggagaacagagttgcaaaatactttaacagccgatgagtattataaccttatggccgatgaaagggaagatctggttcaatcacggctatgagctcttgcaaaggttactagggataaggagcgtgttgtccggcattataataagagagtagtacccaaggacttttcggagggtgaacttgtatggaagttgattctgccgattgggactcgggatagcaaatttggcaagtggtcgccaaattgggaaggaccgttccaaatttataaggtggtatctaagggagcatacatgttgcaaggactcgatggagaagtttatggccgagctctaaatagcaaatacttgaagaaatattatcccagtgtttgggttaatgcatgatcgactagtgttgccgatacatgatagccgatgtgtttgcatcgcctggagatggccgatattgttatatcgcccttagttgcttttcactattgtaatcggttgtggtttgccgatctacaaatggccgatattgttatatcgcccttagtcgtttctataattttgtcaatgttttcaacattgtaaaattaggggggcacatacatagagaattgcaaagaaaaatgagagaattgaaatttttgaacaagccggcacaaggatggcagcaaagtaattagggtgtcttagccgattacaacagttttctacaaactattacatggaaatcactgagacaagtatcgctggatagccgatatagccctttgcctaatttgatctatttcttcgatagcttgggcgtcttgagcatcggttccaggaatgactttcaaggatttagtcatctcagcaatgttcttgatagctgattttagccttgccttctgttcttcgacagcttgcatgagatcggttaacttcttgtgctctagatccagtttagcattgcattcttgaagttgtgccaagagttcaatcttgtgagcttcaagccgatcaacattagatttgatcgggccttcagataactgatcaagcttggctttctcttcatgaacacgctgccgattggtttggattgtagcctcgatgtccttgcgctcccggcgatcggataacctctgcctggctttctccagtttgaattgatgctgctcgaggtagacagctggagtaagagcatcggctaattcgtccgaaagaaaggcttggatatctgcaaatcttgcccggattgagccacagttggtcaccaggttatctagtgatgctcctaaccgatgggagatgtcttcgagtgttttcttcatatcatcagacaggagagctatcgctttactggtggtgtcttcttctgtttcatcgaggtaatctttgatgtcaaaggagaacagatcggctaagacctgcaagagacaatatcatggatgattaaggatcaagatatgattggccgatctcaaatttatgttaataaaccttactggaatagtaggtgcagctaattgttcctcctcttcaacatgatgactgcctgcagtcgatggagtgtggccgcctgattctgcctgcacaagaggggaagaaggaggaggagactgctaaagggataaatattagatataatcagcccaaatcagttaatgagatgataaaagtatcttactgtaggagctggtttaagggttgaagtagctgatctattcctcacagcaattttctttctctatatttattaaaattgtgaggaatcggctataaagtaaatgactgcaaaagtggacagataaagtcgcttacctttgccaattgagctgaagcagaaggggatggaggagattgcttaggtgaagccaatggtgttctttcagtatcgcttatttcggctgcagcttggtcgatgtcttcctcgatttcttcttcatccagagcttgttcaatggatggatctagggcgggtagatcgtcagctggcttagctttctttgtcttagccttattcttcggagccggggctgaagtatctgcagccgatgatctggttctccgcttcttgccggcatcggctggttctctgatgagtcctcggggaagtgctgaggtctttggggcattgtagccaatggcagaaggggatggcccacctccatttggaattagacccggagcatacttaatgaccttgccgctattgctctggtgaggaggagaagattctgttgtctgcaaaacagaagaaaagttagtcaaggttcaaatcggttgattgactattcaagcaagattgaagaaataaagattaacatgagggatagcatcagggaataagtctgtcatgtacatggaagccgattgatggaacagatgcagcttccactcgccccaccatctgtcaaatgtcctgctcctgaaccttgccagctttatgttctcgatgctgcccaacggaggtccagggatgttcaatagctgatccatcattaaagttgaggagatgtcgcctctgcattggatcttgttggcaaagtacagaccgattggcaattgtcccattccaagttgtctggccgatgacatcggatgataaaactcgtaagagacttggatatttctcccttgatggatgccgactgggaggatacatgggctgatagcagtagtaaagatttctctggattgctgaaacttctcatgattaatatcctcgaacctgaaatcggctggcagttcgaaatccattgagtcggcatagaagaaccaaactcgggcatctttttggaatccatcataaaagctgaagaaccagtccttcagaagttcagccgataactttgctcctgcatcggctggtgtagatgcatattctccgtatgacatacatctgcgatgggtgtgttcttctccatcatcttccacaatcggctccaaacttggaaattcagcttctgtcacagatggccgattgacaactttcatgactaccaggttcagctaggattgcaagagccaccatggtccacctgttccaaccactgagccgataattatcttggccgatgcgttgtttaatatctggtatagatagccgagaaggattttgcctaagggaaattgtttcttcgttactagggcctcggctagaattgccagttggttgtaggaccgcagcttgatccgcagaaaaggaatttttccaaccacatcagcaaaaaagctacgtgctctctaggagtgactggccctttgcccatatatgctgtgatatatcctgaccaacccccaatgctcttagttttgaactcaaaagtgttcttggtgttcaggttcatagggttagctgatgaggttacatctaggccagtgagcatgataatatccagcagcgttggggtcatcggcccttggttgaaaagaaaagcattgagagtgttggaccagaaataagttgcagcagccattaggggttcatctttggccgaatttgctattgtgagggctagggcttggctgattccgatctcatcccaatgggcttgtttgctagccgatatccgcttataccatacaggccagcttttctccaaagaaggccaggatttgaaggtgtttttccaatggcttgtgtttggattggccgacctaaaaggggttctgttggtttcggctatgataaactcagtggggtctagattgccgattggaccgagaaagtattgttggtcatgaaacagactgggaaccgcaacaagattggaaagatgctacaagaatagagaagaagaaaacaagataaggtgagcgaaaaccggtctgatgaacggaaaagggggtctagccgatggggacttacctcagcgtattcggctgatgatgcggcggtcggattggtggaggtcgacatcgtcacgggtgaagatctggccgggagtggaatcgcctagaaatcgccatgcgtgttgaggaggtcgccggagagagaaaggacgggatctgtttaagcggtgaaaacggaaatcacgacgtgaagattctttggggcaacggttagtatttaaagtagagcgataacggacaggaaaacagcaagtgcgagtttctctcagagtcggtatatggcaaatccgaaacattatccaatattccggacttggggggcatgtgttaacgaccaaatttggtaaattctatcactattggcatcggaggtgaagatcagattgaagtgggatccaaaatgaagatcgttgcggaaacagagtaagagtcggctgcagtccaaatcggctaaggtcaagtcggaagagttcgagtcggacgaggctagccgatacagccgattctgataatatgactcggtgtacgtcatcgggttcaagttgatgtgcttcaagatggttgccatgcatggatagagtcctgggaaggcaattgtatctattaattaggatattctatgtaatttccttagagatatgtttgggcaaaagtctgccgtaaagacttatggtatcttagagtttgttagagataatagtcatgtccgttgtggacgtatcttgtaattctcgggtataaatagacccgagccctatgtaaaaaagggacgacatccaatacaatctcggcgtatcgccaccctttttgctttacttttatttcgacgagttcgtactctcgggttgagctgcatcggtttcgatcttcaacaagaggtaaaacttgtcatgacgacttatgttctcaggattagtgcttccatctttatgatactctaatcttgtctatataattcgtcgagttatcatatatctcacataatcttcgataatatctttatctaacctataatcggctaacatctgttaatggaaggcagccgattaggttagacaatgacgttaacttagattatgtgatatatctaccactctatgaaacttccagcggcttgattgtctagatattgttcttcttttcatacttaatgctgcatcaattgagtttgatctattaagtcatgcttagaattgcaatctctagcctgctttctggtcgccgattagggtagtatcggagtttcagccgatcttatctgatttaactacttttattccatatgcttaatctatatgttaaatctgccctttatgttaagatcttgtcacatctaagtatattaggcttctgtttggtatattctacttactttaatatcttaatatagagtggtatcggagtattagccaatacatgctagatccatttgatcggctatgctataaatgtatataatcccactattaatatatatttcgatctaagtgatttatactgtctcggcaaggcgaccgatctatcccaaccacttgattcaagtatatatcgatataaggattatatatcattaatatctacagccgatcgagtagatttagttctgatttgcttattgatatttgccgatcgatgtacgcatgacatcggcttgaaataaatgatatgtcatcggcacctagccgatcggctatcatttataggattaattgcggtttctttgttctatttcttgttgattgcaggatcaaattaactggtacgctcatacatccgaaggcgagttttggacctgcactggagttaagcagatctcccaggcctcgtgttttctgtcaacatacgcatactcagtaaaacataatcgttccaacgctgtctatgactgtccacagattgttatggtatgttttttaagattcaagccatcgtcatcattcttcaagaatgatagctagatcacaaaagagtaggatatgatatggcacattaaccacaaattgaatactaccttgaggggatcgatcgtttgctctaatttgtatagtatatggagttaaataactggtttcgaaatacaaggtaaaatggtcttaatttttttttccttatgaatcatatttttagaatcgctaccttgagggaatcgatcgtttgctataatttgtatagtatatggagttaaataactggttttgaaatacaaggtaaaatggtcttaattttttccttatgaatcatatttttagaatcgtagagcatataatacgtggaaataattcagtaaataagcagaaaagaacggggctaataatcaaattaagaatcactccagcgcaatcatattttccaaacctatgccccttccattgattagtttcatcaactgaaagtttgatgcagtacttgtggggcagaacatgcagaccaatcaacatatatcaacaggtaaaattatacagttgaatattatgaggttataatttctcagccaaagcttcattctcaaatgaatatatcaaatctggttactcacactataaggaatttgattttttatgactgcaaaacatatttatgagtagacagtcatacatcattaaagagtggctaatctactgcgttcatcaaccaaattaaatcttgtatcaaattgatatgtaatttgtgttcatcaaccaaattaaatcttgtgtcaaattgatatataatttagcacatgttttacatgttattatttctcaatcgaatcattctttgtcttcctatctttaaccatcatctctagttttccttctcaaatcaacaggctcaaataaaaaatttgtgcctcattcaatatatatagtatacattcatctataacattgatttctctgtcttcctatctttaaccatcatctctagttttccttctcaaataaacaggctcaaataaaaaatttgtgcctcattcaatatatagtatacattcatctataacattgatttgtaagccacatgactattgataagaaacagatttaacagtttagtaagcaaccctcttgtttttctccaatattttatcacatttaataatgatcttttgcggtataactaacccatattatttcaatcatgcctaaaactagcactcctatatatcactggtacgacataaacacatcatgtgtgcaaagttagctgtatgatgccactatatactatcactgtcatttaattgctatggcatcatgtttatgttccttgcccacttatttgcttcataaatcacatacgcatgaacgctagctactcccgcatgaatcattagctagcttactttattgaaatgcagaacgatcatgcatgtaacatgtttcaatttttatgttttttttagcgcgccaattgatctctacccttctctgccctttttgttttttctaaaggtatcccaccctcgtactatctttggttgattggatggaccgacgagatgaatggagaactatccagttcatgctttcttgacatcctactgtttggatgcataaacgggattatatgtgtttggagacagcaagatattacctccgttatcacatagatgacattatagaatgcgtctagtcaaaccttgatatattaaattaagcatacataagtattagaatttaatacacaaaaatggtattgatagatttatcatgaaaaaaatattcacatggttatatgttcgttatttttataaatatactgttataaaaaaataatggcaaaacacatgcatttgagacggtgtcaatgtccaaaatgctcaattaaaaagaacagatgcatatatgtttcactaatattctcataactccaaagatgtgtatagttccgttccatataaataatatggttttggagcgtggttctttggcaagtaacaatatatgctggagacgcaatatatgtgaagatatattatttaattgacaaaacaaaacaatgaatgagatgcacctacacaaggttggcccaatccggtagaaatggaaacaaaaccaatagaaacaaataaaaacaagataataaaaaagagaaaataaaatatgaacaagaagataaggacatgcaatgaaatattatcgaggaagattatgatttacttacgtaccaacatctctatgaaaattagaaataacataaattttacccaaccattctgggtcatcttttacaatattatcaaccaaataaattgatcaatcgaaccgtagatttgatcaaacaatcaataagtgtagttattctatcctaacccccatccaacacattgtcctattccattcaacaacatccctccaacaaaacatagaatataatacatcaaatgaaatacaccttagtcataacaaatgagataaacatagaatataatccatcaaatgaaatacaccttagtcataacaaatgagatgtgtttttttacacatatcatagtatacgtgtatactcaattacattgtccattaaattttattcaatcagaacccaaccaatattgaggataaatagaattggacataatatgctcacaatttgtaggttatgcggacaatgaagataatatttgtttgagtatatcatcctccgatgaaattacaattatgagacataaaaagttacaacttatagtactatttaatatttaaaacctaaagcccactacttaaaacactaaaaatgatataattgggtcggtttaaataataaaaaaatcacaccaatcatttaaatactatatataattttcctccctgtacagagagatttcttcttaatgaaaaatgtagatatattatttctcccccatacagagcgattgcttcttaatgaaaatatggagtgatcgaatgtttttttataaaactgtcatatgaaccatatcagaaaattctatcataactatcccactcgcaggtttgttaaaccataacaaaattgacatgaatatctgttcaatctatcttcacatattttcttcaaaatctggtgggtaagaaacccctcttgctttcctccaatattccatcatgaattaatgtttctttttcagtggataaatatgtattctcatcaatactatctaatacgagccaaagctaataacctagccaaagcatgtattcatcactgatatttatatatggcaatgtattcatcactcgctggaagaaaatccaatagatcatgcgtgcagtgtttgcatgcaactgtatgttcttcatgtcacttaattacttgctgtacatgacacactattcatgtttctttactgttaatctcttccatgtagtttaagaaggttttgcatgcaactagtcgcacgttcgcgcgactataaccttcctatctattagctgctattacaattaacaataaattttccaccattcagctaaatcaataattaatgtatagactcagggtttatattcatcttattcgtgttgtttcctgctttacttgatttaatattcgaaaaaagtatttggtcggaagtgcatgttcaatacaaatactatgttgttttgatatgtaataaatacatattgtaatgaaaataaacaatttactataattacgctaaacttgtgatattattgtaagaatcaaaattaaatttcactactacctcggattccaaatatcctgggtctacatttaagtaaaattgcacatcataattgtaactatgttataagatttgtttgagatgttaactttttttttctatatctttgttttgattgttgctgactgatttaaagtgttatatgtagaataatttttccctcttatgaaattatttaattggttatctagtctaaggaccgtttgggttgattggccaggctaagccagccctaggcctatttgggaggccaacatgagataaccaataagaggtaatgagtggctcaaactcttccttctctctatattttactacttctagaagattcctcatttcaatggctaggattcttccttgctattttgtcattttgtgaatccaactgctattttttgacaaatcatgtggctaattctggttgctttttgagttttacttttcaattaggtagatgtctatgcattgcaatgcaatggaatttagagtagggataagtctatttaacacccttcaactttttgctttgttaaaaacacaccctcgaactataaaattggtttctaacacactcaaactatcaaaaccagacatttacatcctttagaggttttaggatggttttggtatagctggacatcactttggatgccacattttaaaaagatccacatcagcaaagggaagtgtcccattagtcagttccattccacccctcttcttcttccttcccctctaactcgctctcccctctcttcgtggagcagttaaagttgacagcgagctccatccgtggagagacccccaccctctcggcttggagctccacgctatttcgccgccgttggcagtaacactgctcaacaagctcgagttggaggtgaagatggcgcgggcgacgacaaactcttggtggtggaggccctgcggcatcgactcctccgtcgagttcatcttgggatcaaggccgtgctgccggcacccgtctctttaacctcggcaaggagggggagggggtgggggtgctgggtctagggtggtagtggcgcttggataggaagccatctacgagctccctgagcttgacgaggagagtgccgacggcggtagtggtggagcttgggtaggaggggacggcaaaggcttcatggaggagagaattgaagaaccacaccttggtctcgtactctcgtcgacatcggggaggagagatacctccaaatttcaactagccgtagccagatcaagatacagttgggtcgatccgcatccatcaaccctcaccagagcttgccaataaccccgtcttctatgtgcttggcgaaccctcttcttcgagctt

SEQ ID NO: 43419 - DNA, 825 bp, Oryza sativa
atcaaattaggcaaagggctatttcggctatccagcgatacttgggtcagtgatttccatgtaatagtttgtagaaaactgttgtaatcggctaaaacaccctaattactttgctgccatccttgtgccggcttgttcaaaaatttcaattctctcatttttctttgcaattctctatgtatgtgcccccctaattttacaatgttgaaaacattgacaaaattatagaaacgactaagggcgatataacaatatcggccatttgtagatcggcaaaccacaaccgattacaatagtgaaaagcaactaagggcgatataacaatatcggccatctccaggcgatgcaaacacatcggctatcatgtatcggcaacactagtcgatcatgcattaacccaaacactgggataatatttcttcaagtatttgctatttagagctcggccataaacttctccatcgagtccttgcaacatgtatgctcccttagataccaccttataaatttggaacggtccttcccaatttggcgaccacttgccaaatttgctatcccgagtcccaatcggcagaatcaacttccatacaagttcaccctccgaaaagtccttgggtactactctcttattataatgccggacaacacgctccttatccctagtaacctttgcaagagctcatagccgtgattgaaccagatcttccctttcatcggccataaggttataatactcatcggctgttaaagtattttgcaactctgttctcctcgagccgattcgaacttcccatggcagaacagcctcatgaccataaacaagtt

SEQ ID NO: 43420 - DNA, 6652 bp, Oryza sativa
  unsure (1)..(6652): unsure at all n locations
cctcttatatgcaggaatggtaaagaatcagaagctatctgcaaatatacttacaccaacaactaaagctgcagatcatgatgttcctgtcactcctgaagaggtctttactctccttcacttttatgtcaacataatcttaacagtctaactccataatgattcccctcaaaatagacactagcttatatagggaaggggataaacagatgctcttggtagtctaacattggaattacattggtgtattggagaaaggtggaaaattaacgatggcactagttgaagcctgtcattctggagtcacaaaagttaccgtactgtctttagtcagttattgaagtttctcctttgcttataagtctaattatcacagttggcagtaatctagaagtccttgaatgattcatggatctcattttcctttttatgagctattttagttgcactttgtgcctccttggtgtttattcttcagcatgtaaatgctaccgtatttattcatcgcctccaaagaggtcatgacattgcattctgcagattatcaattcaggactaatgtcaaaggaagattttgatgaagcaagaagcaaagccttaagcttatttgcatatgggcaggtgattaattctcatatcttctggttcttgtaaggtgtcagttgcatgcctaataatcttctatagcaatgtcactggcaatgttaacattggacctggaacatctcaaatttagccttgatatgcctttttatttaaatctctgcaggaagtggccttagagaatggactgattctagttgacacaaagtatgagtttggaaaaacagctgatgggacaatcatgttgattgatgaggttacatcttcttacatgattttatccttgtgatatgttctgccttcaaattttatgcctgtcggtctcaggaaacagaaagagcatggctgatccaaccttagataactatgcctgactagcaacttgtgctagctgtgctcactgtttctctctataaacgtaacatgctcgtcatgacatcactttagtgtgttattgtgttggaactacccttacataagtacatgttttgttttcatatttggtaagtgatttttgcacaaaaaccaagccaagggatttttgtgctggggcttgttctaagggtttgagttaccatttcgccaaccggttcccattcccagaaatatagtttctaggatttttttatttttttaaaaaaatgttgcatgtcttaatctctttgataatttctaatatatttaatgatgatttctaacagaattccaaatttcctctttttgacaagcaggtacacactcctgactccagcagatattggattgctgattcttacgaagagagattcagttctggtcttgagcctgaaaatgttgacaaggtagactgctcctgaaactatacatgtggcagcgttatgccttaaacttattatgcttttaatttacaatggaattgctgaagatgtgattttattttcaccaggagttcttaagactctggttcaagaacaattgcaatccatacgaagatgcggtataccatttttccttaaaccacttaagcattttccatagtaagcaaatgttgataattagtgaaatatgagatgtccatgaataggtccacgtataaattccatgtccattgactgcatgtttgtttgtcttttgaaggctctttgtttttgtgaaaactcatttcatgtttatctgttactttaaaatactcaggttctgcctgaagctccagaagaactagtttgtgaactagcttggcggtatgtctatttctctgagtttgttctagtacttctcatttcagagcatgttcaaccaacaactttatgtgcttctctatgtacatgaatctcgtacaaacatgatatcatattggttgaattatagtttgcttaaatatccaccacaggtacattttcctgtttgagacaattacaaacacaaagttcgagatccccaaaactcaggtatgtgacgacagtttggtgaatttgctgtaactgacaaccatatacttaaaacatttttgttaaatgcaggagccgattcacgaaagaatatcaaggaatgttgcacaagccttgcagaacctttgattgtggataaggaagaggatttccagaacaaaaacttgcttgctgatgagaataagaggtgcacttctggacttctggtaccggcattactaataataatatcagcgtacgttcatgccgtctatcattcaaagtatacgtgtgctccgagatgtaatatggttggaaacaactatagccagaatcgcctggcaatactctctgcccttaatagtttccctgttgtgagggtcagtgagtgatagagcgccatacacggtatgcatgattgcgtgctaatatttttttcaccctgtgatgtaacattttctggggttcacatcgtttatcatgatgacactaccattatactccctccgttctaaaatataatcatttttagctatgaatctagcatgtccagattcatagctaaaaatacttacattttgggacggagggagtagatattattaacgtgtgggataataggagggatggtgagacctgcatactagtgaccataatgataatgatattatattatactccctccgttctaaaatataagcatttttagctatgaatctagcatgtccagattcatagctaaaaatacttacattttgggacggagggagtagatattaacgtgtgggataataggagggatggtgagacccgcatactagtgaccataatgataatgatattatggtaatgataatgacattatggtagagtattctcaccccattttctgtgtaacaaacaaataatatcgaagaggctgagttcaagtttgctccgcctctagtgaaagtgtgatcctatacttcagaacacttcagtttagaaacaaacaatttctaatgatgccaagtcgtttgttattactagcacnnnnnnnnnnnnnnnnnnnnnngtcaaactcccacaaaatccgtacagatggaccattcattttagaaagtctctcttgtcagtgtcactgatcgatatatcgatagaggaaagggaagaagaatcagccgcttaaaatgtagagtactcccaagcaacgttgacttgacttcccaactcccaactcccaacttcccaagcctttttaatcccaaagaggggatcagcagctgcaagtgcatcagcagcgagttccagccatggcagcagacaagggagtgaaggtgttcggcatgtgggcgagccccatggcgatccgtgtggagtgggcgctccggctcaagggcgtcgactacgagtacgtcgacgaggacctcgccaacaagagcgaggcgctgctccggcacaacccggtgaccaagaaggtgcccgtgctggtccacgacggcaagcctctcgccgagtccaccgtcatcgtcgagtacatcgacgaggcctggaagcacggctaccccatcatgccctccgaccccttcgaccgtgctcaggcgaggttctgggccaggttcgctgaagagaaggtataatccaactttctctactgatgactcaaatccaaatccaatcctttttttttctgacctcttagttagattgattggctttgcattggaaaagtgatttcatcactcggggatatcccctcccctcgttttttacatgacatctaaatagtcataagaaaatttggtaacatagattaatataaaatatatcactccacaaacatgcaattttaaatttaatttctacaagttgtaacaaaaataacaaatatagctgcgaatgtacgataactattttcagtttaatttatttttttttgttgcaagttgtataagttgaatttattgaattttgtatagcatgtctgtggagtgatatatttcatagtattaatctatgttgttaatttttttaataactatatagatgatatacaaacaagaggatattcccttgagaaatgaaaatccacgttcctttacgttgcattggatgttgttatagtgcaacgctgctctgtacccgatcttcatgacgaccggagaggagcagagaaagctggtgcacgaggcccagcagtgcctgaagacgctggagacggccctggaggggaagaagttcttcggcggcgacgccttcggctaccttgacatcgtcaccgggtggttcgcctactggctgccggtcatcgaggaggcctgcggcgtcgaagtcgtcaccgacgaggcgctgcccctgatgaaggcctggttcgaccgggtcctcgccgtcgacgccgtgaaggcggtcctgccgccgagggacaagctcgtcgcgctcaacaaggctcgccgtgagcagatcctctcggcgtagagagcacggtcacttcagctccccagctagtacgtttcatctccatggtccatggttaaacaataagttcgtcacaagcacattgtgcagaagtagtagatgctcgaagcatgatccgtcttagagagacaaacttaatgctctatgatatgttatccagtgtacaatattgcctacttaattatttcctcaagaggaaaaatacagtacagttttgtacttttgtagtgatctgatcattctaattaagggtccaaatggtccggttttgggggctcgtcggagtggcggcggcgatgcgccgccttggccgcccggacctcgccgtagaagtaggagacgaagccccatagcgagagagcgagcgcgacgccctttgtgccgttgaatggctcgtggaagaacatgacggcgagcacctcggtgaccgggatgagcacggtcatgatgacgccggcgagcagcgccgagccgtagaagatggcgccgatcgtgccgaggaagaagcactggtacatggcggccgatccggccaggagcaggtagtagcccgcttggcccagaccgaattcatgggcttctcctgggattgcctgcgtttggttgctttccagcttaatgagaaatactactgcatatatgatctaatgtctccaaaagagcttgatcaagaatttactaaacataagctaggcctctagttccctttagtatatttattaatttcaaccggttgcacaacaaaatttaattgaagtgttagaaatgaagaagtcactaattaggcttttttttctagaattaaaaacaccttcatgatagcatgtatttttttttctatgagatagctggaaatatggatattcaattaattttcctcttgtttctgttgtgaagaatattcttgggctatatagactttgattacccatttgttaggtctaacggtagacagactcgtcaacacaactagctttccttgttcgagaaagagttacatcttattgcaaacatgaacaacttgctaaatgattggcttgcaccgatctaccactacctatcctatatagcccacaagtacgacttgctgctgctgggcttcagtgtaagtacaaaggccaaatttgatccaaaaagaaagaaaaagagggtccaaaatgaaaagaataaacaaggggatcaaagtaaaactttgataagaaaaaggaggtacaaaatacaattcactctctttttttattgtctattaagatttgattatgtcattgtgtgccaatctttcagaagcgtgctctgatatacttaaatttcttttcaaaaaagcttggaacgtgctctgatctattggcatagttacattcatttctgagtggggttaaatagtttataatatctcagtagcctgtagattgcctttcactagcagtccactgatcagatcacttagcatgacaaaaggtaactccactcctgtgcattaccatgtcagcctaataagtactctatacagttcagaactctgagaaaagggtagacgtcattgctaagaactctatcagaacacagctaatatctattccatcccataatataaggcatgatcaaacttggcacaatgttcaaaactaatttttgacttataatttctcatatataacaaaattttaaccatcttaaagtaaatttaaatgtcaatccaatgatattaattttagttaaaaaattaatttatattataataattgttggtcaaatgtttttaagttgaattttgaaatgtgtgcatgtcttatattatggaatagagggagtatatgaaaaatgtgttgagtttttggatggtgcaatacggctaagatcagtgtgctgtgaagaactgtgagagtagaggttgaaatcttacgtggaaatcgttgttgacgagcatgccgacggcgctgaaggccgtggcgacgaagccgatgacgagctgcatctccatgacgagcgtgtacgtgacggcgccgcgcgcggcggcgtggtgcgcctggctgagctccatgacggggagcacgagcccgtacagcgccgcggcggcgagcgtcatggcgaacccggcgcagtactgcgcgcgcgacacccccgccggccggtccccgccggcgttcatccccagcatcgccgcgccgacgctgagcagcacgacggcg

SEQ ID NO: 43421 - DNA, 4747 bp, Oryza sativa
  unsure (1)..(4747): unsure at all n locations
accgcaacagcccatgtcgagaacactaacgcgcgcccaggtgaccaggtccagttgcacctagctaggctcgtagcgcgaatgtgccttttctcattgtcaaggcccaattaatggcttggcacaaatcgttctaccatctcggtgcccgagagattgcttggcacaagagattcgattgagacccatgcatttgagagctatcccaatggtgatgtctaaaagtagagctcctcgaagagaaggatactaaagaaaaccgataggttgtttagcaactttcacgtagaaagttttcacacaaaatatactaatataaagagtactgtttagctgtttgaaaaacgtgttaaggaaaaccgagataaaatatatatttcatgttttcattagcacattcttcaaactgctaaacgatgtattttgtatgaaagatttctatatagaagtttctttataatatcaaataaatcaaaatttcaagtttataatgattaaaacttacttaatcatgcgctaatgtctttcttattttgcgcgcccacacttaatcttcatgtttggaagtgtatgtccaatcgtttgttttgtaatcaagtcttaaatactaattaaatagttataataaatctgaaaaaaacgacaacattggtacattagtcatctatcaccatgcaaaatatcaacttcaagtttgatcacataatgagaaaaataacaaattacaccctttcttttatccccacaaaaaaaacaccctgaatagtacaagtaatcagatttgttatttttcttcaacttgtttaggtcgaatttaaatttgcatgttgtgatagtgatatctctcataattatctatgttatcgaatttctataatttttcatacccatatacattacatgcaaagaatgagcatgtacatgcacacaatggtcgttaatagcggtctcttaccggtactaattaggaataattgctgacatggaagaaaaaaaaaagagaagagacaaaacatcgttgctatgggtaacaaatggcttaacaatgactcttagcctctgtaatatggaaacatggttgtatgagggttaaaagaaggaaataatagtaatataaggaatattttttgagttaatggttagagtctttatcgtctcaactattaaaaagacacgatatttaaataatcttgtattgtctaagagacgatagttgtctctaccattgaatatgcccttaagtgacaacatgactttcccttaacctaagtgccatatcatatattttacttattatgtgataatggaattaattatatgtaaatccaacaatgagtatcgggatttagtcagtcgtcatgaaatacacggagaatgcttgtaatcggccatccgaataaaacaggaaaatcggacaccacgccgatgcttcccacgttggagtatctgcaaccaactaactgctaatttcaaccatgcatatgcacgtgtcaattttcaaaatattttttctcctagactacttatccgatctaaaatccgattgcaccgttatattcattggaattaaatctttataacaagatgtcacatgattatattccgattaaagaaaaacatatgtttcaaaccattaatactttatgtttcatacgttatagcaacatgtttcagcatatgtttttattgtgtttcataaaattcacataaatacttgccactaccctcccatctctctctacctcatacatgcatacatgtatgcatttttgcgagctttaaaatgatttttctcataaattaattatccaatctatgatctgatcacaccattgtattcgttgtaattaaatctttacaagatatcacatgaatatattttgataaaaaaatatgcttcaattcgttaaccctagttgtttcatatgtggtagcaacatgtttcaacgtgtatcttcatcatcatgtttcataaaatttttaaatgtttcaattgttgattttttttgtttcgccatatataatttgatgtttcactcaatggtcaactaggaacatttgaccaaccaattttttttgacatgagacctcagatgggaagattcctcatgattgtggagtgaaaaatgaagtgtagcaatatgcacatgcacatacgctcagaacttggctgggcgtccgatatttgatgggatatttggtgggatatcggacgtccgagccgtagcgctctccgaaatacacccctaaaaactaaaaaaagcaaaggctcaataaagtactccctccgggctgataatacttgtcgttttagataagggtgaggtcaaactttaaaatatttgattatgaatcattttcaaaatatttgtctttcaaatatggtgaccacatgtatagattagtcttaaaaagtactttaataagatcatatatttgttaatacttttttacatattatgatagaaaataatggtcaaagttgttttttgaagaccgtgcccttgtctaaaacgacaagtattatcaacccggagggagtaggagtatacagtccctccccacaagtctacttggttgtcaatatctcgatcctataattcgattttactatcctaattaaggtttctaactgtatcatcatactccctccgtttctaaatatttgacacaattgaatttttagtacatatttgaccgttcgtcttattcaaaaacttttatgaaatatataaaactatatatatatacatatatgtatatttaataatgaatcaaatgataggaattacttaagtttttttaataagacggacggttaaacatattttaaaaagtcaacggcgtcaaatatttagaaatggagggcgtatatatgtagaatttacgattttttatacatataattctatgattgtgattagtatggagtagaacatttaatttcgatttaggatcgcgatttaacaagaagttggtccattccccgtgatatctgagatgcatctctacagctcataggtacggtgtatatagagtttggttttggtggcgtcatgttcgcacacaccgagaacgagcaggtccagccgtccagggaagaaaacggcaagaagaggacaagagaaaccggtgtgacataacgtgcgtcaatctgcaagtcaagcgttatccttgaggaaactgaactgatcgccggatacgcccaggcccagcaactgcaggtgctgtagtgtcagggataagaagtggtgctctgcttctgcactgatcatgaaactcacctctgcttcttttcctattgaaagtgtatgcgtcaattatcttgttcatggtagttgattttatcggttaataccgatacaattaggaagaaaataattttattggttttcctgccctaacaaaaaaaaacaagtaaaacatgagagataaaaaccgtcgtcgtggtcagtggcaactacctatattctaatcgggattagccccccgagtctcaccagtaaaaataaaaggagagtagcagttgagaagaagtaaagactaattcctacgctaaatcctaaaatctaatagagcccgattgatctatcatactgtgagggattcgtagtgctgtcttttattcaattcttgtgcaggagaaacatcaagaaagaagcaggtgttcctgcagcggtgttgcatcctttacccgatgtccagtacaccgcgtaatctaagaaaatgagtaagaactggtaagaacagaaaaggaggaacagatataacacttatggcttcaattcatccagtcagtaatcatcccaatttcgtatttagaattggtaatcatgtgttaagctaagcaattagatcccgagaataaataattccaacaggtcacaatataggcttgcatgtagtccagatgtccacattcactagagtacacagtacacaaaatggtagattggtcatggacatgcatgaccagattaataagaacaaaaagtgagtacaagaacaaacattgcaccgtactcagtcattacagatacagtgaagtagcttgttttcgccgacccacaaaaacagcctcgatcacatacagtacacaaatagtgcaatgtgcacacagtctgctattttgctccacgagcagttgaactgctgcagatgcagctcactttatggcctataaaaactaataaatccgtggccactggcacaacaaaagcaaagtaagcaatatatacacacggattcatgaggcttcttcagcttccaaagccgctttcttcttggccttggcgtcggcgtactcgccgtaggagtaggaggcgaggccccagagcgagagcacgagcgccacgcccttctcgctgctgaacttctcgtggaggaagatgacgcccagcacctccgtgatcgggatgaacacggcgatgatgatcccggcgagcagcgtgtgcacgcagaagatgacgccgacggcgcccacgaagaagaactcccacaggacggcgttgaacaccagcaccacgtagtaccgcgcttcacccagctcgtactgcttcgcctccctcgggatcgcctgcgtacgtacgtgttcagtttcaggggtgatcgatcgttagtaggcaacacaactttgaaagggccaaatcaatatggtagtacgtatacttgtcacgatctgaatatctgatggatgttcacgcacataannnnnnnnnnnnnnnnnnnnnnnnnnnnnnnnnnnnnn

SEQ ID NO: 43422 - DNA, 1234 bp, Oryza sativa
agacaacgtggtagccaacccgatgagccaaaaaaaattcgaaaaaaaggagaaaatcggtagcactagggcttttattaattgatgatgtagctaagaaagtacatcaccgatcaaatggcagcatatgcgggcagcacacagtcctatggtgacctatgtagctacggtgggggggtcgtcaatagcatatcaggagatagtaccgtcgcagaatgatgaaccacttcaaataactcagccgacacaagactacgggcacattgacttcagcggcgttggagagacacacaggtctgtccacgatcaacgttcaactgaaagattattgttgtcaggacgcagacctccagcaggggctagaagaaatgcaaggtaaagaacactagcacatcaaggaatttcgatgaggagaatgatcagtaccatgattatatatttcttatgtctgatgtatggcttacttcaaacaaatctgtgtgttaaactatctaacgtgtgtgatacatttaaaataaaaaacttttaaatattaaactgtcttttctacatctaaatggacacttataaatatttacctgcagcacgataacaaagttttccacaacctttatacattacttcagtgggtttgaaagtttcatgaattcacgaccttgacttatggtaagaccccaatactcaccataatcaccgtgtactcagttcataccacaagatagagcctgtgaattcatgaaactttctaacctattgaagtttacaccatgagtacaccaacaataaactcaagagtaagagtgatccactctactgaagtctgtcttctttcccttcgtaaggttccttttataaacagtccgtgagtaggctatccaaactttcaacagtataggacaacaaacttttgacgctacttcactgctacagcatgtgcataatgctaagacaaggcgagagaaactactcttttctatggacatacgtgacggcgacattgttgtgtgcgacaaaataattgctacagcatgtgaataaagctaagacggacgagagaaattactattttctctgttatgcgtgaccatgacattgttgtgtgcgacaaagtttcagcgtggactatttggatcaaatcggtcgcatgccacggtattgcgagtttcaaacgctaccgcacgacatgcatgcggggagagggcgatactgcacaacgggcatgtaggagcgcaga

SEQ ID NO: 43423 - DNA, 2070 bp, Oryza sativa
acccattaaacattcgaagcccctttcgagattcatcactaaccgtgtaggagaactactcagtcaccacgagatccaagtatctgcttcttgatggagccaattctggtgatcaattcatcccgattttcctgcacaaaaaagtagtacaaatatgagtagaagtccatttaataggggagagtgttcagaacagatataaaactaatcaccttaaaaatcaaatatcgcgaggtgaaccaaactgtgaatccaaggccgacaacttccatcacctggggaacctgctcatgacagcgataatcacatcgttatgagttgtgacatagtacttccatatataatactaacaaagattatgcaatgcttctatagcttgttcgagaaaagtcctaaaattgccaaaggcaagcatgtaactgcgagctgctccagtcatagaaagtaagtgtgagagaactggcactaccgaaataaccaacaggtggcaaaatttggtacagccagcaactgtattgccttcagaaactattttttcttttgacttcctaatttcaaaaataaagcactgatctgttttacatcttatcatacaatttcaaacaaatgaaattgtgatgagtgagtgagtgagtgagtgagtgagagagagaatcagagttgcataccaaagggactgaatcaagtgcagaaacaacaattgatgaaatccagatcgtaacaagcgcagatgtcccataaacaagagcagtatatgaattttcagagtccaactgcataagagtggtttgtagaggtgagccacagtaaagcgcatcattgatagatgaaacattggatgaaatactctcaggaaattgcatattatgcatagcatttggaagatacaagataaacaaaaacctggtatagaccttatgagcctgagctctcttgaaagcatgaagtaacaaactaacaatatacttatgccatcaaaacatatgaacattttggacaaattaaacaggagtcaagaacaaaaggatttttttttcaaaaataacagtagggtgacaattctgaaagtaatcttacaatgataaatgtttactttcatctaatacataggctgatagcattctgaatgagaagaacaaggccgtccttgtgtaagatccaaacagtaagtaaatggcagatgttttctataaaacataaaagatagatactgagaccaagtaatcggatatctagagacaaatttactttttgctttgataaagagcctacagagtacagaccatttctagtatcccagaaagtgttactccctccagtcaagtatacttgacatttaggacaacttagttgtactattatcaagtatattctgatgccataaacgtcatgtaaatatgacgagaggtagtatttatttcctgaatatatgtacttcaacaaatatatggcttctatgatagtttacaaagcaaacaagaacatctacaaattagcactcatcggacaactaaaacaatctactcgcaagactgttattctacatgctgaactagagcagtagcaacatttactcctgtcctattaatcagtgtaaaaaagagaaaaaaaactcatgttatgttcaaaccatgatcaagattgattgaaaaagaaatgagatcgaagaaatggtgatcaagacgaaatcttcaccacccgcacctaaatcattcgtttcagatcagaaatgcaacaagcaggcaggcacgcgtgctcacctcgacgccaatctggttgagaacattccaggaagtcgattccccctgcacctggacctctccatccccatcacccacctcccggccaaacccctcccacccctcccgcttcgcaggcgccggctccgcgggcttctccgagatcagcactctcagatcgtcggagtccttcgcccgcacggccagcgaagacgccccggcgcggcggcggccaaaaccttggggggtgaacaaaactagggttttagctctcccatcgcccatgcagcggaagattcgaggtgaatgcaccgtgtcccggcgggcgtgc

SEQ ID NO: 43424 - DNA, 10112 bp, Oryza sativa
acagtcgccgccttcactggctcacacttgcctagcctgcctgtccgtatgcggcggcagagcgctggggtttttgggctggcccggcgggaaaccggcggaggaggaggcggcgcgagtcgacgagcacggccgcgtggcggagagcagcttttgggctttctttttttccccctttcctctcaactgcggatggatggagcaaggtgtgtggaaactggaaagaatagtgggctttttttctctcttgtgcttcgtccgggtaggctgaaccgagttgcttcccctttttcctcgtgttggaatgtacctacttcctccgtctccagttttaacccttagagtataaatgttataaatgtattgaaagcagataaaaagagaaacaattacattcggatctcacaaagtgaggctattataggtttttgggttttgtatgggtatgtgtagaatgggtgaaaaataaacttattttaatatggagagagcaggaatttctaagtttatgtacatagtgaatctctaagaaaaccttgtgttcaaaaaagggcatacgtgtttttcttttcattgcaaagtagtctgttccattatgatcatagcctaaccaaatgtctaaatttcagcaatgatcaatgcataacattttaggatatggtttcttttgggtatcccatacccaagagaaacccgtcgacagcgaggcgtctgtggtgacttcatcaatcaccagtatttattggcccagtcttcgaagatgctcatagagatagggtttgcgtgcgtgcgtgcgttcttagggatggatgtgcgtgcgttgtgagtgtctgcgttgtactgtgtaattttaaaaaaaatgttatacactgatcattcgtactcatttataccgtaggggttaagtacaccatccgtaatgcttatgtctaactttctcttctctttcataggaaaacaacatcaatagatggcatgctcaagagaggtttcactagcacaactaaatatttaaagatttgatggactcagctagatatagagaaaccatcggatgagtaatgacaagaagaaagaaaaggtccgaattataccgctgaactgttggatgagtacgaattacccctataccaaaaaaaaagctatctttcacccctcttacttaatccggagtggttttagttctatgtaacagtccaatcagtatttaaaaaaaagatccgtggaacccacttgtcagattttctctcttacccctctctctctctaacaagtggatccactgatttttctaaaaaaaaatgggagtagctatatttatggcgtcatatttttcatcaaaaaatagtcggcatgtatttacattgtaagtccctaaattgcgtatgtaattttagtgtatttacaatgtaaattccaaaattacatatgtaagtcctaaaattacatatgtaattctcaaaattacatatgtaagttgatgtaagtcacaaaactatagatttgtgatgacacagatatttagtttttaagattaattagtaatcctgattagcaaataacgttaaaacaaaagaagagaacagaattggagggatatgcgtacacatgcggtgatttctgcatctacatctgatggttgaaacaaccgactgaaatccatcgtaatttgtggcgacatatttttagcaataccgaaaaatattgaccggactactacgtaggatcaaaaccactctagattaaattagggggttcttcatccggtattaagagttgagggtgaaagatgtttggtttttaggtctaggggtgtaatttatactcgcctaatagtttaatggtgtaattcagatctttttaaaaatatcgttttatccaagagagccttattttcctctagaataggtgggaagtatgatatttcattcgtgccattcctttgatccaaacgatgctatagtagttgaatctacaggcatgccaatcttttgttttttccttgcttttcttccaatacaaagaaggcataagtcatatataatccgaagaaataatgtttgtattagaatttagagttctcctgctttgcgtaaatattcacacctctctgtaccaacggcctacctcgccctcaagtttcaacagatgcattttacctggtgtttcacaacttcatttgtgcgcccttttattgatcgattgcgcaagatcaaacacgggttatgttaaaccgaaagggtgccactccataaaagaaaaagaatgatggctaggctagccgcttagctgttcttgaggcttgcgagcatcctgattcctgcagctcgtgtcttgttgctgaaggactggctaaaactagcgttgttttcgcgtaacccaactccgagcccgaggcgcatgtatactcccaacatcttcttgggcctcccattgctaaggctctcgatctccggatatacattattaatcatgtccgaaaacaagaggagactgaaaagtgattagttaaactctccatgaattccagctaattgttcagcatttatatactgctcggaacagggcggtgagccggcgcggattgtggcggcgcagaggctgtgcctgccggccttctgcggcgttgccggcgggatggcctggtcgaccgaccggcaacgtctcgtcggcgcatgcaccggcctgatctctgcatgtagatcgagatgtgtgctgctgtgcatactgaatttttgcaattttgcatcttgcatatatacttcctaaactggcttgataagaaaaaaacagttggttacaagaaatttcatactgaagttcaatttgttgactaatatgtctgaatttcgtcgttttttgccagtttaataatggttttggcgaaaaccagatacggcatgtgactgtgagtggcttttgtccggtaatgagattgtgaacccgacttagatattaatcactgcaagtttcccaagatttaacaattaatggagacttatcagcaagtcttggtcaccatccactgatcgatcgagaggtaaaaaagaagtacagatcttgcagaaagagatgaaaaatgggtcgatcgatcgagagttggaaatgtcctgtacacttgtacaggttgatgacccttattgcacgtagataattccatgcgcgcgtgtaagtatgcgtacatattccccgtgtctaatgctgcaggactcatgcgtgccgacgtgtgtgtggttagtaaaccaccccgtggcaatatgcagcatatacaaatcagaaatttgatttactatatataatccagatctaagaggtgtagtcactgtgtactgcgtacactactattcagatgcagctattacaaaatgtaagcgacgttctaatcgttaaaaagtcgtgttctggaaattgcacttgaggctgaaagcaattgagcaatagagatttgcaaatagcggactccacctagcctattattgaggatttatttatttgtagggaaacatatggataattcagaggattccaatcttataggaaaaattgtaaggaaaatcattgaaacctttttttaaaagaaaaattctatgaaatggataattctataaagattttgaagaaaagttagcaagtgttacaatctcctaaaattttttttgtttgaatctattgctatctctaattcctgaggttttttccccaatggtctatttaaacaaccagtgttttatactcatctgttttacaattgtattatgtaaaaattttatatttttatatttctcctttttttaataatgggtttcaaatgagccttaatcgtactccctccctcgacctatttcattctttggtttttttccaaaagtctaagtcttatttgtagttatcatgtactaaactaaattgttgatcggaatctaagaagtcatcttagtacttattggttacatgtccattgattttatcacatggtgaataaattaattgctccttagtcttggtgcagtaagaaatactccctccttcccaaattgatcatcatataatgaaaattaaattttctcaaattgatcatcatataactacatggacaaagatttcatcagagtacaattaatgcagcacgaaaaaatgtgttcatgttaagggtgtactccctccgtcccataatataagagattttagaaggatgtgacatattctagtattatgaatctagacgaagagtctgtccatactcatagtactaagatatgtcacatctctgcaaaatcccttatattataagatggagggagtaattgtgcattgcgtttttaattgatgcatacattgtgggagaatatgtgcattataattgagtatgcatgacatcttgatcgatgcggtttaaattattcttggtcatggtgcacagatattatatgatcaatttgggatggaggtatgtcttagacttttggatagagggagtattaattgggaaacttaaagcaattgagcaatagtaatttgcaaatcagacattatcttctgggttactttcatcacatcctactacatttcgcacaatgcatagggagcaatactgtaatattgactttgatcgagttaggcgcccatgaaaatgctcgaactcaaagacaaaggtaaaaaagttccaatcacgtcatttctatgcttggacggtagcactagtgcactacagtagtagtacctcgctaaggcattccttaacctcaccttcatgtttgcagtaaagaaaccgagaacgtagcgacgattccatttgggcaaactatgcatttagcctcggttcatgtgaagcatgtactgcctgcattgcattggacttggagttggcagatcagtcaaataagaaaagccaatgacactgtcaaaaactccatgtctgaatctgtcacctgctttgtttttactagcttgtaaccttctcttctgactttttagatcttgcggtgcttgtgtacagtcatatacagagatgcaggtggcatacactgcatatatgcatgaccagaacatcttcaccagaaccgatgcagtacaacatgcatgcatgaagcatgcctggttgattaggatacttgggaagttgggatccgtggtagcagagagtataatatttcaagtcaaaacaattaggaagcaactgttagtgcttgtaaaaaaaatgaacagtaatttagacatggacgagggttcaaattaattttgctctgtgagctagaaagattgagcagttgcacaagattgatccttaagagcaaactgcagctaaccatcaaattttatcggtagaacatcgtgaatcccagctcttgcattataatctagaccatgtactgcttaatttgattgggtaactacgggctctgtttgcccaagtttttttttagataaattctatctgtgataaagggtggatcacatatatgatatccagataaaattgggatcatgtcatcgtaaaaaacggtttcatttaaataccatcatataaatgggtttgaaataccattataaaacatcgcctttatactaagatgcatttactctttcaacggataaaaattgtatgtggcctcggctgtatgcggtggccaaggtgggtcgccatggtcaacgggaaggcggtggaagtagcatgcgaaggctatggcaatgtcaccatgtgaagttagagaaggggctagggacagtggcatcgatgggatgctagcgaaggaggcatggcggctagagagaaggtaagcgttgatggtgtgaaggcccacacactgacataatggaattgacaaagcctcttgcagaggcccgtgaagatggcctagccgatcatacaatgtctcagcaacgatgctagaggataatttattgccgtctgtgtcatactccgttaccgtccttcctcctatccacggtccgccatagcgggagtgcggcaggttaccacacaatcagcaaaaccacaatcgacctatccttgtgctatcgccgccatcgtctcccctacctgtgctcctcttcacacgtgctcgtcttgctcctcatcctatccccatcctcgcctttacctagaaaatcttgaggctcaaggtagaaaagaagacagggatggcgcactaaatgcggactcaagcacataacctcgagacgctaacaggtaacaagtttaataacacaaattctgttgtttcaattccagataagactcttgctgcaaatttttctaaattaggggtttctctaggaaagaatgatttagaaataaaggagtccattaaccagattaaaatttcagaattggatagatttactactctttatagtagtgctgtagcgtctactagtaatgtagataaaaacaacgatgaattgttaaaagtgtcttctctccagcacttatgtagtgaatggctagaagaggttgagagtaatgacgatgagtctatggattctcaggccatacctcgaatgaggaagatttcgaccaaagtcaaacataaagtggtatgtcctcttttgactggtccaaaaaagaaagctaataagtttaagaaatgaaaggaatattttggaatagttgtggctttggtgatgcatctaaatttagatttatatctgaatgtgttaaggagcaaaatttggattttattgccattcttgagactagaaaaccatcattcaccccttcaaatcttaaaaacctttgtggtggaaaagattttctttggcatgagaaacctcctatcgggcgatcaggaggaatacttttagaatttaaatgtttttgatataggtgaaatttcagaaggggacttctatgtgaagtttcttctaagaaataaagaggatggtttcaaatgggttttaatggcagtatatggtgctgctcaacccgagttaaaagaacattttttacggaactagctcagacttgtggtaaggagtcataccctctattggtaggggggactttaatatcattagatcacccgaagaaaagaataataattcttttgaccctcgttggccttttctttttaatgcggtcatcaatagtctcaatttgagagagattgatctttcggggagacaattcacctgggccaataacctcgaaaatccaacttatgagaagttggatagagtgttaatgaacactaactgggagcaaaaatatcctttagttacgtgtcaagccttacctcgagccatttcagaccactctccaattatactgagatccagatcgcatgcacattttggcaatcagctgccatttcgttttgaattaggctggctagagcgggatggattctttgagatggtagccaaagagtggcaaagcataaacaagggaaggaatcctatggaacgttggaaacacaagatcgtccaccttaggcaacatttaagaggttgggcgcgaagtttaagtagcacatataaaaaacaaaaaataaagcttttagctttatttgacacactagacaaaaaagccgaacacataactctctccaacacagagttagcttcgttgaagcaggccaaaaatgatttggcaaaactgttaagggaggaagagttgtattggtaccagcgatctaagacaaatcatttactccaaggggatagtaatactaaatattatcacttgatagccaatggtaaacatcgtaagcagatgattttccagttggaacaagaggacactataataacgggtgatgggaatctcaaataatacatcaccaattattataaaggattatttggtcctccagatcataatcatgtatcatgatagagggatggactgatgatattcctcaagtgtccgacttggaaaatgacatccttactgctgaattttcagaaaaggaagtcaaagaggcaatttttcaaatggatcataactcctccccaggtccatatggctttcctgcagagttttatcaggtcttttgggagattgttaagaatgatctcatggctctatttagagaatttcataaagggacattacccctttataacctaaactttgggatcatcgtgctactgccaaaaaaggctgatgcaaaacaaattcaacaatataggcctatttgcctactgaatgtcagctttaaaatttttacaaaagttggcaccaataggattgcaacggttgctcacaaagtcattcgcccaacccaaacggcgtttttgccagatagaaatatcatggaaggggtggtgattttgcatgagactgtccatgagttacacacaaagaaaatggatggtatcatattcaaaattgactttgaaaaggcttatgacaaagttaaatggcagttccttcagcagacattacgaatgaaagggttttcacaatcgtggtgcaattggatttccaactgggttgaaggaggaactgtaagtgtcaaagtcaatgataatgtaggaaaaaatttccggacatgcaaaggcttgagacaaggggatccaatgtccctaattcttttaacatagtagatgacatgttagccattcttattgaaagagccaaagccgatggccaaattagaggggtaattccacacttagtggatgatggtttgtccattctccaatatgccgacgatacaataatatttcttgaacatgattttgaacaagcaaaaaatatcaaggccattctttgtgtgtttgaacatctctcggggctgaaataaactttcataaaagtgaaattttctgctttgggggagccaaggaaatggaggaccaatatagacaactgtttggttgtaattctggttcctttccattcaaatacttaggaatccccatacactatcgaaaactcagaaattctgattggaaatgtgtggaggataggtttcaaagaaaacttagcacatggaagggcaaaaacaactcctatggtgggagattggttcttcttaactcggttcttttgagtcttcccatgttcatgttattcttttttgaaatacctcgaggtgtacttcaaagactggattactaccgatcgagctttttctggagcagtgatagccagaaaaacaaatataggttaacaaaatgggattatatatgctagccaaaagatcaaggtggactgggtgtcctaaatcttgatatcatgaatagatgtttgttgagcaaatggctattcaagcttcttaatggtgatggcctatggcaaaaccttctgcgcaataagtacttaaagggtaaacccctctcccacatgtcacacaaactaggaacatcccaattttgggctggcctaatgtaagtaaaagatcaattttttcagtatggatcttttaaacctggtaatgggatggaaataagattttgggaagacacatggttgggcttgcaacctctcaaatatcaatatccttctctgtacaatgtggtccgaaaaagacattctactttggcagaggttatgagcacaacaccgttgaatgtttcattccgacgatcaattgtaggaccaaagttagttgagtggaatgatttgatctctcgactagctaacataaccctgtcaaatgaaaaggattgctttatttggtcgctacataaaaatggccatttttcggtcaaatccatgtataatgcgatcatcaattccaatgtaagaatccataagaggatcttatgggaggtaaaggtaccactaaaaatcaaagtatttatgtggtttcttcaaaaaaaagtaatcttgacgaaagataatctcataaagagaaattggaggggaaacaagcaatgttgttttttaatacacaagagaccatccaacatcttttctttgactatcatgttgcacgttttgcttggcgatgtgtcttctttgccttcaacatcccccctccccacaatgcaaaagatatttttggtgactggctaaggggagtgcctagacccacaaaaaaaatgattttgtttggagctagtgctttatgttggtcaatttggcgttgccgtaatgatatagtttttaaccataaaaaaatgcctaacatcatgcaggttatcttcatttttcccaattg

SEQ ID NO: 43425 - DNA, 1472 bp, Oryza sativa
  unsure (1)..(1472): unsure at all n locations
nnnnnnnnnnnnnnnnnnnnnnnnnnnnnnnnnnnnnnnnnnnnnnnnnnnnnnnnnnnnnnnnnntggcgatgtgtcttctttgccttaaacatcccccctccccacaatgcaaaagatatttttggtgactggctaaggggagtgcctagacccacaaaaaaaatgattttgtttggagctagtgctttatgttggtcaatttggcgttgccgtaatgatatagtttttaaccataaaaaaatgcctaacatcatgcaggttatcttcatttgttccaattggctccactcttggtgtatgatgctttcacaggaacaacagtatactatgcgcaatggtgctacacgcttagaattagtagccaaggaaattttattccagtttggatggcgtagtacctacagaatttcgtgatagaatctacgtgattttgaaaaaaaatattattttagtagatcatatcatcggcagaagttaggggtttgtcccatctcgccttttttaacttttctgttcacgtctgaattttttgactgtgtgcctacgggcagaggccggagatgtaacccatttccattatctaaaaaagcacatatctatatagtcagagtataaaagacttccttatggagccacctctttataatactgactttgatcaaagtcaagctactttaagtttgactaagtttatagacaaatagagtaatatttatattaccaaattaattttattaaattaataattaaatatattttataataaatttatcttgtgccgaaaatattactatttttttcataaactttatcaaacttgaaacagtttgactttaaccaaagttaagacatcttataacctaaaacggagggagtagtaatttgatggagcttgtgaaatggtatttgagtgaagtctctttctacaatgacaaccccaaaattctcttgacctgtgtagggacttctgcagttgcaggcttgcagcttgccttacagaactggtaaagaaaaagaaacaaagtgaacaatgtgttggtataatgtttggacttgcccttcaatttctatacattacagtacatgacacatatgagcatcagagcatctctgctagatgccgtggtggttaccactcgatgccgtagtggtcaccactcacatgggcggagctaccatgattcccgggaatacccaacttttttatcgaaaaacaagtatatttctaatatatacatatgtacacatattagtgcacctaaatcctcaattattcgatccaaacatagccctatacacatgtacatatattagtgcacctaaatcctcaattcttcgatccaaacacagcccaaccggcctatatgacccatcagacatcagttgatccacttagccaccactcttccagacggccccctctcgctctcccttcatgacccatccctccctggctcgggtccctcgcg

SEQ ID NO: 43426 - DNA, 12166 bp, Oryza sativa
acgtcagtgtgtgaccctgtgtgtacgcccactagagctgaatcctgaatggatagtcgactctcgttcactcgcttggactgtcctgcagacaaagcgcgagaccacaacactggcgctgacatgcacagctggaggtatacgcgtatatatctgggctacttacgtacacccctggaccattacacagcacatagcctcatacgagcacgactttacatagcgatgcatgtaagccagtttgcttcatgtacaaaggttatcactagggatggcgacgggtcgggtcgggcacgtgtagagcaaaaccatgcccgaccccatgcccgttatcgcccgccaaaaccgtgcccgtacctatgcccgacgggcacgggtatatccggcgggtacccaatggacctcacatgaataataacttgaaagatatataatttaacaaagagaaataaaatcaataatttactaaattatcagttatcaacaataatttgaattacatcacaacttattattagttagtatcacaaatgaaccaagagaaagtggtataagaattaagagataagttgaaattagggcaggggttacccacagacaaaaaaaaatgaaacccggctgttgctcacgatgtccacgggtttcgggcgggcatgcccatgggtaaaaaatcacacccgcgcccgtgcccattgggtcgggtatctgcggatacccggacccatgggcaaaattgccatccctagttatcaccatttacgtacaattaaaaaaagaaagaaaattgctaaccttttgttggcacaaaaatccatccttaaatcttactcctacaaattttgaatcatcggatgtgcttcacgattcgtgctccaaatccttctcctccacctccggagactttctctttttctctggggccaacgacaacctaaactacaacgggtgacctacaaattaaagcccgggattgaggtgggagtgggaggagggggaagagagagagagaggagttcgacaactttataaggatagccatgggatgcggtggcccaataatgggtgacggaagaggtgaacaacgtgtgtggcgttgataatgcggcgacctagtaatgggtgacggaacaggtggatggtgtacgtggcggtgttaatgccactaaagccgcggagtcggcaacgggcgttggactagtgttcgcaacgaggccgaagcagagctacgagttagaggaggcgatcgggggtagctgatccggcagcggggagctgtcagagactagaaagaccgtgggataggatcacctcgccaccactggctgaaggaggaggagagacagagaagaacgaaggggcatgcagagacctggcgagcctcatcggtgttagagtttgtattaaatatgtatacaaattaagttatagttttgcacggttcgtgcctttccatggtgaggacgagcgactacgctgtggggcggtggcggcaaatgaggttgaggtgggggaattgcaaaggagttggtggcggcagtacttacgttagcgagtgggaacaaggaagggaaagggagagttagggatatgtgtgacgcagaaatctcaaagcagattcaacaatccaaagattacgtgatttgggatgcgcatgattttctgcggtaatttttttattaaacttgtctaaggttaactaatctttgccacactttaataaatctaaaagaatttatcacacatttctgagctattgactacgagaaagttgtgtaatcttaaacgccgtgcaagctttttgctgcaaagtgcaaaccaaacatatgcatgcccgtagtccgttacaactcctgctgctaggagtacgctgtcatccagggggagacggagaaaggacacgctattggagggcgagccgagcgagaagcccgagcagtaaagtagctcatcgaactctagctacgtactggcctactgtgtcgaatggggtaaaggttaaagctgtcgcgtgcatgcagctatggcgggaaatctcgatctctctttctcatttttatttttcaaagaatggtatttttttatccggcctctccatttaaccggatatatacggaatatatatggctattgaaatagggaacttagtcccataaataactcaatctagaatttactcatataaaaatttaaacttagaatttttagaaactactcacgtcactgtaaccgctaagctaagtatctctctctcggccgaagctagacgacgaggaggcaaaggcacgcgaggcaacgcagcgatgcaagcggatcggtggaggaggcggtggaaacgaaatccacgcagttcaagcgcgggccggggggaggaccgcctgactgctgatcgatcgatcgctggatcgattgatcacaagcgaacagtgtggatactgcagggccagcgattcttcaggggagcggccaatgggaatcaggtcctagtggatatagatctctgtaaaagtctctgttactattttatttacaaagtgccatttgcatggatgcgtgtatgcaagggcaacaacttgtcctgatggtttcgtttaaatattttatttcttttttctttgatggtatatataaaaaccgtccttatgaaaatcaatatatcgcaggggattcccttatatattgtttcatggtaaaagaaaagagatattttgttcggaacacattataaatgctgacgcttatatacatgtgtgtacgcttatcatttaaagatacatatgcacatcttaccccccgtaagagcaaggataatagtgagctataagcaagctaaatgcttatgtggaagagagagaaagaaaaatggggagtgttggctctcatgcaagagtgctccacacaaactccaagaaataagcattaaattcatagagagataaagagagaggatgaaaaaaataaagctaaccttatagctaacctattatacatgttagctttaacattggcttataacattggcttatagtaagtagtgggctgtactactaaacttgctctaaacacctctgccatcaacgaaaattgctgtacccctctgtagtttcatggtaaaaaaaatttgagatttcttttcagaacatataacaaacattggcactcgtatacatgcatgtgcacttaattataaaggtagacgcacatcttatctctatgagcacctccgagctgttgatagaaacgtcacctacccctcaaagaaacttagtgcttaatgcgaataaccatgcaaggctgtgttcggttgtggtggttgggaatattttccctctttaaggaaaacgagatagcttattagcacgtatttaattaagtattttctacttttttaaaatagattaatatatttttttacagtaactttactgtacaaaattaagttcttttagaaaaacattgtttcgtagtttggaaaatgtgctcacgagaatttagaaagtagaggttggaaaacttgagttgagaaccacaaacgaggcttaacgatctgtgtatgcacatgcttattggacactaagaacattaacaagagtacacgcataccaaatacaattttaatctgaacatcgcattgatgaaacaaaattaacaattcgatttccttttttctttttgagagagggtttgatacacattggtaggctagagatttgaagtcatacaccttactgcaagactaatatgcaattccacttaatacatacgatgcgtaccttatagcatctctaacagagtgatcaaatgactcttcgaactaaattaaaactaacataaaaaattacccttcaacaaactctctaactaactggccaagccttccggctagccaaacacgtccagtaacaggccaaatttgacaaaccacatctgttggtcaattgtgggccacacacgtctctctcccctcttccttcggtctcgcctcacgcaccggccgttgatgttgcctctgtccccggccacatccggcttggttgccttcgcccccggtgatccgatgctgcctcccgcagcctcctagcgtcggcgtcactcctctctgcctccctgcggcaaggcctatgtccatctagttgcaccgcctccgcctccaccctcggccaaccggcgctgccgtctccatccctaccatccagtgttgcctccccccccccccggcatatgtagtgccgttgcgagggggtggggaaagaaaagagaggagagggagagaataagagtttcgagacagtggcaatgaagagtacggaataaagaatttgttggagtgtgtagcagtatggagagaaatcttttggtgcgttggccaaatggatgaatggagagacaaaaatagtcatgctattggagatgctattaacattcccaaatataggcatagtttgaacgtgtggtacggctggagctgttcgtgactcagaaaaatggaacgtatcattaacacataattaattatgtattaaatattataaatgtgaaatagatttatttgattttttaaaaaaacatttctatatagaattttgttcacagaacgtactatttagcagtttaagaagtatgctaacggaaaacaagaaaaataccatttttagtttctgaaaagaactaagccttaatccgtaggcacctactggcttgcagagagcttgccttcaagctaagttcggttatctagcaatttgatttctaataactcaatttcacatcaataaataaatattgaacctatctatctacttattataaatatcttgaaaataaaacatcacctccgccctaaaggcaacaaattatcatattaatcgaagaaagaatatattagccatatgttcgatcgaccgtgatagatctatagaaattatgatttgagaatatattagccatatgttcgatcgactgtgatagatctatagaaattatgatttgtagattgttataacttcctaacgttgaatctgagctaaaaatatgtaaatattaattatgaacattagatctattagaactagttatgaaattgtacttctttaatgtataatttcataactattaattctagccttcgatttaactctgatatgaataatagtaactctggacttaattttattaatattacatatattcttttaaaaaatgtttgcacgtaaaaaattaagaaacataactgatctaaaataatggtgcacataaatatgtatttgagataaacgataacaaaaattgcacttgcgtggcagagatcagctagctccaaaattgttttacagcattctctgcttgcaattcagtcaaacaataaaaatcatcatctgacttttgaaaaagactacctttttttatctcaaatctaaacatacatataattatcatcactaaaaaaagtaaagaaagcgcccaaaaaaagagtagaaaagcaaaacacgcgtagatgctagctattccggcactccctttgctgtgactacctttgcaaagttcttaatgcttgtatgaaccaaaccgagaaatagtttttcttttttctttgggtgcggagacaaaccgaggaatagttggccaaacatattctcttttcatataatgcaatttcctgaggcatctttttagatggcgagaattttacttatttccacgaaatctgaattgattttgacgaaaactctacatttttttaacaaaaaatacgatgttttatattgatatagcaggaaaaaatacacgaatataatcataggaggctataaccagggaaaaaatagaaaaacacacagccacatgtaaaaactcctaaacacaaaatcaagggaaaagcattagaccgatcgctgctatgcgtgaccggccactgcttgatcaacgaaaacttagatctaggggtgaaaatttttaccgtgtcacatcggatatacggacatacatttgaagtattaaacgtagtctaataacaaaacaaattacagattccgcttgtaaactgcaagacgaatttattaagcctaattaattcatcattagcaaatgtttactgtagcactacattgtcaaatcatggagcaattaggcttaaaagattcgtctcacaatttacacgcaatctatgtaaattagttttttttctgtatttaatacttcatacatgtatccaaacattcgatatacatgctgaaaaaacttgccagagaatgtaagcaggccctaagttccaaatagtcttgaatcttttcaagcaggttagctgatgctgaggtcctgaggaggccggaagtgagctcagtttgatcatatggtcattaaagttttcattatcttaagaaaaaaaaggtggtgttgaggtggagaagaatatatgaaaaaggaaagggataaaagtgcatgcaactaatgctcagactccataaaaaaatacatttaaaagctctattaaaagtgagtagtattactcctccaccagcaaagtacagacaagaaaagaaaagaaaaagagagccaaagtgccatgaaaaaaagagcaatttttttttctagtcagcgtcaccctcctcccttcccgcttcagttggcagctgccctgtttctgcttcatgtcctgcccaaaatgccctcctcctaccctccacgcggctgtgtatacaaagagaacgcatccccccattgctcacttgccccctcctcctctttcacacctcacctcccaccaagataaagagcaagaacagcaagagcaagaagaggaggagggagaccacacaatctatcacaagcttagcaagatttatcagcaaggaaatggcagctctgacgagctacgagatggcggcctccatcttgctctgcgccgaggacagcagcagcgtcctcggcttcggcggcgaggaagaggaagaggaggaggacgtcgtggctgggaagagggccaggtgcgctggtccgccgccgccgccgtgcgtggacgtcgctggcgtggatttcgccgtgccgtcggaggaatgcgtcgcccgcctggtggagacggaggcggaccacatgccgagggaggactacgccgagaggctgcgcgccggcggcggcgacggcgacctggatcttcgcgtcaggatggatgccatcgattggatttggaaggtgggggtgttcttcatcgatgcgagccatatataaatctctctgatttggcattgttcgcgtcgatccagtgattgatccgtctgttcatctcgatctcgacaggttcactcctactacagcttcgctcctcttactgcctgcttggccgtcaactacttggaccgcttcctctcactctaccagcttccggtaagaaaccttatagctgtagtagtactagtactcgctccatactcgtaaagaaagtcgtttagggcagcggtacggtctccaaaacataactttaacttcttgtttctataaaaatatttattgaaaagtgatatatgtatacttttatgaaagtaattttcaaaacaaatctattcatataatttttatattttcaaactcaataacttgagagttttttatggtttatattcccaaggtttgacttaaatattgttctaaatgacttcctttatgagtacggagggattaattaactactgctcggttctcgaagaaaatggtaaatctgggacgtttcagctgttcaggatcagtaattctgtgcacttgtctgcaggatggcaaggattggatgacgcagctgctagcagtagcgtgcttgtcgcttgctgccaagatggaggaaaccgatgtgcctcaatcgctggacctgcaggtgagacttaaattgtgaattgaaacgcataggttttgcattgaacgatgcagatttgcgttgcaccctgcgtccgttttactgtgggatgatcacgttctgatcgtttccgggtcgcgcgtgttaccgtctgccaggtcggggaagaacggtacgtgttcgaggcgaagacgatccagaggatggagctgctggtcctgagcaccctcaaatggaggatgcaggccgtcactcccttctcctacgtcgactacttcctccgcgagctcaacggcggcgatccgccgtcgggacgctcggcgctgctgtcttcagagctcatcttgtgcatagctagaggtacggccagtgtgcatgcaagaaaattctggcacatctccatgcatcacagaagcttctgaaaaaaaatctaacatgaatgtatatgttcacgcaatgcaggaacagaatgcttgggattcaggccgtcggagatcgccgccgcggtcgccgccgccgtggtcggagaagaacacgccgctttctcccatgtaaataaggtgcgtgtgcagggcaagatgaccagtcatgaatgcaacgttccttccaaaattcaatgcgaaacgttacgcgcacagaagccataggctcaaactgtagccatactacccttaacgctacagaaatccgtgaaacgcatttacagccgcgagagagagaaagctgcacgtaaactggttattaatgctctctgtcgccgtggttttttctttgcaggagaggatgtcgcattgccaggaagtgattcaggccatggagttgatacatccaaaaccttcaagccccagcagagtcttcgtctcctcctccattccacggagccctactggcgtgttggatgcagcaggctgcctcagctacaggagtgacgattcagctgttgcctcacactacgcagcaagcagctggggatatgaacatgatagctccccggttagcagcaagaggaggaagattagcagatgatgcagccaatgatggatcaattaaaagtctgtttatatgtgttgcgaaactgatcgtgcatctctctttcttgggaaagtcaaatggttttgattgcaaatgactgtggagcctttcgatgccgtatgggagctagagcctgaaaggcgatgaaggaccaaaagcaaggcattttcgacatggcaacagagcaaagatactgatggataaagagagtctgaggtagacatgtgctccaatattttcatgtgctttagcgttagttgctaggaggcaggcagccacaaaagagtagaggatttgtgggaagagagccgggcgagatgaaaatgagatgaccaaaataaaggcagagacgaggtgacagtggcacaaggcaaagcgagctaggcactgacactccagatgtcctgcgtgtgtttcagttttgcgttgttctgtaatttcccctgcttaattcctttgtgaagaaaaatcataaaaaaggagagaaacaaacaattttggtgtcaaactccaataattcagcataactaaactacaagaagaagctgaagcaaaaaaaaaaaaagaagataaaagtaaaagacatagacaaaacccataagagctggaggagggtttcttctgatcatttctgaggtgttatgaacaatcaacatcacatattcacatatgatcagttcccttttgctttgtgctagtgcttacgactatcttgctgccaccctacattgtttgaccagttgtctgcatggaccatggaattcgcctctttgcccttgaaaggagaagggacattgtctggagaaacctcgggaacacaaacataaaaatagtgctcctactagtgccatacaggagagttgagaatatggctaaagaaattaggttggtcctttctctggagttaaagcttctctgctcccaaactataaaactgctagcaagattattccttcctgagttggatttctttttcaggtgacccattttgcgttgtttaggttgcttgttcgccatatgttccaagtaaggacacttaactactaataatgcaatgcttccagacaagcatggctgtaggcaacaataaagatactgttcagtgcccttttcaagcgggaaagatccgccactttgacataggagtattattgttcaattttgggagatcatagggtttggtttggtttgaggcctatattggccttaccaatatttgacaatttcaatagtgtttattgtctatttggtttggagccaaattttggcatgcctaagaaaataggccatttcaacagttaatttaggctattttggcttcaatccaaacacaattttacttttgccaaaattagccatgtcaaaagttgccaaaatttgacattgacaaaaattggtaaggccaatttaggccacaaaccaaaccaacccatagagtctgtttgtgtatatatcactcttgtgcttaacaaatatcaaatgcccacttgtcatttctattctaaattttagggcgcaatttaacttaacgcagtcttttagatttgctactaccacaaattttccatgcatttcatcatacaacctcatcccaacgagcatctccaacagcctctccaaacacccatttagcaatcttgccaaaaatttggggagtcaaatttgccttttactccaatagcatgcatctctattatcttctccaatctggtagtgggtcccacatgttaatttctaccttcttcccctctcttcctctacagtcacacctttccccttccccacctccacccacccggcgccggtggccctcttcccaaccggcggatgaggaggcggcggcttgaggcgagggggcgggtggatggggagccggcggcggtgccaccgtttcacgcgacgatggccagcgccagacgacgacgacaggcgcatgaggcgacgacgggatctaattctcgctggcctccctcgccgccatgccctccatcccgaccgtcgtgccctcccttcctcgctgtcgatggcgcaaaccgactctcccccggcgaggaggtgattcatcgccatcgtcaacgagaacccgccgcacgtaaactggtccacctgctcgaagtcagcggccgcaaggggcacagcggcgtcggccatgacgagctctgccccggtgttgtttgagagccgtcgagccgccccgtcgtcctcgttgtcgagctgcgccgatggccgacgccgaagaaggaaggcgatggcggcctgcaggggcgacgacggctggcagggaaggcgacggccggtagggtcggcggcgcctgcattgacactgggccggcgggcactaacgaacggcgacaacggatacgagagagaagaagcagagagagaagcagcaggtggcaaaagcacgtggggcccaccattagccagtgacttcgactggtcaaatctggctaggggagggagtgttttggccgccatcccgctagagaagctgttggagaagttttttttttttttttttttgctagagtgactaaaatttggcttggagaagcaattgaagaggctattggatatgctataaggatacaaagtgctgatactgcctaattggttatatttttttgtttttttgcctgcggcttattagccgaagatacaagaccgaaacaacgaaaaataattaatgctaaaacatacatgcacataaaactagcatgcagaggaccagcaactttcatttattttttcttctatcgttattttctactaaacatggagatgaaatcaggacacgcaaaaataagaaaataattagtgcatgattaaataaattttaattattaaaaacatgaaatttaatttatttgatattttaaagaaatttctatatagaaatttttttgcattaaacacaccagataaaaaacgtgctaatagaaatcgaggtaaaatctagtagtatatcttaataagaaaacaacaccaccttttttttttttgcaaagccacactgcctaggacaaacaaaatgcctcaccaagcaaagtgagttactaacttccttatataataattacatttttaccattcaaattttatcaaaaaaaaattatatttctgataagataggaccgaacaaatgtaatgtgtatcccaaccttccttttaattaagtttacttatgtgatgtatgtctcaaccttccttttagtcaagtatgcatatggaatatgcgcatgcagtatagttattaaatacggttattgtggtaaattgtgtttgccgttaatctat

SEQ ID NO: 43427 - DNA, 10122 bp, Oryza sativa
  unsure (1)..(10122): unsure at all n locations
aaaaaatgaggtgaaagtaaagtgaccgtagctcaactggttagctaggttccttgtggtggaaccaacccacccaagttcaaatactagatttgacatgggtgctcgcatttacagctaattactctttcagtggtaggcaacgtaaccgtcgatagcgaggcgcctgtggtgacttcgtcaatctcaagacatgccggcccagtcttctggagaagctcataggggtagctagaggcgcctgcggtgacttcgtcaatctcaagacatgccggcccagtcttccagaggagcttataggggtagagtgtgagcgcctgcgtttgtactgtgtttctaaaaaaaatgggtgaaagccaatgaaaattttccctaggaagggagggagtaaatgacaagaggcaacacaattagagcaggtacaataacagactattagccagctataaacatattttaatgagataaaaaatgagagagaagagcagcgggctacagatctgtagccaactgcagcgcggactccaagacgcaatgtgtgtatgacatgtgggaccatatattaatagtatattaattaactattgtatgaattggctattagtttggtgaattggagctagtagtgggctatactattaaacttgctcttaggtgaccttgagaacattatgaatttaggctcagttttggcagcccaggtttccaacgcaaacagtcgacatggaaaacggagcggtccattaacgcatgattaattaagtattagctaatttattttcaaaaatggattaatttgatttttttaagcaactttcgtatagaaattttttgtaaaaaatgcatcgtttagcagtttaaaaagcgtgcgcgcggaaaacgagggagaggggatgggaaaatggggtaccgaacattagtaacaaaagcaagagtgctatcttctaatattgatcttgcattccaaacacccgtctatataattgttcatatgttttttttccaatcttgcactatatattttcttttcctacgtttttattgttgtgttttgttcctttgatccaaacatctgccacctctctagctatctctatccggtcatgtgttgtcttttgtcagaacaaaccctctacaaaatatacagataaaaaaatgttaccttgagtgaaattgtcaattaatttccagatggacttattgctgaaatgcagttgtgaatttattgacgcagcattcaatatcgagtgcatcatgaactgcccagaagaattacgagaccaacaaaaagggtcccaagctggatacatttctacatgagaaagactacaaccaattagaccatgcattccaaactagtagtagaaggtatggaccaaatgtcccttctgaaagagtcaaagagatactatgagttttggagctggtaacttgttcttaaatgtcatacagtatattgtaacactattagatggagggagcaacttactacaaaatcatggacatgcaaatctacttttttttgagtgggacatgcaaatatactgaaacataaatctagtgaattatgttttgacaatgcaaatatatggccatatgcagtaaacatatacattgtcaatctgatagtcaaaacttacgaattaagttccaatcctgaaatacatatggccctaaaaatttggatggagagagatcacgtgaaaaagaatctgaactgtaaacataatggactgtaccatagtatgatccagactcgcgtgctcatggcaaaacagtgaacttgcactaatttggatctcagttttggcgcgcgtgcgagaccaatcttagcaaggattctgcaagatccacttcattgaggccatcacatgcacgtatttatggccttcgtcggcattgtataacgaggttttgatcgatctccagttcacacatcagtacctaacccctcttggtcaagccttggatgaatacattaacttttagtctatcagaccgataagtttttctatctctggctttctaacaaattgagtagcgtttgaataatcttctctgctaagtatttttcaaagacattgccacacagtgacaagatcaagcaattttatttttctgaagtgtaatcggttaattatcccagctacgtcgaagagataccgtttcagaacagtagtaccacacaccttccatccgtggatgcaagtacgccccacgagacatcaaagaacttattcttctcatatggctctcacgcgtctcgagattcgcgtcaaaccgcgacagttcaatccactttggctgtaaaattcgtcagaaaaaggctcacgaccacctgctcggatcaacaaccgaacaacgcacaggggataaatgcatctatacactgcgcgcagaagcagaacaaaacagaacgccgaaaaagcagatgcgaatgcgacgcccagttgccggccggccgatcgatcgatcgatgcatcgacggatcaattcacttttttcttgccccggccactgccaggggaataaacgcacgtcgcgccatgccgtgccagctcgaaactgtaacaaaaacgtttcatccccccctcactgcgcagtagcggcagtacactagcactagtataattcagaagcggtagccgtgcccggccaaaaggacgctgcagtagtaaaacctggctgggtcgcgagatgggatcacgcgacgatagcgagaccggtctcgtcgtcttgctcgtcgtcttggacgtacgtacgcgtcgtccccgccacggcgccacggcagacggtgggtctcgccggccggcatgcagcgtggtcaaatacgttgccgggggtagcagtatagtggccggtagggtagaggcaggcccagtgttcgtttggccccagggagaatataattgactacacagatgatggcatcgatcgtctcgatcaggtcagagcatgctgatcaatcggacaattgtttggtcatcatgggacacgaaattttcggggcctttggggaccgaccctttggtctgaggagacctcgaaagttgcaccctttggtgaaacaatggactcggcagcagccacaggcacaaaaatggcaggctcgcccaatgacagcaacatcagcgtaccgagtgccgagtgtgttcctttcacgtcgtccattgctatctggttgaatcgtacggccgacaatgggatggatgatgtggatagagtgaacgactgcaaaacacagcactgtacttttcacctttttatccttttagaaaattaactctacaaatagattcctaaaaaacttattctaagaataactattttcgcgataccaacgttactgatgccatggtccaacatgatggcgccaatagcgttggcatcgtccccctaacccctagttaaagctaagccactaatgtgaaggggaacgatgccaatgtcgttggcactgagagtctatatatatatatatatatatatatattaaaaaacccatttgtaataaaaaaaatatttacaaataaatcctcatcatcaacgtagttgacattgaggacctatttataaatagttttattttcaaataggtccattttcgctacaaatagttttttttattttctaacaaatatgtcctcggcgcaaacgatattgtcgccgtccccctcacattgttgacttagctttcacaggaggcaagggggtatggtgccgtcatatcggaccacggcgccgatgatgttggcacagcaaaaagggatcaatcctagcataagttttttaggatctatttgtataataagcttttcaaaagaaccaaaaggtgaaaaatttaggaacacagcacacagaagggcacaaggggcatcgtgtatgcatggtggctgtcgcgttggtgtagcggtgtagtcacgtctcaggactttgactttgtagtgttgagtaacaaagggagcacagctgcacaggtgatcatcacccgagaatagaggtgaaaatggtcggaatcggtagcatatcttcggaaacgacggtcgatcgaccggtaattaaccatattaatcatttaaagtatatcgtgtcaacattaatacaatgcaaaaaaaatagaaaaaacaaaatttataaatagccaaaaacagtgcccctgaaaacggcgctcggtcgatcgagaatttccgtgactgttttcacccctaccaaggaagaacgtggataaatacacttgtagattaaatttgaccatgtgtctttggccctgttcggctggcagtgtagtcaactacaatagcaagtagcacagccatgcacaacatgcatcgcaacctcagtgctgccacaaagatgtctaccgaacacactccttttttccaaaaaaaaaaaacaactatatgaatggccagaatttcatgatcttctttctaatttatgggaatgctaacggatgggatctcatccccagcatcgcacgcggtatcatcaggatcctttgcactactaaagcattatccgaaccccatgaccatgttccctatgtggcagcgtggcaggagacgtcgatggtgagttgaggcaacgacaaagcagccttatgatgatggccatgaggttgtcctatgtggtcctcgtatgcccctacggcacaacacacacgaacatgacttggcaatcgagcgcctccttcatggtgatctccactaagctactgtggtggatctcgccgcccactgcgtcgtcacagattaatcggcccaagtacacggcaagctcctcaggaggaaaattgagataggaagaagcagcaagagggttagggaaggaacaaggggcgtggtcaccggtgcatggctgggtggaggaagttggggagagacgggggctcacagcacctcaccacaaaggagcaccacaattcgcccactgacacgcatcctgagctggcctagagtgagtaaccgatgcggggaatcaattcaatggaaagggatacatagattgtactgcagggcgcaggtatttgtcttggtatcccaaaagtattaggcgggtacctccatagtatcagatttgggaaccgtaaatacgagatttgataagaaaatactacataacaatatcccgtttggacaggatgataactcgtatcatgtcctcatacctctgaggtatcatatcctgacataatttttacctataaattatttttatcgttaataagagtataatctaactatagacaaatcgatgggtcgactgagtccacttcatgcgaccatattgttcttcggcgctatatatttgaggaaatgacctgattgtatcggaaaaggtcagaaaggttgaaggtagtaacagaaaggaactctggttgaaaaccacttgggattgattaaatttgagccctttaggctctgggcttgtttgcaatcagtaggccgcaaaggaagtgggctgcccggttggtggccttctagcaaagagagaaattatataaatttaattagtatgtgtagtgtttattgacagtcatgatcactttggtaatcacttttagctgcctcaggtacgatgctttttgtcacaaatatgaacacatgttgtgcagagtactgaagagaggtctttagaagcttctttttttcaatttttatgaaagatatatatgacttcctaattaattaattaattaatacgtcataattaattaatacgtcatcagtttaagtgaaaatcgatggaaaaatattttttattaaaaatagtatactttttagtacatatttgaccgtacgtcttataaaaaaactttcatgaaatatgtaaaattatatgtatacatataagtatatttaacaatgaatcaaatgataggaaaagaattaataattacttaaatattttgaataagacgaacggtcaaacatatttaaaaaaatcaacggcgtcaaatatttagaaacggagggagtataaattagttaatatagatcataaattgataattaatggtataaaatgtagttgtgtaacctttattttaaaccgtgtgtttttaaaaataatggttctaaataaaattatgttatattgttaatataatgggtaaaataatagattccaaaaaaattttatttccaaagattatggatctaatttatttacgtatatattgtgatatatatataatctatgtttataaagttatagttctttaaaatttaatatcactaattatagttacgatctcatctatatatgcatagagaaaagaggggaggagatggaagcgaatgtaatttttaatgatatatgtaatatatatttatttgtttttaatcgtacgttgcattacagttgtatatgtattttttttggctttttgtgagcagtatgtaagtacctttctctagtcagtgcgctgagagagattaggtgtgaggttattaatagatttaatttaatgatctgagataacagatatactaatttaaataaaaatcgatgagaagttgttttacttttttcctcatattttcttgaattttttttctaatctattaaagtgcattttagaacttaaaatattaacagttaatatgtgtattaaattattaatttggttttctatctcatctaaccaagaagaagggaaaaaaggttaaaaaaaaaagagagtactatgtatgtatgtgcacgtatatggaacagtggaacattttttttacgtgcaaatctttcacaggtaaacatagttagaaaatctgaagatagatataggtgttagctaaaaaataggagtagttaccgagaaaataggagagagaggccggagggagggaggtatagcacgaacctgcacatgccgcatatatgcacgatggggatgagggctaccggatttttgtttcttaagaggtctaatgattaaaatatatgggtccaccgatttaacggaaaatcaatggctatatgtttattaaattttttatgatattctatatttaataaaagtgccacgtggcaactcgaaagtgtttatagggtgacacatggcggtttaaaaccgtttgtaaaaagtttaatagacttttagtatataatagataccaaatatttaattaatcatccattaatagatgttttgttttgcgtgccggggagaagccatggaagctacaggttttgtaccaccacctttgccaaaagtcgtcgcgcgacggcaacgaggaccggcgcggcctttgtccgcaacgttgcattccctccaccagcgccaaaactttcctttttctaatgaggcgaagccgtgccgtgccgtgtagttcctgcccgacccagccgtccagcctgcgttcccgtcacgtggcaccagaaaacttccccctccgctccgcacgctacggactcccgacaccgacaagaaacgaaccaaccgcgtgcgacacacaccggcgcccgcacgtacgtacgtgcgcaacccggcaaccgtaggagactaggaggaccggtgcaacagaagcgcttacaaaaaacgggcaggttaggtgactcgtcccgttccggtaaattatattctgtcgaacgctacgagctgagctgttcgcgttgccagaagccccatttgtttcgcgatacgcgcgaaacaaatcggcagatacgaagggaacattccaacctcctcccacacggctccaccaagaggcgcggcccgctcgatccgctgattcaccagcgtcggtctggtcgccgagtggcaacggaggccaacccctacgcgatgccgtcgtcgagtacgtccccggcgcggcgctcttggtcaaacagagctttgctacccgctgcgtggcttacacagttcggttgattgctgcggtgcaggcaggacggagacggtgaagaacgcgctgtcgcggtgggcgcggagagtcggcgagacgaccaggaaggccgaggacctgtcgcgcaacacatggcagcaccgtgagtaccgtttcgtgttccctcgtcgtcaatggacgaaatttgtcatagtcgttatcgattgatttccctttgtgattatcgatggcctgcattgctccatcgattctgcagtgaggacggcgccgagcatcggggaggcggccgtggggaggatcgcccaggggaccaaggtcctggccgagggcggccacgacaggatattccggcaggcgttcagcgcgccgcccgacgagcagctccgcaagtcctacgcgtgctacctttccacctccgccggcccggtgatgggcatcctgtacctctccacggccagggtcgccttctgcagcgacagcccactctcctacgaggccggcggcggcagcaaaaagtggagctactacaaggttcgtacagggtatataaacatgtactaactgtgcgtgtgaatcgtgatgataataatacagtacggtactccgttgttaatggtgagtgatggcctgatgggcaggtggcgattcctctgcacaggctgaggtcggcgagcccgtcggccagcaagcagaggcccgcggagaagttcatccagctcgtgtcggtggaccgccatgagttctggttgatgggctttgtgaactacgacagcgcggtcaagcacttgcaggaggctctcagcggcttccaccacctgcaagcgtgagtgcgtgacaggcggcatcggcatttgcccgcgctaatcttcgttgttcgctgattgacacggcgtgatttgtgtcttggggtgtttgtgctctagttcttcttgctgaggatatgtttatgagtgcatcggtcacttgagattgtttgggattgcggatatcttcgattgtttggagatacatgtcacacatctaagattcctgaagctcttcacttaaaatcttataggttttggaaactgtggttgccttattttttttttttgagagaatagccaacatgatccttgaagttttgctccatgatcaatttggtccctaaccttttatattgtccaaacgagtccttatataatttgtcatgtgggctaatatagtccttagttccacttaaattgccacatgagcatgccatgttatgctctcatgcaaaatatatggtaaaatgtccaatttacccttccatgtaccataaaaaataatgaaaagaatttacaaactttattcaatgtgactggatatatggcaaacttttttcattggattatgctaatacaaagttaaattagctacaaccactaaatatataattatcatgccaaataaatttcatgtaagtagttgcatttcaatgttaaaactctaacggatatttaatatgcaggatcacctacttctttattattattatttttctccttttctttctctcttttttccctatgacgatacgtgtaagggaaaattgggtatgtcatcatatatttgcattggaagatgacatggcatgtccacatggcaattttcgatgggccaaggactgtatatgtccacatgataaagtttaagggcttgcttggataatttgaaaagtcaggcactaaaatgatctcaaagcgaaacttcagggaccatagtggctattctccctttttttaaaaaatactccgatgaacctacgaacaaactccttttcaggcagatgccaatgaggacgagtggaatgaggcaccgaacacaaccgaacgacaagggtacgcctaataggcaggtaatcgctgggagtgatcacccgccctcccctatattgtcgctccctcctcccccctccccctttctccttccctttttatcttcatactacatcataaatatttaaatttaaattcagaattgaaacggttatgtaaatttttgacttataaactttgggtctataaactaatatttgaattcaaattcaaatttgaatcgggtatgtaaacttttgacttataaactttgggtctataaacattagatgtataaactttagatgtatagaaagactatatataaaaaatatttgaattcaaattcaaatttgaatcagatataattcaaattcaaattcaaatttgaattgggnnnnnnnnnnnnnnnnnnnnnnnnnnnnnnnnnnnnnnnn

SEQ ID NO: 43428 - DNA, 15281 bp, Oryza sativa
cccccctccccctttctcctcccctttttatcttcatactacatcataaatatttaaatttaaattcagaattgaacggtttatgtaaatttttgacttataaactttgggtctataaactaatatttgaattcaaattcaaatttgaatcgggtatgtaaacttttgacttataaactttgggtctataaacattagatgtataaactttagatgtatagaaagactatatataaaaaatatttgaattcaaattcaaatttgaatcagatataattcaaattcaaattcaaatttgaattgggtacgtaaacttttgacttataaactttgggtctataaactttaggtgtataaactttagatgtatctaaatactatatataaaaaatatttgaattcaaattcaaatttgaatcgaatatatttcaaattcaaatttgaatcgggtatataaacttttgatttataaactttgggtctataaactttaggtgtataaactttagatgtatagaaatactatatataaaaaatatttgaattcaaatttaaatttgaatcggatatataaacttttgatttataaactttgggtctataaactttaggtgtataaattttatgtgcataaatttactaaaataggaaaataatgcggtgtcaaaaaaggaaacgtggagggagggagaggggaggggtggcgattagcgatcgatcgcgcattagagtttccggaacggcaacctatgttgggctgaagcagattattggccattgactgggctatgctgtttatggtccagtttggcactacgtagtctagtttaggtaataagtctaattagcatcccacatctttgctcccaattgaattgcctccctgaactataaaaccggatatgacgtctcttccaactacgaaacccgatgcaaatcgactccttcagtggtttgagaagtggtttttactaacatggcaagtttactcgctgagtcaacaagggaacccacatgtaagcaattctcctctcttcccttctctcttagggatcacttatacatttgtcgacaaatttccttttaaaaatttgacaaatgtaattatggtacaatcgggatgtaattatactaacttgcgtgtaactacaatataacttgtatgtgactttcaaaaatctctccgtaacatgctattttggtgaaacggaggttgtggaaatgaattctcttacatgtgtgcgtgatgtgacattttctccttcctcacttgcacaaatcttgaaataaatctaacgattcaaaattatgtgaaagttacatacaagttacattgcggttgcatgcaagttacagtgtaattacactacgattatactataattacatctatgaaatttttaggagcaaatttgtcgacaaatatatagcaaaattgtctctcttaaagacagttttagtaggtgggatccactcgctaagttactaaggccagttttagttgacgtatcacctatgtaaaagtggcactggaagaaaataaaaaaagaacaaaaaaacataaatgagacccacctgtcatgtaaaaataaaacaaatatgatgggcttaagaaatctgatattgtgtcattgtcacaagtgggttttgttgaaatgtcacttcataaaaatatcattcttaagccatggctggattatgtttcttatgccactcatggatcctcacgcgtactagtattatctacatgctttaattaggcccaactcatttatgtgccaaaacgtccattgctggctattctagttcttctcaagaaaaaaataatgaaaaaaaaatcacatatgaaaattacactgagagaataaaatatacaatctttatatggagggaaaaatgtacagacacgaaagcatatagaaatcataaatatcttaataagaaagttgatgtacaacattggtagttgtttcaaaaacttttaaatataactacttcctccgttttatttatattataagataccttaacttttttctggatcaaactttctaagtttgattgtatttataaaaaaaattagtaactctataacaccaaatcaatttcattaaacctaacatttaatttattttgatactatattttttatgttaaaaagtatctatatatttttctataaatttgatcaaagttaaaaacatttgactttgaaaataagtgaaaacattttataatataaaacatatagagtataatataattggagtgtatagttaaaatttaacttccatataactcatctgcagctagacaaaatatttgtgtagctttttggcatagttttaaatctctgaatatagctatttgagaagagtctagctattttctttcattgttttggtagcattaattacgagccttcattaacctagttgcgcgttgaaccgccctctccaaagcgcgattgcaaaatttgtcgattgttttctagcaattttgatttgaagtaaagtcgaattaccttgtcccattgcttccattttttttaaacaccttttaccttcgtgtgcttccccacaaacagtgcaatatactgtttgatcacaaagtgcaagctaaggagccctgttagtctgccggatcaaggaaccttaccatgaaacacaaaacctaacaatttgatctggtgcagcagataacttcatggcgctactattccttcaaacggacgaacagttcattgattggaaccactaggctaaccagattgaaccagattgtcatgcgcacgaccgttcgtacagggaccccctgacttgcgctgacgctctaccagcccgatctgtcagtcctcttcccgcacgtacggttgcgggcttgcggcgcggtggccataggcctaaaggccagtgaccacaattgcccgtaccgttccacacgatacgccggaccacacaacgaacacagcccataaatcgatcggcgcacggggccctggtgggtctcgcgcacacgcacccgcgccctatcaaagcaaccgcaacgcgtgcaagcacagccgtaccgtgcgcgacgtcgtactggccggcaacccgacgccgcacgactcggcgaagaaagcccaaagcaacggctcgcggccgggaaacgccggcgcacgcgtcacggtcgtttcgtccctttcacccgcgcctttccgcgcgcgtcgcgcggactcgcgcgcgggcggcggcacgtacgcctcgccgtgatctggtatatggtctgctgttgcgtgccttcgtgcgtgctcgcatgtgttggtgttggtttgcctttgccacggtgtgtgttggtctcgcgtcgcggggcgcttttttcggtccgttcgacgaataacaatcatgagtggtggcgaccccgggaggaaagagagattcttctgtgtctaccgacaaatcttgccgactccggtcaatggcgcagtcgttgcacgaccgaacgagtaggtggtgatctagagcacacgacaacggtaggtatatgctgcatctgcatgcaacgaaggtcgtcgcaatgtaccatctttcctacggcggtaagaaagcatcatgtcttctttgtcgtcaattttacccggaccttttgggcacactctgctagctagtgctccgatcagagctctgatgaagctacgaagcaggctagagagtagagagagagcaaggaggccgggttattgcacacctgcagtcgcgtgcacggacgcatatgggcaaatggctgagcccatcctgagcccgtgtgtgctttatacgtgctctccaactttctctcggctcactttccatgagatgcacctgcactcgcggcatcaatgtgcagcagttagcatgcaagttgcaggacgggccggggagggagaaggcgctcatgattcaaggacgtgcacgcaccattgccgcatgcatgcattgtccgtgacagtgtcgccctctctgccctcacttttgcaccgtacccacgtaggccaaaaaggaagagaggcctacagtcttgcactgacaaaggcccccggctctctgcatttgtcgcctccgtctcagcttaaacttagctagctggtgtcatgtgtacctgttttcgtgaaatttgattacaaaaccagcaatggaaaataaggtagacgcggagttaactagctagtgcgctgatgggttgtacttagcggaaaacgtttctgtttttaatctgaaaaaaaagcatgcttaccaacaagcatcccacatgcaatctatttgggaaacgtctcatgaacactcacatcacgtacgtctggtcgtgattagtagggcctacgattagatatctcaaaccatcacctcagtgttgcattatccacacaccatcataagctaaacagggcatgcacaagggttgacttctttttttccctcctaccatgcatgcatggtcaaagtcaagtgtaccgaaaagctaggcctggtttctgtgtggtcgatcggtgtcattgttttttctcctttccccccttgagatagagagagtgagatcagagactgatcagtttgagctttcactgcacagtaccagctaaggtctgagccatatgttgtgatcacgcctacgccaaagttgcagctacgcgtgaatgatcaagtgcgtgacccgctgttaccaatttaatcgtgcatgccttgtccctgcagggtcccacccccggcacagtgtctttgactggatcccttaactctgtcgagtcattgtcagcaagaaggcgacgagagtgcaacagtatggtgattagtacaagctaagcaagcaataagcccttcactcctttcgcttgcatttggagcaagccgactgatcgctacatgcatgagatctagactgattgggattttgtggttgaacttaccattgcatggtggttactactgttcatcagaccgaaaggaaagccccagcagaatgcatgatccctgtatatacaggtacagcgagctctcttgattaattggctgactcctgcggtcgttgtagagtcttattcagatatataattcatatacactactatactaaagtcgcaaacatgcatgcaaaccgggaccatgtgtctctgatagaatttaaacgaggtttggtgagccaatggggatatatgtatcagtgctgacaaacacatgcattgcacgctcagatttcagaatcggatcagcaaagtacgtactacaactgtttgtaagatgttaatttggcaaaaaaggacacgctgagggcctcatgaaatgtaggagtatacagttgtcggcttggcgggacgacagtgaatttctgtttactgatcatgtagggtgaaaatggcagcactgattaatcaaccccaccggcagaattgcacggccggtgtgaatgattaattgcctatagttcaaacagtcctgggcaattatgtaactagctagcataccatgctttattttgaatctgatctgtttttttatagggtttgaaagaagcaaaacgcctggctaatttgtttcatacctagagcaagatttgcaacaaatatatatccgatttttattgctatagcttctgcaacggttggatgaaaatactaacgatgccaagcaatgttgttgccatttagtaccacgtcatggaacatctttaatttttgacaacgacatgaacatctctgtttaacaacagcttgctgattgtgcatgatcatctgcatgatttgtcatgctgatagcagataaagacttctgctggagttctaaacaaccaagcaaccgtattacaaaacaaagaaatctactcgtactaaacagtagggatgaaaacaatagccaagaaaaagctatccctacctgtcccaaaacggaaatggtacatggtccggattcggcttgttgccgtgttggtggtatacagggcaaagcagcgtggcaatatattgacgatgcagtactgtagcatgggattcagaatgcaaaccaacctcctcatctgaaaaaacagtgacatatttgattttcctaaaccaaagtgttcaagggaccacaggtgttttgtgttcataaatgccgtctccaatgtgcacactaccgagtaggcagtgaaaccacacaccacctgggcatgcatacacgcacttgggcagcaacttggaccaggcgtccaaatgaccatagctgagtatatgttgttgcgttctcttttccctgtaggcaccacaccactgcatacttccatggcaccaggtcagcacctgggctagccgggcccacctgccagagtgccagtggccagcctgggcagtttctgtgtttgagaacaaaactttgcaaccttcaatcagattctgctactacctgcccctgccaccgcccagtggccacgcctagcctataatcctagtagttgcacaacatgctatagcctagctgcctctttgatctgcatcatggcatggacatgtctccggccggtccggccgtacagtcaggcatccacgagacgccggcccggccggccggccagcttccatttctccaagcctgcaagcgatgaagccaaccactactagctcctagtatagtacatcacgaggaggaagagacggcgagagaaacgggggaaacccggaaaagtcactgtatttttcggtgacctgctgcggtgctgttccgtcgctgctgctcccgttaatttctctggctacgcatagccaccggcatggctgcctcatcttctcttcgcagtgtgcactgcggggcaagtatccaatacaacgatgtgaaaatcgaccgagggactcgtcttaaatttgtccgcggtccatggctcgccgtaataaatgcaacaaccgcatccatgtagcatttggccaagacggggagagtaaattaaagcgtaaagctctagtggcagggagcgagagaagagacgagacggcagtggcgctgcatgcgctgggtgcacagagcatcatcagagagtgtatatctctgaaatactactgaaactgtcgccagttcgtcacacccttagcttgctgcgtgtcaagaaaatgaaacctggacggatggatggacaatgctcgcggaatgggggaggagttaatgcggtatagagaaggagcaaacggttgcgcgcattaatgcaagatcaaaaaggagcgaaaaaaatgggaagaaaacaacaaaggatcacgtcatggagtagacctggccagtgcaagcatcaaactgaacaccgatcaaagcagtagtagtaattggtaaaacgtcatggttgtttcgagatttggaagttgttaggcactagcattaatccgatcgagcacagttaataaactcatgccctgatggagaacatattaccacaagcgtccgggaacgagttcggaaatgttgtaaatgaaaagatgaagaagaagaagacaagttgggagagaaggaatgcaacagtggcctatcttttttaggagtggcagtactccgtagtagccaacaaactattgctactagcaaacctagacgaatggcccgacccatgggtaaaattatcccagcgcgcaggtcccaaccacaaaaaatataagagcacatacactgaatccatgcagctactctagctagccccaatccccagacacaattcctcacctgcgctgatcgatcacttgaaacatcaggtacattcccaagaagaaccaaatcggcaaatggccaagccatgcataggaattaaacagcacgagcaacagttaaaatgaaaagaagaaagaaccacctactagagccgagaacgaatgctctctcagtctctcttgctacagattaacctaagccaccaattaattaagtccaactctaaataaataaggttcaggtacctaccataccggggtccgggtggctaagccacggccggtcgatcagctcagctagcttgggatggacatggatgcatgcgtcgtcccacaacttggtcatgcatgccgacgatgagatcaaatgcatttgctcccggtcatggcagcttcttgcccagggtgtgcttgttgttgtgcatccacaccttgagcacgtggcgcttgacgccgacctcgtcacagaactgctgcacggcggcctcgtcgtgcttctggatgcgccacccgacgcgctcggcgaacgccagcatcttgtccttctgctcctgggtgaacttggtgcggaaccgcttcttgccggagccggagccggacgggccggcgccgagggacatgccgctgagcggccccaccgccgacatgggccccaccatcccggacaggtcgtcgccgtcgtcgcggccgctgtgggaggtggacgggagcgcgaggggccgctgcgggtagccgccggctgcggcggcggcggccgcggctgccgcggccatgtggtgctggtggtggtggaggtaaccggcaggggtgcggtagtacggggagaactggtggtgcggcgtggcgccgtaggggacgacggcggccgggagaagggcgagccctcgccggcaagcgactcggactccttccggtggaagttgcggtggcagttgcacgcggcgcagcggagcgcgtcgatggtgccctcctcgccggccgccatgaactcgccgcagccgtccacggcgtggccgccgatgccaaccgcgtggttcttgaggcactcgcggtacctgccgccaccgcagctggggcccttcacacggctgccaatctcaccaggaggcttgggcgccatcccaccgccggcaaggccatgctgcggcggagtctcgtagctcgagctcaccggcatcggcggcatctcctcgtcgccgtcgtcatggtcatcgaagtccatggtcgccgtcgccggccggccggccggcaagcttgtctagctagctagctacctagctaggaaaacacttagctttactgtcctagctgctttgtctagtctttggtttgtgtgtgttgctgagcatggaaggaggctaagagaagctttagcgaggttaagaccgagatgaagggataagagatgcagcagagtgtggacaccatctggctgccagttttgacgcgccgctagctagcagcggcagccaggcaagccgctgctggctgcagcaagcagcagcgcctaggtgatgatgtaactttgtttctctcgctctctctctctctctctatctacagtatctctctctagatagcaaactcgctttctccatttctcctcctctgttcaccgcttccctcaagagtcaagccgaaatgcgctagagcttgtctctgaaccatgtatcgtgttgtggagtatgtgcttttgcttcgccgcgagcgcgcgttcatgtctttgctgtccctttctctacgctcttctcttttcaagtggtttggctccaacgccttttaaattgcggtttagaatatttgatcgtgacatttggtctttcttttttttttcgccttttactcgaatcaatgtgtggcacgcattttttcacaaatataattttggtcaaatacatatatacttgaagtaaaacgagtgtttcccatgtttcttacaaaacaaatcgatttttagttaactatgaacttgaatatgtctatgtccaaacttacggagtatagttaggaactgggttcttcttgacaagggcgtgtgacgcatgcaaagtacattgcaccacattgaattcaatttgttcaaggtaccgcaaactacaaagccgaccaaactgatctttattaacagttgtcgtatctgctactagtactgtaccaaatcattttttcccctaaaaataacattcagatgttcaacgtactgtgctgtacgtagtaatgtcctagccagctgctttcaagggatgtaaatcacgccctccatgcatgtttctgtagtttacatttcagctggagtgatgcatcaaagtcaataatcagctactttaatttcaactggagtaatgccagcaacgttaacatcgaatcgtggaaggcatcattttcagggcctagttgacgaaagcaaaaaaacaacaaccaggcctgcatgcaaacaaaattctccacagtaacaacgggaaactgttacagccacgcgccgtacatttctatatagtatgcatgaatcggctggatacgttggtgtgcgccactgaaaaaggttcatatttgtcgatcaactatagccttgttttatatcattttcccttcaaatacgaaaaggtttattttggtctcttagctacaaaatcgcaccatgtttaaatcaggatgctgttttgatgacattgcgagccacgtggtgttatagttaacaatttaaaatagatcatatacataaaatatacttcctccattacatataataaattttttttgacttttttcctagtcataccttttctattttgataaagtttgtagaaaaatgtagcaacattttcaacacaaaacaaacatattatcaaaatatatttaataaaattaatttggttttgtagatgttgttaattcttttataaactttaatcaaacctaaaaaaattgataaaaagtaaagtcaaagtacttatacctgaaacaaagggaataggagaaaaagagtaaaatgagatgatgtgaaaaaaatgataaaatgcagataaattgaagatgtttttttttttggtgtgaagttggagcatccaacaacaagcccgaaaagatgaccgttttgtgaagtcaaatatgttgtgttgcttatgcggtaagcttgacaatgatatgatgctatgtatttgagctccgttattgtttgttgtttggtgggtggggtgaattctgcccttattcataatggcctacttttttgctagactattcccgtctagttgtttttctcttttcttataatctgttcgatttttatttttattaaaatataaataacagtccttatgctggtatatttttttaaaaaaataagggacgaatagtaaacgatctcatgccatgacatttagatatttaagtaaaactggcccacatagggtcaaacagtcagcgacgaactgaattgactggaaaagatggaggaataaacgcacacccatgcgtccaaatttacagtgtttttgacggttccaaggtgtgtggccggctgatcgataggaaaagcgttggaaatgagaacaaacaggctagtacccctccctacgcacgaccggctccatcgctacatgcgcccatgatctggtccccggccgatgagctcaagccctccattccatcacaaactcgacaatcttgtggcgtgcttacctcgtcacaataacgcccggccgttcatgccttcatggtgtggacttacacgcaacgtacacaccctgacacgcactacgcatggttgatctagctttctttcggtggctaagcggctaatggtctccaattccggccggacttaatagcccccatttaagccatggtttgtcccatccaggggcgcccatgtcacgcacgcggataagctctgctcccctagctaagcaagcaacattagctacgtacgtcctacgtgatgcatgcatctatctcgcgcgccgctctctcgatcgccaggtgggttcacggccaaaccacgtgtttatgcccttgggcttgggcgactgcatgggcggcagcaccgtgtctcccgcgccgctccaccaacgtcaacggcagaaattgggatattctaacgtaaagttagattttttttttcgcaagcgtctaaaaggatcacacgcttatatattagattaacgtaaaattagaggaatatagttatttacatataaacctcaactacggatccacatgttagtgacggtttacgttagaggacgtgttttccacctgtgagtgctagagattatgaacgaaatcaaggcggcagaggccttatctgctgtgataaggagtgtgagagttaagcaccacaggtccacaggctgctaatctggctaatcctctggctcgatcgatcacggcggacggggaggtatcttcggtcgatcgatcgctagctcgcgcatcgccatggtccacgcgcgcgtggcgtcgttggaggcgtggagcagccggccagttgctgtcgatagcggcgtatacgtggacgcggccgccgcgcgccccagtgcggtggttgtaccggtatactccgtattgtacttaaatatttgcgtcctatttcaacaacaaattcatagatttttttatttattaaagaatatatatattatccattaaatatgatgtatatgtgtacgtttataggggtgagtgtgtacatgttttaagtgcctacatttgtattgtatttgtaaaaacaattaatccacatagctgatagaacttcgattaatttgatcactaagggcaagtaaaaaggtagagaccgttagttaaagaatatcatgttacaatagttaagacaatacggtctctaactattaatgtaccaaaatacttttttactagtcatctttcctttattagactcagggcatgtacaaaggcattaattagtgggctctctttattgccatgtaaacatatttaattaggtggaagagagagaaaagagaaaggagatgcatcgatgttttgcatgccatcggcttgacatcggctctcatcgagataaacacgagcacacgagataaacaacgagcgttgtatggtccatcttcaagaaaagtcgcttatttagattcaaagtgcagaaaatcacgtaatcattgctactagaatttaattactgcatatcagtggagagacgataaaaaaaaagccagcctttacatatctatgagcccgtagcgggctcaaccgttgaacgtgccctcagtgcagcaaaaaatttcctaataaatgctaagaatcgactctaaggtgttgtcttgcgtagcaaccatctttctctctccttcttcctctctcttccacgtcatccaatatgcttgcatgacaataaagagagaccgctaataaagacctttgtatatgtcctaatatgatgatgctggtgtttgaaactgaaaaggtgtatagtaccgaccaagtatcaacggaaaacggaaggacatcttgtctacctgtgccgtgggtcccgcggttattgttgcgtccgatttgcttggggcttcatatgcgcgatccggaccgaatccagtttgcgattttcttggtgggcctatgacagcgtcgtcgcatattgctagataactttggtttgtcacgatccatacatcacaacggcgctgcagcatatggaagcgttgctccgttactaagtgcgaatgcacgtgaaccaggttatacggagatgagagttcctggaacaggtttacatgaccaaatattaaattttcacttcacgacaatcgataactatttgaggttctctactatgtatcattccaatctagagatgtttatgttgttaatagtccaaagaatggaaaaaaataataatcaaaggtatatactccctccgtctcataatataagggttttgactttttacttacactgtttaaccacttgtcttagtcaaaaaatttgtgcaaatataaaaaacgaaaattgtgtttaaagtactatggataataaagtaagttataaataaaataaataataattctaattttttttaataagacgaatgatcaaacagtgtaatgaaaaagtcaaaatccggacggagggagtatatatatatatatatatatatatatatatatatatatatatatatatatatctcctatgggactatatttcagtcgcctaaaactacacaatgctatgctgaaattgtagtgctttgcaatgtgtaattctatttcattttaactgcaatatgtcgttatatattgttgtacttaatttttgtgttttttttacagaattttgtaaattttaatgacttttttgtaagttagaataatttattgttcagccattaggtagtaataataaataacaagggaagtgataataatcattgtataggagttgtataacaaattcaattctatattcattttgctctgtgcaaaattgaacgaggaattcaactccattgttttgatataatccactagaataaatctgaatgatcaacgaacatattcaatatacgattaaaattttagcatatatatatatatatatatatatatatatatatatatatatatatatatatatatatatatatatatatataatatatatataatcatcaataacaaacagtaaaacctattacttggtgacaatatgatgaactttagatcgtgcaaaactgtgctggaaatgcactatacaactggagaagggctcatctcccggtttgcaaccccctttatttcctctcgggtattgaaccgggagggagaattcaggactaaagatgacggtctttagtcccggttcaaatacccgggagaaaagccacatatttagtccctgttggtgttaccaaccgtgactaaacagagggtagcgacagcccctccaggtcacctttttctttttttttcttttttttcattgttgatttattactggctagagttaatccctgtattttctcccaaatcgagtgggatacatatccccaaatcaagtaacatcccaaatcattcacaacacaaatcctaagttacttatacacacaaatcaaatacatcacaaatcctaaaaaaaattacacacaaattaaatacatcacatattatacatctcagatccatgcaatgaatcacaaattctagaaattatacatccagtgaatcacaaattatattaaaaaaatggagaacgcagccgccactcgccacggccgccgccgtgcggccgccgcctgcccacgcgcggccgtgccggccgcctgctcgccctcacccacgcgggccgcctgccctcgctcgcctgcgcagagggggagggggagggggagtttaggaataagatctgaggggaggaggagagggacataaccgatcttatctaaatatctcatctgtgacttaaccaatcaaatacggagagaaatatttactcccggttggtaactccaaccgggactaaagataaatctttactcccagttggttaatagtaccaactgggactaaagtggtaatctttagtcccggttggtagtatcaaccgggactaagatccttggccccctgat

SEQ ID NO: 43429 - DNA, 3864 bp, Oryza sativa
  unsure (1)..(3864): unsure at all n locations
caaacatgtaagaaaaaatcaacggcgtcatctattaaaaaacggagggagtattggttaatggtataatgtttaatggactttaatttggtactagtatataaattatgggtagttttagtcaatactacaaattataattttagcacggctagccccttgctccttttagcatgttcatcagaccattgaaatggattattttcattttatccacgttttgaaaaatatgttttcttaaaaaaaatcttcatttttattgcttgcatgtaccactttagactttttgttaatttttaaggatttccttatccctataatcaaatcaataagccgctataataatccaaatcaaactatgctagctagatagttcttttagcgagtgagggattttttcctctatgggtaatagactatattagaagacctatttactccctaaaaatatagcaatttttgccgcatttatatttgttcaaaaacattgcaattttccttatatcttatttaatttcttgacagctttctctgttctctccttaaatccttatgaaactatataaagtgtttatgttttgggatgaggctagtagatcaatttagttggacatttaactattgtcccgcttttaagagtgacatttaacaatctgtcaataacatgtgagctgtgtctataacatgtaaattcagtgacaaattattaaacatcacattacatttaagagtgtcaaatactcctacgtcccaatataagtgccacatacccccttcgtccaaaaaaaaccaagtcctgtatacaaacctgacatatgcgtgtccaagttcgttattagtttatctttttttgatacatgagtcattaatacggatgtgatatattctataactatgaatatggagagctgtctgttcagattcaaatcctatgatatatgaaatatgtactatgttgtatatgttgtatttatactgggataagatatgtaattaaatatctcctatatttagctgctggatgtggatggaccacgtacctgccggatctgctgtttctgcccgaccgtaccgtatggatctacgcaccgtaagcgactagagtacacgcaccagggggccgcacaactgcgcaagcgtagctagcgcgtacaccagcggcacgccggcatatacgtgtgtactgaatgtttctttgaaaagtcgcctctgcacgagttgctatttccctcgtgactagctagtgaccaataagagtgggaaaagaaaaatagaaacacgtacgggggggcaaactaaagggcgtacgtgcatacaggctacagcagcaaggtaccgtgtcgaagaattgatgtgcatacggcaagcgacgtacgaacggacggaaacgtgcatgctgatgcatgcatggagccagcccggaggcaggcaggtgcatgcgcagcggcgcagagcagggcgagctagctagccggccggccgcgcggcccggggcggcacgatcaggtggcggtgccaggagggggacaagggaggaagagaacaaaagcgcggcacaaacacggcccctcccattggcaaacggcgctcgcaggcgacgacgacgacgcatgcatgcatgctagctagccacgaccatgtcgcgctgcgctgcgattgctgcgtaatgcatgcatggcagcgccatcgcaggtcggtcggtgtgggggagaaagaggtagtagcagcgtagcagccatgcatccgatccgccgatccatgtacacagcggttggcgacgggtgcgggccggtgcgtgcgtgcatggttgccgcgccacacggcactgggctcgagctgcagcctgcagggcgcatgcaggggctggggcagggcatgcagccggccgtcagcctcgtcacgtgctgcgcctgcctacctgtggtggccatgccgtctcgggcgtattaggcatggctttagttcccaaaagttttcccaaaaatataatctttaacatatgtatggagcattaaaatacagattaaaaaaattgcacggttagggaggaaatcgcgagacaaatcttttgagtctaattagtctatgattagtcataagtgctacagtaacccacatgtgctaatgatagattaattaggctcaaaagatccatctcgcggtttccaggttatgaaattagttttttcattcatgtccgaaagccccttctaatatccgatcaaacatccgatgtgacaactaaaaattttcttttcgcggactaaacaggcccttagacatttgtgatctttgcatttatatatatgatcctaaaccagtgtgaatagataagttattagtatctgatctcaacgtataagctaggagtaggagccagccaagaaacctcgaatgacaatgttactggaacagtgacattgacttttctctctgtttttttttaaagttgtttggacactgctttccttcgtggtatatatgaagcaaaataatggcgctcgaaagttaatttggccaacacccagacatgtcgggttgtacgcggtcttgtgcatgcatgcgctcgcttgtacatgcggccacagccggccagcagggtcccatctaattaaggggcttagggctcgatcgatgatcagtgtaatagttcatcacgttacgtggtttttggtggtgtgggtcatttgagttgatgtttcttgtgtcagcaacagggcgcaaaacgttagccgacgtgactagcccttcggctccctccatgtccacgcgatcgaatgcacacccctctgatcatcacatgcgtggggttacgtgtacacacacccactgcaactttcgaatccaaaccttaacaatggatggatggatgtaccccgtgtacagtacctgcgtggtcgatcgtgtgcctcgtctaatcgatggctcatttttcgattttaccgttgcagggtgttgtcgcctggcgtatggtgcttaccggcccctgggtgccatgaatgtagctagtcgtgcgagtcgaccggccggactacttgcccgtgcatggccgatcgacgacgagcgcggactggctggcccggctccgtccgtgtgatctggccattttccaggactgcgaaacgcacgaccggcgcccatccccttccctttccccctccagctacagaggtcatcatgttcagaaccacccaaagtgagacagagagagagaggtgcagtaaagaagaggacaaaaccatcggtatgcctgtattatggggatggtgcagtaaagtacgttacgtacgtgtggccatgaaggggggccaatgcggcccctgcaacgctgcagcgcgcccatgggctcacgaaagaaaggaggttcaccaccaccagcagctatagctgtacccgagaggccgagacctgcctgcccaacgtccgttcgttcgtttcgttggcatgcgctaagctttagcctgtatcacctgtaggtatgggcgtcgcaggtaggggtggaaaaaaaaaagctcgggctcgtgagctcagctcgggcttggctcaagcttggttggcttggctcgactcgtaagcccaacgagccaagcccaagctttctttttagctcgttgctgaaatgagccgagccgagctagctcgcgagcagcttgttttggctcgcaagcctaggctatcgtgcgtttatattgattattttactttatattacgttattatttgtcaacttgaaatttattattaagattttgaagtattgaatatataaacttatttaaattttacatgttgatgatttaggggatcttttttaaaattacaaaataatnnnnnnnnnnnnnnnnnnnnnnnnnnnnnnnnnnn

SEQ ID NO: 43430 - DNA, 2318 bp, Oryza sativa
  unsure (1)..(2318): unsure at all n locations
nnnnnnnnnnnnnnnnnnnnnnnnnnnnnnnnnnnnnnnnnnnnnnnnnnnnnnnnnnnnnagctgtacccgaaaggccaaggcttcctgcccaacctccggtccttcctttcggtggccttcccctaactttaaccctgtttaacctgtaggtttggccgtccaaggtaggggtgaaaaaaaaaaacctcggcctcgtaagctaagctcggccttggttcaactgggttggctgggctcaactcgaaaccccaacaacccaaccccaaccttttttttaacttcgtggttaaaataacccgacccaacttactcgcgagcagcttgttttggctcgcaagcctaggctatcgtgcgtttatattgattattttactttatattacgttattatttgtcaacttgaaatttattattaagattttgaagtattgaatatataaacttatttaaattttacatgttgatgatttattcttacttttttaaataattacaaaataatatgaagatgtgttttaataggaaggcttgcaaggcagctcgagctaggaaacgagccgagccgagctcaagttttagcttgtctccctaaccaagccgagccaagccaaacctaatttattgtgggccactgcaagccaagccgagctgttcagctcggctcgtttccacccctagtagcaggctccggtcgcttctgtagccgatctgtacgcccgaaccatgcagggcgtacgtgcttttccgtgtgtagctccgctgtctcggccgtgtatgcatggggagtgatttgaacctgcccgcatcggtgctctctcgatcgggggacgtacggaggcgaggaaagtgggggtgtgaagacagtgacaagacgataggaggtagggccggccgggatttccattttgcaggctttgttttcgctcaaaaacccttggagtattattcgcctggtcaatggttatgaccgatcacgggaccaaacccattaccagtactttttttttatataaaaatctttttgcgcctccgatccaccatgcatggacatgcattactgcattaattgcagacttcatagtctaaaaaatgcattacctagcaccgcaaggtgagcagggtccatgattccattcgaatttcatcacctgaatttcggagatttcccaagcagctcgtttgtgttgaattccgttctagttccatcaaatttcatgaaaccatcatctccctagcgcggcccgcatttcaacacgaaaacaaaattgcaaatcgtttctgagtagccttagggtcaaattatatatagggatctttaaatgcatgagtttcaacttttgaacaattttttacccagctagaatcaggtgaaagaccgtacatttcgaccaatttttagtattttaaaacataaaactaaacgagccaaaacaagccaaaataggattatctaagctaagagcatcaccgacaacatcctaaaatttcttttttagaaccctaaacatattaggtgtgaaaatattaaactctccaaaaagttacctaaaattgatttttccaaaactacgaacaaatgaggccctataaaaactttccaacaaaaatatgttttttttcactcttttcatggtgattgcaatcaaccttgatgcctcccatcgccatcacacgaatgcgcacacacctcccatccctgatgccactctccccgtgagatgggttgggagcggaacctcttccctataagcataaacaatctggacttaggattttgacctattaagagcaatatagaatatgttggaatttttttaccaaaatttcctaaatttccagatatggaaatatgtatatttagatgctagctgttgttgatgctctaatcctttagtctagcccttgaaggttagaaactaccattagtcggaaaaaaatgagaaaattatgccactctcattatgatatgtcggagtttatagccatgtaaatcagttgcatctgtatgctacgaaatatagatatatttttagaaatagaaataaggatcataaatattaagctttgcgttcaactaagatcttcagccgaatgaggaaaatttgattggaccgcacactagtttccaggactatatatatatcggttgacaaaaaattccacctctcatctttaaaattttggaccatcggatatgctttaatattcatgcagaggcattaactctaactctcatcctcttgttcccctcccctcgcgcattccaccgccaccactcccattgtgcattctgccgtgacctcccgatacccccc

SEQ ID NO: 43431 - DNA, 3810 bp, Oryza sativa
tgctgtcttaatcaagtcattatttcctccaagcaatcgaatgcatgcacgtcccaagcgcgctctctcgtgcggaactacgaaatactagtactccacttttgaacttttgatgggtcatggactcatggtactgtacgtagtaaggtatgtactcgaggagagcgttaaaagtaggatgacagcgtgtgtgatagcattgccatacacgagaaatttacgtgccattttggctcttttttttactacttccgttccaaaatattattgtctaaaataagatttaacctatcgtagaacaataaatgtgaacacagtaaatcctgattcattgtctttgaatttagatagtaatatttgggacaggaaagtactgtatttaaataataaaacaagctaaaacgaaataaataatacttaatattttcaactaatgcttaattgagcagcatcttatgatatttaaaaaaccgaggtgtcgaccgtgtcgtacatatattgttacggcgtacggatcagtcagtcagtttgtcccttgtcgtgtattgtacatgtgttccaccattcaaagtttttctttttttttctctttcgttattatgctcgatcgtttaatttcttttatttttcttctcccggtgtctcttggctcctttggcgagggcatgatcgctgaaacggaggcacgggcgggagggagcacggcgacagggagcacctgttagctttgttgccatcagttcgataggctggtgacaagatgacaagtgacaagcgagcgcgagatgggaagccaacaacacatgcaattgactaatcatatgattcctggcctggagcaacacgatcagctataggctagctcgtccatggccgtgtcaccatcttctctactgctcctctttactcccgtgcaagcgtgcaacccagttccgagcaagagtactcccgtgcaacttaaatccaaacaggcaccgtatattcactagcagtgacgagggctcgctctctctctctctctctctctctctctctctctctctctctctctctctctctctctctaacaaatcatatgccacgtccgatcccctgccatcactggctcatataggattccatttttgtttcttttttgattttttttctcctacgaaaaaaatgacgtgttggtaaccccctgtagtcccggttttctaatcgggagtaagaatccgggactaaagatcgatcagctattttctactattataaaaactgaatatgtttttaccggtactttgatacattatccgtgtataaatcggtttttaagttcgtttacttttagaaatagagaaggagtcgtataaaaaatctctttaaaaaactcgcatgctaacttaatatgattagagttctaattgcatctcatgattttctaaaaaaatactcattccgtcccaaaataagtgcagttttgtactattcacgttcaacatttgatcgttcgtctaatttgaaaaatttttatgattagtatttttattgctattagatgacaaaacatgaatagtactttatgtgtgactaaatatttttaattttttcataaattttttaaataagacggacggtcaaacgttgggcacggatatccacagctgcacttattttgggacggaggtagtatatctaagcaaattctcacagtgaatttcatcttaactaaaccgtataataataagataaaatagacttcacccgttgcaatgcatgggtattttttctagtttagaaaaaaactcgcatttgcatggaacagtgcaaatatccttgaaccacatgacactccgttgtattttatccgaaaaatccccgctttatatctaggagtaaagtaatactcaatcgtcaacatttacttatagctctagcaaatcttaatcattttaattacatggcttaccttcattaattatatcctaacaatatttttcaatgtaaacattaaaattctttgtgaggagtatgcgctagtactaatatttcttcattggtggtggataaaaaaacgcacgtctaacagctctttgaaatgttagaacgataattattttgataaccaaaaattttgaatgataggacaacaagaaattgaaatggaggcgataacattttagagagaaaatatagtacgtaggcttcatagatcgtagtgcttgtagaagatcgatcttaacttcttctatagcttactccctccccccttccaaaattcttcgacattttaggcttggaatcgaaggatactaattgttgaagttttgggctccgcccgatcatcttggacttgtttgccgaattagggataattaattgctgaatttgacgcatgatcattgaatgcttcgaccaaattactccctccgtttcaggttataagactttctagcattgtctacatacatatatatatagtttcattaacatctaaatgaatatggacaatgctagaaagtattacattgtgaaacggaggaagtagatattaataaacctagtcacacatataaggcagattcattcattcattcatatatatatatatatgacactcatatggggcaccatggtgcccgggcaccatggtatcaaatgcacaaaatcactcaaattcaaaattttcaaattgtgagtatatacctagttataataattcgattcatacctatacctatcaacaaaacaactcaaatttaactttatttcacaatccatgattacatacctaactaattatatgtatggatatgctatatacctagaatcaaaatctaacaaaaacaagttcaaattcagttcaaacttgctttgaactagttagtaaagtagttaatgttaatacctaagtaattgaaaaagtttcatactcatttgaattgggtatatactctattttaacaatggtgcccgggcaccatggagcaccaaacaaattatatatatatatatatatatatatatatatatatatatatatatatatatatatatatatatctgtgtgtgtgtgtgtgtgtgtgtgtgtgtgtgtgtgtgtggggggggggataatgatagaaagtcttataatataaaacagagaaaatacttttctttaaaattaaatccacatgaccgtaattaatttaaataaccaattgaaaataaaaagtaagtttagaccccatttgtatttcatactgaggcccaaatttctgtagacggtcctgcgaatggagtatgacacaaatcctctagaacaaagctacttagcaccttgcataaggtggaagaggatgttctaacttagttttctttaactttgggctacataagagtaactaagtaggagtacatctatctattatatactaaaagtccattaaactttttacaaacgctctcaagccgccatgtggcactcctaaaaacactcctaggccgccacgtggcgatttgataaatcctaaaaattctaaagaaaagcaaaacatctagccgtttattttcatttaatctggtggacccattattttcaaccattagatctatcttacaaaattgccaaatcaacaaccattagatctatcttagtacaaaattagcaaatcaattatctctcttaaaatatccttcggtccgtgtacctgtacagcatgtacgtttgtacgtacatatgatcctaccatacttctttttcttttttttctcatttagattagatggaaaacgaaaacaaataattcaagtccatatcacaaccattgattttcctttaaacatggt

SEQ ID NO: 43432 - DNA, 4679 bp, Oryza sativa
tagctagatagtacgtagaaggagttaagaataatgcatatagagagagtggaagaaggcacaatgtgcttagcttcgccttacctttttagcaatagggaatattaaataggagcagcaagaggaccatatagccacaaacaatatatatactagaatgtgaaaaaaaattgaaagaatttatttggttgttggaacacaaagactttctagggtctctttttaaaattttatggcaattggatcggatatgcattgtgggcttcacataaagcattatgtaatttaaattttattaattcataccaagtgaaggccagctaaaaaaatagagagtgattggtttcgatcacacaattcctaatatttcataagaaattttatagaaatatttaaatcatggaagcattagtaatacattacattccaaaaaacaatattgcatgcatgtattgttatatttaattagccatcaaatcatattcacaatggttgagtagagccacagacactatatatgaaacgttcccaaataaattatctatcatataatgcaaatatattggagtatacaagcccgtgaatttaccgtagccgtatgtccatacaattcatttattaataaacaatgagaatctataccaatcttacttccttatggataaaaaacttttaaaaaaattgacgcacagggtgtaatgctgtcactatttatgatatcataaatttgaactcaaaataatttttgtataaaataaaacaaaagtgtaaattgaaccaattgtagaaaatcttataatttcttagaaccattgtggttcttaatttcccttaaattgagacaaccatacataaccactgcatgatttttaagtgactacatatcaatagacttccctctattctatgccatagcagaagatagctggttttaaatattatatttcttactagtaaatttgggttttaacactcaagttgactaaatgtatttaaaaatatatataagtcacacataatataggaagcaaggtctagaatatatctactctatttttgttaattcatatgtaagtacgtataacaaattatatcaaatgtgaaccaactaaaagaaggaataaaacacatttattagaaataaccttttttgagattcgttaaaaataagagcccaaaacatttaattaaaaagaaaaacaacaccttacttttgatttagacttaaagacctacgtcttcttaaatgatgaagaagaataactttatagattgttgcttatatagatgaattaaatattacatattataaactaacaaatatcttaaaagaaatatttaagctatgaatgcgcgaatgcgcgggctaccatcatagttatcttttaaaaaaagagttaagtagtatagagaattttatccagctagggtagtagcttggctgtgacatgggggcaactagaaattatggcaatgatgaggaagagcgaatgaagacaaggcaggatgtctttatgccatgcatcgagaatagagtttgtgggggcactgaaatctgccacggcccctgtttgtgcacgagtaaataattactggtcggtctaccactgtatcatcactgtacttgtctctactccattctctttttaccgtgcaaaacattgctgtcaaattgtcataggagattaacgctgcctcgagatggccttgatcctccttcacaaataggagtacatgtttctaggttatttaacgggattaaaatttagaataaaagatcttggtgtccctcgtttgaagtattgctacaagggattgatagcgtgaaaaggtggttagcaatagagatagaaaaagaaataagagtactacatatttaaagttgatgtaccataaactacaaattgaacgataaatttatcataaaactatactatgttttaggttaaatatcataaaactatatatttaataataaatttatcacaaaactacaaaattgggggtttaagcactaatattatgtttgaattataaatgttcaagttttatatctaaattgatactaaacctgtagtttttttatagctttgttataaaatttatagttttacgatacttcgccttaaatctgtagttctatgattaatttaatattaaatatgtgatatatcaccttgaatatattgttttattataatttgaccaaagtatctgtaattttataaaatttactaaaaaattaaactatattccattcatcctaaaataacaacttagaaccggattagagagatcctattaaacacgtcttgcctaatactaagaacatcgcaatatagagaattggataaaatgtaactatctaggaataggatcggatgtgtctaatccaatcttaaattgttatattttaaagcagatggataataatagatgattgatggacaaatactattttagaacgcctatatgtctagacaaactttaaagggtaattttatcttttctaatgtaaaatttgatacatctaggtaataagaatctcaaggtattaaacattataatgtaaaatttagttaccttaatgtactttctcaacgattgtaaaatttttcaactttaaatgcttgaaatacttataattatgaacacggagagagtatcaaatttgaggtgaaatctaaatgagagatggttgtgattggataagataatacaataaataaaagataaatgagatattgtttgtggttggttgagataagcatctaggtcaaaaaataaaagagaaattagtgtggttaatttagatgatgaaataggcgaggaaagaactactatattttagaaaaaatgctaaagatactcttatcctatctaaaatgtaataatttatagcgttcaatattgcttatttctaaaatataataacttccctcccaaccctcattttaactgaccacgatcatttctcatttcatctttccatctactttcgcatctcagctgatcagaagcaccctcttatttagttccaactactatctttttccaaactctataaattccagggttggatctacggtataagggccgatgtcaggcgacacggatgatttgttatgatgccaacaaatagattttctggatccgccactaattaaatcctcatattttgtgacggtgggaatagctcataggagtactttctaacgggggagtagtgcatctggtgatctgtactgaaacattcgcaaatgcaggattagatagacgacgcacatgcgtcgttgctcattatcctctgcccattgttctgtctctggaaatgtgttctgaagatctctgcacagaaagacgaggataaaacaaaagaagcagacacctattgacatattactattgagcactcgataggtttgctcctggaacacagcactataatgtgatatctgaccattcattacacttgcttggagtactccagcagtccagctcgccaaatgcttgtttagatcgggagcaacttgctcttgctgcataatgattccggagattattgctactgtggcgccactttgtttgtagacaaaacgtacgggtgttgccttttcttatctcgcttcgacgttgagggcatggagagttggagacatttggtcagcgcactattctgccgttgtgaagaagttgtttgctctcacatgctcttgttttctttgtagggtcatcgagataaaaaggtgtggtacgagtaatttttactatttcgttgtgacgtactcctagttgaatttcacctaactaatgcatagtgcagaaatgcactagaagctccagaagatctcaagcagaagcaagtatagcggatcattgatgatttggaggttagagttgataggggtaagtgatgaattcgacatcacagagagcagagtttcctataactccgaagcaaatattacccgagagtatcaagctaggtcagatggatatggagttcttctctacagctgaaaccctgcttgaaaggtagcagatcagaccgacattctgctgaagtagtgattttgaactaatcacaacatttttttttacctccattgtgcttaaagcagtaactgcgaaatgcaaactgctacaaaagtaaaaggtattctcaagctcctgttgctcccaataatgtctcagagagttacagtacatgtgtttgattctgtcattcgcagctcacactacaacatggagtttgttctcgatctgactaaaggaaccaaagtcccaaacaagtaggagtacacattacagcaaagcccagttaatttgagcccataaagaccgatgtctattggaccactagtcatactggtatggaaaaagtatacttttcactccctcaactattgtccgagtatgattcatgtcctccaaccacaaaaccgggtatcctccaattatcaataccggagtaaacaatatccctcggtggttttggagatagttttagctgacatggcgcctacgtggcggtgtcctacgtggcattagaataaaaaattaaaaaatatgtgggacccatatgtcattaaaaaaaggattatgggacccactgacatatgggacccacatgtcatcatccctctccttcccttcttcctcctcctctctttccttct

SEQ ID NO: 43433 - DNA, 3715 bp, Oryza sativa
gcctctccccaccgctgtcgtcccaagaagggaaaggccggggggagagagagacacgggagagagagggggagaaagaagagaagaaaagggaggatgacatgtgggtcccacaatatattttttttaatgacatatgagtccccacatatatttttatttttttatcctaatgccacgtaagcgccacgtaggataaagacttggtcaataccgccacgtaggcaccacatcagccaaaccaccgagggatattgtttgcaccggttttaatagttggaggagtcgatatacccggttttatggttggaggacatgaatcataatcgggcgatagttgagagagtcaaagtatactttttcctactggtattgatccaattgaaactaaagcccaaacagatcaaatcttacggatgactaggggaccgcctattcatcactcgggtgttttgagaaaaaatcacccagatttttttcttcccttggatttgcatccaacggactacaaaataaaataactaatacaaatttacttacacaatatttttatcaaaattacagtgcacttacatgtcatatcaactaaatttacatatgtaattttagttatataggactgtaattttatatttgaaatcaaataattaatgtaaatttacttacacaatatttttatcaaaattacagtgcacttacacgtcatatcaactaaatttacatatgttattttagttatataagactgtaattagaaaataataagtacatatttacttacacattatttttatcaaaattacagtgcatttacatgtcaaatcaactgaatttagttatataggactgtaattttatattttaaagaaaataataagtacatatttacttacacattattttttatcaaatgcatcgcgtgctgcggcggtgcgggtgctggccacggacccggatccaagcggcgtcgtgtgtgcgatgtgatgtgaacggggaacgagtgcgggcgtggtcgtgtggggcagtgagtggaccgggattggagttagcaatcagggttaggcatgatgatgggctgctgggctgttcgtgggcttctatgccttgtgcaaagatcatgtggcaaaaaaacgtcaaatgccaggaaaaaaatcacgcgggagatgtttagcaaaatcgctagcgctaagcctctcttttattagagccatacgagagcccacaaacatgtacaacaccctatcttgtgtccgttctcatgtctgctcactcactttagactttgttgaaatgctaggttcaataattcatttagttattagttactagcagtactatattcacaaacaattgctggattagtgactgcagttctgatcagtagtcaaggcacatgaagagagcattacaaacaaagtcactgactaaattgtcttagcagtgaagaaattgttaatttaacattaggtaccgaataaactgaagcgattcacattgtgtgagtaaagctgtacaaatatatagagtcaaaactaatcgattagtcgtgaactcgtgataggcataaatgatatagtaagtgcaacgagtatagatttattctttccgaattagatttatgcaaatgggaggtgaaatggaaaacttttaatgatcttacatgcttatgatgatgaaaatgttgatttgtcaccatgaatggtgtaagtgtgaagatgatgcttatgatctctatgcttcatactcacatgagctcgaactgtttcgctatctttataaaattaaagaaaaatgaaaatagagcaattatcttttgtccacctaaaaaaatgctcggatcaagagttacagttgcatttttcaggttgcttattcagatacaagtatatataaggtataacccaatattaatcagaccattgaattatcatccctggctccctgcatgccaccagcgtgcacgtaaagcttcacgaatcacgacccaatgcaacttgatcattaactgatcatacttcagttagctgcactggcacgtcggcgcttctcgtcgccgcgtggacgccggcgagccgccggccttgcgctccttggccgccgcgaacaccctggccgcccactgcgcgaagtaggcctcgtcgtggccgatctggcggttcttgtagcagctgaggatgtccggcgagccggggcacggctcgccgtggggatcccaccacgagccctcgtgccgcatccccgacctgtccgcgccccaccggtacacgaactgcccgcctcccgccctctctcgccaccccttggggtagaactccatgatgctgctgttcctgtccatgaacaccagattcgtcatctgcgccccgtgcgacgagatcagcacgtccgtcccgctcatcaacttcacctgcgagaaaaaaacggagagaaaacacgcgtgttacattacactgctcgttcgtccatgcgtgcatatgcatggagcgagctgggggtacgtacctggtcgcagaaggtcaggttgtcggagcgcgccgtggtgagcgcgcagccggcgacgcgcgcgcactcgctcttgaagacgcgcgtgactgcggcctgtccttgaacgcccgcgcgcccgtgcggaacaggatggtgacgcgcacggcggcggagtcggggtcggagacgtccgccaccacgccgcactgcgccctggccttgcaccgcatgaagtcgaacgccgcgagaagcagctcccgggtcatcccggccatgatcggcctgaacaccaccgcctcctggaagcacacggggacgttggacgcgttgaacgtctcgacaaccattcccacgccggtggtcgccttggccaacgacgtcagccacggggttatcccgagcctcacctccccgtggtggaacaagggccacctcgggggcctcgccctgcacccgctcctcgcgtgccacgacgcgaacgggatgagcgccgagatgccgtgccacaggttgctgtggtcgtacgccgtctcggacacgtacgcgaggcccggcctgagctccgcgccgcccgggagcgcgtcgcgccacgcgagcgcgtaggcgttcctggtgccgtcacggcgtgacggcgccgacatgcagaggaggcggccggcggaggccgcggacgggaagacgatgttcttggcctcgccctccggctccgacgtgtcgtcgagcgtgctgatgaaccacgtctcggcccactcccgcgtgtccttcagcgggaggaacgtggccgaggctcgcagtcggtcgacgtagtcgtcgccgccgccgccgccggcggactggccaccgcaccggaagatcggggagaagaggcccagcgtctggaactgcaggtagaagaacaccgcgagaagtagaggcgggacgaggcagagcgaacccttgacatgcttcaggttaccttctctgctcttcttcatggctgtcgagcataatttcacacgacgacgctcattgtctcgtgcaaatgggcacgccgtatgtatagattgatacacagatctcactgcagtgattctgcaatctacggaggccaaatcagacgttgacacttgacatatatcatgtacaatttacgtgtaagtaaagacgtgaattggagttacgacgacgagccataggatggggtggtttgatcttttctgtgatataataatttgggtaccgagctcgaatt

SEQ ID NO: 43434 - DNA, 1147 bp, Oryza sativa
ccagcgccagcgccgtcgtcctcaacctcgcgccggcggcggcgtgaggagtacgagaagcaaagcggcgcgagcagcagcggccagccggcggtctggagaaggctggagagccacttgcggttgccgccgcggaggaagtaggcgcggaggaggagcggcccgcacgccgagccgaccaccatgaggacgaagttgacgacgaggagcgggctcctgaacagtctaccggtgctcagctgctgctgctgctgctgctgctgcttggtggtgatcgcgttcttgcatggctgtcgctgcgtcgtcgccgcttccacctccatgatcaacaaagtgagcccgagaatgagatattgcgaggatgatgagtgtgcacggcgacacggcggtttatatggaaaactcaattcattccctggggatatccctcatttatacatgtcattttaaaagttattaaattttttttaaaaaaattagtatgatagatcaatattcctatgtgatatgtcactttacaaacatgtaaattcaaattcaatttatacaagtatataaaaaataacaaatttaactatgaatagaatacgtaattcacggtcaaatttgtttttttttcgaattgtataagtcaaattttaactcgcatatttgcgaaaagatataccatatatggatctatcttgacaattttttttatttttttatatctttgtaaacgacatgcacagaaacaagaggatgtctctttgagggacaaaaatccacttccggtttatatggcatacgggtgcaccgtgctgtgtaccgtgtacgtcccgtgcaaaaatgatttcggcagctgaggttgtcacgacacacgaacctgacagctgaggttgtcagcttccggcgacgtccgctcggtcacctctcggtgatggtacactgccaccaccaccaccgcaacagcccatgtcgagaacactaacgcgcgcccaggtgaccaggtccagttgcacctagctaggctcgtagcgcgaatgtgccttttctcattgtcaaggcccaattaatggcttggcacaaatcgttctaccatctcggtgcccgagagattgcttggcacaagagattcgattgagacccatgcatttgagagctatcc

SEQ ID NO: 43435 - DNA, 3128 bp, Oryza sativa
  unsure (1)..(3128): unsure at all n locations
nnnnnnnnnnnnnnnnnnnnnnnnnnnnnnnnnnnnnnnnnnnnnnnnnnnnntaagctcattttaccgtttttcgctgtccgagtggatcgcaagttgtattgcgtgggttgcgtcccctgaggcgcgtcgggaagctgtgacatgtctatctcctcggcgtctggtacgacgtagtcctcatcctcctcgtcctcatcgtcatcgtcgtcgctaggtggagccggcgccttcccctttcccctcccttgcttaatgcgtgacgacgacaagccaccaactccttcacgctcttctatcctgatagagtgtcgagcagtacttggacgcccggattgaggtagtggtggtggtagtctccccggttggtacacgtcgtccaatctaaccgacctgcaacctaatcttgctgcaagtttctggcacctttgacgaactttctgcatttcaaaaaaaaaagaagtttgttaggcataactcaagtaatgcaaagtgctaaataaattttacctttaaaacattgcggagcgtgttctccgtgtcctcaccacccctcggagcttggagggcatgccccatttccattcacactcctgaggagctctctctactgaaagcgtgaaaagatatacgttagggtctagggtgcaaatggaagtaactttgacaaatgcaagtgtggctggcgccgccacggtggcacgggcacggcgccagtgtggctggcnccgncatgtgggggtacggcgccaggcactctggctcccgaaaaaggactaagtcgggtttaagggggggcacgggtctatttgtgaaataaggtttgaaaaaggaccgcactctaaaagattgagctccttccgtcccataaaaaccaacctactaccgaatatatgaatctaaacatacatatgttagattcatagtactcatccagttttagattcgctttttatataacatagggagtaggaaatgaatacaatgatatacaatgaaaaacatttagaaaatgaaaatccatgaaaggcatacctgaaaattctctaaatttatgagaaaaataataacgatataggcaaggaatacattcatatttgctctgttcagaagctggatactgcagctggactgcagcagcttgaacagtgtttctattattgatttacagagcaacggctgcagctgtgatgcagcgttgccgaacacaaccattaaatctcaatttcaaactcaactttgccgaacacaaccattaaatctcaatttcaaactcaactttatttgataggacaaaaatataaaattaacactattcacccaaattttatattttgtttacttccaaataaaatttagtttaaagtttagagtaagaatgtattttcgtgccaacatctatatttaacattttcttttaatttataaaacttttagaaccggttttcattggttttccttttatcacatatgtccctaagtatctatacttatctatgtactatttaggtgtccgtgttttacagtaagaatttagccacctttttacataatttagctctagcctctgtttgaattattacctaaatctaaatactagatattatataacatcaattctttaaactagacaaatcatcccccttactaaatccggtgcgttttgatcttacatgccagttcaatcaaccaaaaaacaataggccccacctgtaagtgattcccctcccctctcttcctccgtcgtcgctcttcgcctcctgctgcatcccagctcgcccagcgctgccgcctctaagaccgagtttccaaatctacgttcatctgtgccattacaggcaaatttgggaggggagagacaagtgctcgcacccagcatgcaacgacggcgaggagggctcactcgcctccactcctcttcaatcttccccttttccaccagattgatttcggcaggcgaaacaagttttagtaagacgagtcagccgccgccacttatcttcccctcttccatcagatcaaactcgagagacagtagagactccgacgaggtgacttatgcatgagacaggaaggtaggctcaaggtgctcaccaagtgtggctacttccacggttccaggagaccgagctcgagctcaagcaactacactatgctcatgaaagcaacgatggtatctagaagacggcgatggcggtgaatctggagctcgaacttaagcttcacatcatcgtgctcactcctcttgctagtttcctcaacatccgtcatgctgcctgagggactgcttggttatcgcccgctaccaaacgttgtccgtccgactccctttgctccatttcgtgcttgcggctgaggcccccctcgatgtcgtcttcgttgcgatgttgcctactagggtcaagctggggaggggataaatataagaaaagcactggcgatcgggtcccacggattttttttctaactagactgtcacgtgtgtgccacctagaaccaaaaccgatttagattgagtgaaggggataatttatctgggctgaagagtttaggatttaaaatttctggttttgtagcttaggagggtgatccggtcaaacataatagtttaaagggtaattctaactttttccttattagattcgcataaaaagatacttttgtatacttataattttattatgttacataattgatatattagaaaaacaaacgtcaattaattaacgttttaggtaacagaactaaatatgtccaatattttgaaatggagtgaaatagaggaagtagtattattcgaccccgaaatttagctcaggaaaaccgtggagcgaacacgtggcaactggcaacaaaataatcaccaatcaccacacgcgaatgggagctagatttcgttaggaaaaatctcaacccacccaccccccaacgaaatctcccatcgaaaccccgtcgaccgcaggccgcaacccgcgacgcggacggcctggaaacgtcgcgccaccagcccacccaaggtcgcgtgatttcaccgcacgcccatcagggccaccacccgacacaattactaacgccgacctgcttccacaccccccgtgctctccaagaagagacgcgacgcgaacgca

SEQ ID NO: 43436 - DNA, 4408 bp, Oryza sativa
gcgcgctccgcgtgctccctcgtcggatcctcccacgagcccaccaccgtcgcccgcaagcgcgcctgccgcgagcccaagcctcgcccggagaagaagaagaaggatccctcctccgatgacgcctccggccggggcggaggcgggggcgtggtccagacggcgccccccgcgagcggccgggccgcgccggagagccccagcagggggctgaagcggaagctggggtgcatcgagtccgccacccggatggggcggaagaagcggctcgagagcgagtacgagctcggcgccgagatcggccagggcaagttcggctccgtccggatctgccgcgccaaggttggcggcgaggagttcgcctgcaaggcgctccccaagaacggggaggagaccgtccaccgggaggtggagatcatgcagcacctctcgggccaccccggcatcgtcacgctcaaggccgtcttcgaggacgccgacaagttctacctcgtcatggagctctgcggcggcggccgcctgctcgacgagatggcgagggagggcaagttctccgagcagcgcgccgccattgtgatcaaagatctaatgtccgtggtcaagtactgccacgagatgggcgtcgttcacagggacattaagccggagaatatactgctcaccaaggcaggaaagataaagctcgcagattttggacttgccgcacgagttgccgacggtaatttttttttcttcatcttagattgatagtgttagtgacactgatactgaatttgaggctctacaatgttgagatgcgctctttgaggataatcttatgctgggatgcctcgagttgtctaagttatgaggaaacaaaaaatgtgcctgcaccaaaatgcattttttgttgtcatcagaaacaaaagttacccaaaggtagttgaagatcaactggaattctagcattgaattatagattaaaagatggtatcacaaagttagcatggacaacgttttagttaaactgcatctaacatgtaatattttgttgtgttattgtgatttagaggtgggtgccaggtttccaccacaattccaacttattaaatcttgaccactactcttttaccatgatcactagtatttttgcaggtttctcatatctactggccatgcatatcagctaaatgtgatgttaatatgttgggagttgtcatacccttatgagtttaagaatttaagcaagcattgttagcctggatcttcttggtttgatcatgtaacaaataaattaggctaactcaagtttacaaagttatgaggtccctcatttctggagtcctgtttaacttgtcattggcgactgattcagtgttctgtgtggtaccccacaagaagaaatttgttctttcgggatacaaacgagtgcaagctgtgtgttttggagtcttgagttggtagcagtgtccgttcacatgtcatctccatttgataggtatgctaaaagaattaaaattggtgagtcatacttgctattgggtttttgcttgggagtgtcatagctaattagttttaatagtttgcatggatttaaaagttcaaaacatgtgctaatggaaatggtccttgaaattgtgtgccaattcttaaggaattcttgtgcgaattgatatttggccggtctgaggctcaatgtagtgtccttgggcatttatgactttagtgatcagccggtgtacacactaaacagggcatttatgactttagtgatcagccggtttacacactaaacagagttaaagagctaagtgcactacttggtctggttatctaattcatactcatgaataattaaattttccttcatgatatgagctaccttaccttctcctgttaagttggcagtggttaattctttgatagtagtcctgtttaatctggtgctgtttactgatttaatgtttcacatagtggagcacgttctcataggaaatatctagaagtgagtgcaagttgtatcttttatgtcatgaattgacatcaattgctaagagaagtgaagctttatttgatctctgttgcaagatcagtcatacctttttttttaagctaactctgctgtatctttggttctaggcctgtaatagtccaaatccacctctaatctgtatttcgattagatgcgctgttgatttacttggactctattctttcaatcatgctatatgtagttgaattttgatatttacacttcctttccaaacaacacaaaagttttgtgaatgcactcagcttagtctggcctagtagattagaccattttcatttaatgcgtgaactgatatttttggtcttaattgagcaggtcaaaaattgtctggcattgctggtagcccagcttatgtggcgcctgaggttttgtctggatgctactctgagaaagtagacgtatggggagctggtgtgctactccatgtactgctgcatggttcccttccatttcaagggggttcactagatgctgtctttgaggctataaagacagttgaacttgatttccacagtggaccatgggaatcaatatcatctcttgcacgggatcttattagtcgaatgttgaaccgagatgtaccatccagaattactgctgacgaagttcttagtaagtgcaagcagtttctcatcttgcattgcagttttattggattttgcgtttacattgtcattatttaataataatgctatttttcaggtcacccatgggtcgtgttctacacagagtgccctttgaaggctgtaactgctaatttgagtattactaacaatatcgtagcacccagaattacatgggacagaattaggttacattgcgagtcaatatcttcagattcatcaagtcagagatcagcagatcaggatgaatgtggtatagttgatgcactgacagcagcaataacgaatgttaggatatcagagccaaaaaggagtcggctgtgtaacccagccattcccatacagcaggaatgctcttcaaacttgaagagcaacctctgtacggcattctgacccgacctgatgtacagctcctgattggaatggtgcatatttttctcgcagaggttggtctgatgccagttaaaaggctccatcaggtggtgtctctgagctgaggataataacctgggtttctgtcaaatcaaataagcgtttgacatgggtatgatgtagtttttatctggtgatgctgataaaccggccattagaaggccggttctgtaaattttgtaaatatcatgatccccttagctcctgggttgctaatctatgcgtacgtagcaaattgtttcaattaatgttgataaaatatcgtgtgccatttccctgtgcatgattcatcttgtttctttccagtctattgagactaattttgttggcagaggttttcaacctcatatcacaaaattcacttctctaaacttttaacgtacttcatcatggatctatatgcccttgttgtaatgaaggtataatttgttagaaaggaagttttaaagtatttcatcagggatataggccattgttctagaataaaggtataattaactagaaaaggggctatcttaagctgatacacatcaccaacatgacatctggtgcatctgtgacatgctatgctaccacctgactttggccatccctagctgcaccgacgctacgccatgttttctgtggttagtgccggcgcctttgacgtcctgcccaaaagctctcgactttgtagctggccggccactaaccccgcaagctaaacgccagaacaaagacttccatcttaaatagtttccagttcttttgaaattatctggacagctaaagtgtccacttattttacaaaatgtgagtaatttcgccagcttttggaacttgatactttaatttacagcatgcaaaagggtacacgagtaaaaactactccatatattcgttaccagactgtcactgtttcatgtcatttaattggagccttcgagggtagtcgagtcagtcacttgcctcctaaggaaatttacggtactcctctgaaaacgtacgtcgtgctgaactatagtgtgtccggctattctcattgccggccaagcctttttcttctactctttttggcatggaactcaatacgtgccaaagataatccatgactaaaaatgattttagtcaagaaaaaacatagtatctcttttcatgttcatgtccctaccctgttaacctctctatatattttcctatcagctcaactgttcaagttggtgcatgcatacagcacaatgctttgaaatgtatgcttagtttaatactcctacgtgattgatgtgctcattaattgtactagatagaatcagaccatatgtgactcactgcctcaccctag

SEQ ID NO: 43437 - DNA, 855 bp, Oryza sativa
  unsure (1)..(855): unsure at all n locations
ccaaattcctggaaatggttggcttggttgtctacattatgcacaattgcacatccttgaatgtatcacttatatcttaatgtctcttttgaaggtattgagctataaatgaatcctgaaaagcgtttaaacaaattcaaattcccatggaactattatttgtaaatattgcagatcagtatacaattccagacttgatatctccacttcctgttttactccatgtcaaggcttaggtcttttggtccaacaattccacgcttccccttcttatgtgattccatcttatctatatttattggttaatatatcagaaatatttagtttagtgcagttttttttatcatgactttgcaagttatgttgtgtggcatcaatctaagatcgttaataatatctatgttatctgttctataaccaatgtgctacttcagtaattccctttttttggttgcagtaccttcaagtgccagatatctcactggagacaaggccataaagatgaatgccatccaccaagagttgatgccaggcctgacaatataacagtagtttctagtgttaaaaagggtgttggaatgtacaattcatttgaacaaagtgtgaaatccagcgtagaaccagcggttgaagtcaacaagtcagttgctgctgtgcctgaattgtctgaggcaaaccttgtctccgatggtgtagataatgaaagaaagaagatgagaggtcagaaggcatctattactgcaaaggtttctgaggatgtccttgacaacaataggattagatctgttgatagttctagcctcccaacttctggtnnnnnnnnnnnnnnnnnnnnnnnnnnnnnnnnnnnnnnnn

SEQ ID NO: 43438 - DNA, 1446 bp, Oryza sativa
ttggagtagcatcccagttaaaacaaaaaaaaatagaaacctagcatttcgttaaacaatactagatgtaaacagaactccagaacacggtaccatatttattaggattatatattagtctataggctgtttgacattttgacagtggtctagattataggaattgataagctggggtctagatcacatataatatacccaacagaacaattttatgtaatctatgtgcatatttattttcctaatctgaagaagacatattaacaggttatctgaaaataaggtaattctctgaaagcagcgccaatgctcaaaatccattgagccaaagttgattgtacaacaattctaattggctgatatacttactcagaatcaaacaataatatcctcatacagaggaaattatagcttatctggtatttacatataacacactccatacataacatcaccacatagcaaaatcttgctttttccaaaaaaaaaaaaaactaaatattaccagttagaactaataaaggatttttgtggtcattagttctcatactgaatattacacataatggatactttaaattcctagaagcactgttaattgccatactttaggatttactcctatttctggcacatcttcttcacagtcccacacttccacaggcgctaatgctaccactgcttagcacaactgtgcaactgtgccagaatacatgtcttgcaagtgctgtccgtgaccattattccactagcatatcatttgattgaatttatcattttatattagaagcttcagaaataattgtcagaggtaatgcaggttctagcatgtcggtgttgagcaaatcatgtgttgaagtgttatgcagtttctggtactccaagttctataaagttctatgcaacaaatatttgggaaagggaaaacacgctcaagctcaacacaaagaacaggtgcagtggtactctattaacatttatgaaccattcaaatcagtggcgtagcagcgcccttgttttttaggaaagccaaactattttttatgccatttgcacaatgccacatcataatcaacatgaattgcacgggaaacaactcgacatgaattgcacgggaaacaactctaggaggatggtaagtcactgaccagtatttgacccctttgcagcgcttgcatctaaacgtggttggccttcggcacaccacgcacacccctttcaccgccgccgccgccgccgctgcctccgcctgacgggccgccggcatttccaactccaccgccgcggcctcctcctcctcctcctcctcttcgtcctcccgcggcgaagccacctcgggcaccgtccacagcggcgcacccgccacgccgcccctcccccgcgcgtagcagtacgcctcgcgctccgcgacctcggtctccaccgccgcgagcctggcgaggcgcc

SEQ ID NO: 43439 - DNA, 3010 bp, Oryza sativa
catcctttaataaaaagaatgctgtttttttgggttcctttttcaaaataataaggtcaactagtataattttctagtgatactgtatcatgcaagattacggcctatgcgacttctcgtgactcggtatcattaggtgcttgatactctcccccaaaaaaagaaacttgatagtactcttttcttttgctttactttaacagtttaactataattttgttttggggccactttgataaactttctggaggaaagaaatgaggtcaccaagttaaggcgtgtgcatgcatgcaggggtgagactttgctccaagcatatctccaagcatgtcagcaaagtgcttagaaaattgaatattgataacccaccaggttcctggccacatgtcattgttgttcgtggtgcaactttttggttgtttgacacatttgtgaagcttgaggtctttttcacgtggggataggttgggaatttggatgccacggttataagtttatcgcataggccacttttttcatcatcgttgtcgacgttcttgtgaaaagtgctcaaaggtcgttagtaagtatcagttgatatagatgggtagttggacataagcatttgtttcttcatatgattataaatgtcaaaatatgctcacaaaagacgtgcaattggatattaaatcatgagatatgtatcttccctggttcactattaatttcaaggctctttatttcactctcaccttagtgtaatgtatgcattctcgatttaatccacggtattaaaaaaatcttgatttgataatacacttagatctttttttctaatggatattgactattattggaactttaaagtttgtattaattggtatctccatctaatcaagagtaacatagcattgggcatgtgcgtatttgtggattgactttaccttctcataataagtctactcacttcttgtccaacagaactcaacgattctataacctttttttttctgagaaacacaccccttcggaagattgggcgggcacaacgtacgcacactcacccctatgagcatgccactaaaagaataattagccataaatgcgagcacccgtgtcaaatctaggatttgcactcacccctatgagcatgccactaaaagaataattagccataaatgcgagcacccgtgtcaaatctaggatttgaacccggtgggctggttccaccacaaggaacctagccagttgagctatgctcacttcataacgattctataactctcaattcttgtcaaatactccatccgtttcacaatgtaagtcattctagtatttcccatatttatattgatgtcaatgaatctagtcatatatgaatgtagaaaatgctaaaatgacttacatcgtgaaatggtggaagtagaactcaactattccataaactctactagctatattattctttgttttcatcaactattaccacttctcacaataagtgtttctactatgtattgttacttctgccacctagcgattgatctacctccaaggcaagttaggtgttcgcttaggatccgacacttcgtatccaccgccgattgctaatttgctatgccgaccgatgttaatatttgaaacaaagctatcagtcattggaaaactctgttagtcaccaagactcaattgtgacattggctctgtcatcagcatacctaaggtacgtttgaatcttctaaagataaagatgaagataaagattaagtgtttcacgtaaaacgatatgataataatatgtgattaattaagttttaattattacaaacttcaaaaatggactaatttgatattttagaacaactttcatatagaaagttttcgcacaaaacgtatcgtttagcagtttgaaaagcgtgccacgataatccaaaattttatcatctactagtatggaatttcaccatgacagttctacaatgaccttacaaataagtaccaccagtgtaatacttatattgaatatattgtatacatgaacgaatactttgcactgccgcttacaacatgcatgtgctgcaaccttctccttttcatgacgccataggccaaaataacttttcaattagtatccttttccatcaccatcagcaaaattctgatagagacaaacttaattcattgttaattaatggaatcttattgtagatccttttaggtagttgtgctttcttccttttcgtgttctccgatccgctgaacattcaagaagaattagttgtgattagctgatatttgttggcatactactttgcgcagttaataattaactatggctgttgattctcaactagatgaaatacatgccaggtatccgttatttaggtgagaaatgtaactattgaatgtatcattttatcttttgcctaaagttgtttcattattttaagagagattataactctctggtttggtgctggcttatcaacacacactgtcaaaatttaaatcataaaacacaattgtagagttggtttttggccttttcattacatatagtcgttttttcagctctggtttttaaaccattaacaacaaaaatataaaagttttagctataaattatcttcattgttacgtttatttttctatgccttacccatcgtaactccagcaataagtgctaagattttatttattgctttttgtttcattctatgattacagaaaaaaatctaagttaacattttataagttaaatgagttggttaatttgagaaaatcataatgtgtattgttttgagcggtctatttatgaaacccaattttaaagttgaaacggtacgaaaaaaaagtgtactatataacccgcagattttagggtaaattaaatcatgtcattgtaaatgtgcctattcagaaatgttatgataattcgtctattcgtagcccatgtgtcgaggagtgatcctctctagcgggaggacgtgaagcccccctttgtgagtttgcccgggggaatagggcgcga

SEQ ID NO: 43440 - DNA, 15256 bp, Oryza sativa
tgtcctcaggtggcccccagcgccgtcctccgcatgacacgggggacactccttgtcattccttcataaattcctggagacttttgtgggcttagcgccggtcggacattgatcccccgttattgatgggacggggcatacctgacacagggcgggacgtgggtgcgctgtacccgtcccatccgctggtggatggtcacagcccagtcagggcgactgacgcacgtctaatcgctgggcggcgcacgaccagccacgccgcattaaatgcggcgagggggcggttggggcggtgcccataaatgtgcctgatagcgctcctatctccgcccactcgaccgccacgtggcagccgagtgagggcctcagggtggcgcaacccctcgagcccgaggggtgcaacgggacaccccgaggcccctagacggaggtaggcgcctcttcggctattcgctgcctgcgcgtccgtcccccccgacgcggggggggggggggggggtcgggccgcgcggccacatggctgggggaaaggattttttccctttagcgcacgtacccctgggcccatatcaccgacaccatgccacttaaattttataaaattaggagcttgccactgtcgtcacgttttccatccatatctctttttttcccccattttcttccttctttctcctgtcttcttcccttgagcgatgttctcggcaagagaggagcagcatggtggcgtcgtcctcaccgcacgacttgcacgactacttggatgccgttggcaaggtggaggcgttgtccgccacgacagcgagggcgtcggagtcgccgaagcattgggcgggggcgttgcggaggaggaggtggtcgaaggtgaggcggatgccagccgcaacggcctcgttgctgcaggcgagcccgcacacgcctggctctcggtggcagcgtgacggagcagctcctctagctcgaccacgtggcggtgagcagcgtcgagctcggcctccttctcccgtagccactgcagccaacgccaacgccatgcgcaccagcacctagcactgcctctccgcgcctgctccagcccgtcgtgcatccgctcacactccatccgcactaccgcgtcgatcttcgctctatgtaggcacatctcagacaccagcgcatctcccatcactgcagccgaggccactgaccaccaccaaccagcagtagcgtcgtgaatgccgccatcgccacatattgctccactatctccctctcccgcttcctcgacacccccatcaccgcaccactacaaaccccacagccattgttgcacgttagctcgctctgcgccgtgtcactcaccatgatagcgcagtcatacccactgtcgccattgttgaagcaaccacccaacgttgagaacatcactgaaggaagaagacgagaggaagaaggaagaaaatggggggaaaaggaaaatggatggaaaacatagcgacaataacacggttctaatgttgtaaaatttcagtggcacggctataaatagacgaatagtaatgttatttatctgaataggcacatttgcaattgcatgatctaatttaccctcgattttacccaagtttgaaaatcaacaataagcttccaaacgaccaaaccatacacaatacatccctaaacttccggggccaacccattcaatccaaccttctcaaggtaaaataagatgatttttgtttgtatggtgtttatcatcgtcatataagctaaaactcggggcaaataataaagcaaacgatttgaaaagttgaaagatgaaaagtgtccggtttaaaattagctttgattttagaatttgtaaaattaaaatgcatcttttttctatcaacggtactttacttaccaaaatgcacatagcaatttccatttaacctataattttctgaatttgaaaacacctttttcactctttctcccttttcaaaaggggttaatttgatccatgccattgcaaatgtgtctatctaaataaatgccattacaattcgtctattcgtagtcgtgccattttttacaaaaaatgtaaccatgccatcgccgtcatgttttccatcatattccctatctgcacgtgggacccacccgctagattcatcttcttcctctatcctcacctcttctctccttttttccatccctctccaccacttctcagcctccataactgggggagtggcatgggtggagcgatgaggcaggaggaggaaggcgatgaaaggggaagaggtggttggcttcggtgcggggaggaaccagaagaatccatcgccggcgagaggctgctgccgcatgggctcgccgccggccatggcgcctgtcagggttacgggtaaggtataccctctacccctcgatatacgtcacatatcgatatggtatgcttgcgcgtatacagacgttctcagcataagttaaggaagtccatcacggagtctatagatggaaagagtcctactcggatagaactgggtcgtcattgtatcgtgtcgggtccgatatctccgagtcctacttggagaccagttgacctgcggtataaaagggaccccccgggaggacctaaggcatcaaatctcagagccaacacatccaccacagcctacgaagccggagcttgttggagccaagtcaccgggagatctagtcggatcaactcaactacgatcccgacggtatcgtcgagttccgctattccctttgtaatctgtggtttctatcatataatcccatatcaactggattagggctattacgtaccaaggggcctgaaccagtataatccatgtttcctgtttgcttgatgtcgtactatgtagatcctcgtaccagcgtaccccaataccctctatatccggtttacgggtatcccccatcgacagtggcgcgctaggtaggggcacttggtgctcaaggttctactactatgacatccagcttcgtcgacaacagcgtcaacaccaacctcaactaaggagttcctacttcaacaacactggtgtggactcaagtcggcgaaattgtctttccggtttacaccacagtgccgatcttagctggtccgccaatagccggaaacgagaacgcagtggctacaacccggggcgactccatgtcgaaggatcctcccgccgaagcggagatcggaacgtcgacgacatccgagcccgagaaggatcctagtgcggccaagccttgtttttccaataggaatcacgagccgacgaggattacttccgaggtgacaaggtcctggtgtcctatccacaaaaccaggaaacacttcctgcaagcctgctgagtctttctcaacgtccatgctgaaattcggcctgcaaagagcgtgaaattcagcgtacctctccaactcgtgatgtctattgttctattcacaagacaaagaatcacgacctcttgagctgcaaggtctttctcagcgccatgaagacgccgcctcctaaggtacagcagtcacgcatccccatcagggataaggacaaggaacaaggagcgacgccgatttcagatcgatttattggggtaatcgacattgatccccacgaaccatcagtcttgcacctgctcgaagacatggatcatcgacaacaagtacgccatgtgaggtattggctattgatgatgtcggcacgtcagcgtgcaccaatacggaagcggagaatcaagtgactactctggcccagcacatcagagctgtcaacacaatactgagggaaaccccctacgatcccgttctgaacgacgatctcgcacgttggatagaacgactacgggaatcagtgaccaacctcagcaacgcgttcgaagaggccgctgccgcagcgcacccagaacagccaccaaccgcgatgctaatggtgaaaaccctgaacgccgggaatcgcctcatcgagtcacccctccacctcgcggcaccggcgatctccgcgatcacctgaacggccgccgagaggcatgacgcacacgagacaacgagaaccgttcacggcgtcatgtctcttcacggggtcacgataacgaagatcgaggaggccgttcaagcgaagaccaagaccgtgataaccgccacaaccgccacgatcacgacgatcgcgaacggcgggtgctgggcgatactggtcgaggacgtcgccataatgacgacgatgatggagattggcgccgagacaacaacgggagacgatgacaggattctcgagaacccggccgacgtcctcgtaatcgtacgccggaaccaagtgacccatcgtcatcgttatcatcctcgtcatcttcatcatcagacagacatccacgaaggacgtatgatcgccgacaacccaccgcccccagcgctgggtgtagagctttcggtcgttcacttcgggatgtccaatggcctgaaagattccgacctggagcaatagagaaatacgatgggagcactgacccagaagagttccttccagtttactccacagtactctacgctgccggagcggacgacaacgcgttggcgaattacttaccaaccgcattgaaaggctctgcacgtcatggctgatgcatctcccccctactcgatctcttcgtgggcagacttgtggcaccagttcgtagccaacttccaaggaacttacaagcgccacgcgatcgaagatgacctacatgcgttgacacagaacccgggtgaatccttgagggattatgttcggtgctttaacgagtgcagaaacacaatccccgagatcaccgacggttctgtaattcgcgctttcaaatccggtgtcagagatcgctatactactcaagagttggcaacgaggcgcgtcacgactactcggagattattcgaaattgtcaatcgatgcgctcatgcggatgacgcactgagacgcaagaacgacaaaccgaagaccggaggagagaagaaaccagccaaggatgcacctgagtcaagcaagaagaaaaatcgcaagagtgggaaaaggaaagctcaatcggaagttctcgcaacagaatacgcggaccctcccaatcgcgcagacccacaaggcagcgacacgaagaaagcatggtgccctatacacaagtcggacagacactctctagaagattgtctcgtcttcaaaaagtcgcttgcaaaacacatggcatcggaaaaagacaagcgagtacgcgtggttgagaaggacgttgaggcgcctactcaggaatcggactcagcataaccagattccgatctccatgtctcacacatcttcggaggttccacggcatactcctcaaagcaagaatacaagaaagtggaacatgaagtctgttcgacgtggcagggggctgcgcccaagatgaagtggtccgagcagaagatagaattctcagaagaggaccaccccaagactgctgtcatcctagggcgatatccaatcgtggtcgaacccactattcgtaatatcaaggtcgaacgagtcctgatcgatggcggcagctcaatcaaccttctcttcgccagcaccttggacgcaatggggatcccacgaagcgagttgacgcccaccgatcaacccttccatggaatcactcctcagtcatcgtccaaaccattgggcaaaattatgttgcctgtgactttcggccaagcaaacaacttccgaacggaacagatcacctttgatgtcgctgaattcgatacagcatacaatgccatcatcgggagaactgcactcgcgaagttcatggccgcatctcactatgcgtatcaagtgctcaagataccaggaccgaagggaacaatcactattcaagggaacactaagctggcggtacaatgcgacaagcagagcctcgacatggtcgagcatacgcccaacccgcttgccacagcagagccatccaagaaagtgagcaagacaaacaagacgccgaaaccagacggcgcaatcaagatcgtcccactctccagtgccaaccccgacaagaccgttaagatcggggcgtcactaggagagaaataggaactcgcgctcatcaccttcctccgcgacaatgctgacgtgttcgcttggcagccgtccgacatgtcgggggtacccagggagatgattgagcacaaactcatggtgcgacccgatgccaagccagtaaaacaaaaactatggagatttgcaccagatcgaaaacaagccatatgagaagagctcgacaagcttctcaaagctggtttcatcagagaggtactccatccagagtggctagccaacccagtcatggtgcggaaagccaacgggaaatggagaatgtgtgtcgatttcaccgacctcaacaaggcgtgtcccaaagatcactttcctcttcctcgaatagaccaactggtggactcaacagccggttgcgagttgttgagctttctcgacgcttactccggttaccaccaaatcagcatggcgaaagaggacgaggagaagacatcattcatcacgccgttcggggtattctgctacgttaagatgccgttcggactaataaccgcaggaaacactttccagctcacggtccaaggtgcacttagcgaccagctcggaaacaatgtcgaggcttacgtcgatgacattgttgtcaagaccaagacaagcgactcattgattgacgatctgcgggaaacgttcgacaacctccgacgatatcgcctcatgctcaatccagagaagtgcacgttcggagtaccatcgggcaagctactcggcttcctcgtctctggcagaggaatagaagcaaatcccgagaagatcaaggcaattgagaacatgaagtcacctacaagactcaaggaagtacagaagctaaccggatgcatggcagcactaagcaggttcgtcgctaggatgggatagcgaggacaacctttcttcgctctgctgaaaaagcaagacaaatttgtatggacacaagaggccgaagaggcattcattgcactcaagcgctacctatcaaatccacctgtacttgttgcccccccaacctaatgaagaattatttctctatattgccaccacgccatattccgttagcactgtcattgttgtcgagagagagaaggtccaacgaccagtctactatgtcagtgaagctctccacgacgtaaagacaagatatccacagatccaaaaactgctctacgcagtaatcatgacatcaagaaagctacgccactacttccaaacccacagggtcacagttgtctcctccttccctctcggtgaagttgtgagaaacaaagacgttgtcggccgcattgccaaatgggtagtcgagctaagccaatttgatatccacttcgtgccacgaacagccatcaagtcccaggtactcgccgatttcgtagccgattggaccatgcctgataacaggtcagacaaccaaatcgacaatgaaacgtggacaatggcgttcgacggcacactcaacagccagggagcaggggtaggattcatcttgacatcaccttcgggagatcaattcaagcatgcaattcacctcaacttcagggcaaccaataacacagccgaatacgaaggactactcgccgggataagagctgcagctgcactcggagtcaggcgactgatcgtgaaaggggattccgaactagtcgcgaaccaggtgcataaagattacaagtgctctagccccgagttatccaagtatctcgcagaagtcaggaagctggaaaaaaggttcgatgggatcgaggtccgacatgtataccgcaaagacaacatcgaaccggatgatctagcacgacgtgcgtccagacgagaaccacttgaacctggcacctttctggacgtcctgacaaggccatcagtgaaagaggcaaccggcgaagatagcccggacgcccccaacgtcggctcgggggctacaaaggcagagcgcgctgttgccgatatcgagaccacagacgactggcgcaccccactcattaaattcatatgcagcgaagagctgcccgaggacgacgcagaagccgagaaaatatcccgtaaatcaaaagtctattgtatgatcggcaacgatctatacaagaaggcaccaaacgggatacttctaaaatgcgtctcatccgacgacggcagacacctcctcctcgacatacatgaagggatctgtgggtcacatgccgccggtcggacattagtcagaaaagctttccgacaagggtttttttggccaaccgccctcaaagacgcctgcgacatggttcagcggtgtgaagcctgtcaattccacagtaaacacacaaagctgccagcacaagcactctagactatccctctcacttagccgttctcgtgctgggggctagatatgctcgggccattcccacgaggacagggcggctacaagatcctattcgtggcgatcgacaaattcaccaagtggattgaagcgatacccacgggggaaatcaaggccgacaacgccatcaaattcatcaaagggatattttgcaggttcggattgccccaccgtatcataacagacaacggctcccagttcatcagtgccaatttccaggattactgcatcaggctgggagtcaagatctgcttcgcctcggtttctcaccctcagagcaatggacaagtcgagagggcaaacggcatagtactacaaggaatcaagacccgcgtctacgacaggctcatgtcacacgacaagaagtgggtcgaggaacttccatcagtactatgggttgtgcgtaccacaccgacaacgtccaacaaggagacacccttcttcctcgtgtatggctcagaggccatgctccccaccgagctacgacatcaaagtacacgagtacagaagtattccaatgaggatcaggaggagcagcgatacgacgatgtgaatctactcgaggaacatcgcgaacgagttgccgttcgagtagccagctaccaacaagcccttcaccgttaccacgagaagcgcatcctagcacgcacgctttcgatcagcgactacgtcctccgacgggttcaaagccaagcagggcgcaacaagctctcaccctaatgggaaggaccgtacacgatcacacaagttctgcggccaggcgtattcaaaatcgcagacggcgatggtcgcgagttggcaaattcctggaacattgatcaattacgtaaattttatgtataagtcaatagtatccatacttgtaagacaacttacagcctcaataaagcctatttttcaggtatagactacagtcaaagtgttccttcctgacgatcccttacccagatgacacctagcgttgaaacctatcctcatgtccctttacgccgtcttgacaaggcctccgaggaacctaagggaacttcggctagggacgcccagagccgataaggccttgtcagatcctgtagagacgaaagactatgtcagatctggttgtgtaagagttctcgccgtgcgtattaaccaagccgtgtaatcggaaatatactttccaacttcacggctgggggctaggatcagtgcttgttcaaccgaggcatgtcaaaggtccaagagccttatcttccgagaagaattctccgatgacaaggctgtgggctagggagagtgtataactcaaacgactgatcaaagtcgtgaagtgagaagacactcatacacactacatccagagtaagaaagcttagatttcttttctattccacaagtatttcttacaattccatcaaaatccgaaactatatcacactttttccctaagacatttgtaacaggacacggagactaccaggaaggccaacgccagtccatcgactggaagaccttctccgccagcaacgccatcaatttcgccaggccatctatctccgtaggagttctccgagaacgagaaaacccttcacggaggaactcgaggtgcagctgcgggcgatgatctcgtatgcaggccaacacgtgccccccggcatatcggcttgagcaacgacactcctgcttcaaggcctcgtcgatacgttgaccgatgccttcgagctgggcgcaggccccattcagccacgagatgtatccggccgccgattcctcgggatccccacggggtactcggagctctctacagactctcgacatggatgtgcagcaactcttcagatacgagttgaaccacacctcacgaccccgaagtgtctctacagcctggtcctttctcacttccagcatattcctgtcgagttccgcgacctcaaacttcgtcctccagtactggatgcgacgatcctggtcagcaagcgcactctcgagatctactcagcatggaaacgactaagtcaagttgctcttctctcccgagaacacaacaaatcaagtcgatccagacggaagggcaaaggaaatgataacaaagacaaccaacctaagggagtcgtcgccatgctcgtttcgatgggcgaattttgagctacatcgccctccggcacatgtggctcgaacgcaagtaacggaacgaccaccggcaactcagactgcccgcgctgctggacatcctcgacatcaacatctctacaaacgacaacaaagtactcaagatcaaaatgctgaaaacgctaaggtgatgactgcacacacaaaggcggtcggaaccaataaaagttttacaaagcatggccaaagagtacaagaaagctaagaccctactcttcaaaaagagggaggacggactcctacctgttggtattcaccaaggaagaaatatccaagtctcctacgaattctatcaccctataagttcagctagacaacttggattaggccaactccgaatcggcttattctttgctgacaagatccaatgccgaggagaaatttcttcaactctaatgatggatcgactgcttaacctccaaggacctcccttaggcagtatcgacaatattgagttagcaggattcaggagcaagaactttgacagatggtgggggtgaatggaagttgcatctatttcatcaatcggccacaatgtacatgacagatctattccctgacgtcataccccaggtaaactttgtcatcactaaatttcataacggttagccgattcattacttaactaatcttttgttcctgtattgtagacaacagaatcctcccctccacatcagagcaatagtggtaggaacattgaatatgccccaggtctgattcctaatagaggcggattgtctccccctgtcatcggctatcacgcccccaaggtctcaaccctcctccaaggcgccatcagggaaccaaccaatgtaaccaagaaaagaaaaactagatcatcggctgtgagcaccttgactctagctccaaagaaaaaggccaaatctaagaaaaccaagccaaccgacgacctgcctgcattggatccatccattgaacaagctctggatgaagaagatattgaggatgatgttgatcaggctgcagtcgaagtaagtgatactgaaaaaacaccatcggcttcgcctaagcagataccttcaactccttctgcccccactcacttcttcagagtaaaacatctttccttgcaaacccttttgtaatcattatttttcagccgactactcataggttttgtagttgcagaagaagaaaactgctataaagaagaaatcggcagcaccaattctcaaaccagctccatcagtaagacactctcaattttactagccgattttgtctaacacttgtctttttacagcctcctcctcctccttcttctcatgtacaacaatcatcgagtgaccgaactccatcggccgtggggagtcatcatattgttaaagaagaacaaccagctgctcctgctattctagtaagttttcctttgatgcaagaatttagatcgactatattgacttagctctcaaactttctgaacttatacctgcaggttctagccgatctcttttcttttgatatcaaagattatcttgatgaggcagaagaagatacttcaagcaaagctctagctcccttatctgacgatgcaaagaaaacacttgaagatatctcgcgtcggctagaagcctcttctctggatagcttagttgtcgactgtggatcgattaggacacgattgcacgaagttcaagctctaattcctgaagaactggccgatgtcctaactccacccgcttatcttgagtaacatcaatttaaactagaaaaagccaagctaagattagccgaacgccgtgagcgtaaggagattgaagccacaatccaagtcaatcggcagcttgtgcatgaagaaaaagtcaaactcgatctgctatccgaaggtccgatcaaatccaatatcgaccggcttgaagcccgtaagatcgatgtcttggcacagcttgaagaatgtaatgctgaattggatatggagcgcaaaaagctagccgatctcccaaaatctgtcgaagagcaaaaagcaaggctcaaatcagctatcaagaatgttgttgacctaaccaagtccctgaagatcattcctaggactgattctcaagatgcccaagccaatgaagaagtcgaacaaattaggcaaagagctatttcggctatccatcagtacttgtctcaataacttttgtgtaataggacttagaaattcttgtaatcgactaagataccttaataccctgctgttttaacaatcctttgtgccgattaacataacttctaattttcaagaatttcttgtatatatgtgccccccaattttataatgtcaacagcattgataaaattaaaaaaaaacaactaagggcgatataacaatatcggccgttatatatcggcaaacaaaaaccgattacaattagaaaaacgactaagggcgatataacaatatcggccatctcaagacgatgtaaaacacatcggctgtcatgcatcaacaacactagccaatcatgcgtcaacccaaacacttgggtaatacttcttcaagtatttgccattgagcgctcgtccataaactttaccatcaagcccttgcaacatatatgcccctttagacacagccttatatatttgaaacggtccttcccaatttggtgaccacttgccgaacttgttatcccgagttccaatcggcaaaatcaacttccatacaagttcaccttccgaaaaatccttaggcattactttcttgttataatgcctagcaactcgttccttatctttggtaaccttagcaagggctcgtaaacgcaattgaaccaagtcctccctctcatcggccataaggttataatactcatcggctgtcaaaccgtcttgcaattctatacttctagagccgattctaacttcccatggcaaaacagcttcatgtccataaacacgcttataaggaggaacttgaattgatccatgacaagccatccgataagaccataatgcttcggccaaccgggtatgccattgccgaggataatcagaaatcttccgcttaattaatttgatcaagctcttgttagatgcctcagcctgcccattagcttgtgcataatatggtgaagaattcaacaatttgatacccacgctatcggcaaactgaacaaactcattggacacgaagattgaaccttgatcagttgtaatagtttgaggaataccaaatcggtagattatatgttcttgaacaaattgaattgcattcctagaatcaactttcttcaaaggaatggcctccacccacttggtgaaataatcagtcgccaccaatataaacttatgccctttacttgatggtgggtttatcataccgatcatatcaattccccaacctctaaatggccacggtttaataataggattcatagccgatgccggcgctcgttgaattgccccaaacttctgacaatcttgacaccccttataatatctgaagcaatcctccagcattgtcggccaaaaataccctgcacgccgaagtaaccacttcatcttatgggccgattggtgaatgccacaaattccttcatgaacttcgccgattgcaactttagcctgatcagcactcaagcacttaagtaacactccatcaatcgtctgataataaagctcatcatccaatagagtgtacttcaacgccttatatcttaatttcctagaagccgattgagatggattatgtaaatattgatgcacatcatacctccaatcatcggctgttattgctgcaatttcaaccttaacatctttgatcatcggcttataccccgatgccccttgggccaaatcattagcttcaatattttgttctcgtgatacatgctttaaagtaaccagccgaaattccttcatcagttcttggcacttctcattataaactattaacgtatcattcttgcattcatactcccctgccaattgactgattaccagcaaagaatcccccatgatttcaatagcatcggcttcaacttgcttgagcaattgcaaccctttaagcactgcttcatactcagcttgattattagtcgcataaggtttaatagtataagcaaactcgaaacatgcccccaggggaaattataactaggccgataccataaccatgagtacacaccgatccatcaaagaataaagtccacaaaaattttgggggggcgccaaccccccaatttttttcaaccggagccgattgaatcatcacgatgttccacaataaaatcggctacagcttgtcccttaatcgccttcggagactcataccgaagatcaaactcagttaaggaaaatatccactttccaacccttcctttcaatattggagccgataacatatatttaacaacgtcggccttgcatataatagtacattcattggacagtaaataatgccttaaccttgtgcatgaaaaatattaacattagcataacttttccacaggagaatatttagtttctgcattcaagaaccgacgactgagataaaatacaactcgttcttttccatccaactcctgaatcaggactgaccgattgacttctcaccggccgacagatacaatctaaaaggtatccctttctgtggaggaatcaaaacaggaggggaactcatgtatcctttaatattatccaaagccttttgctgctctgccccccaagtaaactgctgatcggccttcaatctcaacaatggtgtaaa

SEQ ID NO: 43441 - DNA, 2431 bp, Oryza sativa
tcaattcccctctcatggacaagaaatcccaagaactggccagccgatacaccaaaagcacactttgtcggattcatcttcaagccatatttcctggtcctctcgaaaacttttcttaaatcggctatgtggtcttttatttccttagatttaacaaccacatcatcaatatagacctcaaccagccagccgattagatcatgataaatataattcatggcccgttgatatgtagctccagcactcttcaagccgaaagtcataacaacccattcaaataagccgattgcaccaggacatctaaaagctgtcttatggatatcttcttcagccataaaaatttgattataccctgcgtttccatccataaaactcaaaattttgttccctgatgtagcatcaaccagctgatcggctactggcattggatattcatctttcggtgtagctttattcagatctctaaaatcaatgcataccctcaccttgccgttcttcttgatgacaggaactatgctagaaacccactcagcatatcggcaaggacgaataaaaccagcatcatataaacgcttaatctcagctttgaaaggttcaagcatatcggctttgcatctcctcgaaggctgctggtgcagcctatcccctggcttgataggtagccgatgttctacaattgatcggctgagtccaggcatctcataatacttctaagcgaagcaatctctaaactcttataagagctctatcagcttggttctaaattctggagacaaattcttactaataaatgtcggccttggccgatcgcctggacctatatctatttcttccaaatcatcggccgacataaaaccttgacttgcttgtcatcgagatcatctaccgtatccttagtgtagacacttgaaccctccacgacgccctcaaaataatagcttgggttctccatcttcaactggttgtatatcagaatcggacacttttagaaaatctccattccaaacttttctagataaacaatcaaggccatccatctcctaaagagctaaatcggcactggcaacattaactgacctgtcggctggtacaatctctattctgtcgccttgccactaaatcaagcattgatgcatagttgaaggaatacaacaattggcgtgaatccaatcccttccaagcaacaagctgtaagaacccttcccatcgatgacaaaaaacgtggtaggaatagtcttactgccgactgtcagctccacatttagaacacctttggtttcctatggattgctaccaaagtccttgagcaccatatttgtcttaatgagatcctcggcatttctacccaactttctgaacgtagcataaggcatcaaattcaccgcggccccaccatcaaccatcattttagacatcggcttcccattgacatagccatttatatacaatggtttaagatgccgattctctgtcccctcagacttctcgaacaccgcctgttctggtgatagaaccaacttagccgattcctcttccacctcgtcgacatcggcttgatcgatcccgaattcggctggcaaggtaaaaaccatgttaactggtgccgtcacaacactctttccttttgccaacctctttgcctcatcagctgcaacatcgtcggctacaggagcctgattcttaacacgccactcctgcctcggttttgctttcttcagccgatgattaatttcttgctcgacctcctggaagcgttccctactcctcaatctttgaacccttcttttctgattcttcgtaaaaatactagcaggacaccattgagtcttcttattttcgtcatattccgaatcaccacgttggtttactggacccaatctctgatgaacaggcactcttgtctgttttagccaattgcctccatcgtacaatcggcttgaaccccttgcaacatcactgcatccaggacaatcctcgatagatggtaacctcataccttcattccgacagaacctgaagaactcacagccccaatgaggatcaaagccaccattatcttcttcatgatgcctttcctgttgcttgtcatatttcctttgatatttgtttataattctagccgaacttacttgataacccctcatgcaccccgtatcagctattcggccaactgtgtgtactatgttaacgggaaatgggttaccatcgaccctcatcggcttttggaatcatcaaacttaatcttgcctccctcaatggccacctgaatctgttgtctaaacaccttgcaatcgttagtagaatgggacccagaattatgccatttgcaatatttctttttgcctaattccttagatgatggaatcgtatgaccagcagggagttgaatttgcttctctcggagtagcagatcaaaaatgttgtcagcttt

SEQ ID NO: 43442 - DNA, 12902 bp, Oryza sativa
ccagcagggagttgaatttgcttctctcggagtagcagatcaaaaatgttgtcagctttagtaatatcaaaatcatattctcttcctttccatacttttacccattggcacggtatgacctttttaatcctcacccattcggctgtagctatctcagagtcatcctcatcgtcatccgacccatacatgtaaggacaaacatgattaaccttcttagagcttttcctagtctccgcagacctatgctcgtgcaaggttaccttttgtatcagatgtgacaagctatcaaagtcttcagacgagaatttctccctaatcggagcaatcataccctgaaaggctagatcggctaactgagcgtcagttaaactcaagctgaagcacttgtttctcatctccctgaatctctgaatatactcgtgcacaggttcatcatgccgctgcttaatcgccgtcaagtcagaaaacacgaggcctgggagatctgcttaactcagataagatcggctgaaactccgatactaccctaatcggcaaccagaggacaggctagagattgatattctaagcacgacttaatagatcaaactcaactgatgcagcattaagtatgaaaagaagaacaatatctagacaatcaagctgctgggtgtttcataaagtggtagatatcctatataatctaggacaacgtcgctatttaacctaatcggctgccttctattaacagatgttagccgattgtaggttaagatgacgatattgccagagattatgtaagatatatgataacttgacgaattatatagacaagattagagtgtcataaagatggaagcactaatcccgagaacacaagtcgtcataacaagttttacctcttgttgaagatcgaaaccgatgcagctcaacccgaaagcaagaactcgtcgaaacaaaactaaagcaaaaaggtggcgatgcgccgaaattgtgttgaacgtgtgtgttaaaaattacatagggctcggggtctatttatacccgagaattacaagatatgtccataccagacacgaccactatctctaacaaactctaagataccataagtctttgcggcagacttttgcccaaacatatctctaaggaagttacataaaacatcctaattaatagatacaattgccttctcaggactctatccatgtgcggcaatcatcttgaagcacctcaattcaacccaatgtcatacaccaaattatactgtcagaatcggctgcatcggctcacctagtccgactcagacccagccgatcctaatcgtagccgatctggacttcagccgattcttgctctgttctcggatcaatcttcgccttcgactccaccttgatctaatatccttttccgatgctgatattagcaaatttggtcgttaacacatgccccccaagtccgggatatttgataatgttccggatttgctgtgtaccgactccgagcaagtctcgcactctgccgtttttcgaccgttattctatcgctttaaataccaaccgttgccctcaaaaaatctcacgccgtgacttccgttttcaccgcccaagcgaaactttgtcctttctctctccggcgattcctccgacgcaaaagcgatccccaggcgattccgcttttgatcagatctccgcctgcggcgatgtcgtcttccactagcccgtctactacgccattggccgagtacgctgaggtaagttctcaccggctagatcccttttcctcgcatgaaatcgatttctccttttctcattatgttttctgcttcccgattcctttggatttgcagcacctttccaacctagttgcgattcccagcctatcgcacaaaaaccactattttcttggcccaatccacaatcttgaccccactatttcatcattggtgaaaccaacagaatcccctttagactagccaaccctaacttgggtcactggaagaataccttcaagtcttggtcatctctcgaaaagcctacccctgataagagctggaccacctggtaccaacgcatatcggctagtaagaaaacccactgggatgagattgggatcggccaagcgcttgctctcaccatagccaattctgctaaggatgaacctctgatggctgccgccacctatttctggtccaacaccatcaatgccttcttatttaaccaagggccgatgactccaactttgatcgacatcatcatgattactggattagatgtaacttcatcggctaaccctatgagtatgaacaccaagaaccaatttgacttcaagaccaaaagcataggagggtggtctggttatgtagcggcatacatgggcaaagggcctgtcactcctcgggagcacgtagctttcttgctaatgtggctagaaaagtttctcttctgtagatccagctgtggtcccacaaccaattggcaatttgtagccaaagccttagaatcaaataaacaatttcccttgggcaaaatccttctcggctatctataccaaaagttgaaaaatgcatcggctaagatagccgtcgactcaatagttggagcaggtggaccatggtggctactgcagacctggctaaacctggtagtcatgaaagttgtcaatcggccatctataacagaagctgaattcccaaggttggagccaattgtagaagacgatggagaagaactcacccattgcagatgcatgtcatatggagaatatgcatccacaccagccgatgctggggcaaaactatcggctgagctgctcaaagattggttctgcagcttttatgaaggcttccagaaagatgcccgggtttggtttctttatgaagactcagcagaccttgagctcccattagacttcagatttgaagacatcaatcatgaaagatatcaaacgtccagggaagtctttacagctgcaatcagcccatgcatcctacctgtcggtattcaccaaggaagaaatatccaagtctcctacgaattctatcactctataagttcagctagacaacttggattaggccaactcccaatcggcttattctttgctgacaagatccaatgccgaggagaaatttcttcaactctaatgatggatcgactgcttaacctccaaggacctcccttaggcagtatcgacaatattgagttagcaggattcaggagcaggaactttgacagatgatggggtgaatggaagttgcatctatttcatcaatcggccacaatgtacatgacagatctattccctgacgtcataccccaagtaaactttgtcatcactaaatttcataacggttagccgattcattacttaactaatcttttgttcctgttttgcagacaatagaatcctcccctccacatcagagcaatagtggtaggaacattgaatatgccccaggtctgattcctaatggagtgcacttacgttgatggcagcatcgcgctcggctgcccccttctcgcaaagggggacggggacgttgctcgctgttgtcgggccactgatcatcagttggccgactcggcgctccacggttgcgctgtccaagcctgcagatcgagaccggaatccgataagtcgggaagaacacgcgtataagggagtcaatttaactaaaaaggaaaataccccgaggagaaatccgggtcgcgtcctccgtcccagaataatcaaaggtcggatgagctcgagcctgaagcggctggatctgcctaccaatgaagtcggcagtgacttcataccccgataacccccgttctcggaggtcatcaatgacatcgatgaaagattggagggatggggtcaaggcgggtttggtggtccaggatggaatcttgtctggttgctcctcaggaacaacgaagaccggatccgaatcctctatctgaagatagaaccacctcccccgccatttgctgcgagatgaggggcactggaaggggatgtatcgcgacttcaggccatcccgaagtcggaaaccaacacacccggacacctttttgggttccatccaacacaactcatagtaaaagcggaaaaggtcaagaaacggctctaccccaatgtaggcctcacaaagatgcgaaaagatatttaggaaggcgatggaattagggttcaaatggagcaaggaaagaccatggaaattcaagaccaagagaagaaattcagaaggcggaggaagaaaaccacagagaataaagtcctcgatcgcaaccatgcaacccaggacaggctggggttcagtacctcctacttccctctccgcggtcccacgaccgggaagggcaccatcctcctgcagtttcttcagcgatgcaccggtggaggttgacttgtcgagatccatcactgctggggatcgccgaagaaaggatcgagatgagctagctagggttttttgcgggagcgaagaagacgagggacgcttggaagctggagagtgttttcaacaggcgtacttcaaatgggatccccaaaactcccttaaatagacgcacttccgacggtgcgaattccaaggaaaggagagagatggccgccggaaatttcggggtccgttacatgcgacagtttttcggacttcagtttaaattcactcatgaccgttgagcttcacccgacgttgtcgatcactccttgtctctcggtcttcacaccgagaacaacgacaacatcagaagccgcgatcggtctcacaagttcatttaagcagaagtcgggagctactgtcagggttacgggtaaggtataccctctacccctcgatatacgtcacatatcgatatggtatgcttgcgcgtatacggacgttctcagcataagttaaggaagtccatcacggggtctatagatggaaagagtcctactcagatagaactgggtcgtcattgtatcgtgtcgggtttgatgtctccgagtcctacttggagaccagttgacctgtggtataaaagggaccccccgggaggacctaaggcatcgaatctcagagccaacacatccaccacagcctacgaagctggagcttgttggagccaagtcgccgggagatctagtcggatcaactcgactacgatcccgacggtatcgtcgagttccgctattccctttgtaatctgtggtttctatcatataatcccatatcaactggattatggctattacctaccaaggggcctgaaccagtataatccctgtttcctgtttgcttgatgtcgtactacgtagatcctcataccagcgtaccccaataccctttatatccggtctacaggtatcccccgtcgacagcgccgtcacaggaatccacacctccacccctcatcgccacggatgacttcgcctccgccctcgtgaccgcaggcgtccacgtctccgatgttgccgctgtggagtactcgtccaccctcgtcgccatgggagtccacgcgtcctccctcgccgtcacgagagtccacacctctgccctcaccgacacggacgatctcgcctccgcccttgcggccacagacgccacacctcccccactcgcggccgcacgcgccacgcctccgacctcgccgccggggaagtccatgcctccgacctccgtcacggcttgctccggcatggtgctggcgccaacggcctgcgggaggatggaggaagtggtgcaacctgttgctgatgaggctgagattgaagtggtagagagggatggaaaaaaaagagagaagaggggaggatggaggaagaagatgaatctgactagtgggtcccacatgtagatgaggaagatgatgtaaaacatgacagtgatagcatggctccaattttgtaaaatttgagtggcacagctacgaatagacgaattataatgacatttatctgaatagacatatttgcaatggaacggatcaaattaaccctttcaaaagaggggtaagttgagagaaaacggatgatatgccactctctaacatcggttcggataaaatgccactttggagacttttatgcccaaaatatccctggagagagaggaaaggggagcaccggggagggccggccgggcggcgcaggaggactcgctgggcggcggtggtggcgacggaccgcggggatgacgggggaagaggacagggcggcaaggacgacggggcggaggaagagccgacattggggaagcctcagacggacccgtcgtccccgtcgccgcccggccgctgctgctccaacgtcgtcctccttctcctgcgtcgcctcttcctcctccttcccctgcatcgcctcctcgtcctcccccggcggcaagcgcgcgtgggtgccaccgccgccgctcgcttgctcctcatcacctcgtcctcctcctctcgtcagcgacgtgccagctccgtcctccttccccacgtcgacgccctctcccgatggagccggcgctgtcctccccccttcagcggcactgtcctcctccccttctcgccgcccacccccgcgtgcttgctgcccgctggcgacgagcacggccgccgtctttcctctttcccttcctctctctccacggtggggtattttggtctcaaaaccacccaaaatggcaaagtatactgatgataacctattgagtggtattttatcctttgtactctagtgggtgacattttatcctttgcaattttctggagtggcatattttccgttttctgggtaagttgaatggcaacgcgcaacgcagcaacaagccaacaaccagccaaatgcgagaagcgcggcgcgatctccctcccaaactccggccgccgtctccgcctccagagactcaagcagcgccgcggcgccgcctcgcgggatctcgtgttggaccggatccttcaaccgaggatcccaaccggcaaccgcaaccgctccgggggcgtaagattcgctaatcccatcctcgcctctctacttctacttcccctcctttccgaggccacgcccacgcatccaggtgtcgatgggtcgatttgcttagctccaatccagccatggcgatcccgaattgtttaaaccgcgccgacgtttcagctttcttgttatagcaaccctcttcagcgcgcgcacgcgagcttaggcccaggaccacgcctgcataaaatgttcttaaattccctggaaccagacccaggggaaggcaacaagtgcaaggtgacaagggagattgttggattgggggggaagtggaatttactccgacacatgtgcggggtggttggggtttgtgggggcttgatgatgcaatgcggacagtgtatctgagcaagctcgcatgttggccgtccccaggatcctcccagtgtaatcatcagtagggaaggggtgatgattcgctcggagctcaggttgcgtcgtatttaattggatattcagatgctaggtggggctgggggctttgccattggaatgatggggtcgtttattagtgtggcttggagtggacattcttcaggaggttgcgaagaacaatgagcgtagggtgaggggctcactgcattagtttaagtgactgcttagattaagaatgatatctgtttgatcattaggtgatggggagaaacataagaaaatgtggtctgttgttcactatctagtgcccacttcttttttttttggggcacgtttactgttattagttccaaaagctgcaaaatggaattgctcccattatcttctgggttcaagtagataataagtaaattatcttcatgatgggaaaaatgcacagtagtttgcaaattcagattgcatctgaatgaaggatagtcctgcaagtagataaaaataagcatatcttgatgaggggatagttgcatggtagtttgcttttgagttacttgacactgacacagagttggacagttggttcacttctatctttgtatgcatgtgttggagcgcatttcaaatctagattgcaattaattaaacatgctgtatacaagagtaccatctactattaatagaatcagtgtcgctttgatcagtaccttgaccatttattgaagacagaacaagttcaataattgcatagattaaagacatcttgtcttggaggtattcaaatgtaatctgtcacattattgttccagttgcggtgactttaaaaattgctttttaatgttaaattgtttccataattggttctatccagactacttttttagttccccccagatgagaatagatagtgtatattaaagaaatgttaacctttgtgtcaattagaaatttagaactatcatctgttggctgttgtgctgttttctttcgatttacaagtggtgtttaggcagatatagaatttattaaataaaattagacatttctttggctggcattaaatataaataagttgcgggcttgcggctattgcttgaaatctatactccttttaaaagaagacaatggtggtggcagtgaatctgccaccccaccaactattgtatagagttttcttaaccaactaccccttcatgttttttattaactactacttcatttgctttaatattacaaaatagttcttctatatataattctatcgatttcattcctataatacaagtttatcatacaaagacatcaacaaggacaaaattgtgcaaaaatgtcacaattaatttgttccaaacgatattagcacaatataatttgtttaatccgtagtaaagcacgactatttagttagtgctctattataattacaacagtcctttcgagatagcaagagaaatgtagaatagtatgattcagaggacatgcacatgttatttggtttggacaatgcatatactcactgttgtaaggtccgattctgttttaagatgttttacccgattatgtatggtggtgttgctgttaaatcaattaaaaccacttaaaatgagctagtgtatggaatactttttctatttcatgcgtgtaaagttattttatgtatgtgcagggatgctcctaaatattgctctttggttcagaatatgatatttggatttctattttttagatttggttgtcctgttgccttttggtccttttttgcgccgttggatgaagctgctatcatctttttggaaatttagtagattacctaccaagagagaatccaagaggacctaaactgcacaaaatgaaagcaacttttgttaaagtcagaatattggttgagtaaatagcaccctgaagtgatggaatacagccaaatttgttggttggattgtctctatgcaatttatccttatggcagtcctacattgcaagtgggccaaatccaacaggccaagaaagtatgtactttaggcccactagtcctccatttgtccaaccaactgatgtttgaaggcagcacctgctgcctggaaacttccattggttcatctaactcaattgaatatctatgaaaaatgatccttggtttggacccttttggacatgattcattgtttgcttgttagcagtctggattctaatggaagcacatgtgattcactgttaagatgacaaaaaatacctgttttgagttttgacagagttggttgtagtactgtttaaattgggtatgggtatatagaagaaccaactccatgatgcttgactgctagcttagttccccttgacaaggagtgcactacggctcttgaaataaaccgtgcagattgtgagaagctagcagtcaatcgaatgattcctagtgtcaaaagggcaaaggcataaatgattccctcagccgtgctcagttttttttttctttggggggtgtgtgtgtgaactttctcagttttacatcagggcaagtttcaatgccccctctttatattatgttgccatcttgtcatttgtggccttatttttggagacatttgtcatgaattttcattttttgaacattacttgaatggttatgcctatttcttgcagaatataaattttctacatagcctgtgcgttcctgttcaatccaacactaacgtatcacttaggaaatactgtgcttcaacaaacctgcacctttggcagcaatacgatccattaacgcatctccccaaaatgaagcaccgtagatcgtcataactggaccggacagaagctatggaccactctttcaccattaatttgctttgtatgaagtccaacaaccttttaatatgtgtttactggagtaaaaggaatatcagctcatgttgtcttgttgagtttttgtgtttgccgtttctagagaatggcagttagctaacctagattgtcttgatatgttggaagattatagagattaggaagatatattttcccctatccgcttcatgagctgatcacggcgttctgtgttatacctgcaattagacggtactttgtctcactgcagatgattattggaattagaaagcacagcatattagccttttactagtttcttgataactacagcatgtgcatctttcactactactatcttcattgcagatgattatttgttctgtgccattgactcattgtgtattgagtactgacgtgtccaatccaatactttgttaaagtttaattagttatttctttcatgtaatccacaataaaatttcatggcgatgcactgtactctgtcttcagggcatctgcaatattaattcagttctataaaacagcctatgctttatgttatgagtaacttgtatgatgcattttctgttgaaccatgggaagttattagttatgtacagtggcggatccagcatggggtctacggggtctcgagccccactactaggtctcgagccccactactggcgttgtaaccgtgggagcccccactaatttttttctgtcatacatccattagaagagggggctatagttttgtatagtttgtttagcctctccttttatccgttcctggatccgcccctggttatgtaggctttgcatattcacatattttcatggctttctcttgcagtgttaattttgcagatctactgaaaacagctctgttttttttcctattgtgtacagaacatgtgttgagttatattctttttcctttttatacaaaaggaaggggatagcttttcatcaaacatgtcgattttgaatcttacagtacaaattattccccttgccaggcagtctgaccggccaagcatcaattcaggttgacaacctgatgtaatattaatacatggtacatgttactaattctttactgaagtgaaaaccgcaatgttgttctaagctagatattataatatagtatggtaagagcatatatctattctgcataattagtctgaaactgttgtgttaatttgcattgttcaatacaagtttacatccagtatcctgtttcagtgtttcatgtctgtcacaggtccaaaaataccatcaatggcgtccttcagccgcctgttgatagcctgcgagggccgaggatacgccattgcagattcagcacttccagctgcactcaattataagtcaattataatcagtaataaactacttcctccatctacttttgatagtcatattttatcttgacacagactaagaataattaattctacttatcatctatttaaacatgctactaatcattcatcgtaaacaagcgattcattaatatttacatttctcaaagcccatgtacccaatcatatgtggaagaatggagagtcacgcattaaattcgagaaaatcattaagatgatagtttgttggattgaaatatgcctatcaaaaataaaattttcagatttagaaatatgactatcaaaagtagacggagtactatttttttcttcttctgaagactgcaatccatcatcacttcactgttatgtgtcgcaaatgcaattgatcacaactgatcagatcactttgaaagacaactaccatacgcaattgatcagttgccttgtagaaatccaaaaataacatctcacatcaaaattaccacaggaaccttttagttcgtctcatcagtgcaactcggggtgcagctttgcaaccgttgcgatggaggcttgcaggacaaaatcttactaattggaaattagttagatatatagttatttataacttaatatataattaagtatcctagcaatggcctgtgcatcttcttgggcgatcgccatgtcgcctcggtcagactgacagaactcaaaaactcagaagtcgacgcccttcaacagcttccgaacctgctcgagggtcacgaagaggacgatggtgaagggcccctgcctcgtcaccgtcgggacgaaccccttgtacagcgccatcgccccctccgaacgcacggtcttgatcaggcagtcgagcgcaccggagtagggcggcggcgcgccggccaccaccttcatgttcatgaccctggtcttgacgacgtcgacgggggtggacgccgacgcggccacgaggccggcggcgaggccggccgcgacgtgcgtggcgagcccgtcggcgccctggccgcggcgcgccaggatggcctccttggcctggtcgtacgtggccagctgcgacgccgccacgatcatggcgcgcttcacggtgagcggcgacccgcgccacaggctgcacacgccctcgtcccgggccatccggacgatggcgtccgcgacgctccggtagttccgccgctgcgccgcggggagccgcccgtccgcctgcatccgcaccatggccacgtcggccgggttccccacggccgcgccgacgccgccggagaagagccccgccgcgaccttccggtgcagcggcagcgggccgccgccgccgccgtcgtcacgctcccacctcctcttgagcgtgtcgtacagccccatgcaggtcgtggagtagag

SEQ ID NO: 43443 - DNA, 2432 bp, Oryza sativa
ggggaacgcgagcgctggggcagggggcccctcgccgtgaagctgcatccggaccttgatgagatcgagcgggtgggtgcagctgccggccacgacgcaggcggcgccgccctccacgaaccccttcagccccatgccttccgcgccagcgccttgggtgcgaatgggggaggagacggcggaggtggacggcctggcggcgggggcggagaggaggagaagggaggggaggcgaggcggccgcgcggcgcgggcgggtggggtggtgtggggggctagattcacgggccttgccgtataaagtttgcaaggacaaaagtggatgctcgaagcttgaaaccctagttgaaaacatgtccaattgtccatgccagcctagaaggcctctttttttattctctcttgattcatatgttcaatttgaaattttgaatgctcaacgtttcgttcctgcatatcgttttacacgcttatattttctaaaactatgtttttctatatatatatatatatatatatatatgttgcttaaaaatcatactaatttattttccaaatttaaaataattaatatttaattaatcaatcatgcgttaaccgttcactttacgcatcttcttaatcttcttatttcccatcctctcaaatactccaagttctcattttctactatagtactatgttcttatttttctctttttattagtatgctttctaaccaatgtatttttttcaaaagatctctatacaaaaatttcttaaaaaatattaatttatttttagattaactgttgcttaattaatcatgttctaatgaaccatccggttttatatgaacggagagaagatccctacctccatccgaacgcacactaggaatgtttttcaactagaaattcttcattgagttgaggtctcatacttaatttcttgatttagttttaattaaagatatgattcatagtctacagtgatatcatgatatggaagtatatcgtaggcaacaccattaactgaatcaactctgattttagttttttttaatcaaaagaattcatcaaacaacaaactacatacaaattccgatgtttctttcttcactggtgcaatgcttttcttgcggtggaacccgtctaccaatctacctacattcagtgttgaacgtagtatatgtgcttgcatttatgattaattattttttcagtgataggtaatatatatgtcgatagcgagatatctatgatgactttgttaatatcaatatatatcgtcctagttttctggagatattgagagatataagagtaagttcaatagtatagcccactactagctacaattcacctatagctaatctaatagccaattcatacaatagttacttactgtactattaatatatggtcccacctgtcatacacacacaatgtcttggagtccgtgctgcagctggctacagatctgtagcccgctgttctctctcatcttttatctcattaaaatatgtttatagctggctactagtctgctattgtacctgctctaatgtgtactccctccgtcccaaaatataagtatttttagaacagtgtgaagtcaaactttttaaattttaactattaatagcaaataaattaaaaagattaatcatgtaaatttgatggtactttgtttatcattaaacgagctatcataatatgcaactctctttatttaaaacatcttatttttataaatattattggtcaaagtagcacctcgaagactgaaccgaggttaaaaaaaatacttatattttgggacagagggagtattacgtttgtatggtgttaaaaaaaagagagtaacaactggtcaatctacagctggatcgaaattgcaaatgtcccagcatcgggtgatgcggacgtttcccttttttaacacgtggccgtccaaccaccacaagtcagattcagattcatcgaacgactaggattcgctgacacgtggaagatcgtttaactcgggcctactcaccagtgacataacctccccccaccccacgcagcgcgcgcctctctcttttttctccccccacaaaacccggagaagcgaaatcaaccaccagatacgacgagcgcctcgacagcgatccgccgccgccgccgccgccgcgtcgggtgtgtggtagggtttggggcgatggggcccccctccgcctcctcctcgccggcggcggcgccgcggcggtcggcgccgacgatgaggctgcggagggaggcgctggagtcggtgctggaggaactccggcgggcgctggacgagcttcgcgagtgcggggagctcggcgtgcctctccctgaccccgagggagccgttaacgacggcggcggcggcgaggagcagccggataacgaggaagaaggcggcggcggcggcggcagcggcgg

SEQ ID NO: 43444 - DNA, 10238 bp, Oryza sativa
agccgttaattgccgtaactgctgacaaattgcgatgatgaaactaaaattcactaccactgttcagtttatcctgataaattcagaattaattgattcgatttgtcatgcatttagatctgataatctgagatggcttgttttcacaatctggattcaatactactagtagtactactgtttcatatttgtctatctgatgccctagtggtgtgatagtagtttttttctcaattaataaggaacctagtggtggctgttgtatcgagtcaaattatctactacttatactatgaatcctatgtacggagtactactttttatcaggagcatactgtgtccttgcacatgtagtgtcgattagttggtctgtcagaacatcatgaagtactgagtaggttagtggattactgcggagtgaaaaggagtacgttagtggcttatttctgaatggagaagaggaactggaaatccagctgacagaacaattgtttctatataggagtagttatgaatgtgtgtgaagtccttcaaaataaaacatctcccctgttaacagtgttttcaggtttgtaagagtatataatgtttaactttaggctagtcatttctgtagttttacatactagaaagaaaactgctaacaggggaaaagggtagaatatctgaacagtctcataataattatggagatctctttctttatgactgggagaatgtacaagttcaattacagttcatttttatgttaatctttcctaatgtttaaaatcgcttgcctttattttttcagctatgtgatcttcttaaatctacattcgaatcacccaatttttttcaaaaggttgatgaaattcagaagtcactgtatcaaaatgatgcaggtattcctttactgaatgaacttattattgattgtgatgtgtaagctattgcatatatggagctgaaattacacttgttgtcgtgctggatctgaaactcacttgctgttctagtaatgcatagaatgaaacggaggctatcatactctaaagttcattgactgttctttgccgcagttgaacaagatccatcatgggatatagtaaaggcagtagatttgtgggaagacgatgacttaggtgatggatatgttcttgttaagaacgatgatgcaactgaggggatggctttctttattgccacatacatatcgtcgcttaaaacagccaatgtaggtactccctattattaatacttctgctccaattatacatcatttttcttgttttgttgtccatgattcactgaaaaaccttgcttaatattgttcacgcggttataattttgagaaaccctagtttttatctgttgcatatcttgtctcaaataagatctgtcaccatattttgaacatgatctagttttccctggtctgaattacgtttatgttcctttaagtaatacatcttgcttttctgcctaaaatatcatcattggacaatcatatatctgatgcctcaaacttaatgttgtacaggaatgttctcctgatcaaattagaaaaggtttgtttccctttccttaattcagataaatggttgaatcattggaatgaatgtttcagtgctgaagttgctcatcattcttttgccagccctcaagaagacattttcatctcgaaagagaaaaggtaaacttcggaaggcatggaatgggacaaaagttatttataatgtagattcatggagtgccacagctattgggtaagttattccaccaatatctgattgtgaatcttctttatggtattattctccctgcaaaatgatagccttgatgttcagttgagtagtgttgaatcaaccagcgcagcttgtcactaagctagttcggaggcaccccaaataggccttagtttcatacccaagcttcagtagccagctttcttgcaggctgcataagtttttataggctgtccataagattgtcaaacagactttcgagggttcatctcagtcctccattatgtagtctcttccaacctggttatgataggttagggggcaaacctaaatctttgaagtgatcctgaagatcaagaaaccataagatcacatctgagctttgtgttcccgattttaagtccaaatatgttctctgcgattagtgactgtcataccttgttattaaactgtatctaaataaacacgtgttttctgtattggtttacttacaagaacttcattgcaacactgcagaatctaccataatcaagcaattcttaaggtagcaactacagccttccggacgtcctgcagtgtgatatccaaatttctgtgagctgctgctgttactggcatgcttcccatcatcattaggtaaattggctaacacggccagaaagacctgcaatactcatgtaaaatagtgtctattcgttggtttgccattgtaagctttgactttctacaacctaactgtaaatatgacattcgtttgaaactttgaataaacatttcaataaatttagtgctggaattaactttccactcgtttgattggaaataattgtaccatcttcttggttggaagttgaaaaagggcacgggatgacaagatcattatttgtctgtaattaaaacagaaaatctataatctaaagtacagggttgcggcagtcatgccatttgcaaccgaataaaaaactaattgctcattggaacaatgcatggcccagccataggcgtcgttccttttattccaaagcccacccaattttacacacatccaagaccggaaattctaagcagcaagcatatcctcatctacattgcattctccaaggtaaaccttgatgcttcgaggagaaccgcagctgccttctgctatgagcgctctatcatttgctgccatgtgctggattattttgtatatcatctcaatctgatgcaacaaatggaatagcacgagttattaatatgaaagggtaaatctgttttgcagttcgcaatgaatccagatagtaacagaagttgagtcaggaatgaatattacatcttcagggcaatgacagcgctctgctatttgatccagcgtcaacggctcggcaggatccttgcagctgaaagacagcagcaagtaatcagcagaaattcaggaaccacttagaattgtaagagataccccatcggggagtaaacgcaaaaccgagagtttcatgtctttaggttaatacactgataaaacaagtttaagcgatgtgctggaatttcacacatatgagcaagatatgttccagttgttacacaaaggcttccctttgtcagtaattaggtttaaactgtccaagacagctaactgttcaaatagaattcatgctatctggtgaatttgcagccacatgaggtaggttctctgattcccaataataacccacagaagagtttttcccaaagaatttatgacatctccaatattttggcatctgaagctgtctagaggccattaatcagagtgcaagtcattccagaaaagtattctctaggtaaagatatagtaatgtaggaacatctgtttttcaagtgctaaaacctaaaagatatgcatgcctcaaactactgtgcacaaatcaatatctgtagataaataatatacgataaataatatacaaatgtaaataaagatataacatgcctggcctcattcagaacagtcagcaccctcttctgaagtgccaacacttcacctgctgcctttttcccagcctcaacacctgtacagcgcatagcacaaatacatcatatcataatcataagaatcataatgcaacaaaagaatcctagtcaactttagcttgtttgaggaatgtaccaggctgatgataggcattgatatttactaaagaagcataaatccccacagcacgttcatatagagcaaccagcgctccaacagccctaggagtaacttcttgcacagtaacggagatggattctcggtcattagaataaagagcagaacgggttccctgcaaaatatttctttcctctgtcattgcattcatagaaaaaaatgtcatagttctgtatcttaaaaagctgaatatcaacctgcaacatcccgaacaaatagtcaccacatgtaactccaggttcaagctcccaatcatgaccaggaggcctatcacgcaaaacctcaataaaagtaacgaagaagttgtgtacaccttctctcagctgctgaatgtagctgtaaccggatataataccattagatttttgcacttttaactacagactcttaagcaagtactgcagaaaaacaggaaaaaaaaacttacgcatgctgatcggtgcttcctttgttgccatacacagttagaccttgattaacctgccattaaaaatttctgtttgtcagcaaactattggagacataatttaattattggtaactagttaagtttaggctctgtttgtttcagcttaagattattgtaatctagattattaaatcagattactctaagctggattataataagctgatataaaataatctacgagttgtttgtttctctggattattagaggcatctaaaggtagtgggtctttacccacttaataatctggaaaaagctcctctagaggagattattggattatagtaatctggcttatagattataataatctagcataataatctacttgtttgttttagcttacttctaataatctagattataataatcctaagctgaatcaaacagggccttagtaacatcagttacagtgagaataaaacggaagaatgtgtacccgattgccatcaaggtcaaattctttcccaagagattccatgacaagctgttgcaaatatctactcaaaagtagcaaactatccttgtacggaagtacaaccatatcctgaaacatatgttcaactcaaaacataaaaataatgcacaaaacaatgacaaaaaaacttaaacagaagtaatcaacaatgctaaccttatttcctattccttccgatgcccaataccagcacaaagcaagtaaggctgctggattttccttaacctgaatgagtggatagcaacatcttgatatatcctcaacagtccattgtatcactaaactacaaactgtatgtattcttataacatcataccacagtattcctggtttcctcatccattagtgctgcgccaactaacatttctttgatatcgataccctggcaagcaaactcgtgttaatctgagagctaatgaaagttcagttctcagcaatataggagaacggagcagcactgacctgtaatgcagctggaagcaatccgacagctgacatttctgatgttcttccaccaacccagtcaaacatgggaaatctagctaaccatccctctattctggcagtgttgtctaacagagaattttcttgagtaactgcaactccctgcatagcagtttatgctgtcacataatggtatgtaccacaccagtcatatatagtactacctccatattttaatgtatgacgtcgttgactttttgtctaacgtttgaccatttgtcttattcaaaaaatttatgtaattatcatttattttaatgtgacttgattcatcatcaaatgttctttaagcatgattttatatttgcacaaaaattttgaataaaacgaatggtcaaactttggtcgaaaagtcaacggcgtcatacattaaaatacggagggagtataatataatgatctttatatcttgagttacaaaatgcacgttaatatcatgtcacacaaatggatccagaacagcccacaccacatgacctacttatgaacactgatggtttgcttgtaaaacaagagaaacaatattgtttcagtgtttatcttaataccatcagtatataaatcaagaaacgggactagtacaaatcgattacagtctaaattggcttaaaataaatgttgcacttcctattttgttgataaaagacatacaagaagtaaaagagcctgaggtaaaaacctgtttcgagaaatccagcccagcatctcggaaggctttttgcacttcaagcagaccattccgggtttcaggtgtgcctccactctgcaagtatagacaaacataaaatttgcaaaagaagcagggagaagagagggtgaataaggaaaaacaagcgtgatatcaaccttagaaataacaattacaagagtagatgcaagctctggtcctagttgagcaatttgatggtcgattccagcaggatcagtgttgtcaataaatcgtatctgagacatcaaacagaacaaaaggtgaggttatagctacatgagaaacaccaaaatctacaaaggggcaaatgagatcgaagcacattgcatggatataaaagtaggggcgcaccttcaatggagggttatcaggtgcaagtgcctctgaaacaaattgaggccccaaagctgatcctccaattcctattgagagtatttgagtaaatcggccagctggagatgacggaggtttaatctacatttgcaccaaatcactttgttaatagtgtttctcaagatcaaaaaagaagtagcaagagcctgcataagcaaaactcgactggcgtctatctattgaacaatgcacattccccagtacccatttcatggtaatcaccaaaacataggtggctccttttcttcacccttgagcacacagcttactaagcttaaaaccgcactaattttaccacaatatgctaatagggtttcgtttgcttatttgctattagccgccagaaattaagctttttttatagtagcagtagcagaactagagatatcaaattagtaacacgtgaaaatcatctaatttcagcgagtccagactcctaacagcaacaatttttagcatctcgagcaaatggaaacttctgcaatcaccttgccggagacgacgtcttgggagaaggcgaggatgcggtcgagggtggtctcgatcttggtgcggaggaaggagttgggggcgaggcctgggtcgcggagccagtaatggccaaccatgcggccctcgtcggggttggcgatggcccccttctcgagctcccgcatcgccgcgaaggcgcgctgcatccgcggctccatccggcggaggaactcctccgtgaaccccatccggctcacgtccacgaacaggccgagctccttgtgctggtacagccactccacgtacctctcccacagcttgatcgggtccttctccaccgcgccgcgggtgctgccgttctgccccggcctggaggcgagcggcgccgccggggtagaggagggctgctgctccgacgaggacgaggaggagcgggagaggtccgcgatggagtggggggcgcggaggcggaggtgggaggggcggaggaggagctgccgccgcagccgcagcctgcacgccgccgacgaggacggaggcgccgccgcgccggagatggacgccatcgcggccgccgccgccgccggagtctcacccggtagtgctcgctcccgctctcctacacgagctcacgcgcatctaactccggcgagagcgagagaggaggggaagcgatggtttcgtcttggagtccacgaagaagaggagttggtggcatcgctgggcttggctttatctgggggaagacgaaggcaccgggtggaccccagccacgtcaccacgtgggacccacctgtcattgtgccacgacttggccccacatgtcagcgtcttggggtgaggcggcgcgtgcgagcgacggcggggggcggaaaaatctcgacggcgagatccggtggtggcagctgggtgccaatggtaggtgggcccggggatcttttcgcgagcttgacgcgacgagtacgggacaaggctacaaaacggtaaagcgaggagaactcgcggtcgaggaggggcagagagatatttggcgaatttttggttgtgatttctcaacggctgctgtttcaggaagtttgctggtttctgttctgtcagttggatggatggctggacggtgaccctcgcaaggagcaagtagaaaccaatttacggccgtagaaaacaatttacggcgtctggtgaatgggaatgtggtttgattttgatggcactttcgtctcacctctgttttcttagacctgatttggacggccaccgtgcagcacgtgtgaccgtcttgtcgtgtattggaagagtgttcaagttgttaaaaccacttccaggtttcaaaaactgcttcttttgcatcaaaattttggaacataaaataaaagtgcatacatacatatggaccaatcttcctctagtttattttggatgatggcatgcatcatttgtcagcgcaaaacaccccagtgaccaaattaatattgcccagttcgatctttaatatcgtcccacacgtttgaaaagcccaagattactgcctcatgctgaacgctaatggccgcttagtgttaggaaagcgattggctcctcccttccctgacgagctacatgctaactgattgcgtcagtattccaattgctcatcacagtgtagctactgttccggctgctatgttgaccttgtcttcctacattctcaggagtcaagcatgcggacaggcaatatccgacatgacattagctagtactccctcagtcccagtatagtggtcgtccgagaatcactgacacaaatttgctttaggagaaaatgaccaaaacacccccaaatcattagctggcagctgcatgtagtcatttcaacatgcagagaattgacacacaatcagaaaaatctcatgtggaggagaaaaatcccacgccacccacggtactagatgggcccacttcttttttctagagtacttctcgctgctgggacttctttttttcaagtacttatcgctgctggaacttggatgcgtcaagctttctgggacatctgctacggggtaaaacgaccgctatactgggacggagtatagatttcacagaatattacaagtttagatgaaagagggggagaactatcaattgggttgagttgctttgtggaatttattttttgggaatatacccccttttttttaataatttgagtttatataccttaatggaaagatttagcacaaatatacctctaacacataatggagacgcgggagagcaacataattacggcgtggacgtgcgggacaggcgggcgggccggttaagaatgacacccgagcagcgccaagtcccacggctcagaagagcagcactgatacagtcccgtgtccccattgcacaaaaccgaggcggtcctgctaccacatgcccgttgtgcagcaccgccctctccccgtcacgcggtagtgttttggaacccgcaatcccgtggcgcgcaactaatttgatccaaatagtccacgccgaaagttattttcacgcggcaacaatgtcgcaatcacgcactaccagagaaaagagtaatttctctcgtccgtctcagctttattcacacggcgtagcagttattttatcgcacgcaacaatgtcgtagtcacgcacgcctatagaaaagagtaatttatctcgttaagactcagctttatgcacacgctgtagtagtgaagtagcaccgaaagtttgttatactgtaccatcaaaaagtttggatagtctactcacgaactgcctataaaggaatcttacgaagggaaataagacatacttcagtagattgtatcactctttaaagttcattgttattgtacttatggtgtataaacttcactgattagaaggtctcgcgaattcacaggacatatcttgtggtatgaactaagtacgtgatgatttatggtgtgtattgggggcttaccataagataaggctgtgaatttgcgaaactttcaaaccaacttaaatgttgtgtaaagattgtggaaaaattcattatcatgctgcatgaaaatatttataagtgtccatttagacgcaggaaaggcatgttgaaagggtcacttaggcctagaagggggtgaataggctaagttaaaacttaataaaatgcataagctaggattttcggatatatgccaaacgacaatcacactagaaaaatgaatctagcaaggcacaacaaataatctaaagctcaaagagaagctaaagctatagcggcacaagcaagtgaagatagtagaagggaaagcgaaaaaggatgtcaccaaatttcttg

SEQ ID NO: 43445 - DNA, 1256 bp, Oryza sativa
aagagaagctaaagctatagcggcacaagcaagtgaagatagtagaagggaaagcgaaaaaggatgtcaccaaatttcttgcaagatgagttattccccgaagttcaaattcttgaggggattctagtctccgttgaggagctcacaaagagcctggactttgattactctttcctcaagaggttgcacaaagcattcatcctttcactattggaatctcttccctttcggaggtgagacccaaccttcacaaacttcttccgaccaaccacacttatatcggtggctcaagacctagtagtctaggagtcctcaatctccaagagtaaaagattaagcaagaatgtcttagggatgaaacaagtgctcaacaaatcttcacaaagtcgaccacaagcactcacacgaactcaaatccacaactctctgacacacaaagtccgagctcggtggagaggagaaatgagggagcaaggctcaaagtggatcttaaatacaaagcaagctaagggcaaagtattcaatagcaccagcaaccttgccttgtggaatgaggagcgtatttatagcaacaccctcagaaatgccattggtgggtaaagataccctttttcggaaatttccaaaccaagttcagaaacttctgaaaatcaccactaccgaaatccaacgtgaaaagaacattctggatatttccgaagcaccttcggaaaaatccgaaatcactagtactgatatgtgcttcaactcatagcttcggaaatttccgaaaaacaccagtaccgaaatcaacaggttcaacacagttcgaaattttccgaaactctccgaaaaagaccagtatagatttttgcaagttcacagcacttcggaaatttccgaaacagctttcgaaaaaatccaaaaaacaacaataccatttttcaaaagcaaatacactttggaaaactccaaaaaacaccggtacacaaatctaaggaagaagccaacttcagcaaatattactttagcacttttctcattcctagatatcaatacaacatcccctttatagtacggctttcctattgaccgagtaaatgaagatttacaatttaccaatagtttcattattactttccatcaaaagtccatacaaaatgatgtcgcatcgaacatcatctcatgacggactaatgtccttcacacattctcaatagtaagcattagtccttgctaatcagatcgtcattaaccaccaaaacaattagggccta

SEQ ID NO: 43446 - DNA, 828 bp, Oryza sativa
  unsure (1)..(828): unsure at all n locations
nnnnnnnnnnnnnnnnnnnnnnnnnnnnnnnnnnnnnnnnnnnnnnnnnnnnnnnnnnnnnnnnnnnnnnnnntgactgctgtaccttaggaggcggcgtcttcatggcgctgagaaagaccttgcagctcaagaggtcgtgattctttgtcttgtgaatagaacaatagacatcacgagttggagaggtacgctgaatttcacgctctttgcaggcacgaatttcagcatggacgttgagaaagactcagcaggcttgcaggaagtgtttcctggttttgtggataggacaccaggaccttgtcacctcggaagtaatcctcgtcggctcgtgattcctattggaaaaacaaggcttggccgcactaggatccttctcgggctcggatgtcgtcgacgttccgatctccgcttcggcgggaggatccttcgacatggagtcgccccgggttgtagccactgcgttctcgtttccggctattggcggaccagctaagatcggcactgtggtgtaaaccggaaagacaatttcgccgacttgagtccacaccagtgttgttgaagtaggaactccttagttgaggttggtgttgacgctgttgtcgacgaagctggatgtcatagtagtagaaccttgagcaccaagtgcccctacctagcgcgccactgtcgatgggggatacccgtaaaccggatatagagggtattggggtacgctggtacgaggatctacatagtacgacatcaagcaaacaggaaacatggattatactggttcaggccccttggtacgtaatagccctaatccagttgatatgggattatatg

SEQ ID NO: 43447 - DNA, 3731 bp, Oryza sativa
ataatagataccctgagtgaaggtccccttagagatggcaatctcttgcatcatgagagtaacaacatcgaactgacggccctgaatgatggcatcgataacgtgccaagccactcccctaatgtcatcattgttacccaggcgagggaggatgctagctctcacaatcctgttgaccacacttgggatggtcctcaacccggcaaccttcccatgtgtgtaccgcgctccaacttcataaaactgagagaggtagtcgatggagagcggattatgggtgtgctcctcatgcaagtcatctccaaagtccaagcgaacatttaggagccgccggaattgcctcctggagatagagcactgaagggtgtcggacatccacttcatctcactatagtccccggccacccacactgtagcataaaacttccggatcaaatcttcattgtaatcttgcttaagagttaaaatccggtcaatgccaacagtcctgaagagatcctgcaagcccttaaactcggtagtctcattaatgtctctccaagagatcaacttatgttctgcaaaagctttcccagcatagacttgctcatacacactcttctggaaagcagtatgaaaacggggatccggggtgtcccgaggcctcaaaaactgatcgtggtgcctcaagatggtatattgggatggattcctcatgtttacaacaaactggatggagggatcaatattcatctcatcacttccttcatcctcatcctctccacttccactgtcatcatctccactttccccctcgctagccccctcaacattggcctcaacctcttcatcactttgagcatactcatctccgcttgactcctcactcacgggatcaggagtgggcgcacgacgaccatgacgggtgcggggaggcatagctgaaaaacaaggagcaaaggatggataagcaacaattttagaaaccacatagtgaagtgggaggaagggcgagtgctgcctatcaggggcggtcagactgagagccacggccggtcagaccgccggccctcggccgatcagaccgcgtgccctcggccggtcagaccgacggccaatggctggttagaccgcctttggtcagaccaccactgacaagagcacacccaaatccttccacaatccacataaatgattctaaaaattgctaggacagtgttgcacacgattggaactagaacatcaaggtgtgtgtcacgaccggaaataacccaacgggcgttccttacgtgcgtgcattattccttgtcccaggaggcaaggtacaccaaaagttgatacaattcagagtttaacaagcggaagcgcaattaattaattattacatgggcggcgaagacccagcacacaagaagacaaacgaaaaacagcggaagactagggtgacgaccacagacgcttgacggcaggcacgagctagacaccaaagccttcatcttccaggaactcctcttctgggtttgggaaaaattgagcaagactgagtacaaccaccgtactcaacaagacacacccacaagtgcagaataaatgcaagggagtacaagggagccataaattaggggttagggtttgcagtaaatagcattaaaagacacttagttgctcaaagctattttgtaaacatggtcctagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaaacactaacttgggtacattgctcggcttgcccataaccgagggcgcggctattcgaataggttatactctgatcagaggtgtacatctttacccacaagacacatcttcctcacgtgtaaccacgtgccacataccaccacggtatacggacggaagacgtgacatagtttccaacccatcctagccatagaaaagagtaccgacccaaccccacctacgcccggaacccccgggacaggtaggcaggactgagcccctaacagcaggacaccggtcctgtgccatgacatctcgactactgggccgcagctcgtgtagcattcatttgccctagagatgtccatcgacccccgacttcgtccatctccatccgtgtacttttgtttataaccagactgagccacaatctaagccttacccactagacatgtggaagtacggtagtgttttgcaacagaggcccgaagaccggtccttatatggccgaggtgctactatcaaaaccatgcaccccgagcccagccaaaaaccattttgagggttttgaatagagggggaggtgtgaatccaattccaaaataatccatccattccgtagtgtccaggtgatgagaatattcccaaagtctagagttgtaaaaccacctaatgttgcctaattaaccagcgaagcatttacctaaaatcatactagtggtaccatgagtagagtgtccactagttggggttctgtttaatctagggtgaacaaggtaataatatcaataacaataataataaggtcataacaaaggtacataggcatggctagataaaacagtgataacgcgggaatttaagtaaagcgataatgcaataatttaaatgaaaataattttataaactgggtttcaatatgttcaaggatgatgtaacttgccttgctcgctttcccaaacgtcggcttcaacctccaccaagagcggatcttccgaagctgcagcgtctacacgaccaacagaaaagaaaaggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaagggtttattgcgtcagccgagggggaggggcgcgcggaccgggtccacgggagtagggcccacgcggcagcctcatggtccacggtggaccgggcgcacccgggctcgcaccggccggcgccgtgggccccacgtgtcagccacacccgagggcgcgggcggctgacggctggaccccacgcggcagccactcggcgcgcccgacggcggccactcggcgcggccggcgggaggcggcgcccgcgcccctatggtcgccggcgacggccataggcacggcggagcggcggccgagagaggggaagggaagggggaaaagaggcggcggtccacggctcaccctaggtcgacggcaacgacgaaaaaggcagccagagcggaggaaggcggcggcgcggctcgggtcgacggggtcgacggcgttccggcggtcggcggacccggcgagggggtggacggggtcgatggcggtgcggcgaagccggaggaggcgacgccggggcgggagacggtcccggcgagcggagaaggccggccggtggtcgtcggcgacggaggagagagagggcgacggcgcgagctcgattccggcggagagacggtgcggcaaggggcggaaacgggcgggggaggcgcggggccagtttaaatagggccggggcgagagagggcggccggag

SEQ ID NO: 43448 - DNA, 2044 bp, Oryza sativa
acgaatccaagggagagaggcagggaaaaatggggggaaagggagaggggatcacggggagtgattgcccccagtttattgcacgcggggacgacgggaggcggcgggattcgtggcggcggcggcgctagggcacgggcgaggcggcgggagcagcgggaggtcggggatgacgggtgggccccacccgtcagcgagggtggcgagcgggcacgctcgtcagcggcgcgcgcgcggggagaggccggatgggccgcggggaggggagagagagagagggggaggggagattttagggtttttctttttataaaatcattttaactttgtttatttcttaataattattatttatgctctgaaaattccactaaaatttatttacacattttaggcttttaggaaatatacaaaaatcctctaagccttaattgacttttaactttgcacattttaattgttggaggctttcacacggtttttaattattctaggcataatttagaggatgtattttagagtcgttttgggacgtgacattgtgtaggtctatttcatcaagattgaagcaatggggaaactacccttaaccctaaagattgaaatagaccgatttgagagcaatgcacaagagggagagggatttaccggttgaaggagttgaatcacaccaagaaactaccctctattggtgcaaatcgatgaacacctcttccttcacctagggttccatgccatggatcacaaactcaataaaaactcaaatcaatccatggaatagagagaggaagaggaggggattcacttacggagtaaccggagtgattttgacggttgaaccggacggatttggtggagggaggtggctagggtttgggagaggagagagcagaagaaatttcgagttggagaagtgaagagatgagatgggatgaggacgggtcgggtagaaggaggaggaggaagaaaggacaaagtcctgggccctccatccctggccagtcagaccgccagggtgcagccggtcagaccgggccctagaggccggtcagaccgccgccaccaggccggtcagaccgcgcatatagcgctggtcagaccgcctggcccccagccgactgtgcactgcccttgcatagttcggctacccccacacaataaaattcaataaaaatttgaattttggagcaattttgaaatgtgtgagttgaaatattgccaaccattcataatatttgaaatttatgaagatttgcaacaaaactcacttgagtgctaggaggtgaccatttatggtctataggggtttttgggcgaatttgattttcaaacaacttttaaaatatttggattttgaatatgatttgaataccaaaaacatttcaaatcttcttctctaccaactttgttttgaaacttttctcaaattccttctcaatctcattttggggttgaatttcattttggccaaaaacaagattctagtttcttcaaaagagggccaaaatggcattttcattaaaaaaacatttttcttgcaaagtgaaggttggaaaacatatagggaaccttttgaaacattttccaagagatagttttcaaattacattaattttgcaaaaattttgacttatgttgacttgggcattttgaaaacactactagcacttttagttgatttgctcacatataaaaggaagtggagcacatgcaagagtgcaaacctcccccttaatgtgacatgctccattttcgcaatgaagaaccaaatggcaataaatctaaagcataagagcaaaaaaggagcaaataaacaatatggaaaagaagcaaccatggtgcaccatctcaagccacattagagaagtctatgatatttaactcattcctcaacttgcaaaagcgggtttcatcaagaggcttggtaaagatgtcggctagttgatcctcggttcttatgtggctaatgactatgtcacacttggcaacatggtctcttaggaagtgacggcgtatgtcaatatgcttggttctagaatgttgg

SEQ ID NO: 43449 - DNA, 4510 bp, Oryza sativa
tatctttatggcaccatcattgtcacataggagtggggttttgggaaggatatgccatagtccaacaatgtttgtttcatccaaagcaattgggcacaacaactacccgccgaaacatattctgtctcggcagtaagagggctacggagttttgtttcttggatgaccatgacacaagggatctaccaagcatttggcaactactggatgtgctctttctatccactttgcaaccggcataatccggatcggaatagccaacaagcttaaatttagcaccttttgggtaccacaagccaatagtagaggaatgctttaaatatcttagaatccttttcacggccactaagtgacactccttaggagcggcttgaaaccgtgcacacatgcaaacactaaacatgatatccggcctagatacggtaaggtaaagcaagctaccaatcatagaacgataaagctttaaatctaccggtttacctccctcatcaaggtcgagatgcccgttggttgccataggtgtcttaatgggcttcgcatcctccaagccaaacctcttgagtagatccttgatgtacttggtttggctcacgaacgtcccattcttgagttgcttgatttgaagtccaaggaagaagctcaactctccaatcatggacatttcaaattccctagacatcatatcaccaaattccttgcaaaatacctcattagtagaaccgaatatgatgtcatcaacataaatttgatacacaaagaaatcatcaccaatgatttttgtgaaaagagtgatgtcaacttttccaattttgaaatcctttgacaaaagaaaatctctcaatctttcataccaagccctaggagcttgtcttaaaccataaagagcttttgagagtttgtaaacatggttaggatatttagtatcttcaaaaccgggaggttattcaacaaagacaagttcggcaatttcaccatttagaaaagcacttttcacatccatttgaaatagttttatatcaaagcatgatgcaaatgcaagaaggatgcaaatagcctcaagtcttgccacgggggcaaaagtttcaccaaagtccaaaccttcaacttgtgtgaaaccttgtgccaccaatcttgccttgtttctcaccaccaacccgttctcatcttgtttgttcctaaagacccactttgtccctatgacattgtggtctctaggtctttcaaccaaagtccacaccttgtttcttgcaaagtttttgagctcttcatgcatagcattcatccaatccggatcacaaagagcttcatctacatgttttcgctcaagacaagaaacaaacgagtaatgttcacaaatcgaagtgacacgagatcgagtttgaacacccttactaatgtcacccaacacttggtcaattgggtgatccttggaaagagcggtgtgtatccttggtggcataggtggttcttgtgccttctcctcctccacttcaacttgagcttgacttggcatagcggaagtagatggctcatcttgagtggaggtggatggcttgtcttccacttcaataggcttgacatctccaattgacatgttcttcataactctcatcaagccttcatcacctacatcatccaaattctcgtgcccctcttgggagccattagtctcatcaaattgaacatcggcggtttcttccacaatacctttgttcttgttgtagacccggtatgccttgctttttgaggcataacctagaagaaacccttcatcacaccgactttcaaatttggttagtctaacaccctttcgatgaatataacatttacaaccaaaaactcgaaaataggcaatattaggcttcctcccaacaattacctcataggaagtctttttcaagacacgatgcaaataaagcctattggttgcatggcaagcggtgtttatggcttccgcccaaaaggaatcggaaacaccatattcatcaagcatagtccttgccatctcaatcaatgtacgatttttcctctccactacaccattttgttgaggtgagtaggtagcgaaaagttcatgtttaataccaagatcatcacaatagtcctcgatattggtattcttaaactcggaaccaatgttacttctaattttcacaagagtgcaactaaattcattttgggccctttttgcaaactttttgaaaaggtcggcgacaatagacttatcatgcaaaaagaacacccaagtatagcgagaataatcatcaacaatcacaagacaatgactattaccaccaatgctcttataggttgttgggtcaaacaaatccatatgcaagagctccaatggtttagatgtggacatgatactcttagtaggatgagaacatgcaacttgcttgccggcttgacaagcactacaaagcttatctttctcaaacttcacatctttcaagcccataactagatcacgttttgaaaatttgctcaattgattcatgccaacatgggctagccttctatgccaaagccaacccaaagaagtttttgcaactaaacaagttttcaaatttgcttcactagaattgaaatcaaccaaataaagatttccatatctaaaacctttgaacacacaagacttgtcaagaaggctagaaacaataacttcttgcgggaagaaagcacatgacaagctaagatcacaaatttgagcaaccgaaagcaaattgaaatttagagatttaacaagagagacattatcaattgacaaatcattggagatagcaattttacctaacccaattacctttcctttgctattgtctccaaatgtcactttctcttgttcattccttcctacctcaaatgtggtgaacatagccctatcaccggtcatgtgttgagtgcatccactatcaagcacccaatggctcccaccggtgtggtagttcacctacaaaagaagatcaagctcttttaggtacccaaacttatttgggtccttggaggttagagaccaaagctttgggcacccaaatgtcattctttttaccaccgagtataggggaacccacatatctaggaacaatgctaccatcatgagccttcctaagcatataatgagaatcaaacatgcatgtcttaggaggcttaccaccggggcaatcattcaccaaatgcccaacctcacgacactaggggcaatacttaccattgctcttgacaaaacgagtggcacggtgagaaggtttcttacccttctttggaatgaatccaagtccctccttgttaaggatgcaccgttgctcactcaaaatcttgtcaagagtgttcttacccttgaagcacctctccaacctcttgttgagcttagccacttgctccttaagctcattgttctcaacaacaagtgaggcatcacaaatagatacacaagagctagagctagagctagacatatccacaagatcatcacaagaggtagaaatgctagatgatgcaacataagcaatatggaaagtagcactatcatcaagcaaatcacaagatatgccaacatcaattagagctccatgttgagtagtggaaaggaggttgtcatgagcttccttaagcttctcatgagaaatggtgagtctctcatgagaagtctttagctcctcatacaagacctccaaagaagcatgatccttctttagggccttgaacttgacaatctccttctcactataagcatggagctcctcaaacatactcacaagctcatcataggaaacatcatcacaatcatcatcactctcactatcactaagagatgttaccttagaggagccttttgccatgagacaaagtggagcgaagagtgatggagcctccttgatggcaacaacggccatcttcttcttcctggagcttgcatcatcaccatcttcttcctcggacccggatgaggcgagctctcctcatttgagtcccattcctcgatgaaggcctcaatcttcttgccttccttcttgagcttcttcatgagcttgtagcctccactcttcttcttggatgacttgtctccatcatcatccttggaagggcacttggaagcaaagtgtcccttctcaccacactcaaagcacctcaagttggagagagtcttgttgggtcttctatttcttctcctatttgagttggagccctttcctctctcctttctccttcccaagaaatcattgaaccttctagcaagaagggcattctcttcttccaagttctcattgacttcattcaccttgcccttgcccttgtcttcaacttcggcttagagagtaatgcacttcttggaaggtgaggcttcctccatttcctttttcttcaacttatacatgtcattggtgttgatcttccccaagaggcttgccggtgtcatccttgacatgtcggagttgatgagcatggtgacaagggtctcatacttctctggtagagccctaagcatcttttgggcaacctcaagatc

SEQ ID NO: 43450 - DNA, 13633 bp, Oryza sativa
agccttcccttcgtgtttcacctcgttcgacatcttctctctaggcggtgaagcccaatcaggagagaccaagctctgataccacttgtaagatcgagatgtcgactagaggggggtgaataggcgatttaaaactaaatgacacctaatcaaaactaacctaagttgctaggcttggtgagggtcaactctaactatgcaactaagttaggttttgcaaacctagggtgatagaggctcaattatatctctaggaaagtaactcacactcctatgtcaatgtttagcaatcctagggtgatatgatctcaagtttgtctctagaaaagtaaattgcacaaaagtaaatgcgacaatcaaatgagacaaggagacaagagatttttcaccgaggttcggaaactcgtcggtttcttactccccgctgaggcgagcccaactccaccgctcaaccacgtagcctccgcacgcccccttcgtcaaggggtgggcatggcgggagccggcccatggagaggactacccaagcctcgatcactaggttagttctttcttcactccgaaggtggtgaactccaaaccactcacaaaccggcaccgggcctcctccacaatcttctcggagaggtcaccgggcagggcacgccggtgagaccgccactatgtggccggtctgaccgcccctggtcaggccgaacccagtgaatgtgtttgtgtgtgatgaaaaagtgagcacaagtgataatgcaatgacctaatgtggcaattaaaatcatctctttgctaggtcattacccctcttaatagtacggcgaaactagaaataaactagcaaatttgatcgccctacaccctgatcaattctaaattaaagcactagttttaccgtcttctttctctttgccttgcgccgtcaattttaatccatcgatcgtcatccatgtgcacacatgacgtggacctaacttaaaatattatctcaaagacaacggttagtccacaattagcgcttgtcattaattaccaaaattaacaccgggggcctcgatgcttcaacgtaggtgttagaacctaatatcacaagtgttgcaatacctcacaagtattacatgatgccccataggaatcatctgagaaccataggtatcagaacgtggtatcacaagtgaaaggatcttgatatcacctgcggaggggggggggggaggttgaagaggcgtttaaaactcgtaagtcaatgaagaagataaactttttggatattttggaatattttcggatattttggaatattttccgatattctgaaatattttgggatattccaaaaatctcagattttttagcaagctagaaaggcaaacaaaaagggatggtgtaacaggtagttaatgggtttgcacaaacaacgactaaactactagcggcaccaaatagcaaagctagaggagtaagaaaaagatatcatcaggattcttgcaagttgatgtgttaccaaagatcaaatccttggggggattctacactttgttgaggagcccataatgggccgggtcttttccaactctatcctcgctcttccctttcggaggtaagatccgaccttcacatactccctcggcacaccacaaacaaatcggtatctcgaggtttactcctaaccatctaggtgtcctcaaccaccaagagtaacaaatgccacagagatttcttggcgatgaatcgagtgctcaacaaatcttcacgaagtcaacaccaagcactcaaacaaactcaaatcaaccactcacgcacacacacgaaatctgagattgaagatcggtggagaggaagaagtgagaaggcaaaggctcaaactgaatctcaaatcaacacaagcccagggcaaagaataagaaatagagccagcagccctagcttgtgggtggagggggttatttatagccacagcctcagatatgcccgttgatggcaaagattaaatttttccaaaattctgaaaatcacaagaaggcaattgcatttcagcagcaatttttgtaaattccaaaaagtgcataattcagcagagaaaaaagcattttggaaataccaaaaatattttagaaaaatccaaaaatcacaagagaacaaaatcaactttcggaaattccgaaaaccattttcggaaaaatcctaaaaacaccagagagcaaaatcaacttttggaaattctgaaaaataccagagggcaatttgctggccttatcaattttgaaaattccgaaaagatctttcggaaattccgaaaatcaccaaaatgtaaaatccaataatgagaaacacttcgaaaggatttttgagcaccaaactcaaaagcagatagaaaagttgtaccaatatgaacaccttcacaccatcttctttctttgcttttatcgatactaatatggttgatacttagcaacttatgacttcctatggcctcgatcggtccattggtgtttggcaaggcattttctccttcaccactgcgtcggttcctttgcgccaaacatttgcttgatcttctcccatgcatggtccatcgcgtagcaagtcttgccaacccttcaccacctcttgccattttccgtcacttgtagaattggatgacaatgaaacctcgttgtattgcatatttttcttcatcatcttcattggttcttcatcggacaaatcccttgcttatacattcaataagtgcattaatcccttaatcgtttgtcatcaattaaccaaaacccactaggggcatagatgctctttctacaagtattgcttggtacctcgcaagtatacctaatatctcatagtaatcatccgatacacatcattatcaaaaactgatatcaagtgtatcgcctaatacctcgcaagtatcacctggtagctcacaggaatctaaagcacgactgattggagacatccccaatgcctaggtagatgaaggctgagatttgcctgattctcaagttcagagagaacccttctatgttgcatgaggtatccctggttggcttcagaaagaccttgtcacgaaccttccccgcttggctagtgagggagtaagatcacgtctcgtgggtaaagcatgcaccctctgcagaggattatcaaactattcgaacggccgtgaccatggtcatgggcaaatgtgaggtgattcctctttgcatagatttgtttgcctatactttgtgaaaagtgtttgtgggattgggaaccattactagaatcagtcatgatgagtaatagaggaccattacgtggtctgaaaatgatcttgtgtagatcggggtgtcgattggcattatagattaggcttccctagtggaagcagtgtgtgctagagattatggacaactcttggagccaaagagatgagtgatgagatgggctacccgatggtttgaaagtgaaaagaaactgatagttgagaacggagttagaagctgcttgatggcagaataatgttaaccaactaaaatttgcttcgtccgtttgagttgttgtaaagcaatttgccaacagtatctaagcaaaaacttctttctgaccccatgattgagggcacttagtggttcgcaaaatgttcttttaaaaagaaatggttgcgaagtaaacccagcctcccttcgaagtcttcatgctcacgtttctcatgacttgctgagtgttggtgatatgccctagaggcaatcatagagatgactgtatcacatactatgtttacatatttatccgacattgttccttgaaatagataactcattattggttaataaatgtttgattctttcatgagactcttgatgttgaatgttactatttctaaaggatccctgatcatatatcatatgtggaacaaatatgtttaaatgatcagcacatgtattagttgatgatcatgtctcatggatcatggtatagagataccaaattgataatgtggatgatgtgggaggtgaggtcccgaatcaacttctttgatcatccatgcattcgttatgctcggcctcttttccttcgtccaagcaagtacatctgtaaacgaaaatgtttgttcaagtatataacaagcaaatctaatatagaacatatgcacatttggttgattaatacctaaggtagtcatggttatatccgagtgttaacaaccaaatttggtaatttcagtatcggagatggagataaagtcgaagcggaatccaagatggagatcgttccgcaaacagagcaagaatcggctaaagtccgaatcggctgtgaccgggatcggcagagtccgaattggataaggttagctgattaagccgagtccgataatatggtgaggtacatgttgtcgggttaagttaatgtgcttcatgaggattgccacgcatggactaagtcctgagaaggcaattgtatctattaattaggatattttatgtaatttccttagagatatgtttgggcaaaagtctgccgcaaagacttatggtatcttagtttgttagagataaaagtcgtgtccgacacgggcatattttgtaaatcttgggtataaatagaccccgagccccatgtaatatgataacacacgttcaatacaatctcagcgcaccgccacccttttactttcattttgtttcgacgagttcttgctttcgggttgagctgcatcggtttcgatcttcaactagaggtaaaacttgttatggtggcttgcgttctcggaattagggcttccatctttatgatactctaatcttgttcatgtaattcgttgagttatcatatatcctatataatctccggcaatatcgttatctaacccccaattggctaatgtctgttactaaaaggcagccgattaggttaaataccaacgttgactaggattatataggatatccaccactctatgaaacatccaatggcttgattgtctagatattttccttcttttcatacttatagctgcatcagttgagtttgaccttgtaagtcatgattagaatctcaatctctagcctgcttttggttgccgattagtgtagcatcggggtttcagtcgatcttacctaatttaactacatttatcttatatgcttgattgacatgttaaattgccctttttgttaagatcttgttgcatttaagtatattaggctttcgtttgatatattttacttgctttgatatctcaatatagagtggtattggagtattagccgatacatgctagatctatctgatcggctatgctatgaacgtatatagtcttgttgttaatatatatttcgatctaagtgatttatactgtctcggcatggcgaccgatctgtcccaatcacttgatttaagtatatatcgacacaaggattatatattgttaatatctatagccgatcgagtagatttaattttttcttacttgttcatgattgccgatcgatctatatatgacatcggctcaaagatgaatgatatgtcatcggcaattagccgatcggctatcgtttatggatttaaccgcggtttctttgtctttatttcttgttgattgcaggatcaaatcaactggcatgctcattaacctaaaggcaagatttttggacctacactgaagttaagcagatcttccaggcctcgtttttttacatcaacaccgagctagttatgttctcatcagtggacacacgttggggaacttgttgttggatagacccaactcgagacactgcaagagccatatgtgttgtgtcatcagtgatttcatttagtgttggtgttgaattcttagacatgagattatcatggttcccaacatatgtagtagcttacttagggactgctaaacgctaccccataattgggtagttataaaagtagttttcgggtatgctatgaaacatgtagtgggatatgaataatcatagtgtgatttgcccctcctatggagagatatctctgggcccctcaatgttatagattatagagtgcatggccatgccaaaggtgattgaggagtgtcacgccctaaaaatcctaaatgtataaactgttgtttaattggaattgttagaaattattttaaaagcctacaagctaaactctaattttctaggaaaattttcaacataaaaatgagctccgtcgttccggagtagagcgtttccattgaggaaggttccgaagcgtttgcggaagcccaaggcaagtcacacagatcccaaacaaccctttgagcatgttgaacccgtttaaagctattattttatttcaacttatgcattattttcgaatgtcattgggtggtgaacctttcccagttaattgttggccgaagatgactttattttcctatgggttataatttgattagcatgaaccttatataatggattggtccagctaaatgctatatatatgtttgcttagccatgcttagaaacattagctaactaaagggattaattataaactatgttatatttttattaatgatggttatattaaatggtagctcacgatggttaatcgtgtgaggttaattaattgataattaaaacctggttaaggtgggttgtgagcatatggttttgatggttgtgctcatgacaattaaggaccggttcgcgagctactgttgtgaaacatttatcgtgccagccacaagccagcgtgggcaacggctttatcttttgtatagcgtgattcattatagtgcgccagactgagaagtggcgagaagtccacgggggtcgctggggagtccaggtgtcacgaccggaaataacccaacgggcgttcctgacgtgcgtgcattaatccttgtcccaggaggcaaggtacaccaaaagttgatacaattcagagttcaacaagcggaagcgtaaatagttaacttattacatgggcagcgaaggcccagcacacacagagacaaacgagaaacagcggaagactagggcgacgaccacaggcgcttgacggcaggcacgagctagacaccaaagccttcatcttcaaggagctcctcttgtgggcttgggaaaaattgagcaagactgagtacaaccaccgtactcaacaagacacacccacaaatgcagaataaatgcaagggagtacaaaggaattatactataaaggggttagggttgcagtaaacagcatttaaagacgtttagttgctcaaagctattttgtaaacacgattctcgaactatacaatattaattatcaaggccgtgaacccacacgaacctgccttaacccaaggcctatgatgattcagaccgaactggcaacccgaccctgggtcccagctcgtcccaagccaacccaggccaaccattccacattttagttgttaagcaggttttaagaattgaaacgctaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagctgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacaataaccaaaccattccatagtatccagatgatatgaatatttcccaaagtctatagttgaaaaaccacctaatgttacctaattaaattgcgaagcatctacctaaaactaaactagtggtgccatgagtagagtgtccactagttgaggttttgtttattctagggtgaacaaggtaataataacaataacaataataataaggtcataacaaaggtaaataggcatggctaaataaaacagtgataacgcgggaatttaaataaagcgataatgcaataatttaaatcaacataattttataaactgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaactccatataacagcagaaacaaagcataaaaatgggttcttggcttcataaggaaaaattagagacttgaacggtccaattccgagttcaaatggccaagttatggccatttgaagtttatatgctctttaaatggatatttgcgaatttcttcatttaaattttaattaaaaatcggatttattgcgtcagccgagggagagggcgcgcggaccgggtccacgggagtggggcccacgcgtcagcctctcggtccatggtggaccgggcgcacgcggctgacgccggccggcgtcgtgggtcccacgcgtcagccgcacccgcgggcgcgggcggctgacggccgggccccacctggcagccgcgggacgcgcccgaaggcggccttgccggcacggccgacgggaggcggcgcgcccgcgccccgatggtcgccggcggcgacctccggcgcgacggagcggcggccgagagaggggagggaagggggaagtgaaacggcggtccttggctcaccccgggtcgacggcggtgacggaaacggcgaccgaagcggcgagaggcggcggcgcggctcgggttgacgaggacggcggtgctccgacggtcggcgggcgaaacggaggagtggacgaggtcgacgaggacgcggcgaagccgaaggaggtgacgccgagacgggaggaggtccggggcgactacggcggcgaaccggagctcggcggcgacggcgaagagaaaggacgacggcgcgggctcgattccgatggggagagaaagcggcgagcggcggaaacggaggagagaggctcggggagcgattatatagcgtcgggagggggagagagcggccggaggggaaggaatcggcctgcggaaatctcggccgccattgatgcaccggcgaagatcgcgggagtgaatccggacgaatccgagggagagagagaggggaaagtggggggaaagagggagggaatcacggggagtgatttccccctctttatggcgcgcggggacggcgggatgcggcggattcggcggcggcggcggcgctagggcacgggcgggcggcgggcgcggcgcgaggtaggggatgacgggtgggccccacccgtcagcgagggtggcgggcgggcccgcccgtcagcggcgcgcgcgcggggaggaggccgatgggccgcgggggagaggagagagagggagggagttgggccgagccggcccaagagaggaaggggggggggggaaaaggacttttagggatttttctttttataaaacccttttaactttgtttatttcttctcaattattatttgtgctctgaaaatttcactaaaatttatttacgcattttaggcttttaggaaatacacaaaaatcctccaagccttatttgacttttatatttgcacattttaattgttggaggctttcacacgaattttaattattctcggcacaatttcgaggatgtattttagagtcgttttaggacgcgacagggtcccagctcgtcccaagccaacccaggccaaccattccacattttagttgttaagcaggttttaagaatttaaaacactaacttgggtacattgctaggcttgcccataaccgagggcgcggctattcgaataggttatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccaacctacggccggaacctccgggacaggtaggcaggattgagcccctagcagcaggacactagccctgtgccatgacatctcgactaccgggccgcagctcgtgtagccttcatttgtcctagagatgtccatcgacccccgacttcatccatctccatccgtgtacttttgtttataaccagactgagccacaaactaagccttacccactagacatgtggaagtacggtagtgctttgcaacagaggcccgagcttaatccttatattggccggggtgctacttcccacaactggcatgcacccaaaccccaccggaaaacaggttttaggggttttgaaagaggaagagaggggtatgtccaattccaccataatccaacaattccataatgtccaaatgatatgagatttcccaaagtctaaagttataaaaccacctaatgttgcctaattaaacagcgaagcatctacctaaattcatactagtggaaccatgaatagagtgtccactagttggggttttgtttattctagggtgaacaaggtaataataacaatagcaataataatgtcttaacaaaggtaaataggcatggctaaataaaacagtgataacgcgggaatttatataaagcgataatgcattaatttaaatcaaaataattttataaactgggattcaatatgctcaaggatgatgtgacttgccttgctcagagagaacggccttccgaacctttggcgacgaccgcgaaccacgcttctggaacctccggaacgacagaagctacgcgaagcacacaagcaaagctacaagcctataaagaaacaataacaatacataaaaagaaagcatacggttctttaggttataacaaacattaggagacttgaacgggtcgattcagagctcgtatgaccaagatatgatcatccaaagtttaatgctgttatatggagatttgcggattattataattaaactttgcaactataaaacatgtgtaagcgctagcctggaaagacaggaaggctgcgccgttgacatgcggacctcacatgtcaacaaaaaggaccgcggtagaccgcgtacacagagacggtccacgggtcgacggaagcggatcccgtgtgtcaaccgaggcgagtggccgacaaacggactccactagacaccacacggcctgcacacgtggaaaccacgcggctaccgagcgggcacactaacacagacactacacggtcaccacccgcacgcgtgaacgactaccgacaccggtacacgggtaccggggtcgacaaccgcacaacgggtacggggtgacactgaaaggacgaggacggggcagcgagaggacggatccttaccaccacgcgacgaggcgtgggaacaacaacgacgaacgggcgcggcggacggcgagggaacgacttcggcggcgatccttggacgaaggcgagacgcggccggcatgaggcttgacgacgcggagccgaggacaaagacgacgacggctacagcgaccttgacgaaacaccgaggacggacgagaacggctcgacagagggacgaacgccacgacgaccgggaacgacgggaggacgacgacgacgacgaccggggccggcgaggagacgacgagggcagccggcagcggctgcacggaggcgaggatggcgtggaacacgccgctgcgatgtcgacgacggaggcggcgccgcgagatgacgagccggcgaggatgaacggtgacgacgacgacgaacaccggcggggttcggtcgaaggggaggcgaggccgagggcgtccttgacgctgcgatgccggaggtggagacggcgacgtcggccggcgcactggcacggcgaaaggggctgccggagtgggtgccgacgagaccgaggaagaggcggcgcgcgtgacggcggtgagggctagggaccacgggagatcgcgggagtgggctaaaacgatagaacggagcgaggggattccgttttatagcggagggaagcgagccgggcatgggagagggcggaacggcgacgggaaacacggccggcagccatggaaggcggccgggaatggcgcggccgttccgggcgattgggggcgccattcaaggggaaaaacgggggaaatcaaagaggaatcaatggggattaattccccccaatcaatttggaaagagccggcttgaatggagcggatttggaggaggaacggcgctagggttcacgggagagagaggaaggaggccggcggctggaggccggggacgcgcctgacaggcgggacccacgcgggaggcgcgcggtcaacgcgcggcaacggcgcgcacgcacgcgcacgtgcgcggcacgggagggaggcgcggctcggcttgggccgggcgaagccgaggcggcccaggaggagaggagggagaggcagcccgggagggagagggtggaggagggagtgggccgagagggggaggggaagagtgggccgggaggaggaggagaggcccgggagaggagggaaagagagggaggagagggagactttggccgcgggccaagagagagagaggaaccttgggccagacttggcccaaagggaaggagagggttatttttaggttttcgttttattaaactttgataattgtttttgttgcttaataaatatttccggcgctctgaaaattcaagtaaaatttgagggctccttttagaccaaggagaatttaacaaaaattctccgggccacattcgaatttttcttgtacgtattttagtgtttgccaatttcttttcgaattttaattaattctattattccttttagaaaatgatttttattttgggatgaatttatcaggacgtgacaccacatcatgtcaccatgtgcctcaataccaccacggtacctcggaaaggagttgtgacaataacccttgcacaacataacccattacagcgcacctttcctggatcataatcacccccttataaacaaggcctggtgtcgcgtcccaaaacggctctaaaatacatcctcgaaattgtgccgagaataattaaaattcgtgtgaaagcctccaacaattaaaatgtgcaaatataaaagtcaaataaggcttggaggatttttgtatatttcctaaaagcctaaaatgcgtaaataaattttagtgaaattttcagagcacaaataataattgagaagaaataaacaaagttaaaaaggttttataaaaagaaaaaccctaaaagaagtcttctttccccccccctcctctcttgggccggcccggcccaactccctccctctctctcctctcccccgcggcccatcggcctcctccccgcgcgcgtgcggctgacgggcggacccgcccgccaccct

SEQ ID NO: 43451 - DNA, 1193 bp, Oryza sativa
gatgcttctggtggcgaggaggtcctttggtctgctacctttcagtgaaaccttgaagtgtttcgccaaaagctacactgactgtcattgcctttgatccggaaaagacacatctgaaactcttagtccaaacaaatgtctctttggttaatcacctgattttcttttccatcctcaggttggttattagctcgaggttagaatatagttcctctggcacgagaccctaggtctcctttgtcagtaaacaattatacacatgatcacatatccgcatcttccgaaagaatcctcttagaacttgtttttattaccaatttctcccatattacatgaatacaaggcactgtcttaaacaaaaagggacggtacttaacatcggtacattgtttctactatgggttagaattaacatgaggcctcacaggtacggcgtttgctccagtgaccacaaggcgagtgacttgtcttcttcttgcataatggccggagtgatggcgcaggttacgcttcggctgtggacaatctctggagaaatgacctggttctttgcagttgtaacaaatcaacgtcttctttgctgagttgtccgtctgggaacgatcgttctgactaggagttggaattggtggttggaaatccttgctaacattggcatcagtggtaccgtagttgctatcacaattggagtctttctcagtgtcaaaattgcacgcttgattcgagtggtcactaatggggcaagaaccatggttgttggtggtatcatcaccattagtattgctagggttgttgtctgtattgcgtccgtcttcttggggcaggaactcttgatgcacaacagaagatccggtgatctgaagtggctcagtgcgctgtctttggttaccacatggaattactgggatgttgacaatccttctcttgcagttcgtcatccgattatgctcactttcgagttgcatggctttgtccacaagtttctcaaaatcttcataatcctctaggagtagttgcacttcaagctcatcttttaacccctggagaaacttctcttgtttgtcttcatccgtttccacatcttctggtgcatagcgagccaaacgatagaactcgtgcaggtactctgtgacggtcaaatgtccttgcttcaggtagcgaaactctcgttttcttagtgtgatcattcctgc

SEQ ID NO: 43452 - DNA, 7342 bp, Oryza sativa
cctctgatcagagtattaatctattcgaatagcggcgccctcggttatgggcaagccgagcaatgtacccaagttagcgtttcaattcttaaaacctgcttaacaactaaaatgtggaatggttggcctgggttggcttgggacgagctgggacccagggtcgggttgccagttcggtctgaatcatcataggccttgggttaaggcaggttcgtgtgggttcacggccttgataattaatattgtatagttctaggatcgcgtttacaaaatagctttgagcaactaaacgtctttaaatgctgtttactgcaaccctaacccctttatagtataattcctttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttctcgtttgtctctgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacaagttggtatcagagccaccgttgaccctaggacgagccgtagatcccaagccttagcaatattttcaaaaataaaaatcttttgttatttgtgaaaactgtctagtctctctctgtcttgctgcttcatttatcgccaaaatctgacctttaaaatgttgtttttctttttgtttttgtttgtagatggccagcagcgtcacccgtcgtggtttggacatgactggcttcgtcttggagctgcggggcatgtgcgtggtcttggggtatccacatggagtggactaccaggccaggccgcttccggagcaggagggtgacgatgcagagccccacgctggttgggaggtcactgcagtgatcctgtctggctctcccgagcggacttcgctggcagtcaccgcgggtggagattccttccccgccgcttgccagaacgccgctctcctcgctatcggcactcttcaccagcgctacccggacgagttgcagcactcgccctaccgctaccaccctcgtcgcggaggagcccgcgactacgccaccttccgggatgctagctcggaggatgacgctaccatcgtgcacctggcgcgcatggtggaggcgtacgacgcggctcgtatcgacttccaccagatggtacgccgtgggatggtcgagaacaacatgaagatcctggagctgcgtcaggagaacctgcagctcaagaaggacctagacgcggtggaggcgcagctgcatcagctcaagatcgcccagggagaggtctgccgccccaagcgtcgccgcgtctggtggagccgttccaaccaactgatgagttgcgaagccaacccgctcctggtcggtgcactgaatcaaccctagcttcttctcgattgtgcgcaaccaatcactggcttccataggatcgacggcaatggcaaaggttggaggctcagttttgagaaattctgataacttgcactgttgccggactgtaggcacttgaacgttggttgtccctgctgggctgctccaattctgtaatagttgaaaggctgttgccaacatgttggtttggttaaccacaacttggattagctctggtgaggtttcgttggtgcttctctcattcccattggcttgggttcttgcgtcatcggatccatcattcccatagcctttgttaccagtattatccatctgtcacaaggtaggggttgagaggggaagcatacaaggaaagaatagaccagaactagggacaagaccttaaaggaactaactctttttgttgatgtgttgtttgtttcacttattctgcaagttgattaagcaaacaacctagcatggttacatcaccacccaccgatgcaaaccacgcgctacacacacaagcaaggaacacacgactaacaacactaccctatagggtggcttaggttctgcgacgggttcccaagatcttcactccttcacagctggcttcattgcttccttcgcttcgctagcggatcctgcagtcttccggagcttcggcaaacaactgacgacatcttcttcctcgcaaagctgaccatctagtactagttgaaaatccgaagaaggaagaacggagtaaaccttttgcaaatagcattaggggaaggagaaaaaggaactttcgcaaataatttttatttataaaatatgtccttgggttttatccacttggcttatcctacagtcgagatggctctgataccagcttgtcgcgaccgggaaaattgccttttcccgaacgccagtgtattaatccccgtcccaggaaaagccggggtacaccacacaaacatgatatagaagacacatctttattatatcgataatatttacattattacaaaggcacttcaggcctgacaagcaaaaataaacagcagcggactagcggcctacggctccatcttcacaggcgctcaactggggtataagccaggactccacctaagacatcttctccaaagcttctcttactgaagggggggaaagattgagcaagaatgagtacaaccacagtactcagcaagccacaccggcagatgcataattaatgcaagggaggtacaagggaataataatatagggattaaggtttgcagtaaacagcatttaaaagtcacttagttgcccaaagccattttgtaaagacgatcatagaactacacagtattattaaacaaggccgtgaaccctcacgaacctgccttaacccaaggcctacgatgattcagaccgaactggcaacccgaccctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtgtgtccaattccaccataattcaacaattccatagtgtccaaatgatatgagaactcccaaagtctaaagttataaaaccacctaatgttgcctaattattcagcgaagcatctacctaaatttatactagtggaaccatgaatagagtacccactagttgaggttttgtttaatctagggtgaacaaggtaataataataacaatagcaataataatgtcataacaaaggtaaataggcttggctaaataaaacagtgataacgcgggaatttaaataaagcgataatgcattaatttaaatcaaaataattttataaactgggattcaatatgctcaaggatgatgtgacttgccttgctcagagagaacggccttccgaaccttcggcgacgaccacgaaccacgcttcgggaacctccggaacgacgaaagctacgcgaagcacacaagcaaagctacaagcctataaagaagcaataacaatacataaaaagaaagcacagggttctttaggttataacaaacattaggagacttgaacgggtcgattcagagttcgtatgaccgagatatgatcatccgaagtttaatgctgttatatggagatttgcggattattataatcaagttttgcaactataaaacaggtgtaagcgctagcctggaaaagacaggaaggctgcgccgttgacatgcggaccccacatgtcaacctaaaggaccgcggcagaccgagtacacagagacggtccacgggtcgacggaagcggaccccgtgtgtcaaccgaagcgagtggccgacaaacggactccactagacaccacacggtcaccacccgcacacgcgaacgactgccgacgccgatacacgggtaccggggccgacaaccgcacaacgggcatgggcgacaccgaaaggacgaggacagggcagcgagggagagggaaccttaccaccacgcgacgaggcgcgggaacgacaacgacgaacgggcgcggcggagacagacgggcacaacggaggcgaacggcgaggggacggcttcggcggcgatccttggacgaaggcgagacgcggccggcgcgaggcttgacgacgcggaggcgaggacgaagacgatgacgggggctgcagcgaccttgacgaagcgaggacgacgaacgagaacggcttgacggagggacgaacgccccgacgatcgggaacgacgagaggacgaggacgacgacgaccggggccggcgaggaggctacgagggcagccagcagcggctgcacggcggtgaggatggcgtggaacacgccgctacgatgacgatgacggaggcggcgccgcgagacgacgagccgggcgaccgacgggacgtcgacggcgagaacgatcggagacgacgatgatggcaggcagcagcggctgagaggaggaggggacagcgtggaacacgccgctgcgacgttggtgaaggtggtggtgcagcggggcgacgagccgacgaggaggaaggagaggccggcgcggagacgacggcgttccggcgaagttcgggcgaggaggaggtgatgccggggatgagagcggcgtcgtggagccgaggaaggtggtggcgacgtcggccggcgctccggggacgtggcagaggcggccagaggcggagaagtggtggcgacgccactggacgccggcgagggcgcgtctccggtgatttccccgcgaaacggagggctgaccgagggagagggggcagctgcgaggccgagggagaagacggcgcggccgggcggcgctcgggcgaggagaggaaggcggctggaggtggccggcgcgagggaaaggggagggcgacggcgggaacgcgcctccggcggtcaccgcgcgaaacggagggtaggccgtgggagaggaggcggctgcgatgctggaggaggcgacggcgcggccggaagacgctccggcgaggcgggagaggcggctggaggccggccggcaacgtgggagagagggggcgacggtggggaggtggctagagaccacgggagagctcgggaagaggctaaaacggtagaacgggggatgaggatcccattttataggatgggggagagagccggccacgggaggagcgggaacggcgacgggaatggcggccggcggcaaaggaaggcggccggacttggcgcgtccgttcccggcgattgggggcgccgttcaagggggaattaagggggaattgaagaggattcaatggggtttaatttcccctattcaatttggaaagaagggcattgattcgcgtggatttgagggaggaagggattagggttccacgggaagagagagagaggtggccgggcggaggaggaagaaggcgacggcggcctgacgcgtgggccccacgcggtcgggcgcgcggccgacacgcggcaacggcgcgcacgcacgcgcacgtgcgcggcacgggtgggagcgcggctcggcttgggccgggcgaagccgaggcggcccaggaggaggggagggagagaagatgggccgggaaggagaggagggaggggcggcccagaaggaggaggagaggagggagtgggctgcccgggaggggaagagaggcccgggagagagagggagagaaggggagggagagaaagagagggaggagagaaggacttttgggctgggcttggcccaaaggaggaaggagggttatttttagattttctttttaataaactttgttaattgttgttgttgtttaataattatttccggcgctctgaaaattcaagtaaaatttgagggctcgttttagaccaaggagaatttaacaaaaattctccgggccacattcgaatttttcttgtacgtattttagtgtttgccaatttcttttcgaattttaattaattctattattccttttagcgaatgaattttatttcgggatgaatttatcaggacgtgacaaatccaccccccttacaagaatctcgtccccgagattcgaggaggctagcaagaagataggttgggcggtcttctcttcttgtctgacttcttccgctccgtcttctataacaaacttgcctaacaacacttcttcactctggactgcttggctcgatctcctgttgcagatggaatcttctcttcacctgacttgtccctggttgaacctttagctgacttcgactgggttgcggcacttgaagatggggcttcagttccagaactttgcatagttcatatctttggagtcaacctcatacaagttacccacttcatgtcatgcgtcgagatcagctcgtctttactaagataccatgcttgtcataacttgtcatcatttagcattcaacgtattcctttacacctttgcccttgatgtgttctttcccgatttctcttattaatcacctttcgacctacttctttgcctggtaataaacatctttttcgatatcttctatcagtcatcttttgaccttggtcactaagtactcttcactccgagagttgtggatgcttctggtggcgaggaggtcctttggtctgctacctttcagtgaaaccttgaagtgtttcgccaaaagctacactgactgtcattgcctttgatccggaaaagacacatctgaaactcttagtccaaacaaatgtctctttggttaatcacctgattttcttttccatcctcaggttggttattagctcgaggttagaatatagttc

SEQ ID NO: 43453 - DNA, 824 bp, Oryza sativa
ttcatttgccctggagaatgtctatcgacccccgacttcatccatctccaatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacagtaaccaaaccattccatagtatccagatgatatgaatatttcccaaagtctatagttgaaaaaccacctaatgttacctaattaaattgcgaagcatctacctaaaactaaactagtggtgccatgagtagagtgtccactagttggggttttgtttgttctagggtgaacaaggtaataataacaataacaataataataaggtcataacaaaggtaaataggcatggctaaataaaacagtgataacgcgggaatttaaataaagcgataatgcaataatttaaatcaacataattttataaactgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaactccatataacagcagaaacaaagcataaaaatgggttcttggcttcataaggaaaaattagagacttgaacggtccaattccgagttcaaatggccaagttatggccatttga

SEQ ID NO: 43454 - DNA, 1514 bp, Oryza sativa; identical to SEQ ID NO: 38941

SEQ ID NO: 43455 - DNA, 7830 bp, Oryza sativa
  unsure (1)..(7830): unsure at all n locations
taaaccaacaagggtgttttactatcaatgcagcatccatgcaatatcacaagatttcgatgttgcacagcggaaattgtcgcaacctctgtcacaaactggcttgttccctgatgagatgattgtgaaagttgcttcacagctataactctttcatcaggtagcttaccctgccaaggtttttacatgtgtattttgagcatagacaaatgttgctaaaacacagcacttcaatgccaaatcagataaatttataaccagctgcagttgtacataattaattatggaaataaagaaccttatacactggcccgaatccaccttcgcctagaatattttgagaactgaaattgtctgtggctagctttagctcagcataactaaaaacgtcaggtcgtccaaccaggttgtatagttctgcatgttatttttagcacagatgagaagagtaaaccagataattttgatgtttgaattatatatgtcctgatatataataccttctttctgttgtgccaatgctctccgcttctttactagtgtaaacactccaaataatgctgctaatactaaaactattgcaccaatcaatattccggaaattgcacctgctttacttttcctttttggtatgccgtttcgaacggtaggagtaaaatctgcaaaggaaaaatattatttatcggcagcgaatataacacttcctgctgttgttttagtgtggtgcttacttggagtgacgctcaatgctgagatcattggcccatagtaattatctttagtaggtatgtcaacagtgcccttgccagcccagaatagatggatctcaaggaagtttttagacacagttaccatgaaactcctattaactacggtaaaagattttccacctgctgttttccttatatcgaaatccttttgttttagagcaccctatgtaaatatcagtaatacttttagataaatattggtaagattcagtagaaaaacattatataaaatgcacaaaatttctacctggatatatatgtcaaaaactcttctccctaagcttagccaagtctgtgagtctggaaaagctaattctgcgaattggagcaaaacagtgtaatttccattctcaagtccaagtccatagtacctcagagatgatgatgacatccttgcagtttcaaacaactctgaatcaactacattttgaaaaggttgggagctatatataatattctttgcatctatggcgttccctacactactgacaccccatcttgtttgaccggtaacataatatgttgcagctccaagatttgtaggatctgcttcataaatagtgtcatctgagcctcttatggatgcattactgccacagtcaactgcgaaggaataatctgcaattaagattaaaaaaattgtagccatcattcaaattcgtaagttcatgttactgtttagttttatgaagaatgagaaatatacattctggagatccacggaaacaaggggtgtcttgttggaggcagtttattccccaaggtagcgtactgtgcacaatttgaattgaaaatttaaagttaccagcaagattttcatatagttcactcgccaaattagaactaaatgtcacaagtacctttcactggtggtatcgagtaagaagttgtttgccaccaaattcctttcaaaaaacagaatattagtatttatattttttctcagcgacacaaatatcacacttttacacttacaactgtaaattgttttgtctagcccaagaaggaatgctcccagtgagttggttgtacgaaaaatctctgtcaacattccagaattatgttatacaaaattagtgcgtactattatgaatgtagtttgtgctatactgccatgtcaattgtatttgacatacatcacttttaatgaagagcttataccatccggcaactttcctgtaaggctattgttcccaagaaacctgaattgggcacagttcaagattataaaatatactcatctgcttaatacaggctcgtatgaacaaattgatgtaaagaaagaatttcttacaaagaattgagatttcccaaattcaagatggattgaggaacttctcctgtgatattgttaaaactcaagtccctgtgccacatgactatcatattacttgaacatatggtacacaacatgaggaaatgagtaataacgtcatcagttggcaccatggcctgtaattgaaaacttacagcaattttaactgtttaaacatggaaaattctactgctccgagatcactagatatcttgcagttcctcaatattctgtaacgaggaaatacaaccttggtaacttgcaactagacaatactgtaagctttatagctaaaagcatcacatacagtgtgctcagggatgccatattactgataaatgccaacggagagaccccatttataatatctccaatccatctgctcatttgagtttttcataaattagttatcagccttgacattgtcaaccttcaagagttcatgccacaaaaagagtatacttacaatcttgttaatttggtcagattagacagactttctgggactggtccttcaaaggagtttccgtggaaagcactacaagctcattattttagaaaaaaagttagggacattcaacctttataaagtaagaaaaaaaatctctgtgtgagcattcttaataagatctctaggtatgaacatgccatgtggaccgcttactgtgatgcagatatctgcatttatattgagtgaggactgaaatgtgaaaaaatgcttttgtttaagtctgaatggagataatgtgatatacagacagtaatttatcttgcacagattcatctatctctgaacagtaagaacgaatgatatcttaacaagcttacatgtcttccaaattagtcattgtgcccaaataagcaggtattttccctttgaatacattatctgatgcactcctgcaagcagaccaaaatatcatttagcatgacaacatgacgaatataataattgaggctatgtttttgactatacaagaacttcaggttctgaagttttcagaacgatgaagggaacggaccactgaatccagaactatcaaagtacctgttattgaaagtttgaaatattatcatgtttgacaatagatatgaccattccanatttagttcttttacaagtagaaataagaagttagaaatcaatggggtatcttacaattgctgaagtttggtcaagttacccagttcttctggaagacttcctgtaaaattgtctgagctaatgcccctaaatgaaaaatgaaatatttcaggactgacaaaaaatttttgtcatcaactaatagcaaaaggggcatagttttcctgatgtgccattggacccacaatattcatcattacaatatgttcaagtatttgctgttcaatcttacttgatcatatgaagcaccacatgagcaggagttacactgacatgcctattacatcctatttagtagtagttttgatcttttttatcactccctccgtcccattataagtgcaaccataagtgtttctgtatcaaacgtttgaccgttcgtcttatttgaaaaaattatgattgtttttaaaaaaataagtcatgcataaactactattcatattttatcatctaataacaattagaatactatttataaaaatatttcaaataaaacggacggtcaaatgttgagcactaaaacccacaactgcacttattatgggacgggggaagtagaacttatgcgattgctatttcatgtattattatattagttcgtgcagtccaaatatatactccactcatttcatattatctgtcattctacttttgttgtaagtcaaacattatatttctaaccatccatttttacatatttatatagtttaacatttagattcaacatgagaaataatttcataatttatagttcgtactccctccgtaaaaaaaaatacaacttctagctaacaatttacacataagctatgctcagattcgtagtcataagttcaactctctctctatatatatgtgcgcgcacgcgcgtgaaaactgctaggaattgacagttaaagctgaaaggatgagtggtttgtagcagagggagcagtggaagattaatccacatgtgagaaaagatttcttacaatgaaagaagattggtgaggtttcctagttcctttggaagtagtccagatagtggattgaaagataatgaccttgagatgattagcaataattaaaaaaaaacaacgaccaatagatggaacatgatctagaacaaacatgtaactcatacaagtattgcattgaagtaaattttccgatgaacgacggaatgggaccagtcaagtaattacggaataagttcctgaaaagatcacaaaaataaactagaacaattagccaacacaaaaataatgatgaatacctgacaagcatttgttggtgttcacagaaagaaccatgggattgaatttatattttgtgcaaacccttgatctataaattattagtacaagactctttagtagtgccacaccctgattttgtttcaggaatttataaattatttaataaaatacttctagaatttatattaaagtgtacattaattaagaaaatgaattaaagtgggaaataaagtttcctaaataaaacattgctggatttaatttttattatattctccatgattagtttacactctctagaattttttcggatttttcagagctcaattactaattttaacaatacaaacatcaattcaatggttatttaaatataaaataaattagaaacccctccaaagttctgggtcgaattgagcccatgtctctctctccgcgctcagcgcagctagcgctaggccgctagcctaagtcaccagcccaccgcctccctcctctcactcctgccaacatgtgggatctggtcccacatgttagtgttgtccccagcatccagccagaatcacactgtctgcgttcctctccaaatccagccgcctctctagatcttttccaaaattagttgaggccgtttgttccctatctcctctttcctttccccatgaaatccccaaaaatatctaagtaaatcgtgtggaatcgagctcgaactcggacactctctatccggtagaaccctagtttttcccagcgctgccatagccgtcttaggcccggatacattatctcgtggctacaaacaggatccccctccctctcctctttccgctgccaccctcgcctgcacaaatcggagcctgtagccctagcttcgccgctagcccatagcatcagcactgctgccaccttccagtcggatcacgtcgttgctctactcgtcgccgctctacttgtcgccttcgcccactgtcaccttcgccgggtgcgcaaggaggaggcgcatttcatctgccggtcctccatcaccctatactgccagaacaccgctattgacgatgacccgagctacaccgtcatttccacctcgtcgccttcaccgtccgtcgtcgcaacgcctctcgatgagttcggctcgtcacactcaacctctcggtaccctccgttcatgctgccgtgcctgattcgccggcgatctttgggttccgagcaggtcgtcgccggtgaggtgacatcatcaccacgccattgctattgtgttatcaccaaaagttggtaaggttccttagtggatttggttgaaggacaaatttgatcaaccaatggaagtctatccagaagataccgaattcaaaaaggattgtgaagaccatggcatggcatattaattctatctgttgatttagtaactttcctttaatctttaggaagttttatctaatgtctgattaagacttgtattttttccttttatgtttagcaaacntatgtcttgtctgattaggacttgcatcaacctgaggagataaatatgtaccacagggtctttgtaaactttctccacatattaatacaattactttcggcgcattgcaaccttttgttctagcaagttcttactttgagttgggctgcattggttttgatctccaatgaggaagtaatttctatcaacttttcatgtatcgccgtggcaagaactttctcgattaagtcaggtattctttttgggttgacgcaagcattacatatccgatatattgattctatctttaactgcattgccgtttagagttgcatcgacttagttaggactttcttggttaggtccgatattctgatttagttgatatttctctaattatactattgttttagatagatttgttatatccatcacgtctgtgtagatttatcggataaataggttttttaggggcaattgcttatttgaccatgtttaaaagcataactactaatttgaccctacaattttcagtttgcttatttgaccctgttcatcaaaatcaaatgaaccgtctgaccctgttccgttaaggcgggttaacactgttaaataagaggcaaatagtcccttttgcccttgcttatttggccctcttgtatccaaacattcatacaaatggatcttttaacaaatcagaatcaatttgacaaatttaatacacagtagctggaggttgatgctgggtgccgccgccgaccaccctttgcacgccactgctccccgcgacagcgccgctgcggacaaaccgatgcctccacaagcgaattaaacggcccatcgaatgaactcgcgagggaattcttatactcttgcatgcccccttcacttgtagagaaacgtctaggcgcagcaaattaatcaagtgctctgataatcaatatctcatcaaggttatccaagtagtagccagatcaatatctcgataataatccggaacacgttcaccatggtcgtcggcgcacccaccgtggcgttcttcttgagagacctgagtaggtcgtcaacgaaacgctccatcctcctccacttctgccgcggtcggccgctgatgcgacacgggaattccgagatacctacacgcatcgcgtgatgccgcggccgctccgtcgcgcaatggcgtttgcgccgacctccctatccgtgcggcagccgccgcttccccatgcgctgccgacgctgctgctccctacctccacgcatcggcggtgctgctagccactccctcgacgcaccgccgccaccgcagatccatttctccatgtgccgcttgtaagagatgagagagacaaggtgggatggatagggttgaagtgccttgatggtattttggtcagtttaaatagtaaatagattttttttctttttctagaagaaaccctaatgatgtagtggaaagagggtcagacggagtgttcaatttaaaaaagtcaaataagcaaactaagaaaaacatagtcagattagaagttaggcttcaaaacagggtcaaataagcaattatcccattttttatcatcttcaatcttatactgtctcgtttaggtttgatttattagattgttgctaatatgtaattatattctactaagccgataagtttttatgcaacattttattagagttctagccaattagttatcttgttactacttctaagtgttgatcgtcttatactcaaacttgtataatcaatagttaaatatctctttatcaacttcaatatcataccgtctcgattaattaggtctgatctatcaagattatctttgattaggaatggtttattgacgattgatgaaaaccttatatacatcggctagcttggggctgcagga

SEQ ID NO: 43456 - DNA, 10107 bp, Oryza sativa; identical to SEQ ID NO: 38943

SEQ ID NO: 43457 - DNA, 1421 bp, Oryza sativa
aaatacttggacattaaaaatatttaatacaattttatctatatcaacttaatgttcaaaattttcatagattttattcacacacttactttaattattaagtaatttctaaaaattcctttttcacaacgatttataatttagcgattttcagggtgtgacatgtgatatctcgcagcacctatcataaacagttgagcaaatcggtcgatctgcattatcctttagtttgtgccacagccaacagggaaagcggtggtaaaccatttgcatgacaagtggaactgtggaccagtctatttttttcttacccaaaatttttacttcaaaaataaaaagtttgacccaagcccgtacacttgtgaaaaatggacatgtgaagtgacagatcgcttcgcttatcctaacactactggagaaaccctcaaaccgggagagaatccgagactaaatatgtgtgtgtatgtatgtacgtacatacgtacgtacgtatgcatgcatgtatgtgtgtgtttaaatacatattatatggatgtatctacacagctagtggtagctggtttgtctaaaacagctaccactctatctataatagggaccatccacctatacttcaaatacaattttctcttaaactactcatccgattttcgatccgattacaccgttgtgttcacaacaattaaatctttacaacaagatctcacatgattatattttgatgaaaaatcacaaattacttttatgatatgtctaaattacttttagatttcactaagttacttcttaaatataaaaaagtaatttacatatattatagaagtaacttagaacaaaacgaaggtaactttagcatgtcatttgaagtaaatccgttttagagataaaaacatgactctatctagaaattaaattaatcagcacaaattatggaattaactaaaaaaataataaaagtaatcacctcagagcattatgaatgtataggaagtattttaataaaatctgaaagtaaattatatatatatatatatatatatatatatatattgaatctattctacaccctctcccatgggtcaaacccaccaccccaccctcccttgggcccaaaacccctctcccacctcggtcaaagcgtcctcccgccggtcaaacccgctcaccactccttcccccacccaccactttgctgctctcgtcttgcaggaattgtgcaataaagaacggtcatcgtgcagtaacaagacaatattatcgcagtaacaacgtcaaaaagtagtcatgatggatctagtttcgttaagcgtttttttatgaacttcatgttgcaaacggattggaaatacaagatatgatgtgagagatattgctctctaatgattgagatttatctcttttttagtccttgtctcacagga

SEQ ID NO: 43458 - DNA, 1518 bp, Oryza sativa
gggtgtagaatagttattctaagggaggggtgtataatagagctactcgtatatgtatgtatgtatgtacatatatgtatacatatatatacatacatgtatacatatatacatacatacatatatacatacacacacacacacacacacacacacacacacacacatatatatatatatatatatatatatatatatatatatatatatatatagagagagagagagagaaaaactattctacacctgggtatagattagctattctataccccctcctctcccaagggccaaacccacctcccacctcagtcaaaggtcggttaaaagcatcccagttagtcaaaccacggtcaaaccacctgctaactcctcccaccacccacctcttctcagctttgtctcgcggaacgatgcagtaacgcgacggtcaacgtgcagtaacactacgtcttatgcatagtaacagcgctcaaatattgttaaaatatagtcatgatggatctagttttgataagcgtttttttctagcatcatggtgcaaacgattttaaaaaatagtacatcatgtgagagataatgttcttcaaatgttggcttttctagaatttgactctccacaagtagtaatgctataacattacttgttactattgtcagttgcacgttactacaatcccatcgcatcgttactttaagagtgcagtaaaaattataagtttttgcagtaactgtgttttactacattttttcgatagtgttactgcataaacatatggtaacgtgtacctgcctttgtagtaacattccacttttgtgtagtaacaaatatatttagcatgtgagacattaacccatatatccttcacatgcagtaacactatagcatcctgtgaaaacggttttaaaaataatacatatcttgtgagatattgctttttaaatattggtattttgaactttaacactccatatgcagtaatagaatatgtaatttgcagtaacatgggtatatacatgcagtaacatggttttaccaaatgtataaaattgttcaaaacacttgtacatcaatcagacctcactcaaagccacctacaaactttacctatagcccacctattcgatcttcatctcgtaaaactgacgtagtaaaattacgattatcgtgcagtaacataactacttggaagtggtaacatgcacctattatgtagtaacacttctacttttgtgcagtaacaaatatatggctagcatgtgaggctttaacccatatatttttgttttgattcctggtctactacaattttactacgacgttactacaaaagtgcagtaacgtcctatgtgttctacagtaacgtcacgtgttactatacttttacaacaatgttactactggagcatagtaacatgttatgagtttcggtagtgaaagatattagaattaataatcatattactttctcataaaattcttaaaacaaatagcatcattagatgaattggttagaa

SEQ ID NO: 43459 - DNA, 813 bp, Oryza sativa
aaaacctttttcaatttaaattattttttaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaaaaattccatttaaacaacaatttatatattttgaattttcagggtgtgacaaacctacccccttaaacagaatctcgtcctcgagattcggaagaactggcgaacagatgcggatgagttgacttcaattcatcttctcgttcccaagttgattcttcttccgagtgattactccattgaactttgcaaaaacggataactcgattcctggttcttctctcatctatttccaagatacggattggtttcttgtcgcgaccgggaaaattgccttttcccgaacgccagtgtattaatccccgtcccaggaaaagccggggtacaccatacaaacatgatataaaagacacatctttattatatcgataatatttacattattacaaaggcgcttcaggcctgacaaacaaaaataaacagcagcggactagcgggcctacggctccatcttcacaggcgctcaactggggtataagccaggactccacctaagacatcttctctgaagcttctcttactgaaggggggagaaagatagagcaagaatgagtacaaccacagtactcagcaagtcacaccggcagatgcacgattaatgcaatgggggtac

SEQ ID NO: 43460 - DNA, 14227 bp, Oryza sativa
ccttaaacggaatctcgtcctcgagattcagaagaactggcgaagagatgaggatgagctgacttcaattcatcttctcgctcccaagtggcttcttcttctgaatgattgctccactgaaccttgcagaaccgtataacacgattcctggtattcctctcgcttacttccaagattctgactggcttctcaacataagttaaatcttcttgaagctctatacgatcaggatctgcttcctccgtaggtacacgtaaacatttcttcaactgagacacgtggaacacgtcatgtattcccgccattgacggaggcaattccaactgataagctacctcacctcttcgactcacaatcttaaaaggtcccacgaaacgcggtgccaatttctcttggtctggaaacgatgaacacctcgtaacggcgtaacccgaaggtatacataatctccttcttcgaaagccaaatctctgcgacgattgtcggcatagctcttctgacgtgactgagcaacgcgcaacctttcttggataatcttcactttttcttctgcctctcgcaatatgtccgtcccaaaaacttgacgttcaccggtttgatcccaaaggagcggcgtacggcactttcggccatataatgcttcatacggagccatttgcatactagcttgataactgttgttatatgagaattccgcgtacggcaaattcttatcccaacttccaccaaaatctagaacacaggctctcaacatatcttctaaaatttggtttactctttccgtctgaccatctgtttgcgggtgataagcggtactgaaattcaaacgggtacccatctctacttgtaatttctgccaaaacttcgaagtaaactagctacctctatctgacactatcttcttaggaacgccatgcaaacataccactctggccatgtataactctgcaagcttattccccgtgtaggttgttttgaccggtatgaagtgagcgacttttgtcaacctatcaaccactacccaaatagaatcatgtcctgccgacgttctgggtaggccggttataaaatccattcctatttcttcccacttccactctggaatcttcaacggttgtaacagaccggctggcttctgatgttctgccttgacccgctgacatacatcacatagagccacatattctgctatctcacgtcgcatactggcccaccagaattgttgctttaggtcttggtacatcttagtgcttccagggtgaatggaatacaaagtttcatgagcttctttcatgatggtatccttcaactccttattttctgggacgcaaattctttctcccaaccacacagtaccttgctcatcttctacataaccgatggcttttcctcttctcatgttcttctttatttcttggatatcaggatcattcacttgagcctcttaacttgatcaaacagagtaggtttagcttccaaagcggccacaaaaccattgctgactattcccaagttcaacttttcaaattcttggcataactcccaaggtaaacgtcgaccttctgacatattacagtagcttttcctgctaagagcatcggctacaacatttgctttccccgggtgatagtagatttccatatcataatctttaatcaactctaaccatcttcgctgacgcatgttcaaatcaggttgagtgaaaatgtacttcaaacttttatgatccgtatacacctctgtacggttaccgaaaagataatgacgccaaatcttcaatgcatgcaccacagctgccaactctaggtcatgcgttgggtagttattctcatgaggacgtaattgcctagatgcataggcaaccacctttccttcttgcatcaacacacaacccaaaccgagtcgagatgcatcacaatacacttggaaacctttcctcgaatcaggcaaaattaacaccagcgcagtcgctagccttttcttcagttcttggaaactttgttcacaatcctctgtccacttgtacttcacttccttctgaagcagacgagtcattggtctggcgatctttgaaaagttctcaataaacctgcggtaataccccgcaagtccaaggaaactacgaatttctgaaaccgtcttgggttgcttccaacttaacactgactccacattgcttggatctactgccactcctccagacgagatgacatgaccaagaaacttcacttcggacaaccaaaattcacatttactgaacttggcataaagctgatgttcacgtagtttctctaaagctagacgaagatgctcttcatgttcttccttcgtcttggagtaaataagaatgtcatcaataaacaccacgactaacttatccagatattccataaacaccttgttcatcagattcatgaaaaaggctggggcattagtgagtccaaatgacataacggtacattcgaacaaaccataccgagttgtgaaggcggtctttggtatatcttcctcacggattcgaagttgatgatatccagaacggagatctatcttggagaaaactgtagcaccttccaattgatcaaataggtcatcaattctgggtagaggatacttattcttgatagtaacctcattcaacgctcgataatccacgcacattctctgagtatgatctttcttctccacaaagatgactggtgctccccatggcgaagtactgggtctgatgtatcctttctgaagcaaatcttccacctgtctcttcacctcaactaactcattagctgccattctgtatggtctcttatggatagggttggttccaggtaccaagtctatccgaaactctatctctctcttaggtggcatgcctggcaaatcctcgggaaacacgtctgggtagtcttgtactatggggatctcttgtagagcaacttggtttaagatcacaccatgagatttaggagaggacataaagaaagaaactgtttccccattgctactggttaaagtcaccttacggttggcacaatctataactcctctgtgacaagataaccaatccatccctaagataacatctagatctttggattctagcaagataagcgaggatgggaaaggaacttcttctatttctatagtagcggaaggacaatactgtgtcgaaaatacttgattgcctggggtattaactagtaaaggtctctcgagactaataacttccatcccatgattgctcgtaaaacttttagacaaaaaggaatgtgtagcaccggaatcaaaaagcacagttgcgggtatagagttaacagggaacgtacccaaaaccacatctggtgcattctgagcttctgctgctgcaacatgattaacacgtgcctttggtgctggaacattggagttgttcggggctggagcgttcttcacgcgccgaggcttaggacacttatcagcataatgtcctggatcaccgcaattgaagcatatcactggcttgcttccctgttccttcctgacaggctggttctgagctgaagttgctgcaggacgagcaaccacgttgcggttgtcattgccacgattactagtattgttgttgtagaactggcgttggggacggacaactgatgaagatcctccttgagggtacgatggaacttgaggtccagtaacgagacgcggcctctggttactgccctgttgtgccttgaattgggcagccctgcgcttcttctgctccatccggttatacttgtcttcctgacgaatcgccttgtccaccaactgctggaaatcccggaaatccgtagacatcaaagcataagacaactcatcattcagtccctccaagaatttctcctgacgctcttcatcggtgcgaacatcttccggagcataacgagctaaacggttgaaatcatggaggtactcggtgaccgatcgagatccctggttgagtgccctaaattctctcttctttagagctacaacacccgacggtatgtgtgtcttcctgaaagcggccgtgaattcctgccacgtaataggctctccttcagccctgccttggcgaaaatgatcccaccattcagcagcaggaccatgcagttgatgcgaagcaaaagaaactttctcctgctcagtacactggatcaaatccaacttcttctccaccgcatgcagccaatctcctgcttctactggattggtggtgctggaaaaggtagggggtctcacgcgtaagaaatctgccagcttgttttggggaggtgggggtggattctggttctgattgtttgcctgctgattctgtgcctgctgcactaacagattgatcagttgtgtttgttgggccagaatctgagctagcgtgggatctcctccattgttagtagctccacttccacttccacttccacttccggtgcgcgtgttcaccatctgacgataagcagagactcatgctgttacatcccaccaatgatgtaagcaacaactaaaacccacacactcacaagcaaacttaaacaagcaatctaacacagcgatctacggcaacgatctaactaagcgactaaacccgccttgtgtcggaacgaagcgatggatcttcttcctctggagtagctggctctctttcttcagggtcttcctcctcttcctcatcacttatgatgtcgatgacaggttcagcacgatcgggcacagcttcacccatcacgcgaatcttcgaagctaactggagacgaggtggcggacaggttctttttctttgagtgaggcgatgcttgggtgttggcggcggcgtttctcctttaagttcagctaattccttttgtagacggtacaccttgctctccaacttgcaaatcttgcctcgattccagttttccctgtcatgagctgctttgtctcgctccacacttactgcatccatagcactaagcatatgcaccgcatgcatcagagtggcactctcttcaccgtcaggacaggtataggttccatagtcttgaccatgaggcttgtgaggatgatactggaaagctgatgaatccaactcttcttcaaagcgttgacgcaactctccaatggccaccaaagctgcctcttgacaagcatggctgtacgatcttcctccagcttcgaacttaaaagacggaaggtcatcactatcactagccaacgtcacacgaacacgacacttctcctcgtcggggtcatgggaaatttggcgatactcgggagcaacttcatagcctacctcaaaagccatcaacctcagctccctgacgaaccctaacaccttgatcaaatttctcggtgaatggggtggcatctaaagaaacatagaagggaagaattaatgcatatttttaagttagctgcaccaactagacttaactgatttagaccaaaaaggaagaaaataaaagaaaagacacatacaaagctactttatatatttttctttttgaatttaacttttgaacagagacaaatcagtttgaacaagtgaataaaataaaaccaaaatacttaagacctactataagcacggtacaatgtcaccattaaaagggatgagtagtactagtgccaacatgattaaatcgataccataatagatgtacagtgccgaccaatccataagatttagtaaagagaaaaagaaacattttgagaagaacaactttttgctttttaaaagaaaagaaattgaattaaatgaattttgtgcataaccttgcatgtgctgccaacttatttaatttgtaagagaatagagaagagcagttctatttttttttcaaaaatattttgaaggctacttaaggtttaccatttggcttatcctaaggtcaaggtggctctgataccaacttgtcacgcccggaatttctatccaaaattccaaacgcttacatgtgtgttaaaccctcgtccaggaatcaaccgaggcacacaatgacaatttgataatagagtacaaataaataactatttaatactcgcaaataacaaaagattacagaggtagatagttcctctcaaaaaataacattctacgcagcggaaaaaaaactataacaaactacggaacagctatggcgactccactccacaggcatcttaaccaagaacaagctcaatcctccagatcatcaccttcactgagatactcctcttctgatgaatgaatattgcaagaatgagcatatgacatactcaacaagtcacacagcaaatatgcaagtgcacaggataacgaaggatggcataatatagctcatttgcagaaacagcatttaataaatatttaagagaatgataaaaacagttgaataattaatcagtattaaataaacaccatacaacacacccatgttgcataggcccaaccacatttgaacaaccaaccccagttgaacaaattaaacctccaaaccaggaattatccattccaaaccaggagtcaaattaattaccacattataaccattaatgagtagtgtgagactaatcacgaaaaacattgctcaactcacccataaccgcgggtacggctattcgaatagtttaaactctgatcagaggtgtaccactgtacccacaagacacaaccccacatcatgtcaccatgtgcctcaataccaccacggtacctcggaaaggagttgtgataataccccttgcacaacataacccattacagcgcacctttcctggatcataatcacccccttataaacaaggcatggactccccagcgacccccgtggacttctcgccacttctcagtctggcgcactataatgaatcacgctatacaaaagataaagccgttgcccacgctggcttgtggctggcacgataaatgtttcacaacagtagctcgcgaaccggtccttaattgtcatgagcacaaccatcaaaaccatatgctcacaacccaccttaaccaggttttaattatcaattaattaacatcacacgatttaccatcgtgagctaccatttaatataatcatcattattaataataatataacatagtttataattaatccctttagttagctaatgtttctaagcatggctaagcaaacctatatatagcatttagctgaaccaaaccaatatataaggttcatgctagtcaaattataacccctaggaaaataaagtcatcttcggccaataattaactgggaaaggttcaccacccgatgacattcgaaaacaatgcatagttgaaataaaataatagctttaaacgggttcaacatgctcaaagggttgtttgggatctgtgtgacttgccttgagcttccgcaaacgcttcggaaccttcctcaacggaaacgctctcctccggaacgtcggaaactaaagcaattaaacaaaaatcaacaaaacagtacaaaaacaagcataaacagtacatgtggatatttttaacatgtagatcttgattttagaaaaatttagcaacttgaaccacctgaaacggatctacggttatttagttatgattttccaaagttttaatctattagaaaattggaaaaaaagaaaaaagaaggagatgatgacgtcagcatgacgtcaccccacggcagccggctagggtttgcgagctcgccggagatagagaccttggccggggatttggagggcatgtacacgtagaggacgacgaggcgaacccaacggtactcaccacaacgacaaacgacgaacgatgatggccggcgacgaagaggacggcggcggcggctcggcttgacggcgacggcggagctccggtggtcggcggcgaagggggacgggcggccgaggttcccctcaccacggcgcacctaacggcggcgacggcaagcggcggcgacggcggaggcggcgcggcggcgcggctggagaaggccgacggcggcggcgagctaaagcaacgcggcggcggcgctacggtgcacgggagaggacgagagaggggcaaacgaaagagggcgacgatgtggtcctatatatagcattggattgaagagatcgaactccaaacgagaggaatcgactcgggaaaaatccaaactcggttttagggataaactcgaaaacgagtttgattcgaacaagatactcaacggattgctccgtttcttgaggggaaagatagaggagaacgagaggaacaaaacccctcaaaaacccggaagaatcggggtcggattggagcggaatcggaggcggaaaagggcggctcgggctcggcttcggccggctggaggtaggagatggatccgacatgtgggccccacatgtcggtctcccgagaggagggcacgggcggctcggctgggccggcttgggccgcgcgggagagagagagtgttgggccgaattcggcccaacggcttaaaggaggggatttttgaactttttaaaataaaaacaatttgtgaaatgttgtttcaattattaaaaatacttcccttgctcaaataattcccagaaaaatctagaaaatagaggagcaagcatagtatttaataaaattttatctagctcatttttatgttgaaaattttcctagaaaattagggtttagtttgtaggcttttaaaaataatttctaaaaattccaattaaacatcagtttatatatttaggatttttagggcgtgacatcacgcccggaatttctatccaaaattccaaacgcttacatgtgtgttaaaccctcgtccaggaatcaaccgaggcacacaataacaaattgataatagagtacaaatgaacaactatagaatattcgcaaataataaaatattacagaggtagatagttcctctcaaagaatatccttctacgcagcgaaaaaaaataaatctataacaaactacggaacagctatggcgactccactccacaggcaacttaaccagaacaagcctaatcctccagatcatcaccttcactgagatactcctcttctgatgattgaatattgcaagaatgagcatatgacatactcaacaagtcacacagcaaatatgcaagtgcacaggataacaaaggatgacataatatagctcatttgcagaaacagcattaaataaatatttaagagaatagtaaaacagttgtataattaatcaatattaaataacaccatacaacacacccgtgttgcataggcccaacctcatatgaacaaccaaccccggttgtacaaatctaacctccataccaggaacgtaccattccaaccaggagtcaaattgattatcacaattaccattaatgaataacatgggactaatcacgaaaaacattgctcaactcacccattaccgcgggtacggctattcgaatagattaaactctgatcagaggtgtaccactgtacccacaagacacaatcccacaacatgttaccatgcgccttagtaccaccacgatacctcggaaaggaactgtgacaataccccttgcataacacaactcaccacagtgcaccgtacctggatcataatcaccccctctacaaccagaggcatggactccccagcgacccccacggacttctcgccgcttctcagtctggcaccccataatgaatcatgctatacaaaaggtaaagccgttgcccacgctggcttgtggttggcacggtaaaagtttcacaacagtagctcgcgaaccggtccttaattgtcatgagcacaaccatcaataccatatgctcacaacccaccttaaccaggttttaattatcaattaattaacctcacacgatcaaccatcgtgagctaccattaatgtaaccataattaaaataataatgtaacatagtttataattaatccctttagttagctattgtttctaagcacggctaagcaaacttacatatagcatttagctgaaccaatccaacatataaggttcatgctaatcaaattataacccataggaaaataagatcatcttcggccgttaattaattgggaaggttcaccacccgatgacattcgaaaacaatgcatagttaaaataaaataatagctttaaacgggttcaacatgctcaaagagttgtttgggatctgtgtgacttgccttgggcttccgcaaacgcttcggagccttccttaacggaaacgctctcctccggaacgtcggaaactaaagcaattaaacaaaaatcaacaaaacagtacaaaaacaagcataaacagtacatgtggatatttttaacatgtagaccttgattttagaaaaatttagcaacttgaaccacctgaaacggatctacggttatttagttatgattttccgaagatttaatctattaaaagaaattggaaaaaaggagatgatgacgtcagcatgatgtcatcaatggcggccggctcgagttggtgacctcgccggagctagagtggtcggccgggattttggagggcatccacacgtagagaacgacgagacgaacgcaacggtactcaccaatgcgtccaacgacgaccgatggtggccggcgacgagaggaggcggcgcggcggctcggtcgacggcggcgacgggtctccggcgaccggcgacagcggggagagggcggccgaggttcctcacctccgtgcgcacctaacggcggcgagaggaagcggcggcgacggcgaaatcgaaggcgcggcgcggctggagatcaccggtggcgacggcgagacaaggcggcgtcggcggtgagctacggggcacgggagaggacgggaaaaggggcaaacgaaagaggggaactagggggtcctatttatagccttggattgaagagatcggactccaaacgagaggaatcgaaaccggaaaatcttcgggttagtttggagagataaaatcaaaacgagtttgattcggacaagatactcaacgatttgctccgatttttgcgggtaaagatagaggaggatacggggattaaaacccctctaatatccggactcggggtggccggattggggcggatttgagggcgcaaggtggcggctcgggctcgtcatgcacggctcggccggctgctagaggaaggggaaggatccgacatgtggggcccacatgtcggtctcccgagaggagggggcggcggcgacgggttggaccggttttgggccggctcggccgcgggagaggggaaggatgttgggccaaaaacggcccaatggctttagggaggggtttcagaactttttaattaaatataatttgtgaaatgttgtttcatttattaaaaatacttcccttgctcaaataattcccagaaaattctagaaaatagaggaacaagcaaagtatttaataaaattttatctagctcaattttacgttgaaaattttcctagacaattagggtttagcttgtaggcttttaattttaatttctaaaaatgatttaaacaatgtatttttaatttaggcgatttttagggcgtgacacaatccaagctgccatgatgtggtcgcagccaatctttgacccatccatagcggcccagcaagtaccaccagttggagccgggcaatcgaatgccgtggcccaactccacgcacaagccgcgatttcgcccttcgccacaccgtacccgcagcaaggtgcggtaaacagggcgggaggcgaaaaggggctgccgctgagtgggggaatcaagactcgtccaatcccaccccagttgaagttcccacctgtcccgcgttattcgggcgaaactgacccgaaggagttcctctccatctacgagtcaacgatcgaagcgactcatggtgatgaaaataccaaggcgaaggtaatacatctcgctctagacggtatcgcccgttcttggtatttcaatttaccagccaatagcatttactcatgggagcaattgcgcgatgtttttgtccttaactttcgaggcacctatgaggagccgaagacgcaacaacaccttcttggcattcgccaaaggccgggggagtcgataagggagtacatgcgtcgcttctcgcaagcctggtgccaagttcaagacataaccgaggcgtcggttataaacgccacttcggccggtctgcttgagggcgaactaacaagaaaaatcgccaacaaggagccgcagacgctcgagcaccacttcgcatcattgacgggttcgcaaggggcgaggaggattctaagcgacgacaagctatacaagttgagtacgataaagcctccgtcgccgctgctcaagctcaagcacaagttcaaattgccgaaccacctcccctctctgttcgccagtctcagccggcgatccagggacagccgccaaggcaaagccaagcccccatgacttggagaaagttcagaacagatcgggcgggcaaggctgtgatggctgtcgaagaagtgcaagccctccgcaaggagttcgacgcccagcaagcaagcaaccatcagcagccagcccgcagaaggtccgaaaagacctctactgcgcctttcacggacgctcttcgcacaccacggaacaatgccgaaacattaggcaacgtggcaacgcgcaagacccaaggccgcagcaaggaacaactgtcgaaacaccccgtgaagcagttcaggagcaaatacccccagccgaacaacgccaatatacacaacaaaggataatccaagtgattacaagagctgacccgccaagccagttgtcgaaacggcagaggaagatgcagatccgtacggtccacatcatcacttcggcaggtgagggggcgccacagtacgtgaaccagctgatccctttcgggccagaagacgccgaaggagtcctgttcccgcatcaagatccactagtaatctcagctgagatagccggttttgaagtccgacgaatcctggtcgatggagggagttcggctgacgtgatcttcgccgaagcatatgctaagatgggcttgccaacccaagctcttgcaccggcaccaacgtcgctccgggggttcggcggagaggcagtgcaagttcttggccaagcacttttgctgatagctttcggctcgggagaaaacaggcgcgaagagcaaataccgttcgacgtcgtcgacatcccatacaactacaacgctatcttcggccgtgcaaccctgaacaagttcgaagccatttcccaccacaattatctcaagctcaagatgcctggcccaacaggagtgatagtagtcaaggggcttcagccttcggccgcttcaaaacgcgatctagccataatcaacagagcagtgcacaatgttgaggccgaaccgcatgagcggcccaagcacacgccgaagcccacccctcacggcaagataacaatagtgcagattgatgatgccgacccacaaagctcgtatcactggggggcgacatgggcgaagaagaagttgagagcatcctagaggtactcaaaaagaacatcgatatcttcgcctggagccctgatgaggtggggggcgtcccggcggatctcatcatgcatcacttagcagtcaagccgaatattaagccaagaaagcaaaagttgcgcaagatgtctgtcgatcgccaagaagcggcgaagaccgaagtacaaaaattactccgagcgggggttattcaagagattgaccatccggagtggttggctaatccagtgctggtgcggaagtcaaatggcaaatggcgcatgtgtgtcgatttcacagacctgaacaaggcatgtccgaaagacgatttccccttgccgcgaatcgaccagctcgtggatgcgagctcatgagtttcctggatgcatattccagttaccaccagatccacatgaacccgctcgacatccccaaaacatccttcatcactccattcggcacattttgtcaccttaggatgcctttcggcttaaggaacgcaggagcaaccttcgccaggctggtgtacaaggtccttggcaagcagttggggcgaaacgtggaagcttacgtcgacgacatcgtcgtaaaaagccgcaaggctttcgaccatgtgttcgacctgcaagagacgttcgacagcttgcgcgcggcaggcataaagctgaatccggagaagtgcgtattcggcgtccgcgcaggcaagttgttgggtttccttgtttccgaaaggggcatcgaggcgaatcccgagaaaatcgatgccatccagcaaatga

SEQ ID NO: 43461 - DNA, 745 bp, Oryza sativa
gaacagccaggcgagcacccctcgtcgaactcattcagttcggtgaacatgcttggggcactggcgggcagtacaagattgcttaccccctccacaaaaggaaggaggtccgctcgcgtctcgaagtcgccaggggcgaagcggggtaccgagagcgaatattccaaagcggacgtctcagcgaccgctctctttcccttcgcctccatcagcggcgatgcaaccggctgatgcggaggattgccgaatactttcgccgcggccgtcacaatcctttacgcagaagccgaagccccagcggcggtactaccatccactccagcggcgccaattggcggaatgggggcggccgaaagatccaggctgcgaccagtgggcgaagtcggagtcccgtcggaggactcgttgtcgctaaaaacgcgagcgacatcgacgagtcctttcgttttagccacctttttgataggacctcccttcgccgccgcgcccgaagagaacgcaactagggccttcgccccttccaaatccttccgacgaaggggggagctgttcgactccaccccggtttcgttgttaccaggacttggggtaggagtgtaccctggggtgtcggcgcggtttcgaccgcctcacccgcggccttatcagccacagcctccacctcctcctttccttccttcctcctcgccatcacattcttcggcatcatcctcgtcgtcggcgtcggagtcagacgaagcaggaa

SEQ ID NO: 43462 - DNA, 2170 bp, Oryza sativa
tagtttgttatagatttattttttttcgctgcgtagaaggatattctttgagaggaactatctacctctgtaatattttattatttgcgaatattctatagttgttcatttgtactctattatcaatttgttatgtgtgcctcggttgttcctggacgagggtttaacacacatgtaagcgtttggaattttggatagaaattccgggcgtgacagattggtacttggtttgttccgaagcctggggttggcacttgctgccgaacggttggcacctgagcagtgttgccgaagtcgaactgctgtcattgactccacggcgaaggtcccgagcctggctgaattggtggcaacccattgggcgctccttgacttgtattccctaccgggtgagccgatggggttgtgcttgaaatgtagtggggttggttgagttgctaaaggaaagcttggagttgcgcctgcagagccgaagcccattccaccactggttgtggcgcttggccaggtggttgatgctgcccggcgaagtacaccggcggctgtgcggctagtggcggagagggctaggtcaccacttgcggccggacttgaggtggggcatagcctgccgaatactgaaggattggagccgacgtggccttggtcggccttgtcgcctcgtatgcttgttgttgttcttgcatttggcgaagcatgtcttggagccgtgtcatattctgccgcatggcttccatgtcggcttcggcttgcgcttcggggtccaggctgatttgggcctatacaacggcgagcgcagttggtgccgccggctgtgatggggcggcttgaggcaccaccagttggtttgtcgaaaggatctctgccctggtctggagtgcccttgccgccgcagccgccttcgccacgtcggccttgttcggcacttgcactgaggttgcggaggccgaagacggttgtgatggcgcgggggccgaaggcggctgtgatggcgcttgtccttctccatcttcggccacagacgccgaaggctctgctccttcctcggcggccatgtccggtccggcgtcgctctccttccgcctgacaaccttctccttcacgaccctcttcgtggcattcgctctcagtggtttcgctcggagtccccacggtcggcgccagctgttgtcgaaacaacaactgtatacgtcgaaggacgtggttactcaacagtggttgggaaaatgaagtgtactaaatttttaatttcacttgggatcccccgttacatagccctagggggctatttatagccctattgcaggctctttctactaggatctaggttgtacaggggaatttatataattacccttatgaaagggacatttacaggggtacataatgttatagggtctcatgggcccctaatgggccgtctagcgatcgccggcccttaggcttgatgggctggaaaggcttccttggcccttgcgggggcgaacttgctatggcgaagtcgtcttccttcggcagatagtcttcgccttgcacccttcgcccgagacgccccttgcagctgctcatctcttttaaagcgatgtgacaacacattttttcagccatttattcccccctctgatgagttcactgcaaccatacgcaacaaatgagagcacatttttacaaatgagtaaaaagttacaaatgatgttcgtaagtatataaaaatttttaaagttggacataattattaagaaagtaggtaggattaaatgtggagaggatatgattggtgaaaaaagtaaatggtaaagggttgtgattggttgggaaaataatgtaggtggagaaattattatattttaaaataaattcctaagagtttaatgttgctatattttggaaatgatatttttagtgtcatgcctagtcacacaataaggaccacaatttggcttttcgaacatttttttttaaaaattgttttcttaaatcctccactctcaaaatccataatcttattgggtatatacattgtatttattacgatgatctaaactagaatgtgataataattttatttttctctttaagcagttattgtgtcttatgttttagaatggcgagagtaaattataaattaaaagtacataccaccaaaatgtaaagaattttactcatgtaa

SEQ ID NO: 43463 - DNA, 15788 bp, Oryza sativa
ttggttacggattccacattactgggatcgacggcaactcctcctgctgagatgacgtgaccaaggaacttcacttcagacaaccaaaattcacacttgctaaacttagcatacagttgatgttctcgtagcttctccaatgcaaggcgaagatgttcttcatgctcttctttggttcgggagtagataagaatgtcatcaataaagaccaccacaaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattctcaactggtgatatcctgatcgaagatctatcttggagaatacagtagcacctttaagctgatcaaacaaatcatcaattctgggcagcggatacttattcttgatagtcacatcgtttaatgcacgatagtccacacacatccgctgagtatggtctttcttttccacaaaaataaccggagcaccccatggagatgaactcggtctgatgtaccctttctgaagcaaatcgtctacttgccttttgacttctgccaactcattggctgccattctataaggtctcttatggatcggagttgttcctggtaccaaatctattctgaactctatatcccttttgggcggcataccaggtaaatcatctgggaacacatcgggatactcccggactataggaatctcttccaaagttatctggttcagtcttgaccttaaagactcagatgacaatgcatgaacagttacaactcgaccatcattgctgatgagagttacttttctgttagcacagtctatcacacctttatgtctggctaaccagtccatccctaggatgacatcaaggtctttggattctaacaagataagattggccagaaatggtactccttgaatttctattctgacagaggggctacgttgcaaagagagtgcttgattgcttggggtactaaccatcaaaggacgtctaagatcttctacttccatcccatgatttcccgcaaaactcatagataagaatgaatgtgtagcaccagaatcgaaaagcactgttgcaggaactgagttaacagaaaacgtacccaaaatcacatctggagcatcttgggcttctgcagcagcaacatgattgacacgggcctttgatgctggtgcggtagagttgctctgggcagggacaaccttcacgcgtcggggcttcggacacttgtcagcataatgtcctgggtctccacagttgaaacacaccacgggcttgctgcctggctccctcttggcaggttgttgctgtgttggagctgcaacaggacgtggagcttgattgcggatgttgttgccagcattgttgttgaaaaactgacgttgcggacgaacaacagacgaagaacctccctgtggcatagactggggtcctaaagtaagacgcggcttctgattactcccctgttgtgctttgaagtgagcaatccggcgtttcttctgctccatgcggttgtacttgtcttcctgacgaatagccttatccattaatttctggaaatcagaataatctccagtcatgagtgggtaagaaagctcatcattaagtccttccaagaacttctcctggcgctcttcatcattgcgcacatcttccggagcataacgagcaagacgattgaactcgtgcagatactccgtaacagagcgagatccctgggtgagcgacctgaactccttcttcttgagagacaccactcccgatggtatatgcgtcttccggaaagcagcggtgaattcaagccaagtaataggttcagcagtagtcctattcaggcggaagtgatcccaccattcagaggcagggccatgcaactgatgtgatgcaaatgagaccttctcctgatcagtgcactgaagcaaatccaacttcttctctatggcatgcagccaatcaccagcttcaacaggattagtggtactagagaaaacaggcggcctcacacgaagaaattctgctaacttattctgaggaggtgcatggttatttccttggttctgctgattctggagttgctgcatcatcatgttcatgagttgtgtctgttgagcaagaacttgggcaagagtgggattctctccattattgttgttattggggttgttagggccattcccattgctgcgagtgttcaccatctggcatggacagggcacaagaagagaaaccgggggaaactacttaggatagagaattactttaacttttattgatcttaactgagttttattacaaactgaagactctcacaccactaaactcaccaacttcctcacactcaaaagcaaacaaacgcatgcacttacatcccaccactgatgtaaatcacatgcgagacacacacaagcaaacttaaaacaagcaaactaacacaacgatctaagaccacgacttaacaagtcactctagttcttctgagcatcggaggtcgattgaaggctcgttcggctcgtcttcatcatcttgagttgctacccactcaatcttggaatgggtgcgcttggattcttcatcttcatcactacttatgataatgaccggaggatctgctggggcaacttctttctccaccacacgaacctttggcgccaattgatagcgagggacaaatagagctctcttccttgcggtaagacgaatcctggccttctgcggcggagcttctcccttcaatgcggctaattccttctccaaacgatccaccttgtcttcgagcttgcaaatcttaccacgattccggtcttcacgatcttgagctgctaacacagtctccgcacgactttcatccatagcccacaacatctcaaccaaatgccttgtggtagcatcattctcaattccttcagtctcaaggtaactgccacggtcacttccctgtggttgacgaggatgatagcgatactcagtgtcggccaactgatcactgtagcgatcacggagctctcctatggcgatccttgccacttcctgacatgcatggatgtagtttcttcctccagcttcgaacattactgaggggacctcttcactattgctgttcaaagtaactttgactcggcacttctcttcatgacgatcatgaggaatctgggcataaaaaggggcagtcccaaatccaatgacaaaggacatcgtacgcaactcctggacaaaaccctcaacaccaaacaagtactcaggcttgtagcgcggcatctaaagacaagtgaaaggagggagttaagacatctatccaattaacagcacaagtttttggattaatttgaataaagtttagaaatcaaaataaaccaaacctgcaggataagttgaaacagttggaaacaaggttacaagctttgtgcttttgagtaacaggttttaaaagaaataaaagaaagttataaaatcaacttgctaaatctattttattgcagcaagattaaataaaacaacattgtaaaacttttgctggtaaatgagccattggtacagtaataaatgtacggtactaataacactggaataaattttgaatgagaaccattaaaagagattatgaagtgcatgtgccattagtttggtttaattaaaagagaaagggaggagaacagttctacttttccaatatttttagaaggcttctatgggtaaccatttggcataacctagggtcaagggggctctgataccaacttgtcacgcccggaatttctatccaaaattccaaacgcttacatgtgtgtgaaccctcgtccaggaatcagccgaggcacacaataacaaattgataatagagtacaattattactctaattaataagcgtataaagtgtcattacagaggtagatagttcctctcaaacaataaatatctaagcagcggaaaaagaaataaacggcgcagacggctccactccacataccgaggtgcgagcttcccttttgtctgaaacctgtgcacacctcgcaatggcgtgacccgaaggtatacaaaatcacccactgcgaattccaggtcacggcgacggttatctgcataacttttctgccgagactgtgccacctttagattatcccgaatgattctgactttagcttcagcttctctcaggatatcagtcccgaacacttggctttctccaacttggtcccacaagagcggtgtccggcatttgcgcccgtacaacgcttcataaggtgccatttgtatgctggcttgataactgttattgtaggagaattcggcataggggagactcttatcccaggtcttcccgaaatctagtacacatgcgcggagcatatcttctaggatctgatttagatgctcggtctgtccatctgtctgcgggtgatacgcggtgctgaaatttaatcgggttcccaactcttcttggagtttcttccaaaaatgagaggtgaattggcttcccctatcagatacaattttcttgggaacgccatggagactcacgatcctagcgaagtagagctcggctagtttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttctccttcaagtctaagtacatctttgtactgcccgggtgaatggaataagggctctcgtgagcttcctgaagtatcagctgtttgagttctcggttatctggaacgcatacccgctttccgttccatagggttccgtgttcatcctctgtgaaaccagcggctttaccctgtttcatattcttgaggagtccatgcatgtccggatcattcttctgagccttgcggatttgatcgagcaaggtaggcttggcttctagcgcagccaagaatccgcgaccaactatgcttaggttcagggcttccatctgttgattaagttcgggtggaatgccacggacgttaagagtgttgcaatggccctttcgacttagagcgtcggcaaccacgttggccttaccaggatgatagtgaattcccacatcatagtccttgatgagttctaaccatctcctttgccgaagattcagatccgactgggtgaagatgtatttcaaactcttatgatcggtatatatttcacagcgattcccaatgagatagtgccgccagatttttagagcatgaaccaccgcggctaactccaaatcatgtgtagggtagttgccttcatgaggtcgcagctgacgtgaggcataggctaccacatgaccgtcctgcatgagcacgcaccccaatccttggcgcgaagcgtcacaatacaccaggaagtccttgcgagtatccggcaagattaacaccggcgaggaaaccagcttttccttgagagtttggaacgccttctcgcattgcgggctccacacaaatttctcttctttcttcaacaactgtgtcatgggtcgagcgattttggagaagttctcgatgaatctccggtagtatcctgccaaacctaagaaactgcggacttgagtaactgtcttgggttgcttccaatcggtgacggtggtcactgtttcggggtccacagaaactcctttagcagatatcacgtgtcctaagaatttgacttcggacagccagaactcacacttgctaagtttggcatacaattgatgttcccgcagctttcccaacaccagacggagatggtgctgatggtcttcctctgattgtgagtataccagaatgtcatcaatgaaaaccacaacaaacttatccaagtattccatgaacactttgttcattaagttcatgaagaaggcaggtgcattggttaggccgaatgacatcaccgtgaattcatacagcccgtatcgcgtggtgaatgcggtcttcggaatatcttcttcacgaatacgtaattggtgatatccggaacgaagatcaatcttggagaatacagtggcacctttaagctgatcgaacagatcatcgatccggggaagagggtacttgtttttgatggtgacttcattgagagctctgtagtcaacgcacatcctcttagtcttgtctttcttctccacaaaaatcacaggagcaccccagggggaagtactcggacgtatataccccttttctttcaactcttccaactgtttctttacttcggccagttcatttgctgccatacggtagggtcgcttgtgcagaggagtggttcctggagcaagatctatccggaactcaatctctcgcttgggcggcataccgggtagttcttccggaaacacatctccgaactccctgacgatggggatttctgacagtcctatctgatgcagttctgaactactgacagaggttgggggtgcaaagaaaacaaccggttgttccggccctcggtacagagtgacagtgcgcctcgcgcaatccactactccttggaattgagccaaccaattcatcccaaggatcacatccaagttcttggtgtctagcagaatcagatccgagggaaaaggaatcccctgaatttctatagggacggcagggctataatactttgctgtcataacccctccaggggtggtgatgagcagagggttcctaagcctttctacccccaactgatttctccccacgaatggcacagatataaaccagtgggaagctccagagtcgaacaaaatggtagcagggatggaatgaacgaggaacgtaccaacgatgacgtctggagttgtcagcacgtcctcggccgtcacgtgattcacacgaccccgaatgacatccttcccaccgttgttggagtggggaggcgcttggccttgctgacgccttggcttcgggcatttatccgcaaagtgcccgggctcgaagcagttgaagcacagacgctgctgaccttgagcgtccctgcggccttgaccagactgcacggttggcgtaggaggacggggcgcacgagtcccttgctgattctgctgctgctgcggctgtgggacgcgcaccacgaattgaggtcgcggcgcggagcgaggttgctgctgctgttgttgctgttgcgaggaggatccccctggataggggttggtgtagcggaccctttggttagcaccctgttgattgcggaaattcgccaagcggcgcttgtgcgactccagttccttgtgctttgtcgcgtcccaaaacgactctaaaatacatcctcgaaattgtgccgagaataattaaaattcatgtgaaagcctccaacaattaaaatgtgcaaatataaaagtcaaataaggcttggaggatttttgtatatttcctaaaagcctaaaatgcgtaaataaattttagtggaattttcagagcacaaataataattgagaagaaataaacaaagttaaaaaggttttataaaaagaaaaaccctaaaagaagtccttttcccccccttcctctcttgggccggcccggcccaactccctccctctctctcctctcccccgcggcccatcggcctcctccccgcgcgcgcgccgctgacgggcgggcccgcccgccaccctcgctgacgggtggggcccacctgtcatcgcctacctcgcgccgcgcccgccgccgcccgtgccctagcgccgccgccgccgccgaatccgccgcatcccgccgtccccgcgcgccataaagagggggaaatcactccccgtgattccctccctctttccccccactttcccctctctctctccctcggattcgctcggatttaatcccgcaaagttcgccggcgcatcaatggagcccgagatcgccgcgccggtttccttcctccccggccgccctctctcgctcccgtccctatataattgttccccgtgcctcactcctccgtttccgccactcgccgctcgctctttccgtcggattcgtgctcgcgccgttgtactctctctccgccgtcgccgccgagctccggttcgccgccgtcgtcgctccggacctcctcccgtctcggcgtcacctccttcggcttcgccgcatccccgtcaacctcgtccaccccttcgtttcgcccgccgaccgtcggagcgccgccgtcctcgtcgatccgaaccgcgccgccgtcttcctccgctccgatcgtcgtctccgccgccctcgtcgtcccggggtgagccgaggaccgccgttcgctttcccccttccctcctctctctcgggtgccgctccgccgcgtcggtggtcgccggcggtgaccatcggggcgcgggcgcgccgcctcccgtcggccgtgccggcgaggccgccttcgggcgcgccccgcggctgccaggtggggcccggccgtcagccgcccgcgcccgcgggtgcggctgacgcgtgggacccacggcgccggccggcgtctgccgcgtgcgcccggtccaccgtggaccgagaggctgacgcgtgggccccactcccgtggacccggtccgcgcgcccctcccctcggctgacgcaataaatccgatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggagtttattagagtaaaagccttttcttttccgttggtcgtgtagacgctgcagcttcggaagatccgctcttcgtggaagttgaagccggtgtttgggaaagcgagcaaggcaagtcacatcatccttgagcatattgaatcccagtttataaaattattttgatttaaattaatgcattaccgctttatttcaattcccgcgttatcactgttttatttagccatgcctatttacctttgttaagacattattattgctattgttattattaccttgttcaccctagaataaacaaaaccccaactagtgggtactctattcctggttccactagtatgaatttaggtagatgcttcgctgattaattaggcaatattaggtggttttataactttagactttgggaattctcatatcatttggacactatggaattgttggtttatggtggaattggacatacacctctcttcctctttcaaaacccctaaaacctgttttcggtggggtctgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggatggagatggatgaagtcgggggtcgatggacattctctaggacaaatgaaggctacacgagctgcggcccggtagtcgagatgtcatggcacagggttggtgccctgctgctaggggctcagtcctgcctgcctgtcccgggggttccggccgtaggtgggattgggtcggtactcttgtctatggctaggatgggttggaaactatgtcacagcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaaatggctttgggcaactaagtgacttttaaatgctgcttttctgcaaaacttaacccctatattatttaccccttgtacccccttgcattaatcgtgcatctaccggtgtgacttgctgagtactgtggttgtactcattcttgctctatctttctccccccttcagtaagagaagcttcagagaagatgtcttaggtggagtcctggcttataccccagttgagcgcctgtgaagatggagccgtaggcccgctagtccgctgctgtttatttttgtttgtcaggcctgaagcgcctttgtaataatgtaaatattatcgatataataaagatgtgtcttttatatcatgtttgtatggtgtaccccggcttttcctgggacggggattaatacactggcgttcgggaaaaggcaattttcccggtcgcgacaagatggtatcagagccatctcgactgtaggataagccaagtggataaaacctaaggacatattttataaataaaactatttgcgaaagttcctttttttctcctttcccctatgctatttgcaaaagggtttactcccttcttccttcttcggatttcaactagtactagatggtcaggtcagtgaagaagaagacatcgtcagttgtttgccgaagctccggaagactgcaggatccgctagcgaagtggaggaagcagtgaagccagctgtaaagcaggagtgaagatcttggagaacccgtcgcagaacctaagccaccctctagtgtttcgtttgtcgtgtgtttccttgcttgtgtgtgtagcgcgtggtttgcatcagtggattgtgatgtaaccatgctaggttgtttgcttaatcaacttgcagaataagtgaaacaaagaacacatcaacaagaagagttagttcctttaaggtcctatctctagttctggtctattctttcctggcttgtttcctctctcacctcaatccctgtaacagatgtttaacagagaaaaaggaaagaatgtcagcgggtatgactcaagtaactcaagttttcaactcaatctgccactggcctcaagagagttaaccagggcacacccttggtccattccaagcatgctgcttagttcacagctaccattggttggaagtcaagaccaaaatcagtatgtgtttgatcgagcctttgccacccaggtcaatgagcttccaatgccagaagagcaggttcccttttgtcatgattgtagagagcaaggacactatgccctgaattgtccatgggtatatgtcaaagaagccccttcccttggtttagcagggcggacatcgctaaaccagcctcctcacaccaagtcaagcttgcagcctagtgtgcaaagtagagagctcaacggagagaatccattgaatcccgggaaatgctttcctcctagcctctcgtaccacgtggggtcacatactaagcaagccaaaggcaagaagagtaagaatcagaagagaaaagcaccgatgcgaactgaagaagaagtacgtaagatgactattaccagcaccgaatggcctccagcagggataactattcctagacgtcaaagaggaaataccttccgaggtgcacgacagttgacccagcacctcctaagccgtggtggcagagtatctgatagtgaagggtcagatcaagtctcctcggatgaagaagatgagtctccccgacatctcggcgaggaagagatggaatccaaagcatgcccccgttgtggagaaattggacacgttgctagcatgtgtctcacactctgccctcattgtgaggaagaccatccaccaggtgaatgtcccacccgcaaggtcacatgttttctgtgcgaaggtacaaaccatgtgcccaaggattgccaactcagtgtgttgttgaccaagaccgcagaaatccaacgaacaaccctacgattgtctcatcagctagtcagctccaacagcaacatcgacgatatcatccacagcaccaatgctcctcccgctgcacctgactctgcaataaatcatagcgataataccttcagcaccaaccattctctgcaccgacagcctcaacaaagaattgtcatcgatggaagaagttgtgtctctccccgacctactccaggccgagccaagggcaatcaacctccggagggcgataccaagcagaagaccgttattcgcctcaaccagcaaccagaaggaaacttctcctgtgaatgatagcaatatgcagtcctatcacatcatcacagaaccaatcaaggatgcagtcactagaacaatgccagctatgtatccatgtttgtgattttcagttcgctacttatcactgtaatcgggagtttgcagcaatcatgtaataaataaacatattcatgattataaacaatgagtttgttatgtttatggatgattcatgttgaggatacaatgtaccgatgataagcaccttccctttttgtttaaggcagtgccttgtattcgtgtaataagggagaaatgtgtaatacagacaagttctgagaggattcttttggaagatgcggatatgtgatcatgtgtataattgtttactgacaaaggagacctagggtctcgtgtcagaggaactatattctaacctcgagttaataaccaacctgtggatggaaaagaaaaccaattaaactgtgttgggttaaaaagccaatgagacagtagttggggataggagtttggatacgcctcttacagatcaagataaggattgttggatgaaacccataagggtacccgccatgcctctacattgataagttcggatattcctgcaaacagttaagaagatccaggagacatcaatatttgagaacataatagtcgatggttggtaattagtctatcaggtatcagaaaagggtcaaaggtgatatggcagaagaacaatatggatgctccccatctcgaggaagcactaaagatgatcatcggcaattaaaccctagtggcatagatacagatagcaagcaatgtatttccctgaaggtggtcagtgcagcttcttgacaaaccacatcaaggtttcactgaaaggcagcaagccaaaggacctcatcgtccccagaagcgtccgcaatccacattaaagaataccacatgttaaagataagccgaaagatgattgataaaagagattggcaaagatgttctccagcatgaaagaagtaggccggaaggtgattgataaacagaaacatgctctgcatcgctcaaggaagacccctgatagtaattgccccgcaacagtcaccttgtcattaagtaagcaagatgacctaggtaaaagtgtttctatgaaggcaaggagtgaaatcttcaactcggtatcagatgctacacggagtgaaaagtgcaagcaccggttaccaggtaatgccatgtcttgggagatgatccaatgggaaggaacacatcaaggttaaaaggtgtaaaggaatacgttgaatgctaaccgaggacaacctgaagataatagtggaaagtaaactgaacataaagaaagtgaatccgagttgcttgttcgtgagagctattcccagttatgaatcaagtgatatgttcaaagataatctacagaggtcagattaaaatcacatctaacaacgaagcctcagatttggcaggataatgattagacagtaacaaatccagcaataaagccatttgggaagacgtcaaagtatgtcaagtgggataagttggttctcttgggaagcataattcaaaggcaaagttagcgacccttgcatcaaatagcagaagtacctagcaccggagaccaggaaagctaatatgagacagttcatgttgtcaatcatggtatccttagtaagcgggatatcatagtctaaagcatatggtggtaagctggaaggaaacgccaagcatggtattctcatgatgacaagcatggtatcctagtaatgacaagcaggttacgagacatgacatgaagttgataacttgtgaggttgacgccgaagatatgaatcgtgagaagttctggatctgaagccccatcttcaagtgccgcaacctagtctgagtcagctaaaaggtgcaccctggttcaagtcaggtgaagagaagattccatccgcagcaggaggtcaagccaagcagttccgagtggtgaagttttgctgaaagtttgtgaggacggagcggaagaagtcaaacaagaagagaagaccgcccaacctatcttcttgctagcctcctcgaatctcggggacgagattcttgtaaggggggtggatttgtcacgtcctgataaattcatcccgaaataaaaatcattttctaaaaggaataatagaattaattaaaattcgaaaagaaattggcaaacactaaaatgcgtataagaaaaattcaaatgtggcccggagaatttttgttaaattctccttggtctaaaaggcgccctcaaattttagtggaattttcagagcacaaataataattgagaagaaataaacaaagttagaatggttttataaaaagaaaaatcctaaaaaaagtcttctttccccccccttcccttactgggccagctcggcccagctccctccctctctctcctcctccccgcggcccactcggcctctccccgcgcgtgcgccgctgacgggcgggcccgcccgccaccctcgctgacgggtggggcccacctgtcatccctatcctcgcgccgcgcccgccgcccgcccgtgccctagcgccgccgccgccgcggattccgccgcatcccgccgtccccgcgcgccataaagagggggaaatcactccccgtgattccctccctcttttccccctctttcccctctctctctccctcggattcgtccggattcactcccgcaaagttcgccggcgcatcaatggcggccgagatttccgcggccgattccttcccctccggccgctctctccctctcccggcgctatataatcgtcccccgtgcttcgctcttccgtttccgccactcgccgcctctcctccccgtcggaatcgagcccgcgccgtcgcaccttctctccgccgtcgccgccgaactccggttcaccgccgtcgtcgccccggacctcctcccgcttccgcatcgcccccttcggcttcgccgcgtcctcgccgaccccgtccgctcctccgtttcgcccgccgaccgccggaacgccgccgtcctcgtcgacccgagccgcgccgccgccttcctccgctccggtcgtcgtttccgccgtcctcgtcgtcccggggtgagccgtggaccgctcctttcgcttcccccttccctcctctctctcgggtgccgctccgccgcgtcggtggtcgccggcggtgaccatcggggcgcgggcgcgccgcctcccgtcggccgtgccggcgaggccgccttcgggcgcgccccgcggctgccaggtggggcccggccgtcagccgcccgcgcccgcgggtgcggctgacgcgtgggacccacggcgccggccggcgtctgccgcgtgcgcccggtccaccgtggaccgagaggctgacgcgtgggccccactcccatggacccggtcc

SEQ ID NO: 43464 - DNA, 11609 bp, Oryza sativa
catataatttgcatatgtgttgtgctatgttgaaatgtgatattgtaatgtgcattggctccatatttgctatttgtgatttttatgcatatgttagggggagcctttgcttttcaatgcaataaatgtccatgtgctctatgtttgattatatatctatttgtggagtttgtcatcaattaccaaaaagggggagattgaagcatctaggcccccggtgttaattttggtaattaatgacaagcgctaattgtggactaaccgttgtctttgaaataatattttaagttaggtccacgtcatgtgtgcacatggatgacgatcgatggattaaaattgacggcgcaaggcaaagagaaagaagacggtaaaactagtgctttaatttagaattgatcggggtgtagggcgatcaaatttgctagtttatttctagtttcgccgtactattaagaggggtaatgacctagcaaagagatgattttaattgccacattaggtcattgcattatcacttgtgctcactttttcatcacacacacacacacattcactgggttcggcctgaccagggcaggtctgaccggccacaagttggcggtctgaccggcccataatgtcggtctgaccggcggcacatgcccggtcagaccggccccctggaggccgaaatggtgctcctcgggactgccgatacagagccgacggagccgtagtcggtcagaccgagccgatggcggtctgaccgagccgactccggtctgaccgcccaatcaactccggtctgaccggccgggccgatggggccctctgacagcgctacaactgctagttttctagccgttgcagagtagcacagtatgaccggccacatacctccggtcagaccggcagagcacaaagttgggggatttcgcccccaacggctagttttggtgggtgggagtataaatactctcccaccagcagcaaggggactctcttggcacccaattcaattgcatacaccccttgcacctctctcacactcacttgagctttgtgttcatccatctagtgttatagggttgattagccaagagtcaagtgcatttgcttccattgtagagctagtgtggcacttgatcatctccacgccgggtcattgcttgttactcttggaggatgccgcctcctagacggcttgtggagaagttgcccggtgacctctccgagaagattgttgtcacaccctgaaaattcaaaatatataaattgttgtttaaatgaaatttttagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttaaaaaataatttaaattgaaaaaggttttgaaaagtcttcttttggctttgggccgaaagtcagcccaaaacccttctctctctcctcggcccaagtcggcccagtccgcagccgcagccgcccgcgcgcgcgtcctcgctcgctgacaggtggggcccgcctgtcggagtcgtcgtcttcctccggccgaaaccctagcgccgcgccgccgccgccgctttccaaatcggccgatcctttccttctccggccgaatcaaaagaggggaaatgatcttcgggatttcctctaccttttctcctttggaaacaccggctaaaatcgtttggaaattcgtggattcgagtttgtttcggattcgattttcccgaactttccttctcgtcgccggccgtcgtgggccttcgccgctgcctccgagcccctttaaaaggacccccgagctcttctctacccgccgccaccctcgccttcgcctctcgtcgccggtagcgccctagcgtcgtgagacctcgagccgccatcgccgccgtcgctccagccgtgcgccgccgccgttccggtcgtcgtcatcgctcgggaaggccaccgtcgggatcgccaagtcgtcgccgtcctcgtccgccccttcgccaccgtcggagaccgccggagcatcgtcgccgtcgtcgacccgatctccgccgtcgcttcttcctcgtcgccgtcgccgtccgttggtcttccgccgtcgcttgggtcgccggtgagttcgccgtgccgtccgctacccgttggtgtccaccgttcttgccgaagtgccgccgttcactggcaagcgtgcgccgtccgagccgtccgagccgccgagccgccgccgccggtggtgacgtcatcgccgacgtcatcgtcgccctcttccgtgagccggtcgtggaccgatcgatctcggtcgtccgttttggtcatcgtcgccctcttccgtgagccggtcgtggaccgatcgatctcggtcgtccgttttggatcaagtcgatctcggccgtccgttcgcgtgaactgccgccgtgcgcccggtccaccgaaaccctagcccgctgacgcaataaatcccttttccttttcaaaaataattcattattgcgtcataattcaattaaaatcaatataagtgttttaatccgatttaatcttcaaaaattcataactaattcatcttagctccgatttagttggttcaagtctctaaatttttctaaaattgagatctacacaataaaaatatccacatgtactgttcatgcttgtttatgtgctgttttggtgattttgctcttttctgcttagattccgtcgtttccggagagtccgttttcgcaggagaagagtttgaagagttccaaggccagcaaggcaagtcacacagatcccaaacaaccctttgagcatgttgatcccgtttaaagctattgtttctattcaactattgcatttattttcgaatgtcattgggtggaattaacctattgtttgctatagcccttttgttcttgattactttattccttgataccttgggttattataatttgactagttgagctttatttatattggttcaactagatattagatataattgcttagccatgcttagaaacattagcacacttttgggataacttatgattcactattatttaatgatagctcacgatggtcaatcgtgattggttaattaattaatgtgccaactaaaacttggtaatggtgggttgtgagcacatggttttgatggtcgtgctcatgacaattaaggaccggttcacgagtttcggttgtgaaacattaaccgtgccaaccacaagccagcgtgggcaacggctttatcttttgtataacatggttcattgcagggcaccagactgagaagtggcggagataagcccacgggggtcgctggggagtccatgccttgtttataagggggtgattatgatccaggaaggtgcgctgcagtggattgtgttatgcaaggggtattgtcacaactcctttccgaggtaccgtggtggtattgaggcacatggtgacatgatgtggggttgtgtcttatgggtacagtggtacacctctgatcagagtaaaactattcgaatagccgtgcccgcggttataggcgggtctaacaatgtctttcgtgattagtctcacccttctcaccatagtaaatgatgctataactggtaataatttgattagctcctggtttggaatggtatattcctggtttggagatagaactgtgcagccgggatggttattcagaatgggtgggcctatacaacagggtatgttgtatagcgttggattaatattgtttaattattacttaactgttttattaaattctcaaatgtttgctaaatgctgcttttgcaaaagaaaccctattatgccatcctttgttatcctgtgcacttgcatatttgctgcgtggcttgctgagtatgtcatatactcaccttgcaatcattcatcagaggaagagttctacaatgatgctgatggtgtggaggattaggtgtagccttggtcaagctgcttgtggagtggagccgtccgcgccgtttatcttattttccgctgcttagatctttattgattgagaggaactatctacctctgtaatgacattttattcgcttattagttagagtaatatttgtactctattatcaatttgttattgtgtgcctcggctgattcctagacgagggttcccacacatgtaagcgtttggaattttggatagaaattccgggcgtgacaagttggtatcagagcctccttgaccttaggttatgccaaatggttacccatagaagccctctaaaaatattggaaaagtagaactgttctcctccctttctcttttaaaccaaactaatggcacatgcacttcataatctcttttaatggttctcattcaaaatttatttcagtgttattagtactgtacatctattactgtactaatgactcatttaccagcaaaagttttacaatattgttttatttaatcctgctgcaataaaataaatttagcatgtcgattttataactttcttttatttctgttaaaacctgatgatcaaaagtacaaaaatttgtaacctcgttttcaactatttcaacttatcttgcaagcttggtttactttatttacttacctttttactttgattttccaactttattcacattaatccaaaaacttgtgctattaattggataaatgtcttaactccctcctttcacttgtctttagatgccgcgctacaagcctgagtacttgtttggtgtggagggttttgtccaggagttgcgtacaatgtcctttgtcattggatttgggactgcccctttttatgcccagattcctcatgatcgtcatgaagagaagtgccgagtcaaagtcaccttgaacagtaatagtgaagatattccctcagtgatgttcgaagctggaggaagaaactacatccatgcgtgtcaggaggtggcaaggatcgccataggagagcttcgcgatcgctacagtgatcagttggccgatacggagtatcgctaccatcctcgtcaaccacagggaagtgaccgtggcaattaccttgagactgaaggaattgagaatgatgctaccacaaggcatttggttgagatgctgtgggctatggatgaaagtcgtgcggagactgtattagcggctcaagatcgtgaagaccggaatcgtggtaagatttgcaagctagaagacaaggtggatcgtttggagaaggaattagccgcattgaagggagaagcaccgccgcagaaggccaggattcgtctcactgcaatgaagagagctctatttgtccctcgctatcaattggcgccaaaggttcgtgtggtggagaatgaagttgccccaaccctagcagatcctccggtcatcatcataagtgatgatgaagaagaagaatccaagcacacccattccaagattgagtgggtagtaactcaagatgatgaagacgagccgaatgagccttcaatcgacctccgatgctcggaagaactagagtgacttgttaagtcgttgtcttagatcgttgtgttagtttgcttgctttaagtttgcttgtgtgtgtctcgcatgtgatttacatcagtggtgggatgtaagtgcatgcgtttgtttgcttttgagtgttaggaagttggtgagtttagtggtgtgagagtcttcagtttgtaataatgaaactcagttaagatcaataaaagttaaagtaattccctgtcctaagtagttttgcccggtttctcttcttgtgccctgtccatgccagatggtgaacactcgcagcaatgggaatggccccaacaacaacaacaataacaacaacaacagtggagagaatcccacacttgcccaagtcctggctcaacagacacagcttatgaacatgatgatgcagcaactccagaaccagcaaaaccaaggaaataaccatgcacctccccagaacaagttagcagaatttctgcgtgtgaggccgcccactttttctagcaccactaatcctgttgaagctggtaactggctgcacgccatagaaaagaagttggatttgcttcagtgcactgattaggagaaggtctcatttgcatcacatcagttgcatggccctgcctctgaatggtgggatcactttcgcctgaacaggattactgctgaacctatcacttggcttgaattcaccgctgctttccggaagacgcatataccatcgggagtggtgtctctcaagaagaaggagttcaggtcgctcactcagggatctcgctctgttacggagtatttgcacgagttcaatcgtttggctcgttatgctcctgaagatgtgcgcaatgatgaagagcgtcaggagaagttcttggaaggacttaatgatgagctttcttacccactcatgactggagattatcctgatttccagaagttagtggataaggctattcgtcaggaggacaaatacaaccgcatggagcagaagaagcgccggattgctcaattcaagacacaacaggggaataatcagaggccgcgtcttactttaggaccccagtccgtgccacagggaggttcttcgtctattgttcgtccgcagcgtcagttcttcaacaacaatgctggcaacaacatccgtaatcaagttccacgtcctgttgcagctccaacacagcaacaacctgccaagagggagcaaggcagcaaacccgtggtgtgtttcaactgtggagacccaggacattacgctgacaagtgtccgaagccccgacgcgtgaaggttgtccctactcagagcaactctaccgcaccagcatcaaaggcccgtgtcaatcatgtcgctgctgcagaagctcaagatgctccagatgtgattttgggtacgttccttgttaacttagttcctgccacagtgcttttcgattctggtgctacacattcattcttatctatgagttttgcgggaaatcatgggatggaagtagaagatcttagacatcctttgatggttagtaccccaagtaatcaagcactctctttgcaacgtagcccctctgtcagaatagaaattaaaggagtaccatttctggccaatcttatcttgttagaatccaaagaccttgatgtcatcctagggatggactggttagccagacataaaggtgtgatagactgtgctaacagaaaagtaactctcaccagcaatgatggtcgagttgtaactgttcatgcattgtcttctgagtctttaaggtcaagactgaaccaaataactttggaagagattcctatagtccaggagtatcccgatgtgttcccagatgatttacctggtatgccgcctaaaagggatatagagttcagaatagatttggtaccaggaacaactccgatccataagagaccttatagaatggcagccaatgagttggcagaagttaagaggcaagtagacgatttgcttcagaaaggatacatcagaccgagttcatcaccatggggagctccggttatttttgtggaaaagaaagaccatacccagaggatgtgtgtggactatcgtgcactaaatgatgtgactatcaagaataagtatccactacccagaattgatgatttgtttgatcagcttaaaggtgctactgttttctccaagatagatcttcgatcagggtatcaccagttgagaatcaaagaggaagatatacctaagacagcttttaccactaggtatgggttgttcgaatgtactgttatgtcttttggacttaccaatgcccctgctttcttcatgaacttgatgaataaggtgtgtatggaatacctagacaagttcgtggtggtctttattgatgatattcttatctactctcgaaccaaagaagagcataaagaacatcttcgccttgcactagagaagctacgagaacatcaactgtatgctaagtttagcaagtgtgaattttggttgtctgaagtgaagttccttggtcacgtcatctcagcaggaggagttgccgtcgatcctagtaatgtggaatccgtaaccaactggaaacaaccaaagacagtttcagaaattcgcagttttctaggcctcgcaggatattaccggaggtttatagagaatttttccaagattgctaagcccatgacacgactgctacagaaagatgtgaagtacaagtggtcagaagaatgtgagcagagttttcaagagttgaagaatcgcttgatatcagctcctattttgattttacccgatccaaagaagggtttccaagtctattgcgatgcatctaaacttgggttaggttgtgttctgatgcaggatgggaaggtggttgcctatgcatctcgtcagttacgtccgcatgagaagaactaccctactcatgatcttgagttagctgcagtagttcatgcgttgaaaatttggcgtcattatcttttcggtactcgtacagaggtatataccgatcacaagagtttaaagtatatctttactcagccggatctgaacatgagacaacggagatggttggaattaattaaggattatgacatgggaattcattatcaccaggaaaggcaaatgttgtagccgacgctcttagcaggaaaggctattgcaatgctaccgaaggacgacagttgccattggagttatgccaggaatttgaaagattaaatttgggaattgtcagtagaggtttcgttgcagctttagaagcgaagcccactctaattgatcaagttagagaagcccaaattaatgatcctgatattcaagagatcaagaagaatatgagaagaggaaaagctatcggtttcttggaggatgagcaaggaactgtttggttgggcgagagaatctgtgtccctgacaacaaagatttgaaagatgtaattctgaaagaagctcatgatactttatactccattcaccctggaagtactaagatgtaccaggatctcaaagaaagattttggtgggcaagtatgaagcgtgaaatcgcagaatacgtagcagtatgtgatgtttgtcagcgtgtcaaggcagaacatcagaaacctgccggtttgctgcagcctttgaagattcctgaatggaaatgggaagaaatcggtatggattttatcactggtttacccagaacgtcatcaggccatgactctatttgggtaatagtcgatagacttaccaaagtggctcattttattccggtaaagacaacttattccggaagtcggttggcagaattgtatatggcaaggattgtgtgttcgcatggcgtccctaagaaaatagtgtctgatcgaggcagtcagtttacctcaaatttctggaagaaacttcaggaagagatgggttctaagctgaactttagcactgcttatcatccgcagacagacggacaaaccgaaagggtgaatcagattttggaagacatgttgagagcttgtgctttagatttcggtggaagttgggataagaatctaccttatgcagaattttcgtacaacaacagttatcaagctagtatacagatggctccttacgaagcactgtatggtcgtaagtgccgcactccgcttttgtgggatcaaacgggagaacgtcaggttttcgggacggatattctaagagaagcagaagaaaaggtgaaaatcattcaagaaagattgcgagtggctcagtctcgtcataagagttatgccgacaatcgccgtagagatttgagttttgaagaaggagattatgtgtatcttcgtgtcacgccttttcgaggagttcatcgttttcataccaaaggaaaattagcaccgcgttttgtgggaccttataagattgtcagtagaagaggagaggttgcttatcagttagagttacctcaatccttggcaggagtccataatgtgttccatgtgtcgcaattgaagaagtgtttaagggtacctaccgaagaagctaatcttgaatagatagaagtccaagaggatctgacctatgtggagaaaccaatccgtatcttggaaacaaataagagaagaaccaggaatcgagttatccgtttttgcaaagtccaatggagtaatcactcggaagaagaatcaacttgggaatgagaagatgaattgaagtcagctcatccgcatctgttcgccagttcttccgaatctcgaggacgagattctgtttaaggggggtaggtttgtcacatcctgaaaattcaaaatttataaattgttgtttaattggaatttctagaatatattttaaaagcctagaaaggaagatctagttttaattaataaattccaatataaaatggggccagataaaattttattaaatactttgcttaattctataattcctagatttttctgggatttatttgagctaagaaagtatttttaataaatggaattgcatttaagaaataatttaaatggaaaaaggttttaaaaagtcttcttttggctttgggccgaaagtcggcccaaaacctcctctctctctcctcggcccagccggcccagtccgcagccgcagccgctcgcgcgcgcgccctcgctgtcgctgacaggtgggtcccgcctgtcggagtcgtcgtcttcctcgggccgaaaccctagtttcgcgccgccgccgccgctttccaatccggccgctcctttccttctccggccgaattgatagaggggaaatgatcctcgggatctcctctaccttttctcctttggaatctttggccaaatcgtcttggaaagagttggattcgagttcgtctcggattcgttctacccgagctttccttcgccgttgccgtcgccgtgggcctttgccgccgcctccgagcccatttaaaaggacccccggtgcctcctctacccgtcgccaccctcgccttcgcctctcgtcgccggaagagctctagcaccgtgtgccctagtgccgccgtcgccgccgtcgctccagccgtgcgccgccgccgttccggtcatcgtcgtcgctcgggaagaccgccgtcgtggtcgccaagtcgtcgtcgtcctcgtccgccacttcgccaccgtcggagaccgccggagcatcgtcgccgtcgtcgacccgatctccgccgccgtttcaacctcgtcaccgtcgccgtccgttcttcctccgccgccgttttggtcaccggtgagttcgccgcgtcgtcctctacgtgctggtgccctccgtttgtgccgtagtgccgccgttcgccggcgagcgtgcgccgtccgagccgtctgctccgccgagccgccgccgctgtcggtgacgtcatcgctaacgtcatcggggtcgtccgccgtgagccggtcgtggaccgtcgatctcggccgtccgttttggattggatcgatctcggccgtccgttcgcgtgaaccgccgcccgtgcgcccggtccaccgaaaccctagccgctgacgcaataaaccttcttttccttttcaaaaataattcattattgcgtcataattcaattttccccgatttaagtgttttaatccgattctcatctttaaa

SEQ ID NO: 43465 - DNA, 1566 bp, Oryza sativa
tgcaatgctacagaaggacgacagttgccattggaattatgcaaggaatttgaaagattaaatttgggaattgtcagtagaggtttcgttgcagccttagaagcgaagcccactctaattgatcaagttagagaagcccaaattaatgatcctgatattcaagagatcaagaagaatatgagaagaggaaaagctatcggtttcttggaggatgagcacggaactgtaaggttgggtgagagaatctgcgtccccgacaacaaagatttaaaagatgcaattctgaaagaagctcacgatactttatactctattcaccctggtagtactaagatgtaccaggatctcaaggaaagattttggtgggcaagtatgaaacgtgaaatagcagaatatgtagcagtatgtgatgtttgtcagcgagtcaaggcagaacatcagaaacctgccagtttgctgcagcctttaaagattcctgaatggaagtgggaagaaatcggtatggattttatcactggtttacccagaacgtcatcgggtcatgactctatttgggtgatagtcgacagacttaccaaagtagctcatttcattccggtaaagacaacctattctggaagtcggttggcggaattgtacatggcaaggatcgtgtgtttgcatggcgtccctaagaaaatagtgtctgatcgaggcagtcagtttacttcaaatttttggaagaaacttcaggaagagatgggttctaagctgaactttagtactgcttatcatccgcagacagacggacaaaccgaaagggtgaatcaaattttggaagacatgttgagagcttgtgctttagacttcggtggaagttgggataagagtctaccttatgcagaattttcgtacaacaacagttatcaagctagtcttcagatggctccttacgaagcactgtatggtcggaagtgccgcactccacttttgtgggatcaaacgggagaacgtcaggttttcgggacggatatcctaagagaagcagaagaaaaggtgaaaatcattcaagaaagattgcgagtggctcagtctcgtcataagagttatgccgacaatcgccgcagagatttgagttttgaagaaggagattatgtgtatcttcgtgtcacgcctcttcgaggagttcgtcgttttcatatcaaaggaaaattggcaccgcgttttgtgggaccttataagattgtcagtagaagaggagaggttgcttatcagtggagttacctcaatctttggcaggagtccataatgtgttccatgtgtcgcaattaaaaaagtgtttaagggtacctaccgaagaagctaatcttgaacagatagaagtccaagaggatctgacctatgttgagaaatgtcacgtcctgataaattcatcccgaaataaaaatcattttctaaaaggaataatagaattaattaaaattcgaaaagaaattggcaaacactaaaatgcgtataagaaaaattcaaatgtggcccggagaatttttgttaaattctccttggtctaaaaggagccctcaaatt

SEQ ID NO: 43466 - DNA, 902 bp, Oryza sativa
cctctcgtcaccggtagcgccctagcgtcgtgagacctcgagccgccgtcgccgccgtcgctccagccctgcgccgccgccgttccggtcatcgtcatcgctcaggaaggccaccgtcgggatcgccaagtcgtcgccgtcctcgtccgccccttcgccaccgtcggagaccgccggagcatcgtcgccgttgtcgacccgatctccgccgtcgcttcttcctcgtcgccgtcgccgtccgttggtcttccgccgtcgcttgggtcgccggtgagttcgccgtgccgtccgctacccgttggtgtcctccgttcttgccgaagtgccgccgttcgctggcaagcgtgcgccgtccgagccgtccgagccgccgagccgccgccgccggtggtgacgtcatcgccgacgtcatcgtcgccctcttccatgagccggtcgtggaccgatcgatctcggccgtccgttttggatcaagtcgatctcggccgtccgttcgcgtgaaccgccgccgtgcgcccggtccaccgaaaccctagcccgctgacgcaataaatcccttttccttttcaaaaataattcattattgcgtcataattcaattaaaatcaatataagtgttttaatccgatttaatcttcaaaaattcataactaattcatcttagctccgatttagttggttcaagtctctaaatttttctaaaattgagatctacacaataaaaatatccacatgtactgttcatgcttgtttatgtgctgttttggtgattttgctcttttctgcttagattccgtcgtttccggagagtccgttttcgcaggagaagagtttgaagagttccaaggccagcaaggcaagtcacacagatcccaaacaaccctttgagcatgttgatcccg

SEQ ID NO: 43467 - DNA, 1187 bp, Oryza sativa
  unsure (1)..(1187): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggatgatgtcagcatgacatcatcatcttctccttttccagttttttctaatagatgaaatcttcggaaaatcataactaaataaccgtagatccgtttcaggtggttcaagttgctaaatttttctaaaatcaagatctacatgttaaaaatatccacatgtactgtttatgcttgtttttgtattgttttgttgatttttattcttttgctttagtttccgacgttctgaaggagagcgtttccgttgaggaaggttcggaagtgtttgcggaagctcaaggcaagtcacacagatcccaaacaaccctttgagcatgttgaacccatttaaagctattattttatttcaactatgcattgttttcgaatgtcatcgggtggtgaacctttccccgttaattaatggccgaagatgatcttattttcctatgggttataatttgattagtatgaaccttatatattggattggttcagctaaatgctatatatgtagggatgctctagagtcatgcttagaaacattagctaactaaaggggttaaatctaaattattttattattaattagggttatattcaatggtagctcacgatggtaaatcgtgtgatgttaattaattgataattaaaacctggctaaggtgggttgtgagcatatggttttgatggttgtgctcatgacaattaaggaccggttcgcgagctactgttgtgatacatttatcgtgccaaccacaagccagcgtgggcaacggctttatcttttgtatagcgtgattcattatagtgcgccagactgagaagtggcgagaagtccatgggggtcgctggggagtccataccttgtttataagggggtgattatgatccaggaaaggtgcgctgtaatgggttatgttgtgcaaggggatattgtcacaactcctttccgaggtaccgtggtggtattgaggcacatggtgacatgatgtggggttgtgtcttgtgggtacagtggtacacctctggtcagagt

SEQ ID NO: 43468 - DNA, 2416 bp, Oryza sativa
  unsure (1)..(2416): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgcttctcgcaatcccgatgccaagttcaggacataaccgaggtgtccgtcatcaacgccgcttcggcggggctgcttgaaggcaaactcacaagaaaaatctccaacaggagccgtagacactcgagcacctgcttcacatcattgacgggtacgcaagggacgaagaggattccaagcgacggcaagcaatccaagccgagtacgataagccttcatcgccgctgctcaagcccaagtacaagcacaagtcgccgaaccggctcctctcgccattcaccaacctcagccagcgaaccaaggacaaccgccaaggccaagtcaagctcccatgacttggaggaaattcagaaccgaccgcgcgggcaaggccgtgaaggctgtcgaagaagttcaagccctccgcatggagttcgatggccaacaagcaggcagccatcaacagcccattcgcaagaaggtcagaaaatacctctactgcgccttccatggacgctcttcgcacaccaccgagcaatgccgaaacattcggcagcgtggcagcgcacaagatccaaggccacagcaaggagcagctgtcgaagcacctcgcgaagctgctcaagaacaagcaccctcggccgaatagcgccaagatgtgcaacgcaaagtaatccaagtgattacaagggccgatctaccagatcaaccgtcaaaacggcagaagaagatgcagctgcgaatggtgcacaacatcacttcgacaggcgaaggggctccgcggtatttgaaccagcagatctctttcgggccggacgatgccgaaggagtgctgttcccacatcaagaccccctgataatcttggccgagatagttggcttcgaagtccggcgaattttggtcgacggaggaagttcagccgatgtcataatcgccgaagcatatgccaggatggggttgccaaccgctagccctcacccaagcaccaacctcgcttcaaggtttcggcggcgaagcagttcaagtcctgggccaagtacaactggcggtggctttcggcacaagcgacaacaggcgcgaagagcaaatactcttcgacgtcgtcgacatcccatacaactacaacaccatcttcggccgcgcaaccttgaacaagttcaaagccatctcccaccacaactatctcaagctcaagatgcctggtctggcaggcgtgatcatggtcaaggggctccaaccttcggctacatcaaagggcgatttggccgcaatcaacagagcagtgcacaatgttgaggccgaaccgcatgtccgggcaaagcacattccgaagcccgcctcccacggcaaggtgatcaaggtgcaggtcgacgatgccgatcccacaagatttgtttcgcttagaggcaacatgggcgaaaaggaagctgagagcatcctagaggtgctcaagaaaaacattgtcatcttcacctagggccccaacgaagtgggaggtgtttcgacagacctcatcatacatcatctggcggtcaaaccggatgccaagccaaggaaaaagaagctgcgcaagatgtccgctgatctccaagaggcagcaaaagccgaagtgtagaagttgctcaaagccgggttgatccaagagatcgaccatcccaagtggttggcgaatccggtactggtgcggaagtcgaacggcaaatggcgcatgtgtgtcgatttcacagacctcaacaaggcatgtccgaaagacgacttcctcctaccgcggatcgaccagctcgtggatttgacagctggctgtgaacttacgagctttttggatgcgtactccggctatcaccagatccacatgaatccagctgacatccccaagacagccttcatcacgccgttcggtactttttgccacctcaggatgcctttcggcctaaggaacgccggagcaaccttcgccagcctggtatacaaggtcctctacaagcagctggggcgaaatgtggagacctatgtcgacgatattgtcgtagaaagccacaaggctttcgaccatgcgtccgacatacaggaaaccttcgacaacatacgctcggcgggtatgttcgcgcgggcaaggttttgggttttcttatttctgaaaggggtatcgaggcaaaccccgagaaaatcgatgccattcagcaaatgaagcccccgtcgagcgtacgcgaagtacaaaagctcgcaggccgaattgcggcgctcagtcaattcctctcaaaggcagccgaatgaggtttgccttcttcaagaccctccggggcgcgggaaaattta

SEQ ID NO: 43469 - DNA, 7780 bp, Oryza sativa
gatggcttcgagcaagcttaaacactactttcaggcccacaaagtcactgtgccatcacagtatactttggccgaagtgctccggggcaaggaaattactggccggctcaacaagtgggtggcggaattatctcccttcgacctgcattttgtcgcccgcactgccatcaagtcccaagtcctagcagccttcgtggccgaatggacaccggcgttcgcccccgaaaccgagcccatcgaataaccttgggtatgtactctgacggctcgtggtcacacaagggggcggtcgccgcggtggtgctcacttcgctagggggcgtgccgattcggtatgctgcaagactgcagttcgacacaaccaacaacacggcaaaatacaaagctgtactgttgggcctaagaaaggcgaaagcattgggggttcggcgcttgctcatccgaacagactccaaactggtggcaagccaagttgacaaatcttttgaggcaaaagacgaaggaatgaagaggtatctagaggctgtttgatctatgaaaaagtatttcgccggcataacggttgaacacctactgtcacgcccagaaatttagcccaaatttctagactattttgtgtattaaatccctgttcaggaccagccagggtacacaaaacgacaagtaatatacaattccaaacgtaaataaagcgtacaatacttacagaagaggctcttagtgctcgcaccaaaaagaaacgacagcagcggaaaaaaatgcgatcctagcggggcttcagctccattccaaaggtaaaactcaactgggggtctgagccttggttttctaacttcgtcttcagctcagaagcactacacttctgaaaagggggaataatagcaaggctgagttcacccaccgtactcaacaagccacaccaacgatgcagacgtgcaaggggaacgcaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctgaactacagtgcattgggtcaatttattaagtgtgagactaatcacagtgaatctggtcgaccgcccataaccgcggacacggctattcgaatagttttactctgatcagaggtgtacaactgtacccacaagacatagccccacaacacgtggtaattaagcatggctaagcatatagttcttgctaggtcacataagtaacatgagttagtcgatttattatccaaggttgacaaaggacagatatcaagtaaacatagcacaagcaagcagttaggtaatacccggatcccatgtaattagcaagacatgcatgtttatttgcaaacggtaaaacatttgtaaattaggatcaacatgctcaagggggaatgtgtgacttgccttgcttcttcactttgatcttccgaactcttttcctcgcgaccgcggacttctgaaacgacggattctacacgctggcacgcaaaacgaggaaaaactctaataaacaccaagaaaatagtacataaaaagtaaacaaacatgtagtgctcaattttagatgaattttgcaagttgaatggctcaattcggagttcgaatgaattagatatgaattttagaagttttgagccattttaattgatttctacaattattatcgaattatgatgcaattatcaattattttctcaaaggaaaaggcattcgctgatatcagcaaggggcgtcggcgccgacaggcgggcccaacgcgtcagcgggacaagggtgtcggtccaccgtggaccaggaccaccgagacggtccaccgccggtccacgggaactgacggcccggatcggcccaaagctgatccaatggccacgggcggcacggctggggcacggcacggcacaaagccaaccggccgaacgacggcgctgggcagctgtcacgcccagaaattcccgaatagaattccaagcagaatgtgcattaaaatccccgtccaggaccggccggggtacacagacgacaaagttgacatacagatccacgtcttacaaacattgtcaaagtcttacataaatgcagcggaaaaacgaaagataactggagctaagccttgacttgatctgcagcgagaacaccactccacaggcatcctcgacggcacggacgaagcctactcctcggagaaaccaccatctgacgcatactcaaactctggggtttggggaaaatagagcaagactgagtactacccactgtactcagcaagtatcacgcccggaaattcactagtaatttccgaacttatttgtgcataaaatcctcgtccaggaatcaaccgaggtacacaaactgacaatttaatatacaaatccatcttaataataacgttacatacttacaaaagaaaagaaaacagcagcggaattaacggtctagcgatggcttcagctccactcccacaggcagctcaactggggtataagccaaacgtcttctccttctggatcctttttcttcaactgaggtttgatgattattgcaagaatgagcatatgacatactcaacaaggcacacagcaaatatgcaagtgcacaaggataccaaaggatggcataatacaggctcatttgcaaaagcagcatttagcaaaacatttaagagaagtaaaacagtggagtaattaatcagaaattttaatcaacactgaacagcacacccatgctgctcaggcccaaccatcctgaacaaccatacccggctgtacagatctaactccaaaccaggagctaagcaaattattaccagttataacatccataattattgtgagaggtgtgagactaatcacgaaaaacattgctcaacccgcccataaccgcgggcacggctattcgaatagttttactctggccagaggtgtaccactgtacccacaagacacgattccacacatgttgccatgccccaaaataccaccacggcattgcaaagggggaaatcgtgacaataccctttgcacaacacaactcaaaacagtgcaccattcccggatcataatcacccccttataaacaaggcatggactccccagtgacccccgtggacttctcgccacttcacagtctggcacactataatgaaccatgctatacaaaagataaagccattgcccatgctggcttgtggttggcacggtaaatgtttcacaacagtagctcgcgaaccggtccttaattgccatgagcacgaccttcaaaaccatatgctcacaacccaccttaaccaggttttaattatcaattaattaacatcacatgattaaccatcgtgagctaccattaaatataaccataattaataagaataatataatatagtttataattaacccctttagttagctaatgtttctaagcatagctaagcaaacttacatatagcatttagctgaaccaatccaatatataaggttcatactaatcaaattataacccataggaaaataagatcatcttcggccattaattaacggggaaaggttcaccacccgatgacattcgaaaacaatgcatagttgaaataaaataatagctttaaatgggttcaacatgctcaaagggttgtttgggatctgtgtgacttgccttgagcttccgcaaacacttccgaaccttcctcaacggaaacgctctccttcagaacgtcggaaactaaagcaaaagaataaaaatcaacaaaacaatacaaaaacaagcataaacagtacatgtggatatttttaacatgtagatcttgattttagaaaaatttagcaacttgaaccacctgaaacggatctacggttatttagttatgattttccgaagatttcatctattagaaaaaactggaaaaggagaagatgatgatgtcatgctgacatcatccatggcggccggctcagatggcgacctcgccggagctagggtggtcggccgggaaaaaggagggcatgtacacgtagaggacgacgagacgaacccaacggtactcaccacaacgacaaacgacgtcggacgacgaccggcaacgagaggggcgacggcggcggctcggttgaccggcggcggaggggctccggtggccggcggcgaaggggaacgggcggccgagcatccccacggcttggcgcacctaaaggcgatggcggcaagcggcggcgacggcggagaaggctgctcggcgcggctgcaacccggccggcggcggcggcggatggtttcacgcggcgacggctctacgggtcacgggaggggacgggagagggggcaaacgaaagaggaggactagggggtcctatttatagccttggattgaagagatcggactcctcccgcaagaaatcgatccgggaaatcaaaaactcggttttggagataaactcaaaaacgagttcgattcggataaaatactcaacggtttgctccgattcttaggggaaaggatagaggagaacgagaggatcaaaacccctcaaaaatccggaagaaacggggccggattgggtgcggatttgaggcggcaaggcggcggctcgggctaggcatggccggccggccggaggtaggagaagcaactgacatgtgggccccacatgtcggcgcctgagagaggagggggcgggcggctaggcttgagccgactcgggccggttttgggccggctcggccgcgcgggagagagggagtgttgggccgaattcggcccaacgacttaagggagggcttttaaaactttttcaattaaaataatcactaaaatgatctttgaattgttaaaaatacttccaacgctcaaataatttcaagaaaaatcctgaaaatacttggacactaaaagtacttaaaaaaattataatcagaccatttaatgattaatttaatatgtgggtaattactgaaatgctctttgtatgattaaaattaggaattgagctccgaaaaatccgagaatattccagagagtataattaaccatggagaatttaataaaaattaaatccatccatgctttatatttaggaaattttatttcccacatttaacttcatttgtaaattaatgaacatttaatataaattctaataataatttattaaataatttataaatcctgaaacaaaaatcaggatgtgacaaatctaccccccttacaaagaatctcgtcccgagattcggaacggctagaaagaaaagggcataggtaaactgcattctatcttattattccataactcagataattattctaaggctttaaagaaaactactgctgctttgaaactggtggctgagctgtaacacttgaagacgcaactcttgaagacgcaactggcactgcattagctcctgtgacaacaatgttgttgatctgaccttgcggctgctgatgcttcggcttcggacactctcttgcaaagtgacctggcttgtaacagttgaaacatacctgctgctcccttccactactgttattctcttgagactgatcctgctgaactggcaccggctgattagcttgctcgatgttaacttcattgctttcattagtctctgatttgatctcaccaccgatgttcaactgttgcgactgtccttgaccagtagaaaaagattcaccaatttggagtggcttgatacgctgcctctggctactatcctgtgcctcctggaaaacaatccttcctctcttacgattgtccatcctgttcttcttgtcttccagtcgaattgctttgtcaaccaactcctgaaaatcctcatagtcatgagagatcaacataactgacagctcatcctttaagccttccaagaacttctcctgcctttcctcgtcagtacgcacatcttctggagcatagcgagctagacgattgaactcatgaagatactctgccacggtatgatccttttgcttcaaagccctaaactcacgtttcttcaaagcaacaacacctgcaggtatgtgtgtcttcttgaatgcctcagtgaactccgcccaagtgattggttgtccttctgctctgttcatccggatgtgatcccaccattctgaagcagatccttgcaactgatgtgaagcgaaaacaactttcttctgatccgtgcactggagcaattccaacttcttctcaacagcgtgcaaccaatcacctgcttccactgggttggtagtgctagagaaggtaggcggcctcacacgaagaaaatcagctaacttgttctgcggcggcggaggattgacattgttgttcccttgctggttctgcatttgttgcactaacatgttgatcaattgggtctgttgagccagcacttgagcaagggttgggttctcttcattgttattgtttccacttccactggcgcgagtgttcaccatctgttgcagattagagaagataggaggagaggggttacactaaagataagaccttaaccaggttaacactgatctgatgtgtgtagaccattatattgttcaagttgattaagcaagcaacctagtatagttacacactcatcaatgaactactccaatgatgggaatgcaactatacctacacacaaagcaaacaacaaacgttctaccctactaactattcttcgaggacagtttggcggcataggttctaagataggatccaaacttcattccatcttgaccacttgcacttcggttcttcctcgatccactttactggcctccataagttgacctcatcaacatcttctagtttcaacaactagtttcagaactactcaagttgaacgagagaggagagtagacaatgaaacaatttgcaaagaattctagataaggaagaaaggagaaattttcacaaattatgttttcggaagatttgtccttaaggtttgaccatttggcttatcctacagtcgagatggctctgataccaacttgtcacgcccggaaattcactagtaatttccgaacttatttgtgcataaaatcctcgtccaggaatcaaccgaggtacacaaactgacaatttaatatacaaatccatcttaataataacgttacatacttacaaaagaaaagaaaacagcagcggaattaacggtctagcgatggcttcagctccactcccacaggcagctcaactggggtataagctaaacgtcttctccttctggatcctttttcttcaactgaggtttgatgattattgcaagaatgagcatatgacatactcaacaagccacacagcaaatatgcaagtgcacaaggataccaaaggatggcataatacaggctcatttgcaaaagcagcatttagcaaaacatttaagagaagtaaaacagtggagtaattaatcagaaattttaatcaacactgaacagcacacccatgctgctcagcccaaccattctgaacaaccatacccggctgtacagatctaacttcaaaccaggagctaagcaaattattaccaattataacatccataattattgtgagaggtgtgagactaatcacgaaaaacattgctcaacccgcccataaccgcgggcacggctattcgaatagtttactctggccagaagtgtaccacttgtcccacaagacacgaattcacacatagtggcatgcccccgaaataccacaacggcattgcaaagggggaaatcgggacaatacc

SEQ ID NO: 43470 - DNA, 1274 bp, Oryza sativa
attaaaattaggaattgagtccgaaaaatccgagaatattccagagagtataattaaccatgagaatttaataaaaattaaatccatccatgctttatatttaggaaattttatttcccacatttaacttcatttgtaaattaatgaacatttaatataaattctaataataatttattaaataatttataaatcctgaaacaaaaatcaggatgtgacagcaagtcataccggaacggagggtatgatgcaggataaactcaaagagtagctagagcgattcatttgcataaaacgagcctttataaacaatagttgaaagcagtaaaacagttgtaataattaatcaatattaaccatccactgtccaacactacaccatgttgcaacaggcccaaccatccacctgcactaatccacttcataaaactaaactagggtgagactagtcatggtgaatctggttgaccgcccataaccgcgggtacggctatttgaatagttttactctaatcagaggtgtacaactgtacccacaagacacagccccacgacacgttaccgtgcaccgacatgccaccacaacataccggaaagaggccgtgacaggaccattcgcataaccccctctaaccaagcacaccacacctcaggtttcacccccactcctcgcaaggcagcgggcagccccctctcgtgcctaggtgaatccggaagccgcataggccgtcgcatggcccatccaaactccatcacgcccacccttgcctggatgcgtcagctagaggaaagctacactacaagcccagccgttgcccatgctggcttgtggtaagtacgataagttcttccagggcatcccgcgaaccggtccttaattgccatgggtgcgaccaacaaaaccatgcacccacagcccaccatgtgatttattttaattaaccaacaccgaagcggtatcactaatccaacattaccattagaacctacagtctaaacattaataggatttccctcattgtgtgctagttgaactaagcatggctaagcagtccctagcccagtgtctactcatgttataacccaagctaacaaaggaacatggtacaaaaatagcatggctatgacaataggtaaacatcccatagtaacattataaaccaatgcagtatttgaagaaaaacaatagagcatttgcaatataggatcaacatgttcaagtgacaagcatgacttgccttgctctgctactggaggaacctcggcgactattt

SEQ ID NO: 43471 - DNA, 812 bp, Oryza sativa
ccggccccgtttcttccggatttttgaggggttttgatcctctcgttctcctctatcctttcccctaagaatcggagcaaaccgttgagtattttatccgaatcgaactcgtttttgagtttatctccaaaaccgagtttttgatttcccggatcgatttcttgcgggaggagtccgatctcttcaatccaaggctataaataggaccccctagtcctcctctttcgtttgccccctctcccgtcctctcccgtgacccgtagagccgtcgccgcgtgaaaccatccgccgccgccgccggccgggttgcagccgcgccgagcagccttctccgccgtcgccgccgcttgccgccatcacctttaggtgcgccaagccgtggggaagctcggccgcccgttccccttcgccgccggccaccggagcccctccgccgccggtcaaccgagccgccgccgtcgcccctctcgttgccggtcgtcgtccgacgtcgtttgtcgttgtggtgagtaccgttgggttcgtctcgtcgtcctctacgtgtacatgccctcctttttcccggccgaccaccctagctcctgcgaggtcgccatctgagccggccgccacacatcatcatcttctccttttccagttttttctaatagatgaaatcttcggaaaatcataactaaataaccgtagatccgtttcaggtggttcaagttgctaaatttttctaaaatcaagatctacatgttaaaaatatccacatgtactgtttatgcttgtttttgaactgttttgttgatttttattcttttgcttta

SEQ ID NO: 43472 - DNA, 6067 bp, Oryza sativa
ttaattgttgcaggctttcacacgaatttaacttattcttttgcacaattttgaggatgaattttagagtcgatttgggacgcgacaaacctaccccccttaaacggaatctcgaccccgagattcggaagaactggcgaagagatcgggatgggctgccttcagctcgtcttcacgctcccaagtagcttctccttcggcgtgattgctccactggaccttgcaaaaacggattactcggttcctggtcctgcgctccatggtgttcaggattttcactggcctctccacgtaggtcaaatcttcgcgaacttcaatttgctctgagtcggcctgctcggatggcactcgaagacatttcttgagttgcgacacatggaacacatcatgcacgttgcccaaggaggcgggcaactccagctggtaggcgacttctccgcgtcgagcagtgatacgaaaaggacccacataccgaggtgcgagcttcccttttgtctgaacctgtgcacacctcgcaatggcgtgacccgaagatacacaaaatcatccactgcgaattccagatcacggcgtcggttatctgcataacttttctgccgggactgtgccacctttagattatcccgaatgattctgactttagcttcagcttctctcaggatatcagtcccgaacacttggctttctccaacttggtcccacaataacggtgtccggcatttgcgcccgtacaacgcttcataaggtgccatttgtatgctggcttgatagctgttattgtaggagaactcggcataggggagactcttatcccaagtcttcccgaaatctaggacacatgcgcggagcatatcttctaggatctgatttagacgctcggtctgtccatctgtctgcgggtgataggcggtgctgaaattcaatcgagtacccagctcttcttggagcttcttccaaaagtgagaggtgaattggcttcccctatcagatacgattttcttgggaataccatggagactcacgatcctagcgaagtagagctccgctagtttgttccctccataagtggtcttcacaggaataaatcgagccacctttgttagtcgatccacaattacccatatagaatcatatccaccttgggtttttggaagtccggtgatgaaatccatcccaatttcatcccacttccattctggcacttggagaggttggagaagtccggccggtcgttggtgttctgccttgacacgctggcacacatcacatagagccacaaactctgcaatttcccgcttcatgctaacccaccagtatttctccttcaagtctaagtacatcttggtactgcccgggtgaatggaataaggactttcgtgagcttcctgaagtatcagctgtttaagttctctgctatctggaacgcatacccgctttccgttccataaggttccgtgttcatcctctgtgaaaccagcggctttaccctgtttcatattcttgaggagtccatgcatgtccggatcattcttctgagcctcgcggatttgatcgagcaaggtgggcttggcttctaacgcagccaagaatccgcgaccaaccatgcttaggttcagggcttccatctgttgattaagctcgggtggaatgcctcggacgttgagagtgttgcagtggctctttcgacttagagcgtcggcaaccacgttggccttaccaggatgatagtgtattcccacatcataatccttgatgagttctaaccatctcctttgccgaagattcagatccgactgggtgaagatgtatttcaagctcttgtgatcagtatatatttcacagcggttcccaatgagatagtgccgccagatttttagagcatgaaccaccgctgctaactccaagtcatgtgtagggtagttgccttcatgaggtcgtagctgacgtgaggcataggctaccacatgaccgtcctgcatgagcacgcaccccaatccttggcgcgaagcatcacaatacaccatgaaatccttgcgagtatccggcaagattaacactggcgaggaaaccagcttttccttgagagtttgaaacgccttctcgcattgcgggctccacacaaatttctcttcttttttcaacaactgtgtcatgggtcgagcgattttggagaagttctcaatgaatctccggtaatatcctgccaaacccaagaaactgcgaatctgagtgactgtcttgggttgcttccaatcggtgacggcgatcactgtttcggggtccacagcaactcctttagcagatatcacgtgccccaagaatttgacttcggacaaccagaactcacacttgctaagcttggcatacaattgatgttcccgcaactttcccaacaccagacggagatggtgctgatggtcttcctctgattgtgagtatatcagaatgtcatcgatgaaaaccacaacaaacttgtccaagtattccatgaacactttattcattaagttcatgaagaaggcaggagcattggtcaagccgaacgacatcaccgtgaattcatacagtccatatcgcgtagtgaatgcggtcttcggaatatcttcttcacgaatacgtaattggtgatatccggaacgaagatcaatcttggagaatacagtggcacctttaagctggtcgaacagatcatcgatccggggaagagggtacttgtttttgatggtaacttcattgagagctctgtagtcaacgcacatcctcttcgtcttgtctttcttctctacaaaaatcacaggagcaccccatggggaagtactcggacgtatgtaccccttttctttcaactcttccaactgtttctttacttcggctagttcatttgctgccatacggtagggtcgcttgtacagaggagtggttcctggagcaagatctatccggaactcaatctctcgcttgggcggcataccaggtagttcttccggaaacacgtctccgaactctctgactatggggatttctgacagttctatctgatgaagttctgaacttctggcagaggttgggggtgcaaagaaaacaaccggttgttctggccctcggtacagagtgacagtgcgcctcgcgcaatccactactccttggaattgagccaaccaattcatcccaagaatcacatccaaattcttggtgtctagcagaatcagatccgagggaaaaggaatcccctgaatttctatagggacggcagggctataatactttgctgtcataacccctccaggggtggtgatgagtagagggtttctaagcctttctacccccaactgatttctccccacgaatggcacagatataaacgagtgggaagctccagagtcgaacaaaattgtagcagggatggaatgaacgaggaacgtaccaacgatgacgtctggagttgtcagcacgtcctcggccgtcacgtgattcacacgaccccgaatgacgtccttgccaccgttgttggagcggggaggcgcttggccttgctgacgccttggcttcgggcatttatccgcaaagtgcccgggctcgaagcagttgaagcacagacgctgctgaccttgagcgtccctgcggccttgaacgggctgcacagctggcgtaggaggacggggcgcacgagtcccttgttgattctgctgctgctgcggctgtgggacgcgcaccacgaattgaggtcgaggcgctgggcgaggttgctgctgctgctgctgctgcgaggaggatccccctgggtagggattggtgtagcggaccctctggttagcaccctgttgattgcggaaattcgccaagcggcgcttgtgcgattccagctccttgtgcttggcttccaagcggatgctcttgtccaccagtcgttggaagtccgggtagtctccagagactagacgaacagacagctcggggtccattcctgccaagaacttctcttgcttctcctcatcttcccgcacatcctccggggcataacgggctagattgttgaactcatgcaggtactccatcacggagcggttgccttgcttcaactctcggaattccctcttcttgagagccacgactccggcgggcacatgggttttccggaaagcggcggtgaagcgagcccaagtgatcggctgcccctctggctgcgtagcctggaagtggtcccaccagagagatgcgggcccctgcagctggtgggcggcgaagacgactttctccttgtcactgcactgcacagtgtctaacttcttccccacggcatgcaaccaatccaaagcatctacgggattgttggagctggagaaggtaggtggacggatgcggaggaactcggcgagtttagagtgttggggaggtggtggtggagcattctgttgtggcgggttttggaggtggtggaggaaagcattcatcaggttagcttgctgggcgaggatttgggtgagaatggcgttggtgtctggtggtggtggtggaggcggaggaggaggtggaggtggattgccttggtggttgtggttgctgccttcgggttggttgccttcaccggtgttaacatttctcctggtcgtcaccatctgaaaaccccacacagaaccagcaaacagagaaggagagctgacgattaaaactaaccacccacgactactataattcttgaatttattactgctattaaattggttcattaatgttcaagttgcttaggcaaacaaataaagacaggctccgacatagttacaccacacaccggtgtaaccatgccccacacaactcaaaaaagacaaacgagaaaaaacacacgcgcaagcctactaactgctcgtctaacgctgcgacgggccaggacggaaggtgagcaacagcgcaccctccgagctaccaacgccggaggcttccccctcctggggaaccacgggcgcaggctcggcacgaggggtctcgacgaagcaggtccacgccagggactgacgaacaagctcaggcctggaggtgctcttgcgggcggtgatcttctggctgcggcagacgcggcgacgcttgggtcggctgtcctctccctgggcgatcttgagctgatgcagctgcgcctccaacgcgtcgaggtccttcttgagctgcaggttctcctgacgcagctccaggatcttcatgttgttctcgaccatgccacggcgcaccatctgatggaagtcgatacgagccgcgtcgtacgcctccaccatgcgtgccagatgcacgacggtagcgtcatcctccgagctggcgtctcggaaggtggcgtagtcgcgggctcctccgcgacgagggtggtagcggtagggcgagtgctgcaactcgtccgggtagcgctggtgaagggtgccgatggcgaggagagcggcgttctggcaagcggcggggaaggagtcgccacccgcggtgactgtcagcgaagtccgctcagaagagccggcgaggatcactgcagtgacctcccaaccagcgcggggctctgcatcctcaccctcctgctccgggagcggcctggcctggtaatccactccatgtggataccccaagaccacgcacatgccccgcagctccaaaacgaagccagtcatgtccaaaccacgacgggtaacgctgccggccatctacaaacaaaaacaaaaagagaaacaacattttaaaggacagattttgatgataagtgaagcagcaagacaaagagagaatagcgggttttcacaaataataaaggatttttatttttgaaaatattgctaaggcttgggatctacggctcgtcctagggtcaagggaggctctgataccaacttgtcacgaccggaaatcacccaacaggcgttcccgacgtgcgtgtattattccttgtcccaggaggcaaggtacaccaaaagttgatacaatacagagtttaacaagcggaagcgtatataaaattattacatgggcgacgaaggcccagcacactcaaagacaacgaaaaacagcggaagactagggcgacgaccacaggcgcttg

SEQ ID NO: 43473 - DNA, 8622 bp, Oryza sativa
gcggcggcggccgaaggtagacgacgactgacaggtgggacccacctgtcagcgaccgaacgcgcgcgcgcggcggctgcggactggcccggctgggccgagaagagagagagaccgggttttgggccgactttcggcccaaagccaaaagaggacttttaaaacctttttcaatttaaattatttcttaaatgcaattccatttattaaaaatacttccttagctcaaataaatcccagaaaaatctaggaattatagaattaagcaaagtatttaatgaaattttatctggcccctttttatattggaatttattaattaaacttagattttcttttcaagacttttaaaataaattctagaaattccatttaaacaacaatttatataatttgaattttcagggtgtgacaaacctaccccccttaaacagaatctcgtcctcgagattcggaagaactggcgaacagatgcggatgagctgacttcaattcatcttctcgttcccaagttgattcttcttccgagtgattactccactggactttacaaaaacggataactcgattcctggtttttctctcatttgtttccaagatacggattggtttctcaacataggtcagatcctcttggacttctatctgttcaagattagcttcttcggtaggtacccttaaacactttttcaattgcgacacatggaacacattatggactcctgccaaggattgaggtaactccaactgataagcaacctctcctcttctactgacaatcttataaggtcccacaaaacgcggtgccaattttcctttggtgtgaaaacgatgaacacctcgaagaggcgtgacacgaagatacacataatctccttcttcaaaactcaaatctctgcggcgattgtcggcataactcttatgacgagactgagccacacgcaatctttcttgaatgattttcaccttttcttctgcttcccttaggatatccgtcccaaaaacctgacgttctcccgtttgatcccacaaaagcggagtgcggcacttccgaccatacagtgcttcgtaaggagccatctgtaaactagcttgataactgttgttgtatgaaaattctgcataaggtagattcttatcccaacttccaccgaaatctaaagcacaagctctcaacatgtcttccaaaatctgattcaccctttcggtttgtccgtctgtctgcggatgataagcagtgctaaagttcaacttagaacccatctcttcctgaagtttcttccaaaaatttgaagtaaactaactgcctcgatcagacactattttcttagggacgccatgcaaacacacaatccttgccatatacaattccgccaagcgacttccggaataggttgtctttaccggaatgaaatgagctacttttgtaagtctgtcgactatcacccaaatagaatcatggcctgatgacgttctgggtaaaccagtaataaaatccatacctatttcttcccatttccattcaggaatcttcaaaggctgcaacaaaccggcgggtttctgatgttctgccttgactcgctgacaaacatcacatactgctacatattctgcgatttcacgcttcatacttgcccaccaaaatctttccttgagatcctggtacatcttagtactaccagggtgaatggagtataaagtatcatgagcttctttcagaactgcatcttttagatctttgttgtcggggacacagattctctcacccaaccatacagttccttgctcatcctccaagaaaccaatagcttttcctcttctcatattcttcttgatctcttgaatatcaggatcattaatttgggcttctctaacttgatcaattagagtgggcttcgcttctaaggctgcaacgaaacctctactgacaatttccaaatttaatctttcaaattccttgcataattccaatggcaactgtcgtccttctgtagcattgcaatagcctttcctgctaagagcgtcggctacaacattagcctttcctgggtgataatgaattcccatgtcataatccttacttaattccaaccatctccgttgtctcatgttcagatccggctgagtaaagatatactttaaactcttgtgatcggtgtacacttctgtacgagtaccgaaaagataatgacgccaaattttcaacgcatgaactactgcagctaactcaatatcatgagtagggtagttcttctcatgcggacgtaactgtcgagatgcataggcaaccaccttcccatcttgcatcagaacacaacctaacccaagtttggatgcatcgcaatacacttgaaaacccttctttggatcaggcaaaatcaaaataggagctgatattaagcgacttttcaactcttgaaaactctgttcacattcttccgaccacttgtacttcacatctttctgaagcagtcgtgtcatgggcttagcaatcttagaaaaattctctataaacctccggtaatatcctgcgaggcctaggaaactgcggatctctgaaactgtcttcggttgcttccaattggttacggattccacattactaggatcaacggcaactcctccggctgagatgacgtgaccaaggaatttcacttcagacaaccaaaattcacacttgctaaacttggcatacaattgatgctctcgtagcttctccaatgcaaggcgaagatgttcttcatgctcttctttggttcgagagtagataagaatatcatcaataaagaccaccacaaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattcttaactggtgataccctgatcgaagatctatcttggagaaaacagtggcacctttaagctgatcaaacaaatcatcaattctgggtagcggatacttattcttgatagtcacatcatttaatgcacgataatccacacacattctttgggtatggtctttcttttcccaaaaaataactggagctccccatagtgacgaactcggtctgatgtatcctttctgtagcaaatcatctacttgcctcttaacttctgccaactcattggctgccattcgataaggtctcttatggatcggagttgttccaggtaccaaatctattctgaactctatatcccttttgggcggcattccaggtaaatcatctgggaacacatcggaatactcccgaactataggaatctcttccaaagttatctggttcagtcttgaccttaaagactcagaagacaatgcattaacagttacaactcgaccatcattgctggtgagagttacttttctgttggcacagtctatcacacctttatgtctggctaaccagtccatccctagaatgacatcaaggtctttggattctaacaagataagattggccagaaatggtactcctttaatttctattctgaccgaggggctacgttgcaaagaaagtgcttgattacctggggtactaaccatcaaaggacgtctaagatcttctacttccatcccatgatttcccgcaaaactcatagataagaatgaatgtgtagcaccagaatcgaaaagtactgttgcaggaactgagttaacagggaacgtacccaaaatcatatctggagcatcttgagcttctgcagcagcaacatgattgacacgggcctttgatgctggtacagtagagttgctctgagcagggacaaccttcacgcgtcgaggcttcggacacttgtcagcataatgtcctgggtctccacagttgaaacacaccacgggcttgctaccttgctccctcttggcaggttgttgctgtgctggagctgcaccagggcgtggagctttgattgcggatgttattgcccagcattgttgttgaagaactgacgctgcggacgaacaacagacgaagaaccttcctgtggcataagctgggggtccaaagcaagaacccgcttctgattactccctgttgtgccttgaagtgagcaatccggcgtttcttctgctccatgcgattatacttgtcctcctgacgaatagccttatccaccaatttctggaaatcagaataatctccagtcatgagtgggtaagaaagctcatcattaagtccttccaagaacttctcttgacgttcttcatcagtgcgcacatcttccggagcataacgagcaagacgattgaactcgtgcagatactccgtaacagagcgagatccctgagtaagcgacctgaactccttcttcttgagagacaccactcccgatggtatatgcgtctttcggaaagcagcagtgaattcaagccaagtgataggttcagcagtagtcctattcaggcggaagtgatcccaccattcagaggcagggccatgtaactggtatgatgcaaatgagaccttctcctgatcagtgcactgaagcaaatccaacttcttctctatggcatgcagccagtcaccagcttcaacaggattagtggtactagagaaaacaggcggccttacacgaagaaattctgctaacttattctgaggaggtgcatggttatttccttggttctgctgattctgaaattgttgcatcatcatgttcattagctgtgtctgttgagcaagaacttgagcaagagtgggattctctccattgttattgttattggggttgttgggaccattcccgttgctgcgagtattcaccatctggcatggacaggataagaagagaaaccgggggaaaactacttaggacagagaattactttaacttttattgatcttaactgagttttattattacaaactgaagactctcacaccactaaactcaccaacttcctaacactcaaaagcaaacaaacgcacgcacttacatcccaccactgatgtaaatcacatgcaagacccacacacacaaccaaacttaaagcaagcaaactaacacaacgatctaagacaacgacttaacaagtcactctagttcttccaagcatcggaggtcgattgaaggctcattcggctcgtcttcatcatcttgagttgctacccactcaatcttggaatggttgcgcttggattcttcttcttcatcactacttatgatgatgactggaggatctgctagggttggggcaacttctttctccaccacacgaacctttggcgccaattgatagcgagggacaaatagagctctcttccttgcggtgagacgaatcctggccttctgcggtggtgcttctcccttcaatgcggctagttccttctccaaacgatccaccttatcttcgagcttgcaaatcttaccacgattccgatcttcccgatcttgagctgctagcacactctctgcacgactttcatccatagcccacagcatctcaaccaaatatcttgtggtagcatcattctcaattccttcagtctcaaggtaactgccacgatcacttccctgaggttgacgaggatggtagctgtcacgaccggaaatcacccaacaggcgttcccgacgtgcgtgtattattccttgtcccaggaggcaaggtacaccaaaagttgatacaatacagagtttaacaagcggaagcgtatataaaattattacatgggcaacgaaggcccagcacactcaaagacaacgaaaaacagcggaagactagggcgacgaccacaggcgcttgacggcaggcacgagctagacaccaaagccttcatcttccaggaactcctcatctgggcttgggaaaattaagcaagactgagtacaaccaccgtactcaacaagacacacccaccaatgcagaataaatgcaagggagtacaagggaattataatataaagggttagggttgcagtaaacagcatttaaagacatttagttgctcaaagctactttgtaaacgcgatcctagaactaaacaatattattaatcaaggccgtgaacccgcacgaacctgccttaacccaaggcctatgatgattcagaccgaactggcaacccgaccctgggtcccagctcgtcctaagccaacccaggccaaccattccatattttagttgttaagcaagttttaagaattaaaacactaacttgggtacattgctcggcttgcccataaccgagggctcggctattcgaatagattttactctgatcagaggtgtacaactttacccacaagacacatcttcctcacgtgttgccacgtgccacataccaccacggtatacggacggaagacgtgacatagtttccaacccatcctagccttagacaagagtaccgacccaatcccacctacggccgggatacccgggacaggcaggcagaactgagcccctagcagcagggcaccaaccctctgccgtatgacatctcgactaccgggccgcagctcgtgtagccttcatttgccctggagaatgtccatcgacgcccgacttcatccatctccaatccgtgtacttttgtctatgactagactgagccacaaactaagccttacccattagacatgtggaagtacggtagtgctttgcaacagaggcccgaagaccggtccttaaacggccgaggtgctactatcaaaaccatgcaccccgagcccagcctaaaaccattttggggattttgaataaagggggatggtgtgagtccaattccacaataaaccaacaattccagagtatccaggtgatatgaatatttcccaaagtctatagttgtaaaaccacctaaggttacctaattagattgcgaagcatctacctaaaatcatactagggataccatgagtagagtgtccactagttgaggttttgtttgtctagggtgaacaaggtagtaataataacaataacaataataatatggtcataacaaaggtaaataggcatggctaagtaaaatagtgataacgcgggaatttaaataaagtgataatgcaataatttaaatcaacataattttataaaatgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttgcgaatttcttcatttaattttcaattaaaaatcctatttattgcgtcagccgagggagcggggcgcgcggaccgggtccacgggagtggggcccacgcgtcagccccacggtccacggtggaccgggcgcacgcggctggcggcggtcggcgccgtgggtcccacgcgtcagccgcacccgcgggcgcgggcggctgacggccgggcccacttggcagccgcgagggcgcgcccgaaggcggcctcgccggcacggccgacgggaggaggacgcgcacccgcgccccgatggtcgccgccggcgaccaacggcgcggcggagtggcacccgagagagaggagggaagggggaagcgaacggaacggtcttcggctcaccccggtcgacgagggcggcggaaacgacggacggagcggaggaagacggcggcgcggttcgggatgacgatgacgacggcgctccggcagtcgacgggcgaagcggagcggcggacggggtcggcggcaacacggcgaagcggacggaggtgtcgccgagtaaggaggaagtccggagcggcggcggcggcggaacggagctcggcggcgatggcggagagagaggagcacggcgcgagcacgaaaccgacggcgagagcgagcggcgagcggcggaaacggaagagcgaagctcgggcaacgtttaaatagcgccgggggaaggaaagagcggccggagagggaggaatcggtcgcggagatttcggccgccatagatgcgccggcgatgaatgcgggattaaatccgagcgaatccgagggagagagagaggggaaagcgggggaaacgggagagggaatcacggggagtgattcccctctctttaatgcgcgcggggacggcgggatgcggcgcaatccgcggcggcggcggcgctagggcacgggcgcggcggcgggcgcggcgggaggaaggcgatgacaggtgggccccacccgtcagcgagagtggcgggcgggcctgcctgtcagcggcgcgcgcgcgcggggagccgatgggccgcgggggaagagagagagagggagagggaaggaatgggccgagccggcccaagaagggaggaggagggggaaaagacttcttttagggttttctttttataaaacctttttaactttgtttatttcttttctattattatttgtgctctgaaaattccactaaaatttatt

SEQ ID NO: 43474 - DNA, 6269 bp, Oryza sativa
ggccaactcattggctgccattcgataaggtctcttatggatcggagttgttccaggtaccaaatctattctgaactctatatcccttttaggcggcataccaggtaaatcatctgggaacacatcgggatactcccggactataggaatctcttccaaagttatctggttcagtcttgaccttaaagactcagatgacaatgcatgaacagttacaactcgaccatcatagctggtgagagttacttttttgttggcacagtctatcacacctttatgtctggctaaccagtccatccctaggatgacatctaggtctttggattctaacaagataagattggccagaaatggtactccttgaatttctattctgacagaggggctacgttgcaaagagagtgcttgattacttggggtactaaccatcaaaggacgtctaagatcttctacttccatcccatgatttcccgcaaaactcatagataggaatgaatgtgtagcaccagaatcgaaaagtactgttgcaggaactgagttaacaaggaacgtacccaaaatcacatctggagcatcttgagcttctgcagcagcgacatgatttacacgagccttggatgctggtacagcagagttattctggacagggacaaccttcacgcgacggggcttcggacacttgtcagcataatgtcctgggtctccacagttgaaacacaccacgggcttgttgccttgctccctcttggcaggttgttgctgtgctggagctgcaacaggacgtggagcttgattacggatgttgttgccagcattgttgttgaagaactgacgctgcggacgaacaacagacgaagaacctccctgtggcatgggctggggtcctaaagtaagacgcggcttctgattatttccctgttgtgtcttgaattgagcaatccgacgtttcttctgctccatgcgattgtacttgtcctcctgacgaatagccttatccaccaatttctggaaatcaggataatctccagtcatgagtgggtaagaaagctcatcattaagtcctcccaaaaacttctcctgacgctcttcatcagtgcgcacatcttccggagcataacgagcaagacgattgaactcgtgcagatactccgtaacagagcgagatccctgagtaagcgacctgaactccttcttcttgagagacaccactcccgatggtatatgcgtctttcggaaagcagcagtgaattcaagccaagtgataggttcagcagtaatcctattcaggcggaagtgatcccaccattcagaggcagggccatgcaactgatgtgatgcaaatgagaccttctcctgatcagtacactgaagcaaatccaacttcttctctatggcatgcagccaatcactagcttcaacaggattagtggtactagagaaaacaggcggcctcacacgaagaaattctgctaacttgttctgtggaggtgcatgattatttccttggttttgctgattctgaaattgctgcatcatcatgttcataagctgtgtctgttgagcaagaacttgagcaagagtgggattctctccattgttgttgttattggggttgttgggaccattcccattgctgcgagtgttcaccatctggcatggacagggcacaagaagagaaaacgggggaaactacttaggacagagaattactttaacttttattgatcttaactgagtttcattattacaaactaaagactctcacaccactaaactcaccaacttcctaacactcaaaagcaaacaaaccgcatgcacttacatcccaccactgatgtaaatcacatgcgagccacacacaagcaaactttaagcaagcaaactaacacaacgatctaagacaacgacttaacaagtcactctagttcttccaagcatcggaggtcaattgaaggctcgttcggctcgtcttcatcatcttgggttgctacccactcaatcttggaattgttgcgcttggattcttcttcttcatcactacttatgatgatgaccggaggatccgcttgagctggggcaacttctttctccaccacacgaacctttggcgccagttgatagcgagggacaaatagagctctcttccttgcggtaagacgaatcctggccttctgcggcggtgcttctcccttcaatgcggctaattccttctctaaacgatccaccttgtcttctaacttgcaaatcttaccacgattccggtcttcacgatcttgagctgctaacacagtctccgcacgactttcatccatagcccacagcatctcaaccaaatgcttcgtggtagcatcattctcaattccttcagtctcaaggtaactgccacggtcacttccctggggttggcgaggatggtagcgatactcagtgtcggccaattgatcactgtagcgatcacggagctctcttatggcgatccttgccacctcctgacatgcatggatgtagtttcttcctccagcttcaaacatcactgaggggatatcttcactattactgttcaaggtgactttgactcggcacttctcttcatgacgatcatgaggaatctgggcataaaaaggggcagtcccaaatcgaatgacaaaggacatcgtacgcaactcctggacaaaaccctcaacaccaaacaggtactcaggcttgtaacgcggcatgtaaagacaagtgaaaggagagagttaagacctttatccaattaatagcacaagtttttggattaatttgaataaagttagaaaatcagagtaaaaaggtaagcaaataaagtaaaccaagctttgcgagataagttaaaacagttggaaacgaggtcacaaattttgtaattttgaataactggtttctaaagaaatgaagaaaattataaaatcaacatgctaaatttatttattccagcaagattaaataaaccagtattataaaacttttgctggtaaatgagccattagtacagtaatagatgtatagtactaataacactggaataaatttttaatgagaaccattaaaagagattatgaagtgcatgtgccattagtttggtttaattaaaagagaaagggaggagaacagttctacttttccaatatttttagagggcttctatggataaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagtccctctcaatcaataaaaatctaagcagcggaaaaaaaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagttcacaggataacaaaggatggcataatagggttgcatttgcaaaagcagcatttagcaaacatttgagaatttaaaacagttaagtattaaacaatattaatccaacgctatacaacattccctgttgtataggcccaaccattctgaacaaccaccccggctgcacagttctatctccaaaccaggaatgaaccattccaaaccaggagctaatcacattattaccaattatagcatcatttactatggtgagaagtgtgaaactaatcacgaaagacattgttcgacccgcccataaccgcgggcacggctattcgaatagttttactctgatcagagatgtgccactgtacccacaagacacaaccccacatcatgtcaccatgtgcctcaataccaccacggtacctcggaaaggagttgtgacaataccccttatacaacacaatccactgcagcgcaccttcctggatcataatcacccccttataagcaaggcatggactccccagcgacccccgtgggcttatctccgccacttctcagtctggtgccccgcaatgaaccatgctacacaaaagataaagccgttgcccatgctggcttgtggttggcaccaaaaaatgttcacaaacgaaactcgtgaaccggtccttaattgtcatgagcacgaccatcaaaaccatgtgctcacaacccaccattaccaggttttagttggcacattaattatataactaatcacgattgatcatcgtgaactatcaataagccatcatgaaataatagtgagtcattagttatcccataagtgagctaatgtttctaagcagggctaagcaattatacctaatatctagttgaaccaatataaataaagctcaaccagtcaaattattataacccaaggtatcaaggaattaggtaatcaagaacaaaagggtataccaaacaataggtttattccacccaatgacattcgaaaataaatgcaatagttgaaaagaaataatagctttaaataggatcaacatgctcaaagggttgtttgggatctgtgtgacttgccttgctggccttggaactcttcaaactcttcttctgcgaaaacggactctccggaaacgacggaatctaagcagaaaagagcaaaatcaccaaaacagcacataaacaagcatgaacagtacatgtggatatttttagtgtgtagatctcaattttagaaaaatttagagacttgaaccaactaaatcggagctaagatgaattagttatgaatttttaaagattaaatcggattaaaacacttatatcggtttaaattgaattatgacgcaataatgaattatttttgaaaaggaaaagagaattattgcgtcagcgggctagggtttcggtggaccgggcgcacgggcggcggttcacgcgaacggacggccgagatctaaccgatccaagatggacggccgagatcgatcgggtccacggcggttcacggcggacgaccccgatggcgtcagcgatgacgtcaccgacggcggcggcggctcggcggagcggacggctcgggcggcgcacgctcgccggcgaacggcggcgcgagaacgcaaacggaaggcaccgggacgaagcgggcggcacggcgaactcaccgacgaccaaaagagcgacggagaagcaacggacggcgccggcgacgaggaggaaacggcggggctcttcggatcgacgacggcgacgatgctccggtggtcttcggcggcggcgaaggggcggacgaggacggcgatgcgacggcgaccacgacggcggccttcccgagcgatggcgacggctggaacgacggcggcgcacggctggagcggcggcggcgacggcaaagctagggcgcacggcgctaggtctcttccggcgacgagaggcgaaggcgagggtggcggcgagaagagaagagcacggggatccttttaaaggggctcggaggcgacggcggaggcccacggcgacggcaacggcgaaggaaacctcggcttggagagaaagaaaaccgatccgaatcgaactcatttccaaagctttccaaagcgatttaaccgatgattccaaaggagaaaaggtagaggagatcccggagattgtttcccctcaaacaattcggccggagaaggaaaggaacggccggatttggaaaggaacggcggcggcgcgaaactagggtttcgggcggcggcggccggaggttgacgacgggtccgacaggtgggccccacctgtcagcgggcgaacgcgcgcgcgcggcggcggactgggccggctgggccgaagagagagagaagagaggttttgggccgactttcggcccaaagccaaaagaagacttttaaaacctttttcaatttagattatttcttaaatgcaattccatttattaaaatacttccttagctcaaataaatcccagaaaaatctaggaattatagaattaagcaaagtatttaatgaaattttatctggccactttttatattggcatttattaactaaaattagattttcttttcaagacttttaaaattatttctaaaaattccaattaaacaacaatttatatattttgaattttcagggtgtgacaaacctaccccccttaaacagaatctcgtcctcgagattcggaagaactggcgaacagatg

SEQ ID NO: 43475 - DNA, 9074 bp, Oryza sativa
aggaacggccggatttggaaaggaacggcggcggcgcgaaactagggtttcgggcggcggccgcccgaagttgacaacgggtccgacagggtgggccccacctgtcagcgggcggacgcgcgcgcccggcgccggactgggccggctgggccgaagagagagagaagagaggttttgggccgactttcggcccaaagccaaaagaagacttttaaaacctttttcaatttagattatttcttaaatgcaattccatttattaaaatacttccttagctcaaataaatcccagaaaaatctaggaattatagaattaagcaaagtatttaatgaaattttatctggccactttttatattggcatttattaactaaaattagattttcttttcaagacttttaaaattatttctaaaaattccaattaaacaacaatttatatattttgaattttcagggtgtgacaggctcttcgccctagtccgccgcctctgccttcgccatgtgctcaagtagacgcgccttggcagtagatcggccgtccttttgctagaactgtttgcgctaggcacgaagtgcgggcaaaacgtcctgagaactgacctcccagtcccccttcgcaaaattggggaactcgacgatgtgctcgcacctgaactgctgcagcaggcccatggtgaaggccgccgacacacgcgcacaataatcgccgtacgcagtggcgcaatctgagatcgcaccgccggcctgttgagtccactccaagaagtcgaagacggaagcatctttgccagggagtcctcgtactctcgcccccatgtcagtaagggcaaggcgaagcgtatggcacacggtcttggcggactcggtggctttcgccatctcctgcgcgaaccgttgcgcctctttctcagcgttcgcctacgccttgagggcctcctggcgaagagcctccatctttggctcagtgaggttgtagtactcagtcaaggcggcagaaaaatcttgttcttttttgagctcggccttgagacgctcaatcttggtattcgcctcgctccccttctccagctcagcttggagccgctcattttttgccttcgtctctttgagggtgttggcgaggctttccatttccaggctcttgcggcccagttcatcgtccttggctcgaagacggctcttgaagccgtcaagatgagcacgcatggttctctccgtcgaacaatgggccgcgagaatctagttcaagaaaaaaggggggccgaaaagggtgatcgttaatataagttgtcgaaaaatgactattaaaaggaaaagaaaaacgaacgacatacccggactgccaagctcttgatggtagaatagccttcgtcgaacccgttcagctcggtgaacaggctcgggctgccaaccagagagacgagattacttaccccctcgacgaaggggacaaggtctgcccgagtatcgaaatcagcaggggcaaagtggggcaccgctagagagtactctgaagcagacgtttcggcggcctttttcttccccttctcgatggcgagcggcgaagccaccagtttgcgcacagggctgccgtagagactggccgcggccttcacaacccgatcagcagaagctgaagtcccgacagcaacgctaccacccgctccgcccgcgtcgaccgcagcaccaggaatggtcgagatacctaggctccgaccagcaggcgaagtaagggtctcgtccaaagactcgtcgtcgctgaaaacgcgagcgacatcgacgagccctttcttcttggaggttttcttgaccaaacaccccttcgccaccttggccgctgcgatcgaaaccagcgccttcgcccccttcaaatcctttcggcggtggggggagctgttcgactctaccccggttttgacatggtcggggcttggagttggggtgtagccgcgcatctcggtgcggttgttggtggcctcgtccgcggccttttcggccgtagcctctgtctccccctcatcctccccctcctcttcgccgtcatgatcttcgacagtgtcttcgtcgtgggcatcggagtcggtggaggtaggggcccttcgcttccgaggagccaacttcacttgcctgtgtgtccgtttcctggatgtcccctcatcgccatcggccttgaagggcttcgctcggggaggaagatcaccgtcatacacccgattcgctcggccggccgcctgccgcataagcagctggccgaactcagcgatcaacacatcaccgatcatcttccgggcttcgatgtcggcctaagcaagggttaacactgcaaaaacgaaacgtgttatcatatcagatgccgaacagggaaaaaggcaaagcacaggaatgtatggggcataccgttcgccccctccggcatgaccagcttcggcaagccatcgacctcctcgtcttggttcacctcgacttgccatgattgggagagggggaagattcgaagcatacaaaattcttccaccaggtcacggcagctaaggcgggagcagaccttgcgaagcagggcgaatcgggcctccatagcgccatcgacggtgaccttgggcttcctgttcggcgcgatcgccctgcgccgccatcggagggctttcgcctcctcaaacccggcctcaaaggggatgctgtggtagaaccacttcaacatccaatggtgatcccatttaggcatagcggcattgaccttccaaagatcggagcgctcggggcgaacattgaagttcacgctcccgaacgccgtcttctttgttcctgccggagtgaccaccgtctttgaattcacggtggcataaaaaatggtgtcgaagagctcggtgctcggctcgaacccagcggtccggcacgcccagtcgaagatggcgatctggatgtttgccattgggctcaattgggggagctccacctgaaaaaggcgaaggatctccggcaacaacacgttgcccagaaattgaaggcccgcctcgaacaacacggcgaagaccaccttccttttgtcgccaggcttcggcaccactaccttccccggggcgaaggcctgattctctgccaatgcgccggaggtgaccagctttgccaactcgtcgtcgtccacaagcgaagcccctagaaaggcggtggtgtcatcatcgattctgccgggatcagggcctgtcgcggaggctgggttcggcttgcgaggagccatggcaaaaagtgtgtgcggtggcgaaaagaggaacaggcgaaaggtctagtattcaagagcgccgcgaagcaagagggcggagaaagagagagctcgcggtgaaaatgacgggggcggtagtgaaaaagggggtatatataacccacccagacgccggttcgccttcccacccaattatgagccgccacgtgtcacgagggtatgcgaaacggtaaattctcattgatcgggccacacaatgataagcccacgaagggaagcccatcactgttcatttcggcccagagaaaaataaagacggcttcgccgtttgcaaaaggcgaaagctagaaacacatgtacacatagtgcacacattctccgcaggactccagtataggtttcggcaggagcgtcggtcgaaaagggggcgcgtcataccataccacatggtttgcacggtctcggccgaagctcttatctcacccttgcccgtgaggggcttgttggcggtatgtcatgagacccttcgaccagtcctgccaaaaccatgcaaccagcaaggattcaagctcagggcatcaagttcatctgggcgaagcccccatggcgaagactgtgaagcaaaagcggcgaagggcgaaggatcgcgctggtatcccacaaggccaaaggcatcttgggcgaaaactaaatggcgaagggtgcatgccgaaggagggtgacttctccataacgagtccagcttcaaggaggccctaggggccatcccagccgctcaagcccattggcccttgggccaatgttcgccaattggcccattataggcccatgtatcacaattacgctgtgtacccatgtaaatatccctttcgtaagggtaaccatgtaaatttccctgtaaaacctaaaccctaatgggggaacctgtgataagatcataaatagacccctagggccatgtaaaaggggggatcccaagaaaaattccaaaattaatacacttcactgtacccaacaactgttgggtaaccacgtccttcgacgtacgtagttgtcgcttcgacaacagctccccctcaagccttttcctgagcgcttcaagcatcttaccattcgaacgttcggccgccccatttcactgtgggtgcgtgaccgaagcgaacttgatttctaggtttagccattcgcacatttctccgaatttgtcagaatcgaattgcttgccgttgtcagtgacgaattcttttggcactccgaaacggcaaacaatgttcttccacacaaacttctgtactgctgccgaagtgatcgcgctgagtggttcggcctcgatccaacgggagaagtattcagtggctacaactgcaaacttgtacccatttcgtgccacggggaaagggccaatgatatctagcctccatctggcgaaaggccagactggtgcgataggttgttgttcgtactggggtgctgtttggcttcagccatgctgctgacagctttcgcacttcttgacttgctcaacacaaactttcagcacggtgggccaatacacaccctgacgaaacactttggaagcgaccgttcttgctgcctgatgcgcaccgcacagcccctggtgtatttcttttgccatatcctcaccttcggcgaaggagatgtagcgaagaaagggttggagcacaccggagcgatacagctacccagagacaagcttgtatcgtgcggctttgagctgtaggcgcttcgcttctgcttcgtcctctgggagccaaccgttcttgaggtacttcacgaacggtgttcgccagtcctctgggtcttcgcccagttctgcctggtcgactgccatgatgtccaggctctctgtgggcacacttggtgcgtacaagacttcgaagaggatgcctggtgaatgtgggcctccactggcagcggattttgccagggcgtcggcttcttcattctggcctctaggtaggtgttcgaccgttatgccggcgaaacacttttccatagatcgaatagcctccagatacctcttcattccttcttcttttgcctcaaaagatttgtcaagaaggcttgccacccgtttggagtctgttcggatgagcaagcgccgaacccccaatgctttcgcctttcttaggcccaacagtacagctttgtactctgccgtgttgttggttgtgtcgaactgcagtcttgcagcataccgaatcagcatgccccctggtgaagtgagcaccgccacggcgcccgcccccttgtgtgaccacgagctgtcggagtacattacccaaggttgttcgacgggctcggtttcggaggcgaacgccggtgtccatttggccacgaagtcagctaggacttgggacttgatggcagtgcgggcgacaaaatgcaggtcgaagggagataattccgccacccacttgctaagccagccagtaatttccttgccccggagcacttcgcccaaaggatactgtgatggcacagtgactttgtgggcctgaaagtagtgtttaagcttgcgcgaagccatcactagggcgtaagtaaacttttccatttcaatgtatcttaacttcgccccttgcaaagcttcggagatgaaatacacgggtttctggcctgactctgtctcttggacgagggctgcactgactgccaccggcgaagctgctagatagagcagcagttcgcttcccagtgctgggctgaccaaagtgggtgggctttgcggatattgctttacctcgtcgaacgctgcttggcattcgggtgtccagctaaactttcccgcgccccggagggtcttgaagaagggcaaacctctttcggctgcctttgagaggaatcgactgagcgccgcaatttggcctgcgagcttttgtacttcgcgtacgctcgatgggggcttcatttgctgaatggcatcgattttctcggggttcgcctcgatacccctttcagaaacaagaaaacccaacaacttacccgcgcgaacaccaaaaacacacttctcagggtttagtttcatacctgccacgcgtaagttgtcgaaggtttcctgtaagtcggacacatggtcgaaagccttgcggctttttacgacgatatcgtcgacataggcctccacatttcgccccagctgcttgtagaggaccttgtacaccagcctggcgaaggttgctccggcattccttaggccgaaaggcatcctgaggtggcaaaaagtaccgaacggcgtgatgaaggctgtcttcgggatgtgagctggattcatgtggatctggtgatagccggagtacgcatccaaaaagctcataagttcacagccagctgtcgaatccacgagctggtcgatccgcggtagggggaagtcgtctttcggacacgccttattgaggtccgtgaaatcgacacacatgcgccatttgccgttcgacttccgcaccagtaccggattcgccaaccactcgggatggtcgatctcttggatcaccccggttttgagcaacttctgcacttcggcttttgcggcctcttggcgatcaacggacatcttgcgcagcttctgtttccttggcttggcatccggtttgaccgccagataatgcatgatgaggtctgctgaaacacctcccacttcgtcggggccccaggcaaagatgtcaatgtttttcttgagcacctccaggatgttctcagcttccctttcgcccatgtcgcctccaagcgaaacaaatcttgtgggatcggcatcgtcgacctgcaccctgatcaccttgccgtggggggcgggcttcggcatgtgctttgctcggtcatgcggttcggcctcaacattgtgcactgctatgttgattgcggccaaatcgccctttgatgtagtcgaaggttggagccccttgaccatgatcacgcttgccggaccaggcatcttgagcttgagatagttgtggtggaagaagcttcgaacttgttcaaggttgcacggccgaagatggcgttgtagttgtatgggatgttgacaacgtcgaagagtatttgctcttcgtgcctattgtcgcttgtgccgaaagccaccgccagttgtacttggcccaggacttgaactgcttcgccgccgaaacttcgaagcgaggttggtgcttgggtgagagctagggttggcaaccccatcctggcatatgcttcggcgattatgacaacggccgaacttcctccgtcgaccagaattcgccggacttcgaagccagctctctcggccgagattaccagggggtcttcatgtgggaacagcactccttcggcatcgtccggcccgaaagagatctgctggttcaaataccacggagccccttcgcaaaccgaggtgatgttgtgcaccgttcgcaactgcatcttcttctgccgttttgacagttgatctggcggatcggcccttgtaatcacatggattactctgcgctgcacgtcttggtgctattcggccggtggtgcttgttcttgagtagcttcgcgaggttcttcgacagttgttccttgctgtggccttggatcttgtgcgctgccacgctgccgaatgttttggcattgctcggtggtgtgcaaagagcgtccatggaaggcgcagtagaggtcttttctgaccttcctacgaacgggatattgatggctgccagcttgttgggcgtcgaactccttgcggagggcttgaacttcttcgacagccatcacggccttgcctgcgcggtcggttctgaattttctccaagtcatgggagattgacttggccttggcggttgtccttggttcgccggctgagattggcgaatggcgagaggagccggttcggcgacttgtgcttgtacttgggcttgagcagcggcgatgaaggctttatcgtactcggcttggattgcttgccatcgcttgtaatcctcttcgccccttgcgtacccgtcaatgatgcgaagcaggtgctcgagtgtctgtggctcctgttggcgatttttcttgtgagttcgccttcgagcagccccgccgaagcggcgttgatgacgggcgcctcggttatgtcctgaacttgccattgggattacgagaagcgacgtatgtactcccttatcgatccctcggcctctagcgaatgccgagtagatgttgctgcgtcttcgactcctcataggtgcctcgaaagttaaggacaaagacatcacgcaattgctcccatgagtaaatgctattagctggtaaattgaagtaccaagaacgggcgatgccatctagagcgagatggattacctttgccttggtgttctcatcgctatgagcggcttcgattgcggactcgtagatggatagaaactcttttgggtccgtttcgcccgagtaccacggaacagatgggaacttgaactggggtgggattggacgaattttgattcccccactcagcggtagccccttttcgccccccgccttgctcacggtaccttgctgcgaaggcccgtttggctgtggatatgtcgtggcgaagagcgaagtcatggcttgcgtgtgaggttggaccacagtatccggttgcctggctccgaatggtggcgcttggtgtgccgccatggatgggtcgaacggaggctgggtccatgccatagcgacctggttcagcgcttgatttgttccgcagcctggcgtcgttgcctgtggtcgagtggttggtgcttaaatggcgttgctgaggtcgaactgcggtccttgactctatggcgaagctgccggaccaggctggttcgacagtagccaactgggcgcaccctgacttgtgtgcccctccgg

SEQ ID NO: 43476 - DNA, 16051 bp, Oryza sativa
  unsure (1)..(16051): unsure at all n locations
aagctggggcaacgtttaaatagcgccgggggaaggaaaaaagcggccggagaaggaggaatcgggtcggggaagttttcggcgcgcaatagatgcggggggcgatgaatgcggggataaaatccgagcgaatccgaggaagaaagagaagggaaaaggggggtaaacggaagagggaatcagggggagtgatttccccctctttttaatgcgcgcgggaacggcggaattcggtgcaatccatggcggaggcggcgatagggcacgggcatggcgatgggcccggcgggagaaaggaaatgacaggtgggccccacccgtcagcgagagtggcgggcgggcctgcctgtcagaggcgcgcgcgcgcggggagccgatgggccgcgggggaagagagagagagggagagggaaggaatgggccgagccggcccaagaagggaggaggagggggaaaagacttcttttagggttttctttttataaaacctttttaactttgtttatttcttttctattattatttgtgctctgaaaattccactaaaatttatttaagcattttaggcttttaggaaatatacaaaaatcctccaagcctcatttgacttttatctttgcacattttaattgttggaggctttcacacgaattttacttattcttttgcacaattttgaggatgaattttagagtcgatttgggacgcgacagtagcgatactcagtgtcggccaactgatcactgtagcgatcacggagctctcctatggcgatccttgccacctcctgacatgcatggatgtagtttcttcctctagcttcgaacatcactgagggaatatcttcactattactgttcaaggtgactttgactcggcacttctcttcatgacgaatctgggcataaaaaggggcagtcccaaatccaatgacaaaggacattgtacgcaactcctggacaaaaccctcaacaccaaacagatactcaggcttgtagcgcggcatctaaagacaagtgaaaggagagagttaagacacttatccaattaatagcacaagtttttggattaatttgaataaagtttagaaaatcaaagtaaaaggtaagtaaataaagtaaaccaaacttgcaagatgagttgaaatagttgaaaacaaggttacaagttttgtacttttgaataacaggttttcaaaagaaataaaagaaaattataaaatcaatatgctaaatttattttattgcagcaagattaaatgaaacaacattgtaaaacttttgctgataaatgagccattagtacagtaatagatgtacagtactaataacactggaataaattttgagtgagaaccattaaaagagatttatgaagtgcatgtgccattagtttggtttaattaaaagagaaagggaggagaacagttctacttttgcaatatttttagagggcttctatgggtaaccatttggcataacctagggtcaaggggctctgataccaacttgtaacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagtccctctcaatcaataaaaatctaagcagcggaaaataaaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttgataaaacagttaagtaattaaacaatattaatccaacgctatacaacataccctgttgtataggcccaaccattctgaacaaccaccccggctgcacagttctatctccaaaccaggaatgtaccattccaaaccaggagctaatcaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgctccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacgattgatcatcgtgaactatcattaagccatcattaaataatagtgaatcataagttatcccaatagtgagctaatgtttctaagcagggctaagcaattatatctaatatctagttgaaccaatataaataaagctcaactagtcaaattataataacccaaggtatcaaggaattaggtaatcaagaacaaaagggctataacaaacaataggttaattccacccaatgacattcgaaaataaatgcaatagttgaaaagaaataatagctttaaataggatcaacatgctcaaagggttgtttgggatctgtgtgacttgccttgctggccttggaactcttcaaactcttctccggcgaaaacggactctccggaaacgacggaatctaagcagaaaagaacaaaatcaccaaaacaacacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaaggggatttattgcgtcagcggctagggtttcggtggaccgggcgcacgggcgacggttcacgcgaacggacggccgagatcgaaccaatccaaatcggacggccgagatcgatcgggtccacggcggctcacggcggacgaccccgatggcgtcagcgatgacgtcaccccggcggcggcggctcggcggctcggacggctcgggcggcgcacgctcaccggcgaacggcggcgcgaggacgcaaacggagagcaccagcacgtagaggacgacgcggcgaacacaccggtgaccaaaacggcgacggaagaacagcggacgacgacggcgacgagaaggaaacggcggaaaccttcgggtcgacgacggcgatgctgctccggcgatctccggcgacggcgaaggggcggacgaggacggcgacgcgacggcgaacacgacggcggccttcccgagcgacggcgacggctggagcgacggtggagcacggctggagcggcggcagcgaagacgaagctagggcacacggcgctagagcgattccgacgacgagaggcgaaggcgagggtggcgacgggtagaggagacaccggggaggcttttaaaggggctcggaggcgacggcggaggcccacggcgacggcaacggcgaaggaaacctcggcttggagagaggaaagccgatccgattcgaactcgattccacgaattccaaaacgaattagccgaagattccaacggagaaagggtagaggagatcccggagatcatttcccctctatcaattcggccggagaaggaaaggaacggccggatttggaaaggaaacggcggcggcgcgaaactagggtttcgggcggcggcggccgaaggtagacgacgactgacaggtgggacccacctgtcagcgaccgaacgcgcgcgcgcggcggctgcggactgggccggctgggccgaggagagagagagagcgggttttgggccgactttcggcccaaagccaaaagaggacttttaaaacctttttcaatttaaattatttcttaaatgcaattccatttattaaaaatacttccttagctcaaataaatcccagaaaaatctaggaattatagaattaagcaaagtatttaatgaaattttatctggcccctttttatattggaatttattaattaaacttagattttcttttcaagacttttaaaataaattctagaaattccatttaaacaacaatttatataatttgaattttcagggtgtgacattcactctcctttcgcttagcaaccctctcctttgtgaccttcttcggtggcattcgctctcaatggtttcgctcagagatccccacggtcggcgccagctgttgtcgaagcaacaactgcgtacatcgaaggacgtggctactcaacagttgttgggaacagtgaagtgtattaattttggaatttttcttgggatcccctcttttacatggccctagggtctatttataatcctatcacaggttaccccgttagggtttaggttttacaggggaatttacatggctgcccttacgaaagggacatttacatgggtacacagcgtaattgtgatacatgggactataatgggccaattagcgaacgttggcccaagggccaacgggcttgagcggctgggatggccccttgggcctccttgaagctgaactcgttatggcgaagtcaccctccttcggcatgcacccttcaccatttagtcttcgcccaagatgcctttggtcttgtgggataccagcgcgatccttcgcccttcgccccctttgcttcacagtcttcgccatgggggcttcgcccagatgaacttgacgccttgagctcgaatcctcgctggttgcatggtttcggcaggtctggttgaagggtctgatgacataccgccaacacttggatttcgtggacttggccttgccaactaacttctttatgtcttttcccattctcaagaagagagagctcgcactaaaaagttggattgaattggacagtgctagctcgaatacatttcgaggacggcttgagtgtctttgagctagtttagaacgtggccaagagcaggagtggctatttgaaagcgacccccaccccttatatagcgcggggcggtgggggtcgcgagtgggtgagtgggcgcgagcaccgaagcgacgaaccccctccccccggtcggttagtgcaatgcaaggttgacacgtggcacacaaaaaaaataataataataacgcatatatagtaagaaataaaatatgcatatcagcatatatgaaataaacagtgtgttttgaccgaataggaggacggccgttttccccctacttttaactcgagcactgttttggccaaaaacacatgtcacccttacccgtgaggggcttgttgttgtatggggtaaacatcatccttcccattcaatcaaaacaccgagggaaaggaggtcttgagaatcctaagtttccaactcggaaaagacttgtgattgggaaaaatactattcgactggtaaagttccatttgagtggtaaagttctattcgagtgattttgtgatacttcagcagcttatcccgcttgagtagacttttacttgtgacaggtaaattctaagagcctaacaggtgaaaaggaatgtttgaactctcaagatggaaaagacgtccaatcgaggaactcgagggaaaacactacttgagcaaggaagataccataagaagattgcatgggaccacactcaaccacctctgccagctggcaccaaaagaccataaacacctccaaaatgttccaaattgcccctaggattgctgacatggcaagggtattatggtaaactcacaagagcctataggggcaagattataacctcacatgtacggctgtgggctatataagccggccaaaatcctgtatcaagacaagatataacttaatagagaaataccacttgctaataccgtgcattttgtgtccgagctcatttttaggataggtggggaaaacgtactttcccgcctatccctgaacttgtccgtggcctaaggtcacaacattgagaataacgttggattaaatattccgatgtggccctattaatacaatggcacattggccgagtttatgtgtataggaatgtactttacacagataggtttaatctatttaatttttattccatgaagccactgtgtgacttggtgcaatgtctgtctaaatattgaatcaaatactcccataagcctattttatatagagagctaaatttatttacatgaacaattattttatatgagtgaattttgtgccctaagagacttgataaagtgttttaaatattctagtgaaacttatagatagggtcattatagtggtgaccattatttcatgtgtacttatatttcatgacactcatcaacatgattcaagtatttaatatttgacctataatttaaattagtaattaaccttccctttgtctagctttgctttcttgtgcgtaaatatttatagggttcataataaatatcttattattaaaattattacttagttgtacaactttagtttaatttcccattgtgacaatttatggcttggcaagcaatagcagccataacatccagcatgatgtaaaagttttaaaaaggttcaaatttttagtgatttttattatcaggaattttcaggatgttacacattcacaaaatttgtaaattgagaatggatagttactcctttatgtatgttgttgaggatgttgtagggatgatcttgttgactctttgatgaatccttgggtgagacaccgtactttgttgcaagtgactactccattatcgtcttgttagttgaggaagacccagttggtgccaatgacattatatttgtgtctcttcactaatgaccatacaccattgcgagtgaaattgttcaattcttcttgcgtagtcatcacccaatctacatcaccaagtgtatcttccatcctaattggcttcaaagaaaaaacaaaagagtaattcttagaaaacttacaatgagatagaatagttaccccatttgtgatatcaccaagaatcttatcgatgaggtgatctcgttgaacaatgtagtgaattcttggatggtgcactgaggggacatgagcttgcatggtgtctctttgctcttgagtacccttggcatcaatcccattcacttatgttggaggcatgacttcaagttcttcatagtcggttgtgagaggttgactagagttgatgaaggttgaccaagtattccatcttggtcatcatggacttcttgatgtctcacatccccaagtattctctttttttccattatctagcataattgagagaacatgctccatttgggagtcattagcaacatcacacaccacacctatcgtgatttcaataaatattagctgaaaacatggtaagtatgagggtttgtctaataaccaaggaccttattccaaaaagatataaattgaaatttcaatagaagaagatactacttgaaagcacttggtcattagggataccttgagcatctaagttaagatgcccgtttgctttcttcaagaacacatgttggtggagtcggttaattcttggatttttttcattttcatcacttcacaccttctcaaccttgggctcagtcttatattgagcacaccgtgcatttcactcgaaggtgtcttgggtttcatgttaagcacaaggaaaaaaaacccaaatgaagtagaaaaaaactcattcataattaaggacaagaccgcatttgttatcttacgtgtttagataagcgatgagttcgtgaagattgatgcatcatagcttcaagctcttgtctcgagtgaggctttatcgatttgactcataattgccttcacttgataggttgtggtaaacatgggctcaaaaatctacaacaaaactttgagatggattataaataacgcacaagttttattttgcaagccatgctgagatctcaaccactcataaatattaataaacctgaaaaattcaggttttcagattttggaaactcaaaatgagcttggaaagagcattgaaacatcacgaaaaaaaaagatttcatgaagtttaacatttgtaaaatcttggatgagttagagacgtaaagagaagccaatatccacaaagaacattagctaaattagctaaacccaccatatgcatgcaagtttaagtaaaaatgtgctgaaacaagattttggataaaagccattttgcttggaataaaataatttttactccaacagctttgaaaaacgttacaaacaaatattgaagcaattttgaaaagatcttcacaaattttcgacttttgaccaaacaggctatttgaaagggctataaatccaaaatttgaaatctttcatgttttgaaagcaagagatacatgaatataatttacataagttcaccctaatgtatctctcacttgaaatccatgaattcaacatttttggacaagtccaagtttgagaaaacatatacataaaagttcacttttccaaaccttccttaaaaaagagaaagaagtaacaaatgagatgctttggattgaaatgcatatgtattagtttgaaaaacctccattaaccagcatgtatcaaaatatgtagttctcgtggcaaaactcacttgatgccataataggaccaaatatggcgagatggctttaatatctggttaatctaattaatagataagagacttgttttcgttggataccaggaaatcattctacctcgaaagattgaattagacagaatgtcagatatcatttcttctcagagatgtgacaactggggaaataatttggctctagcgctaagcaagactttcctggatttgatagaatcaggggtgttcaaactatgagccagaatgaacctccgatctgataccacagtaaactagatatcttttaatcaacatcctaccaaggttgaggggatggtgatttcagaaaggcaaacaagaacgcaactacagaagataggctttttttggaagaagcacagaaaaatgaaagccagataaaggaagtggtcggcgaaggattgccctacccaacttcttgctagccgtttcaaatctcgggatgagatttttgtaagggtggtggatttgtcacaccctaaaaatcattaaaatataaattgttgtgaaaaaggaatttttagaaattattcaataattaaagcaagtgtttgaataaaatttatgaaaaatttgaacatcaaactgagctagataaaattttgttaaatacattgattgcccaagtattttcgacaattttcctggaattatttgagcattgtaattatttttaatgaatgaaagatcatttcagcaattatttaaattggaaaataaaataaaatttcttcctagcctttggaccgaaacccggcccattcctttcttcccacctcctcggcccagtcacgccatccgcagccttcacccctgtttcggccaaagtccgcatttactccctccgccccttcctctcgctgacatgtgggcctatgaacagtgtcatcccctacctcccacccgatgccattgttgaaaccgagcccaaatccacatccgatgccacccgactcccccgtccgtttccaaaattgattgaggcctatttcgctagccgtgggaaatgatccgaaggaaaaccaacccacgtggggtttgggttgtccccgctccccacacccaatacctttcctcccaatccccctctattccactgtcacgttatgtcttgttccctagcagtttggagtagaaggtgggattagaggtgggattagaagggattactaccattcaaattcagagtgagaaaatatcatgaaaaattcggataaattaaaaaaatggaaggtcacgaagtcaaaataattcagaaatgacaagaaaaaaaaagatcatgaaaatggaacagaaattcaacgtgcaaaataattctaaaaagcgtaaaaacagaaaatcgtagatttaccacagatgaattctaaaaatagtccagaatattaaaatcataattttggatagattaaattctacaagcagtaaaacatccaattgccattgtgcaaagcaagctacaaaattggttcttggaaggtaatatatctctgtctgatcaaagtgttaattttgtagaaaaaattggttcctgcaaccatcatagctacatgaattaagaagcagttaggaaaaattgttgtccatccatcgcatttcataattcaagcggtctctgagaactatcttgcaaaagattccttccaatgggcgtagctagcaaatgggccatgggaccctgtaactacacaaccaaaaagaaaccagtcttagacattagacaatggtgattgttaatatgtaaaccaaacaacaggtaaaatgaacttgaatcaaatcagataaatatgcgaaagatggttacttatactcaagttagcaaatccgatatatatattaaacctcagagatagccaaggtacagttctcagattcagatatgtgtacttagttttgctaaaacctcacgtagcagaggtacaaatcttagattcagaggtcagtatatttgtgtgccaattcaaattacttctgctactctagtaaatatgcaggggtaagattaaatgcttcgtatcaggtaaatataagtacaactgtatgtagttttttctcaaataccttgagtaatatcaactccttcagctttccttttgccaacctcacacgccagtgcctctcctgaaaatttaattgagcacaacagattatatttttgtcattcaatagccatttatatagctttgtatggtatgacctctagtaaaatatctgaacacccagtttcctgaaactagttatgaacatagtagcagttcagaatagataaatatgctaaattgattgctaagagtaaaataggtattccaataaaagatatgattacatttttcttgacaatacatcagacaacaaatgcctaattggtgttctgtgttcagatattttacttcttgttgcttgtttggtcagattttcactgttttagcgcaattctgtttctgtccatcaaggcttaatggcttatgcattgcgaagatattcaccactcaagtactcaagtagccaattaatctggtagttcagaagcactttcacccaaaaattactaaagattaattgttgggagaggatagaagcttggatccgaggcacttttgtgacaaataacagatgaagtactcaagtaacaacattttgactgcaaaacaaaatgtaacatgtaaccataataaaatggatctgggaaccactatagcaagaacgcaagaatcagttagttggcagagattcatgagcatctgctcatttgttttcgcaatacacttagtcattcctctacagaatatgtatttatctgttttggctgttctgtgtgtagccgggagaaattcagcgagatgctcccgctgttggaaaagaggagatcaagaatcatacatgcttcttgatgtccaggctgttgccctcgaccttgccctctcccgcaaccggtgaattcgaagcgaggaaggagagatggcgagcagcggtgactgggcgggatggagagcaggaaggagagcagcagcggctgaagcgggatggagaccggcggcgaccaagggcggaatgaagaccgccgggggctgaaaatatgctgctccgggatctccaccctagctagagccacctcccggacctcgcgccgcatccaaaccctagcgccgtgaggagtcgaggaagacaagcgccgtatttgctcgggaagaaaacaaccgtctccgagacgatttttctgtacccgggggtttggcgtggatcgggcggagaattgcctccaccccggcccaggcgaacgtgcatatgggccatggaagaaaattagacccggccgggatggcacacggggatttgggcccatcccccccccccaaacggaataagttcaccagaggtccctcaacttaacagcgagattttttgaggtcccttaaccacaaaaccagaaatatgcacccgtaaactttcacaaaccgtgcacaaaaggtcctatggcagtatacgtgagtggtttcactgacgtggcatcctagtcagcgaaaataaataaataaagtacgtgggtccacatgtaagtgagagaaaacgatgcgggccccacatcccttctttttccccctttcttctcttctctcgtcttcttcgacgggtggggcgacggccggcgagagcggcggcactttttgtaccttgttagttactctggtttaatagaattatctttatgagaaattaagatttacttagtgggaattattcttggttagttcctaatcagcatatgggatcatttttcactatagtccattaaatatatagtgattgttttagtgtttagctagcactagagtagttattaattgcgtatacgcagtgtgtgggtaattaattttcagtggttgctgcgtatcccacagtacgttagaggtgactattgaggcggtgacagccctcaagagcacttaagtcctccctgtacgagtatgtagtagagcgacatatgagaacagcgggttaccagtgcctgaagtatcgtgttaggattaaaattaagctttccttagacactacttctcactaggaaatactctctaccctttgcctatctttgctttgtgtccttggatgaatctggagaacacctgagcacacacgttccctgtggaaattgataccttggaatacttccgggtgaagtgctacattggtatatccgtgcgcttacggattttatttgtaatgttaaaagataccaacactaagcatcacctaaaccaatcatatcatcaaattataccccaagctatcaatgattcgggataacaaaggatgagtacaataggtatccatccctcatgatattataaaataatgcaatttaagtagaaagcgagggatttataaattaggtacaatatgatcaatgctttgtgtatgacttgccttgctctggcgctggaggaacttctgcaaccactttgtagtaaacgggagcgtcggaactgctggattctataagccaaacaaagcaaacaagcaaaacatgctataagtctattgaaacatgaagcaaaaccatttttaatggattttagatatttttataaatttattgagacttgatgggttaatatagagcatggataaattagatacgaattttagaagttttactgtgttctgactataaacaaaaaattccttaatgatttattgcgcattaaagcctgagggctgacgtcatcaggggggggcgttcggtgccgacaggtgggtcccacatgtcagcggcacggggtgccggcgtaccatggacctggaccacgtgggtggtccaccgccggtccacaaaaccgacggcccagatctgccataagggccgattggacggcgcactagcgttgtcgggctcgagatcggctcggccagccatggcgagcacggtggcagtgcggctaagcggcggcacacggcgacggtgcaaggcgcaacaacgatgagcggcggcgcacgttcacgagcgggattgaacgacgagagagaaaaacaaagtggggtccttactggtgagcgacggcggccggagcggaaggggaggtggcaaacgcgacctggtggtcggagcaacggacggcagcggcggcgtctagtgggcaaaaacaagatggatcagggtaggggaagatgaccatggcggcaagcttcgctggccaaagatggaggagatgggaggactcaccggcaagcagcggtggtggcgctccgatgggaaatggtagcaaccaaacggtagccacggtgcagaaggagagggtgaaagcaacagtggcattggtgcagccgggcggcgactagcagcggccggaggtggagatgtggcagcggcggctaggacacggcgcggcagcggaatagggctcaggaatggtggcaaaaatagggaaaaaggtggaggaggtcctgagggggctttttaaggtggcggtgggctcagtggaggctggtggcggctagcgtggcgacggaattagggcggcggcaggataagggcacgatttctgccgattttgaaggggataagggcggtggcggttgcgacgggatggataaggatgccgcgtgcgaggggcgaggccggaagcggcatgggagcggcggtggctgttacggcggtggtggcgcgaggtcggggatgggcctgacaggtgggccccacctatcaatgtcccagcgaggggagcggacgcagctaggccacagcctcaggccggcccagccaaggaaaaatgagaaaactcaagatgtgacaacttcattcgcaaggcatcgcgaatgcattgatgctttgctattggtttaatttggttctggcctccttttatttcttctcttttttttcttcccgttccgtgatacaactcgatcgaactatccttgttgcttccactgcaagatttcaaaggacagaaaggattatatacctcccaaggtattgtactagtagtacctcccgaggctgggcgtggcacggaagcgtcggcggctgttgcggcagtggcggcgcgaggacggggacgggcatgataggtgggccccacctatcggtgtcccagcgaggggagcagacacagctgggccacggcttcaggccggcccagcaaagggggcgcgcgggggaagggaaaggagaggtgtgggccgtttccggcccacagccaaaggtgagagaggaaggaattttaattaaatttaatcccgttaattactttggattcattataattaccttgtttgctctaaaaattccactaaaaattctgtgagtgtatttaaacctgaggaactcaagaaaaattccaccatcccaattccacttattaactgcattggtaaattaatgttagctccaggttaaattaaataatttctccggttgatttattaatgaattcgagactaaggaaaaataggaaaactcagcatgtgacaacttcattcgcaaggaatcgcgaatgcattgatgctttgctattggtttaatttggttctggcctcctcttctttcttctcttttatttttttcccgttccgtgatacaactcgatcaaactatgctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 43477 - DNA, 9347 bp, Oryza sativa
atacaactcgatcaaactatgcttgttgcttccaatgcaatatttcaaaggacagaaaggattatataccttgcaaggtattgtactagtagtaccctctttttattaaaaaaaaggcgtaactaaaaatatttttcatataatttaaaatttgggttgatagcgaaatttaaaatataggtttaattcggttattaattgagtaattagctgaatggaaaacaaatggtttaaagttgtttggctgttaactatagggttttgatgattaattatatacatgaagcgtaatttaccaaagctaattgttgttggattttcggtttggtcactgttaaatatgtatgcgtgttgttagttttgcatgcaaattagagtccagaattttctacaagcgccgagggttgaagacgaaagcgtgcagtcaaagaagatcccaatagcaggcacaagtaatcggcacagagcatgcctcggtaaagccatgtcacggagcatctcctctggccggactccaatgcaatatttctttgtgtggatgtttactgattcggtcacaataacgtctataatcctatctatctatatgtcgtgctatctatctatctatctatctatatctttgtgttcaagtatagcatatggcctacgcaggctacgcggcaagcatttcttcatacatattttttacttatttatttttattattatattttattctaaaatttttttatacatttagtttattttgcaattcatattgcaataatttttttattttaaattttagtttatctcaagttgtattttagatggactcttcttttaatatttcttatttttcaattctaatagttatttctaaattatattgctatatgtgtcgacgggctatacctatagacgaaatttgtagagcatgggaaagattggaaccagaatatacgcgagactatatcaagcagacaagtgacagatttgtactggttacagaagttggacgactcgcgcatatgtctggttggcatcgatgaaaagattaggatagcgtcgatcagattggattgaaagattgtttgaaagcacgaaaccaaacatacaacgaaaataaaaagaaataataataaagttactctaataatactggaaccctaaattaatcaccctaataaccaagacaccctgcacagtatgaaaccttgggtacagcaccgaaacatgaaggctacggtacacgcgcgtactatggcattgtgcatgtccggtaaaacagcaaactgatcgaccttgcacgaaaaacactataactccaccaattctattccattttatgtgaaactcgaaatataagttataaacatggcctaggttcaatttttaccaagaaacataaaaacaacagataaaattgatgagatctaattaaactctaatctaaactaaaacagaaagaagtttacttaaaacctacatcgtgatgagaagctaaccagtgaaactgcgctaggactttcggttgattatcgggtgcagggtgaatttggccatcgacgtaggcgccatctcagcgcgcgcagatggtggagttatggggtgcgtcatttgttacgccgtctcgtcacgtgcaggaagagacatggagtctgtcgctctccatctactctctgcattctaatgtactcaatgatgaactttgaagcctataatctaaactggacagtgacccacacgtgagattagttttgggctttaaaaatccatggttaaaattaatctatggtcatgatattattgttaatataatcaaaggtcacaatattgatttaatacttccaaaacctaattacaaattaataatttgacctaatagtagcaattgccgtaatataataagatattggaactatataattttaaaatataaattttgaagacaaagtcaaattacttcgaccaaaacatgacaattcataaaaaaattgaaaatatgctataaatgttgaaccatatgagacatgaatttggtagatataaagagatattgacgtgaacgtgtttgaaaacacatgcatatgaatataatttttatacacataattgagctgagtgttgcgagcagatcgcacttgcctagcatttgtatgagatcttctcaagagctaattaacatgtagattgcacatgtaagctacatattacgttcctaaatctttgaggaatacctaccagcttccgatgtggtgtggttcgaccggtctgcacactgcagccgatctgccgcctgctacaccttgctgtacgtgcctagatacatctcgtgatgctgtgctccccatcgatctactcctgcgttccccacactgtacgactcctaaatgtacgtacgatgagcaaaacaaataaaggttgagatatatgtggtgggcaaaacatagattggctaggcctgtaattaaagcagttgattggacgagctttacatgaggcccataatgttaatgccgattaaagtttataatcaatggttaagattatatgatctatcaaaattaacgatcagattttacaagttaatgcgggagctcgtagaaagtggccaattagtataagtactagtcggcaacccgcgcgatgcatgggttatcataaaaaaatagccgtaagctaaatatgatagttattttattgaaataatagaagatacctatgatggttttaattttctattattgtttcaaatttaaaaataaaattagcaaaatactgatcaaattaagattggtgtgacttcgtatttattaattttgatttggcattatttaattttaaacaattaaaaatctaagggtccgtgttatatttaatttgatgtcttatgtgacacatattctggctacttatctacggttatcatatctgcatgggctacatttataaatagcaagacatattataacttgcagctaaactgtatggtgttgagagcaaaactttccaatcatataagttttgttcaaaatgccatcattgtagaaagatgggttaaaatattacgtatacctagtgtgaatccagtcttattaattcatcattaatttgtgtattattcctaacgattacgaactgatacaaataataattgtaatttagatgacaaatataagtttgctgaactcagagtatataagcatacgaataaacatccattgtaacactgtcaaaattaaagaaatcctaggtgcacagagataagatttaaaatccgttcgtttctaatcacagatgttagctaggtttccgctttttaaactactaacgatgcattcgtgcgaaaagtgtttatatagaagtatactttacaatataaaagatacataaatctattgttcaagttaaaaataattaaaaatcaagtaattatgcactaatggtttttttgttttgcatgcctgtacttcatcttcattgacgcactactgaccggagccttacttgatctccatatttcgatttagatttgcatgaatcagtctatataacgaattgaaaaaaaaaacagacatgaagtacatatgggttaatcaatggcttaattttaattgaaactatacgtactttggtgaacgtaatagtagatttactggttggcaaatcataaaatttgtgtttgacccgaccaataatctcatcatttgaattcacagagcagcacaacacacatgtttagatgcgcgaagctccaacgctggagcaggcgcagcaagcccatgaaattaaacttcaattaaattgatagcatatatatgccactgctaacctgctaccatgcatgtccatgcctccagctcgctccatcgatgccaaggtgtacgtgttacgtgtgtagctgattctgtgtgcgtacttcttccggttaactacataatcgccgccgatcctgatggacacgtcacaccagaggctatgaaggagttcatcttggccgccgtcttagttttgggataggtctcctactggagtacttgttacattgtacgtgagatacgtacggtggttaggtaaatgaggcgtattagatgggcttaacctggcccacaacgtcgatgaatcgatctattacttaaaagctatttaattacatgatcgatggtgacgatgatacgctcgacctaatcaacggccataactttctaattaacatgagaactcgtaggaagtgcccaattagtataggtatagaggtatagatagatagatagatagatagatagatagattgatagatagattgctaaaaggaccatccctttgttgtgtaattatagttaacgtggcattttaccaaagtgttaacaatgcagaagtgtcacaaaaagtaaatgactaaatagaacacggatacatcacatatcacaaaggaagtgaaagttttattttattgttgagtaccaactgatcaccattacattagtaaagcgacacattgccaacataattacttcaagccgtgtagtgacaggcatgataaaatgctacccttattcttctcttatgcctcagcaactgcatagtgcagcagctcgttgtccctgatgagggcatcaatctcactcttcttttcctcctatgctgcattgtaattctcagtctcaccatccttttcaggattgtaattctcaagttcctgaacgtttgacttcagcttccatgcttcaaccttctctgcatctagagcttcctagactgaattcttctcatcattcaggcacggatacttggcatcaagttcattgtatgatgcttgcaactctgataaagaaacacggatcttcaccaactcgtctcttagcctatgggcctcagcatccttgtcatgcacggctttctcagccgctttcttgccaacttggatttcctctaccatccgaagcttatccttttcactttccgccaaatccttgctagcctggatttcctccaccttcctcttaagatcctccaattccttcatgattttttctttctcagcatcaaatgccttcgtagtcacctcctttgcctccatcaaagcatccaatatcttccagagacgcttaacctctgcttcagatatgctttctttctgttctgcagtagaaacatccaaccgaagtttatcattttcaccctccactaaatacttgttggcctggatttcctgcaccttcctcttaagatcctccaattcctttaagatttctgccttctcaacattaaacgcctttgcagtaacctccttttcctcctctaatgctttcaattcattcttcaggctcttaatctctacttcaaattgattatatttctgcttcgttgtcacaatatctaactgaagcacgttattttcactctccaccaaatccttcttggcctggatttccagtaccttcatctttagatcctccaattcctttaggatttctgtcttctcaacattaaacgcctttgcagtaacctccttctcctcctcgaatgcttccaattcattcttgaggctcttaacctctacttcaaattgattgtatttctgcttcaatgtcagaatatctgaccgaagcacgtcattttcactctcaaccaaatccttgttaaccagaatttcctctaccctcctcttaagatttcctgattccttcaagatttctaccttctcagcttcacatgcctttgcagctgcatccttcgcctccaccactactctcaatatctgattaagccacttaacttttgcttcagactggccatatttctcctctattgccaaaacctctgactgaagcttatcattttcaccttccactaaatccttatttgtttgcagttcctcaaacttcctcttaagatcctctagttcctttgtgatttcatcattttgagcttcacatgccttcgcagcagcctccttcgcctccgtcaatgcaaccaattccatattgagtgtctcaatctttgcttcaaacatgatttgtttttgctttgtaatcagagcttccgaccgaagcctatcattttcactctccaccaaatccttattggcctggatttcctccaacctcctcttaagatccgctgattccatcatcattttgtctttctcgtcatcaaatgtcttaacagctacctctttttccatcaccaatgcacttaattccatctggagcttcttaacctctgcttctgactggccatatttctcctttattgccaaaacatttgacagaagttcatcatttttagcttgcactaaatccttatttgtttgcagttcctcaaacttcctcttaagatcctccagttccttcatgatttcatcattttgagcttcacatgcctttgcagcagccttcttcgcctccgtcaatacaaccaattccatattgagcctctcaatctctgcttcaaacatgatctgtttttgctttgtaatcatagcctccgaccgaagcatatccttttcactctccatcaaatctttcttcgcctggatttcctccaacctcctcttaagatcctctgactccatcatcattttttctttttccttcaccaatgcacataattccatctggagcttctcgaccatatgattatatttttcctccacattcaaaaccttcaacccaagcatttcattttgacccttcaagctactctccacctcctctttctgccttgagatgacctgagcttcctgctttgtctcctccaattgcttctccactttacccttctcgtcaagcagctgggcatttttgttctccaactccgacaccctctccccaagtgtggagacctggtgcattagggtcctcctcttgtcatctgtgaagaagtatgcaacatatgttttagaggggtcttaggggagagagatgggaccacactgtgcaaaaggataaagatgatcacctttcccacccggaagcagcgatttcagcgatgacggcatgctagtcactattgccacacactcctaggtggaagatgccttgttgtctcactgtgcagcagccaaaggatgcagtatattttcctgcccctgcagaggttgcctcagagtgaatatatatacaagaggagtaggagaatgagaggatgaagtatccatgactcctccaagaggaagagggaagaagcaagggagagaagggatggagtgttggtgcagcagaggaatggagtgtcgatcgggaagagggatgggtgaatatacgttttgttttgtaagaagaaaattaaaaagggataatagattttgactatctagtgttagtagggcaagacaggattaaaattgctgccaagaaagaatcaacgtaatgcagaaggaagaaagaaacgaacaaattctcgatgggaaattaaagcagcacagatatattgttcacaagtgtcttcattcgcaaggcatcgtgaatacgttgatgctttgctattggtttaatttggttctggcctcgttttccttcttctcttttgttttcttcccgtttcgcgatacaactcgatcgaactatccttgttgcttccactgcaagattacaaaggccagaaggattatatatatacctcccaaggtattgtacttgtagtaccctcattttatttaagaaaaaggcaaactaaaaatctttttcatataatttaaaagtttgggttgatagccaaatctaaaatataggtttaatttggttattaattgagtaattagccgaatagaaaacaaatggtttaaagttgtttggctattaactatatggttttgatgattaattatatacatgcatgcgtgttgttagtttttaatgcaaattagagtccagaattttctgcaagcgccgagggttgaagacacaagcatgcaggggccaacagatgatgatgaagacaaggacagggacaggcagcgcaggagtcgtcacaagagccgctctgtgtgggattggctcgggcgcctgtcctcaagtcacagcagggagccagaaaggagagatggccagggggcgctcgcgcaaccgggagcgctctgatccacgtagcagaagcggccgttcccgagagccaagcaaggtgagaccacctctctcttcatccttcacctctcagaacaatcctgcctcagacacccttctaccctctcccaatcggcttgcctctccatgcaagcaaccaagctcggtccgcaaaccgagcccggacggggacgccactgctaccttctccgtcaaccttgccatcccggaccaggctgttcttcaagctgacaactgcttctgttcgcaggggcaggaggatgttcttaccctcccggagagccaccttgacccaatgctgcacgaggcggcggtgcagtactccatctactcgccggacacaaattccctccgtgctgtttcccctgttttcgtattttcctcttttgcagaacaggtgactcaagttcatggggcgtcggtggcaggacaggtgaacaatcaagctcaagctgcattgctggtaagccaggtgaacaatgtggaagagttcattgacaccctctcgattccgcttcagccgccgctcctgcctgctctggacgcaaatgctcgccatccaagccacgtgaaagtgacaatacctgcaatttcctcggcacaatgtcatagcgaacgcctgcttggcatgaggcgggcgggagcaaaacttgaaacttttgctcaagagatcatgtcaaaaaagtttggtataattgatgatcatgcttcctttgatgataacatcaaaaagatttacttgcagcgctacaagaaaccgttgtccccctccttcttgaagacaatcactgagctggcggagaagggaggatgcaagagcatccgcctgaaggcagcaagaaagaaggcagcgatcgcgcccctgtgagcgcgctgcatcctgaagaagtaccctgcattggccatgaagagtcccacccctcatcaaattagcttgtcttcctactgtcatctctgcatgttagttccagtcaaagatgttttgtcttcctctgcctgtgcttctcccagctttgctggttgtgttcaagaaaggccttgttactttcaccatcaactagagtagtagttgcagcagcttctgtgcccatgtcacaagacaatgtttacttgtttaactggaatgtaagggttctgaattccaaggcgaagcaagatgcagtgaaagttattttgcaacaatatggtgccactcttgtctgtcttcaggaaactaagattgcttccatcaataatcgtattattcttaacactttgggtcaaagatttgtgcga

SEQ ID NO: 43478 - DNA, 5582 bp, Oryza sativa
ctgcttttgcaaatgcaaccctattatgccatcctttgttatcctgtgcacttgcatatttgctgcgtggcttgctgagtatgtcatatactcaccttgcaatcattcatcagaggaagagttctacaatgaggctgatggtgtggaggattagatgtagccttggtcaagctgcctgtggagtggagccgtctacgccgtttatttattttccgctacttagatttttattgattgagagggactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacagagccagcggccggagagggtggaggagatgcccaagatcacccagaggtgtgaggccctccgcccgctctttagatttcgtagttttcttttggcgtttgccatggagggcgaacgatgtgaatttgggcgatggccctctccctttcgtattgtagccgaaaacggcatttttaatatatgaaatagatgacccaagtttagccaactattatgtttgatgcctttggtgcatatgcttgcattgtttcacatacgaaagggtgtttacccttttcgccaactttgtgtgttttgctgagtcttaactttgcgctttgccatttaccctttctatactgtcttagcagggtcttcgccgaaaattttgtgttcggccccccttgggaattggcgaagtaaaaacgagaagttcgtggcggtgaagggtttgccgaaggtccggtgtccgtttcagcctttttaccacgagatgataataaacggcaacagttacaatgttttgaaagttaccggctggatgcgggcgcaccccgggcgaaccctggacgactacgacagtgtccatgtggaacgtctagaggacatggttcgcttttggtgaaaccaccggaggacggatcgtcgggaagcgatcgcccagcgccgttatagtttagtttgtgtttcgcccccttctcctcttagggttgtgtataacattagtagtgatgacgaaccgagttcgccgaatcattccttagggagtggtgggtgttttgggggcgaagatgtaatttttttgtaagctaggctgtaaagcccgttactttctttcacctgtaccatgttgtatggcatgcactctttgatattttttgaagttaataaagatgtatttcatttcctttctgctattgttcgcatagtcacctttcgtgctttcgttaggtcgaaacatgtcggcccccttgcgtatattagcgaaataggtctgctaacatttcagctttcgacttccgctttcgatctgtggtattccgcgccaagagaagcgcttgcgttttttcacatgaatcgaatataacggtgttcggttatttacttcccgaaacaagctgtcgcggtttcaacgtttggcgagcgatgcttcggccgattcgtttcgcccccttagcgttttcgctgatcgggcatttgccttggggtttttccacgaactatcattcacacaagtaaaaaaagcgaaagacacaagaattttatattggttcgggcctccaggatggataatagtctgacatctagtttttttcttttttcattttcctctttttttgcatttttgtgccgaagggcttacataacgagaggtgccgaaagtcctatacaatagtatgtacatttttacaagttaacgaatgaggtgccaccccttctaaacatagaagcgcttaagagaagcagcgttccaggagtggtcgaactcttcgccttccagcgtcgccaagcgataggagcccgtcctggacctgtgcttgatgaggtatggtccttcccactttgattcaagcttcccgaccgccaccgggttcgccttctttcttaggacaaggtggccaggcaatagctctgtcggtcgaacttttttgttgtaagtcaccgaagtgcttgtggcttagttgcgcatgtgttctagcgcttcgactctcaccccttcgaggagttcaagtgacacctcgcgcccatcttcgcctccagagaacatcactcttggcgaattagcccctagctctgttggggtcattgcatcgtcaccatagagaagcatgaacgggctgaacttggttggccttgtgggggtcgtccgaagggcctagagaatagatagcatttcgttaggccatttacccttcgctgccccctcaagcattttcttgagcgcctcaaggatcttaccattcgcacgttcggccgccccatttgactgtgggtgagcgactgaagcgaacctgatttccaggtttagcccctcgcacatttctctgaatttgtcagaatcgaattgcttgccgttgttagtgatgaattcttttggcactctgaaacggcaaacaatgttcttccacacaaacttctatactgttgccgaagtgatcgcgccgagtggttcggcctcgatccaacgggagaagtattcaatggctacaattgcaaacttgtacccatttcatgccacagggaaagggccaatgatgtctagcccccatctggcgaaaggccagacaggtgcgataggttgcagttcgtactagggtgctgtttagcttcggctatgccgctgacagctttcgcacttcttgacttgctcaacacaaactttcagcacggtgggccaatacacaccctgacgaaacactttggaagcgaccgttcttgctgcctgatgtgcaccgcatagctcttggtgtatttcttttgccatatcctcacctttggcgaaggagatgcagcgaagcaagggttggagcacatcgaagcgatacagctgcccagagaccagcttgtatcttgcggctcggagctataggcgtgcttcgcttctgcttcgtcctccaggagccaatcgttcttgaggtacttcatgaacggtgttcgccagttctctgggtcttcgcccagttctgcctggtcgattgccatgatgtccaggctctctttgggcacacttggtgcgtacaagacttcgaagtggatgcctggcgaatgtgggcctccacaggcagcggatttcgccagggcgtcggcttcttcgttctggcctctaggtaggtgtaacgccccgattttcgttagggattaaaaatcattaaataatgcatttgacaaaaaataaataaaaatttaagcaatttaatcaagtgaaatagtgagggaattaaaattttctcccttaaaaatcattggccgaggatattttgtaatattctttgtgccctaaatattccccgaaattttcccgtgaattttcggagctaaagaagtaattttaacatcacaaagttcattgaatcaattaaataaaaagaaaaacaaattaaaaatcggttccccactacctcgtccacctcttcccccacttttccccaattttcggcgccgtttcgtgccccatctccacccacgttgagctccatgtcgccggccgttgccgcccaaattcaccactccccggcctccccgttgctccctcgcgctataaaaagcctccccgtgctttcctctttcgtttccccctcctcgccgagctcctcacgccctctcccatgctccccgcgcaccacctctctccgccgtcgccggcgagctccggccgcctctaaccgccactctcgccgccgccgcgctgcgccgccaccgctgtcggtcgccgtgccgaactccaccccagcctccactcctttttcccccttccaccccgaaacgctgccaccacgtgcaccacctctctccaccaccgttgccgactccagccggccgccaccgccgcttccgtcgccgtcgcgtcctgccgcttgcgctgctagcttcgcaacgccgcgctccaccccggcaacccctcctttccccaaaacatcgccgtagcactgcttcccccatcaacccgagctccaccaccgcctgtagcctccagccgcgcaccgcgccgccttcgtcactcgcttcgtagcgctgaggagcacctcggttgctgtttttcaccgccggaaccccgccaaaacatgttttcccgtcgccggtgagtatcttctttctttttcctcttcggccggccatactcacgcctcctcccttttccctaatccctccaatcgcttccccaggtgtagccgcccctcggcctcccctcctccttcgttggaagcggtcgaatcgccgtcgccgttgtcttcctccataccagctgccgcttccggtgaggatccctcctcccttcttcctttcccatccccttccttgctagctgccgcctctcggccgcttgccgtcgttccgcgcctccggtggctgtgcgctgctgtcacaccccgaagttctttcccaagcctaaattgaagttataaatggtctcaagaaaataccagtgtaaagcaagagtaaaccctaataaattaatgcgaatggtaatcggatttggcatgtggaatttttcttgagttctacatgtcgaaatacgctaacaagatttttagtggaattttcagatctctcgaaataattttaaccaattaaaaatgaccacaagcaatatttaatcccaggaaaatcctttttccttctttttcctttttctttctttttcttttctctttttcctttgaaatgggccgccggcccattcttctttttcttccccctcctcccactgggccggccgaaggcagaggcccagataagccggcgcgagccggcggcccgcctcttctcaccgggggtcgccgcaaggtggggcccagctgtcgggccagtcgcccacctcacgcccgagcagccgcgccaacaaccgatgacgcgcccacgtcggccacgccggtgcatgcgccgcgtctcccgcacccacttcccctctctcccgcccgcgccctcccccactccccacgtcggcaggagaatcccgcccataccggccacatccgagttccccctccccaatttaagctccgccgccaccccccctctctttttccccatctcgccgaactcactcatgctccccatcgctcccgcgccgtgcacccatccgtcgctgccgctcccgctactccagccaccgctagccgtcgctagactcgccgccgcaccgcaccgtcgccgccgtcgggttcgcgtggccaaggtccacaccgtccacacctcctccgtcgaggtccgtcgccggagcccgcatcccctcacactccggtgagcaccacctctaccgccgccttcggacatggtttccgctcgccgtggtccacccctctccctctaatctctctcttttcctctcttagggcatctcggagctcgtccgcccgccgccgttgtcctcccgtggctttccgtcgacgttcgccgtcgtcctcctccgcgccggccactctcggtgaggcattccccctcctctattcccctccctctccctcctagccgcgccgggtt

SEQ ID NO: 43479 - DNA, 875 bp, Oryza sativa
ccgtctgcgccgtttattttattttccgctgcttagatctttattgattgagaggaactatctacctctgtaatgacattttatacgcttattaattagagtaataattgtactctattatcaatttgttattgtgtgcctcggctgattcctggacgagggttcacacacatgtaagcgtttggaattttggatagaaattccgggcgtgacagtgaagcaggaggggaaatggccgccgaagagggagcagagccttcggcgcccgtcgtcgaagctggtgtggcaccatcggcttcggcacctatgccgcaaccaccaccttcggctcctgccgctttgacggggcaggcgccgaacacggttgatgcagcaaaggcagctgtggcggcgagggcgctccagaccagggcggagatcctttcgacaagccaactggtggcgccccaagccgcttcgccgtaaccggctacgacttcgaccgcgctcgccgctgcacaagtcaaccccaaccttgaggcacaagccgaagcagacatggaggccatgcgccagaacatgacacgacttcaagacatgcttcgtcaaatgcaagagcagcagtaggcatacgaggcagcaaggcaagccaaggtcgcttcggccccaattctctagtattcaacgggctacattccaccccaagtctacccctaagctcttctgccacaagtcatgcaagcgccagcgtacttcgccgggcagccttcggccgcaacagtacacccgacccctcgtgtacagcaacatgttcagccggtcgctacccaagcacgcccccatcacctggttaaatgtcacaagcaatagttgagagggcttcggccttgcaggcg

SEQ ID NO: 43480 - DNA, 27573 bp, Oryza sativa
  unsure (1)..(27573): unsure at all n locations
nnnnnnnnnnnnnnnnnnnnnnnnnnnnnnnnnntttttaacaaatacattctagaagctagagaattacctattttgactatgctagagaagataaaaggacaactcatgactaggcatttcaataaacaaaaagagttggctgatcagttccaaggcttaatctgccccaaaattaggaagaaggtgctgaaaaatgcagatgcagctaatacatgttatgcattaccagctgggcagggaatatttcaagtgcatgaaagggaatatcagtacatagtggatatcaatgctatgcattgtgattgcaggaggtgggacttgacagggattccatgtaatcatgccatatcctgtcttaggcatgagaggataaatgctgaaagtattctccctaattgctacactacagatgcattcagtaaagcctatggtttcaacatttggccctgcaatgacaagagcaaatgggaaaatatcaatggtcctgagattaagccacctgtgtatgagaagaaggctggcaggcccaaaaagtctaggagaaaggcaccatatgaagtaattggcaaaaatggtccaaagctgacaaaacatggagtgatgatgcactgcaagtattgtggagaagaaaatcacaactcagggggttgtaaactaaagaagcagggcatcagttctgaggaggcaaagaggatggttgccacagcaaaagaatcacttgcaatggagattcaacaaaatatcactgaacaagaaccaaatgttatcaaccaggtaaaatatcactgaacataactcctctgttgcacatgttttttttgcatgtcttatgaactacatgacctatggtatatataggatgtcatagatgaacatattgctgcttctcagacttcatctcaactactatcacagctaggaagcactgtttttagtcagatggctgatcaggtaatgttgttttcaatcatttcaatctcacattgcaaactacttgtcattgcaaactatttatcatgtatatatgttctgaattttgcagccaaatcaaagttctgtgctatctcaacaactaggcccattgccagatcctgcctttatcatgtctaacattccatcagcaaggccagctcctcttacaaccaacaccaaattagggaagtcagtggcactgaagaaaagaaagaccacaactggaaacaagaagtctgcaagtgccgcatcaaaaaagaagcctgcacctgggattggaacaaattaatgcctattagttagctgggaatatattttgtttagtgacaatctgacaaaaaatggtgttttggttgtcaacacactgtgatgtatataatggattaaaaatatgctatatcagctgcatgctgtagtgcaagtgcatggctacttgctgattgccagaattatagttgcattttgtgatacttaagtgctgaaagtatctgaaatggatgttctgcctttttactgaatgtgtgcctcattttgcctttgcaatattgtgcctcaaatattctatgaattgaacaagcattccttcaaaatttgtatagacccaacattcacaaagatgcagattaaagaaactggctattttattcatcacacaccatgcatttttagtgcatttcacacattacacatttcaaccactcctaaagaaagcatacatatttgtcaccgcaacaaccacacaggcagctactacacatctcaataaggcaacaatatccctaccaatgtctatcaacaagttcatcctcctaacaagcactttaatctgctcagcaatttgctctgcatcattttcaacatatggttgtgcaccctgttgaaccattgcatttgtctgaacacgcacagcagaacatggactctgaatatgcacagcacgagatgcaagatgcccagtattaatcaagtactcctcatattgttcctcccagtaccaaaagcgacatccaattccatctcgctgcgcaaaaaatgtacaaaattaacctcagcaaaccgatgcgaattgaaaattttccaccacaacacagattatagaagagaagaactaacctgatggcaagggcaagtgtaaaatatgcgccctttattctcaggcgtattagccgcacgcctaatgattgtctcacaatcgcaacaagggcacttaatcagagggaaacgcccctttcccttccgccgattcgtcgacgatgaactcgagcccccttccatggcgccaatcaaattgaagggcttcactctagatacgccaaatggaaccaattggatgccccgcatccgagcttgaagaagagggcgacgaactgaagatggaggcgacgaatcgagcctccctagggtttcacggcttagctcgatggggaaaaaaaagcgaaacagtgggggatttatcgtctgagggctggcgaaaaaataaggggcttaatgcataatgcaccaccctggctgtctcctcccctccacgttggcaagccatgtcagcgagcagaccgagtcaaatgggtttggacaggcaatgtccggctaagcaagtttaggaacctgtaaatgcgatttaagagtttggggatctagatgacacaccctaataagtttaaggaccgctggttcactttactctattttgaaactaaacacggcgattgaatcggagtaaaaagtaggaccgtcacgtcacgtcggatgttagcgcacggacggttggggaagtgatgtactgtaggagtatctagctagctggcattcattcttgcattcatggtacaggcatgatcaccgtcccctttctctctgtgctactgttactgtggctctgctgcgtgcagctgtcacggtttcatttttcgggtgtctctgggttggttaacccaatacacaaggcaacgaacatgtttaccggcttggtttcatgtgggaaaagaaagcaacggaattgtagccatctcagctcagctctcaggtgtacaatggccactcgaccgcttgcttgcctgccggtctctttcgtttgctccgttgaacatgacgggtacaaaaactttgggatgccaccaaaatattcgttcgtccaggactccacataggcacatcgtagccgcctggatatattgctccgaccgacactagagatggtaatgggactccgatttccctgggtgtgaatatatgttgcattgcttatataatttgacacgtatatattattttaaatagggacaaagaccccataggaatttattccccgtgcggactgggatgggagcaaaatttcccttcgtatttcacgaggacgggaacggaaaagttttgttttgcggggatgggggtgggggtgggggtggggaattcaccatccgacacaaacttagattctgtttaagagtagagaaaagaaaacgtttgaaaagataggtaaacgagataagttattagtgtataattaatatttaattaattattaattaattattttaaatttaaaaatgaattaatattgtattttgaaacagtttttatatactacctccatcccatattacttgtcggtttgagttgttgtttgtactccctccgtttcaaaatataagcatttttagctatgaatctagacaactgtgtatccagattcatagctaaaggtggctatattttaggacggaggtagtaatatttaatcattcgtcttattcaaattttttttgaaattattatttattttgtctatgacttgttttattatcaaatttattttaagtatgtcttgtttttttatatttgcactaattttttaaataaaacgaatgatcaaacgttggaagaaaaagtcaaagcgacaagtaatatgggacggagatagtagaatttatttttaaaaaaacatacctttaatttgggaaatgtgcgcgaaagtattcgtccaaatgtttgtgctgccaatcacagccttacgcctcctttgaaatttgatatgaccaaacggatttcattgagatcaaaacccattcctgtaaaattcttatgttccaagaaacccttacagcccacaggaaatgatcggtttgcaattttcaggctgacgttacaacgcgcttacttcaatataaacatacggaaagctactgaaaaggaatgaagtgccatccaagaagaaaggcagcagaatgctggccaggaaggcaacgggggataaactggtaaggatattgggggtggctgcacagaacaggattacgtaacaatacgctatgcccaagacaagtcaatactacaacatctgtggcgagtacagaggtacaaaagtcaggcaccgtaagcctttcgattaaaaaccaaactgaaacacgcacgattttttaacaccccacgaaaaacaatctgatagctagctcctttggtggtggaacctaaagagctttatcttcccaaaacatccacatcattatctgtcatgactatatagtttcgatacgtaaaaaggcagcgttcactcagggatatccgccatgtcttcctttcatttaagcccggccaagatgcttcaagcctgtttttaggatataaaaggcaggtggttagttgcctacaaacattttaggtaagatatgataacgcgcggttaaagcgctactgtggatgttctatagcagcaaatatgccattgtcgtaccttgttggcaatgttgttggaaagccagtcaagcccctcatacaacccctcaccagaggtagcacatgtgctctggatgtacctatgagaacataagacgaataattcagattgcatagaaagtttaactttaaaacactaatattgggtattgtcaacacagttggataatgcacactgaatgctattacttggttcacaatttgctaatgcatgaatggttttacttggtttaggacaaggatttagtacttaagtagaatacaggagcaccattatgcgagcagcacatagtatgctgaaagcatataaatacacactattgctgatcaatctaaaaagccctgtgtgagcaggccataaacttttaagaggaaaggaaaccataccagtgccgctggcgcaaggagtgcagaccaagcttgtcggtgatctcagcagcgttcatggcattaggaagatcttgtttgtttgcaaacaccagcagcacagcatcacgtagctcatcctgtagccacaacatgccaacattaaaactatagcttctagaacatcacatgataagcatgatagcatgtataagttgtttcatccatgttgggctctttagaaatttcaaatagctttggaaccacatcttatgcgtatattaccaatggcagatcttcctgatggctagaggaaaaaagggaaagagggaatcatgggcaaagaatcttacaaatcacacgtatttatgaattatgattctcaacaacagaatatagcaaaccacatgcaatttatgaattgtttcccaacaagagtctaaaggtagactaatactttgaactctgatattgatagtacctcattcagcatacggtggagctcatccctggcctcaacaacacgctctctgtcattgctgtccacaacaaaaatgaggccctgggtgttctggaaatagtgcctccacaggggcctgatctgtattaataaaacacacagaaaatatcagatcacaagaacatgccaagacaaaatagatgagagaatgaagctataaacaattgaaatgataaattgatatgtttgacaaaggaagttaaccaaatctaaattcttttttttttcataaaattcaataaaacagatccatcagagcttagtgtaaggtaatatatactgcagtttgcatgcgtggtttctgattatgcaagcatgttaataacaggtaattgacaatgttaaactatataatatgcaccaaaaaaataattcagaaataatagctgatcgaaggcaatttcttaccttgtcctgaccaccaacatcccaaacggtgaagctaatgttcttgtactcaacagtttcgacattaaaacctgcagttatagacagcaagtttggatcaatgtaaatgctagcagattgtttttccagtgttttaacttcctaaaaccatataattctaccatcctacaacattggctgaactctgaaagagagtattcaggttttaaatccagtaagatgaaacacattgaaggagacatctcagtaatttatttaagtccacctagcatataggagtaaacattatacgtgaagtggagtgtaaacacacttgagccaaataatcaatttgagatcagctaaaactaatcccattgctaaacagttcttatcattaagccagcccaaaaaattattgtctgactaaaaaggacctaattctgacctttgatctattgctgagcaacgcaagctggaatgttaattatgcgcacacagcctaacttaatgcgatgggacaaatggagaccgtgcatctaccataccactataagctgaattactgaacacatcgtaacaatacgtgcacagcataggatgtggattggaaacgcaccgatggtggggatagtggtgacgatctcgccgagcttgagcttgtagaggatggtggttttaccggccgcatcgagaccgaccatgaggatcctcatctccttcttggcgaagaggcggctgaacagcttcgtgaacgtgagccccatctccgctcccgctctgaaaacgaaatgaagacaaaaaaagtcagtcccgtagatccacagggtctcgatagaaaaacgagcggaatcaaagcaaccgcagctagatccgcgagatctgaagcccgcagcccgcagatctgcgagcaagggcacgcagaaagcgcggcatcggatcggattcgcggccaaccgaagcgattccccgcgcccacccagattcctcccaacaccaagcgtgggaacgaagctagatcgagcggagccggtcaaaccgggtcaaacttccccccgaatcaattcaaatccccccccccccccaaacctatcgaatctagcgagaaaacctaaccaatcaaatctccttcagatcaccccaacccatacaaacccacccccaaaaatcgcacaaaacaagcacacacacacacacacccaaatctaccgatcaaatcaaaatcaaaccaaaccagctgctgccgaaccgatcggatcggaagcagacgcagaattccactcaaaaccagcgagatcgaacacgaccagcgggggaatttcgcgggggcggtggttaccgagatcggcgacggcgacggcgacggcgacggcgatctcctcctctccttctctcccctgctctccccgcggcggcgtccggctccctcctcctcgcgggcgcggatggatcgcaggtggagaggagaaatgggcggagagggagaggagatagatggggagagagaggtcgttgaaatcgcgcaagggaggaggttatataggaggggaagggggaggggctgggtcaccggcaggtggggcccacgtgggtttgtggtgagggcgtgaaggggcaggttgaagggccctgctggtaggtgggccccggaaatgtgcggtacgcgtcggtggtcactaggaattttgcgattatatataccctcccggagtgcagggttcgacctgtgggtttactgatttgtatggggtcaccgaaattctaaaatttcagaaattttagaaatattgtggaaattttggacgaatttttttgaaaaaatttgaatacaaatttgaaaattgcgggcgaaatttctgaaaaatgaaaaaaaaacagatagcaacaaaatccgttcggcaagcatacaagttgcaactactgcatcacaaattcacaaaatacagccaaacaaaacccactcacagatgataaaatgtaggttcaaagtctgaacagcagcacatcaacacatcaggcgaacaatatagtgagaacaaacaaatgtgaaaagagggataataacgaaccttggtcatgcctgagtccgtgcctaccttagtttgccattcttctttgcactctaagcctgaccttaaaaatggacctttgagctccacctcttctcttgttccttgcctttctgggattacctcgagggcaacctcaataagggattcaaatgggatgagactgtcaattttgttgctctatgcgagctccagagccgcccatattgctgccacctcccgcttctatcaccgtagcagctcagcctcctcctcctttcgtgctacaacgataaggtagagatgacgcataactaggatgatgacaactaggtaacgtggcataaagatgatgatggtgaagcttcgaggacagctgatgaggttaccggtagtgcaccgagacatggcgaaggggacataaaagagtggctcttcatgtagctcggtgagactgagatagaggcatgaaagaaaactgcagtatataactctattttataatgcatgctaagctatggtatttttgttcccaacaataatttacataaggtaagattcgggatcatgcactattttaccacataaaatttatatatagtattaaatggatttcaattatcaacttatactacgggtagttatgaaaacaattcaaataacataattgcccttcatttacgatgcattgaaacatacaaaccatttatccatgagaacagtagtagcatttatttagtttctttatatatctatttagtttttttttgacgcgtagcattcgttcattaagggaaatagaaaaacaaacagttgcaagaagttctaacaggaactacatttataataagtgagagactattcaaataagagatttaatatttcaaaaatgtactccatccattcctaaatataaggcacaactactctcaacccaaagaccaagaaataattattatcaccttatagattgggttatcctaataaatagaatgcatgcacccaataaaattagattgggctatcctaataaatagaatgcacgcgcccaataaaattagagatcttgatggtgtaggatttaaataatacttccttcgtttcacaatgtaagtcattctagcatttttcacgttcatattgatattaatgaatctagatacatcaatatgaatgtgggaaatgctagaatgacttacattgtaaaacggaggaagtaatattccagtgaaaagagtgctagttaataacatgcatgcatgtctgccttatattatgaaataactttaaataaaagaacgttgtgccttgtattattgaatggagtattgaagttctacggtgacatggaattaaggaagagactattcaattattgtttttcatatcccaaacagtttttttctctatcatgattttgaacagtgccaagattttttttaatttcaaacaaaaacaagctggagtactagtaaaataaataaaatggcccaatgaccaagtgacatgccccatttccacccctcctatttcctctctttcacgcatctcgactccatctcactctcccccctccctcctctctcgctcgctgcgatctgcactgctactccggtaggtctcctcccccccccccttcctcgcgcggccgcggccaccgccggcgagaagcccgccgcggcggcgctgaccccctccgcctcttcccgcgcgcggccccgccagccggccaccgtctcgggtcaaatcgaatcgaatcgaatccaaaggtattctcttcgctcttctcctccgcgggccgcttggattgatggctcggggtcgcgtaggtaggggaatctgttcgcgggttggattgggttgggttggattttcttctccttcccaattagccccccgtccagtttgtcctagatttctgtgatgcgtctggtactgatggatgttagtttttgcagaggaaaatctggggttcagttgaaccgtaatgcccccaggttaggtcagcctcgctgggtatcgcggctgctgaggttacttggagaggggtagggtggaatcctcgggggctgatttggtgtaattgagagcgccgattcatgattcaggcaatggcttcgcatgctggaggtagtggcggcggcggcggtggaagtggccgggatgctggctcggcgcagcgcgggccgatgcaggggttggcgaggcaagggtcgctgtatgggcttacactcaatgaggttcagagccagttgggggagccgttgcttagtatgaaccttgatgagctgcttaaaagcgtgtttcctgatggcgcggaccttgacggtggcggtggcggtggcggcatcgcgggccagtctcagccggccctggggctgcagcgccaggggagcatcacgatgcctccggagctgagcaagaagacggtggatgaggtgtggaagggcatccaggatgtgccgaagaggggtgctgaggagggtggccggtggaggcgggagaggcagccgaccctgggggagatgacgcttgaggatttcctggtcaaagctggggttgtcacggatccgaacgatttgccaggaaacatggatgtggtagggggcgctgctgcggctgcagctggtacgtctgatttgaatgccggagcacagtggctacagcagtatcaccagcaggctttggagccccagcatccaagcataggtgctccttacatggcaactcacctggcacctcagccattagctgttgctacaggtgctgttttggatccaatttactccgatggccagatcacttcgccaatgctcggggctctttctgatcctcagacacctgggcgcaaacgctgtgccacaggggagattgcagataagctagtagaaagaaggcagaagaggatgataaaaaacagggaatcagctgccaggtcaagagcgaggaagcaggtatgattaatccttcctacttagaattttctatatattgtatgctcttactttgcttattataatttactgctttcaaacataaaggcctcatggattctttttttttaatctctggatgtattaagttggcatttctcttactcatacagtatttagtctaatatatcaatatatatgttatatctttccaaagctgtaagaacataccagttgcagtagcattggaatgccattttccccttcttttatggatcatgtatatttatttcaccgctgtgtgcattctaactggcaggcttacactaatgagcttgaaaacaaagttcttcgtctagaagaggagaatgagaggctaaagaagcagaaggtactttctctgctgttaccattgtactgtttctattttgtcattcctttagacaaatgatattccactaaggactactccctgtgttattatgttgatatggctttgaaatactgttgttgcacagtcgacaattcctgttttattttagctagttatttttttctctcgctatccacttgccacagttgttacaccaacaggtccaaagtggtaacagataactagataagtgctatatacttttgtaattgtgttagtaatttctatttgatctgtttacttaaggattatgctatgttctccttataaatggcaaatgtaccagatgtagttactactatatttgaactatgaaacaatcaaatgaggctttgattttgacttgctatatatgcaagtgcctttgactttctaaggagacctatatgaagttcttgaggattttaatcaacttatcatgctacattatactcctatatatcagcattaaatatgtgaaacactagtattgtcatcaccaattttgcgcatcattgcaatcttttaaagtgtaaattttaaatgttgcaatgttgcatacattaaatcactgaacacttaggtgggcctcctttttttggttgccttttatttatcaatcatggtaatgatttatcaaccaaacatgccttttctaagatttttgcatatgaaactactctgtatatctgtagagctttacgggttatacatgtgctgcaattccatagtaattcaccaagatgcttgattcccatgcccttaactttgggccttttccccttgaacagagacttgatgctgaacaaagtcacaaacatctctctgtactattagcataatagaattgatggcccgttgatatttgacaaacggttttatgacattccattatagtatttcttacagtttagaaacgaagtgaatcatgctgcccttgttcttgagattgggtaagcaagaccggcaatgccatttagcttatagcatcttgttactgttcattcatgttgatgtcccttatgagatgattttgtcccccgctgtttccaggagttggatgagatactgaactccgcgcctcccccggaacccaagtatcaactcaggcgaacaagctcggccgccttctgatggtgacgatgtccatagtaaattttgtagattatatggggtctgcccacatatttcgcatcctttggcggtaggaacaatcgatatagcttgagattccatcttccccctccagccggtggtggtttagagcttgtaaacaccagcaccagcagagccctagccatgtcgccccagctgctgatctcttcggaggctttgtcacttgtcagtatgtaaattctccaaggcacgtgtcgctgttaagttctcagagctccttggttatacatgattgggccctttgcctgtttcttgtggttggttgatacttagtacttggttgtgatcagtgtactgtggagacttttgttatggcctgatcaacatcagttcccctgtttcggctaagataacgatgggtgataagttgacggctcacccatgcaacacatatcgtatgcctgtctgggggagcagagttttagattgtgagaagtagctgatgggaatctagagctttttgggtttaatttattttctgaattttgtaactacagtttcttagaatggaagttggattgatcgagaaagctggagactttatgaatagctgtagttgttagaagctcctccaaacaaactctcgcgtggtagtctgtttctcgtaatctggatggaaagttagaatgtttgagagtgttggagattccagaaatagctgcagcagacagaagctcctccgatcattggagctccaaatctcgtggtttgtgtcgaatttcgaatgaatttcacgagataattccgtgtttctggggctcgcatctcatcatttccccgtgctttcctgcacgtgcaatcattcggacagtttggcccggaatcatgcatccatccatgcgtcatgactcatgagtcctatagactactcgtgctagtacaaggaggaaggagagccgaaagcagcagcaggctaggctgggttaggctgctctgcttcgcgtcgcatgtgccgtgcatggctcagggcacgctctgaatctgatctgacgaacggaatgcaattagccatggcatggcaagcgcatgcaggctggctgtcaaatggactaatccaactcgcagcctctcaccacatgcccatcatcacgcccatccactcctaatcacctccacttcattactcacatggaagccgtgtgagcttaattaagctcatataagctgaacacttcactgcaacagcctacattcatactgtccagcaaagtgagccgcaagcaggtcaccaaagccatgagatctgccaccatttgtgtcctctgcatttgcattctcatgatcctgcaatgctttgccagcatcagtgcagtggatcttggcgatgctgcagcttcagcgtcagggggagaaggcctgatccggccgaggaagctgctgcagaatgcgccggcggcgaggtcaccgccgtcgcgctccgccgccgccgtggaggtcgaggtcaatgcgagcctggggaagcagaagccgtcgagcaagtcgaatcccaggcagaattagaagctaagctactatcagtagacgacacacgctcacatggagctcttccgagatgtggctgtagaaatgtacataggaattttgatgtggaattttagtttcttcctcgttttccctttgcaagtagagtgttcaccatcaacatcatcaacagttcatcaccagtgatagtgtagttgcttacaaaatcagaggatctgaataggcgagttcccttcttttatgttgctgtcttgattgcttctgcctcctttggacacccttgaattttgatgatagcttctagttcctgatgattagtttggttttgctcattgttcctgtaatttggcttccgtgtagatcctgccattttttccatcttgccacttgtttccatctagatccagtaactttgtaacattgtctgaataacaaatcatgagtgcaatatatggggttggaggaaatatttcaaggtcctctgcactcaacaactgcctgtgttccttgagcacagggttcttgaaaacagctgttcaaatatctgatggaagaagcaggtgagaggaacccattattgcaatcaacacaacaattcctggttcacatttcacaatcgactgtttgatgaaatcctgaattcgaccaatccaaatggagcaaaaggtaaatactaacatcaactgaattagaatgggaacgaagggtaagttgatccctatgtgaagatacatctacactactttctaaaatgttaatcaacgacacatgttgctccttgtccatcatgctgcatggctcgcaaacaaattttcaccatggcctccgcccaccgatacgcctggcaagttgcatgtccttttgcactgcagaacaaacgtttatttgttaaaccacacaatgacaacgctgataagctttacagggaatagcaagcagcatatttcacacctcaaaactcacaaaccaactaattctccctatgtttaatcaataatcatgataaatttaagagtatgaaaactagatatgacattaaatataaacacatgtattaagaatcatcctgcaattagaatgttattcctataaaaaaatagaatgcttttgaagtggatgcgtatatgatatcatgtaggctgtggcatatatgatatccatttagcataataatataaagggagaaaaagaaagagaaaagttcattcagaatgacaacttactgatggtaacacgcttagcatggatggcgcagagatttgacacttcaaatatgtccactaagtggtattctgctgcctgcaggagagggaaaaccactggaaatttgcaggacagcaagtaaataacataatttattttgtgagaattaagtcagctctttgttccttttcctggttatgcagaaacagacatggctggaaagaaggaactgaaattggtatactctatgatagcaatcttgaacagacacaacaaaatagggaggttgcatatttgtagtatataggtgttctactgaaaaaggataataatttagcaatctgactcataaatcaacacacagagatattcattttattgatcatggaagatttgtacatttttcagttacactcttgagccgtgacttgagtcttgaagcagaatggaatttaaacagtataattcagtctgacccttccctaactaagccatcagttgtaaacttataataaacaggtttgaccactgacctcttgcaatgcaaggagagcttcaagggtccaccgtgacacatcctttgaatagaaatcagtgatctccctgacctgcaaattttatcggcacaaaaagcttccatcacacaagtttgcactacgaaatatttgatatagagagaaggcaggttcaggatgtacccaccagccgagaaaatggtgcaaacgggatcagcagttcggtggttttctgaaatttcctgatctcccgcagtgccactgtgcctggacggaagcggtgtggcttcctctgcttcgtttgctgcctaggcgtccctgcttcacacacatgttaaagttatttaatcacaggagaacaaaaggagagcaattccaaagccaagacttccatatggatacctatcatctaggtagaacagacgctatttgaaccatgacactaaagaaagtttactaaatcagttcccacgatgcaaagactaataatggatgagcataaaaatcacctatcaacatcgtgtctaaaaaccacacatttcttggctagcaatgcttaataccatgttttatggtcataatgtttcagataacccctccatggaccaaactggatttgctattatttcagaatgaaaacaagaaaagctttgactgatgagcaattgaagatctttctgcaactactgttcttataatatattcagaaaacaacgatgaggaaagtacagcacacggtaaaacagagcaagaaaagggacacattgagcccctcaggtcccccggaatccaagagacagaaaggaaaagctccaacgagcccatgaataaccctagaaacccccccaagagaacgcacctgaagccgatgttccagccgcgctcctctgcattccatcaaacaggtggtgagcaagccatccatccagccaagatacaaaacaaaaacatatccccccacaaaatcaaaaaatcaccaaacgaaagacccgctcccgcacgcaccgtggtcgccgaggtacccgtgccgcctgcaaaggggacaagcaagaggcgggaaggggggggggggggcataagcttcaccatccaccgccattgaaagaaaaaggaaaaaaaaaaagaaacgcagagggggagagagcgcgcgctcaccaccagcgcgctgcgccttcgacggccgaggggagcgttcgaactggagcttcttcttgggctccgccttcgacttcctcaccgccgggtgcttcgtgcgagccatctcggcgtcggcggcggcggcggcggcggcggcgacgtggcggtgggttttcaaactgaagcggcgtggaggcaaacgggagagggtttcttttggttttgggttggggatccctttttgcggttaggcccttggttttgttgttatttatgggtcagtctgtgtcagttgcgtttttcacatcccacaaggccacaacgccacgcgcgcgtatgtgtccaacggtcgagtgatcgagttatgtttcttgttttttttccttttttgcgaaatggagttacgtttcttgaattctatcccagaatagtcatttcttgacattatttgacactgacaggactgaaactaacactatgcaaaatttaccaaaaagaaaaggatgtcaatgcaacggtcgaatgaaagattgaagaggaatgtttttttttccttcaaaacaggcactttcccctttgttttgcaggaataattaaacatgaatgcatggcaagctcggtgtagggatggacatggcctgacccacatttaatacctggaccactcaagttcaattaaatgaacaaaaattcacacgacatggtggatcaaggattatccactggttagttcatgccatcgaaataatactcgaccgacggaggaaagaccgcccacatgactttttattaagaagcaacctcaaccagatcggccaacgcgaaccttgacctccacatacggaactcacccctatggatcactaaaggtgagtttgacgataaggtgattgaggagattaggaagatacgcaaaaacgaggtgagccattggctcatgattaattgagcattaactattttaaagttcaaaaatgaattaatatgattttttaaagttcaccgtttagtagtttgggaagcatgcatgtgaaaaacgagatgtttttctctctcaatctcccagatctcccaggaacgaacaaagcctaactccttaaccgtgcttcgagatccctacccctacacaattatccaaaatccatgcaacatatttggcagtagctatccattttttctctttttttggaaatcaggtaaatatgttacccggcttgctattcaatttcacccagaatatagtgaaaatgtgaaatccgcaccgctcataattttttcggacgaggtgacaacagaacagctacagttttgctaccatttcagcagccgacacagatgaaaatttcagataaggcagccagccattcgctgcagaagtattagcagtacagatactagtatttttcctgaagaaatcgatcaatctgagaagcttctgctgctgctgctgctgctactgtgggcggagggaggagaggaggacgtcctggagggcgctgtccttgttcatggcggccttgaactcgtcgaaggtgaccttgccgtcgctgtcggcgtccatctggtcgaacacctcgtccagcttccccggctccgttatgtcgcctggcaggcactcctccggcaacgccttgtgaggatcaccaaagttcagatgaacagcagctcgtcagattttcaactcaaaacttgaaaagagacatgaacaagccatctcaagaagagcaaagatttggttttccttttttaggagttcttactcggagcattgatgccagctcttccttgctgatgcagcctgaccgatcagcgtcgtacatctgaaaagaaaaatgcagtttttttttgtgtgctcatgatcagatgctgaaatacctctcttgttatgaattttaattgaatttgaagttatgtatgatatgatatcatgcaatgtttctgatattcctgtacataaattggaagggctgccacttcagtttgagtcgagtgcatttggaaatttttacctggaagcacaagcgaagagcatcatcgcctcgtgagttcctgaggctggagaacccacacaggatctctctcatgtcgacggttccatcacggttgttgtcgaacagatcgaatacgcggggagctaggggaatcagtgagtccattttcattgctctcagcacctgctcaaactctgacagagtggcgttttctccatctgcacatctgcataaagagcacttgcttagtgttatacttttcgattggaacatcatatgtgtcatgtttaaatcctaaaactatgaaggttttacgagaaatctgaacttctgaagcttctctggcaaaggaaaaaaaggctaccgctttctgcttataaatcttttcggtgttaatttcacagttcatcatagcacatatcttctactcctaaaatcctaataaaatgggctgcacatgatatatgatatgtgcaaatatactcctgcaaaattgggacttcttcagtgttggaaaaaaaaacatttgttttcagagaagacaaggatatatgactcccccttaaagcaactgtagtgttcctcaaattactaactgagaaatgctagtcccaaaattctagtaattacacaagaggttttaggctgatcaagtcatgatactcacattcgtccaaaatgaagccgcagattatccagctcctctgaggtaaggtcatgggttcctaaaagatttctcagccttttagtcctcaatgccactttgcagctcaaaacgctggctatcgcagctgcccgcaatttccttctagcattgaacttttgcagttttgagacgacctctgcatccatgagatcttgcttggcgcagtctccaatcacccaaggatgcctcagaagctggtttcaaatgacacatgatattcaaattaagaacagttatagtatcttagctaacatggtaatatgctgaaaagggagcatatgagacagacatcacttgctgttggccttttgtaaggttgaacagaaagaaggcgcgaaatcaaatctttcgcggatgaagatattgttttccatgtgtggtcctgaaaactgaattcaccctgaagaagcacacaaattatatgccattagagcaagttcctgattaatacaggcattttcgaataattggtgcctaacacaaggactacaaatcctcctcttatagtcatgttattcaaaggcactattgataatggaacccataattcttcagaaacaaacggcacagtttatttattttttcagtggtttactgaacaacatttgactagcccagtagccccatatccatactgactcagttcgtgtttttcattggaaaatgtacaatccaatccatgtgtcttttgtggaagagaacattcttttacaccttttcagtaaaatgtaaggtctagttagctactggccaactgctattgatttgacatctcagggcaactttttctactagaactggacaaaatataggacaatgcaggtataaactgaagtgctaacaactaccaaaagacgacatttcagcaatgattggcaggcagatctccaaactatgcaatgtcatttgctgcaaacccactgataaaaggctaacaacttcacactcatgctgaaattttagagtgaatcaaatgcccaacacataatttgggactggaaaaccgtatggccgactcacactcgaggtcagctacatgtaactctcaccaaaattccattttttgcaagaaaaacaccctcacattcacgggccagaattataataattctgcttcattagaaaatgcaaagatacttataaatcatcttgatcagaatacttataatgattctgcttccactaaaattgcccgaagtgtttaataggtatcgtcaaatgcgaaccagaatattccaaaccattttgaacaccattgaagcaacaatttgaccagagttagctcaggaaacttacttgcaggatcctttgctgcttttctcgattggttgcagcatgaaatggtgggcatctgaaatacacaaactaccaggcttaaaactacgaaaataatcctaatcaagggaactataacaagaaaatggccaacatacccagataaaagaatgtacagaattaccccaacagaccacatatcactagcagctgaaacctcctgcctggatagagcctccggtgaaacatatctattgacccaaacagcgcgacgattgggtcactgaaatcttcgacagaactcaaaccaaaatccatgatcttcagtgtggacttctcatctttgtcagagaacagacaattctccggcttcaggtccctgtgtacaatgcttgccttatgaagagcctccagcccgctagcaatctgacgaatgacgcaggccgcatcgaactccgagtaccggtcacgccccacaatccgatcaaaaagctcaccacccgagcacagctcaaggacgaggtgcacaccatgcacatcttcatacacatcatgcaggttgatgacattaggatgtggcgcaacgctctccactatcctcctcatgacgagtatctcgttcgtcagcagcgcgtcggagatcgatacctgtttccacatcggcggccggagccgggcacgggctttgtcccctgcttcatacccgccatcgccgggccgagcctcctcagagtcttgatggcaacctgggtcttctcttcagacttgctcactcccctccttactattgagaacccgccccggccaagaacatccacaacttcatagtcatcggacaactttctgctctcagtcttggacattatggacttcgactgcctgctctgaagaacttgataaattgaggaaccgaataacaagactcaattggcagtaatccagtagcaaagctgtgtcctgaaagaagtaatcagtagcgcaggaagaacaaatgaatcatatgggtatctgcaggaagtaggagaaagagaatttggggaacagcagagcacaaactggaaggagcagttaggagtacaaagcaagctccttctcctgaagacctgatcagtaaacaaaacaatatgagagagcattatatagagtaatgtgagtactgaaggttgtgacgatggaagaaagggacatgtgcaacaaccaacacaagggaataaaccctatcaaggatttctttttgtgcagagaacaaggtgacaagaagagagaaatgagatgattggaagaagatgacaggccaaaatagtttttgttgacctggttgccactgcttggagctgctctgaattggtcttcactcggtgaggcctaactgtagtttactgctttgtcttagacagttgtaagcacaattccactgtagctgacaacatcataaacatggaaggtaagctctcctcatgcaaattaacacaagatgtaaattggccaggtatggtctggtcaaacggctggagaggaacaaatgaatcattttgatagacatttgtgccatacaaattgacaaatcttcactctggcatgagtttcctctttccaacttaaccattcatcatagaaatcgataaggaaaccaaaattgcagaggcaaatgtaaaaacaaaaagattatatggctcatgaaattacaatatgtaagcaaaacttccatagaaccatatgttaccactgtgacaataacgggttcacagctccagatatatcatgaatgccctaaacagatgcttccacaaggacaacgcccagacaaaaatgcatcacataaacaaaaaaataataattttctagatgaactatgccgaatctccaaagctcaatggctcttgtgacgcttagggtttatctttccataggctgcttgcctttcggtggtcatcttcaactccctcctcctacgcttccttcgttcacttctggttgattttgccttgccatctgcatccccctgttcattcggcagctccttctctggttctgatgaagcagggccttcctcagacttagacttcttctttttgaccttcttgccttctttatcctgtcctccaaggatcgaatccttgatcagtttcttatgatgcgtcaccttccattctgcctccctgtaaggagctatcttcttcatggatacatactggttcaaatccttgtcatctgatgccaatatctcataggtgctcaggccgaaactgttcggcttaacttgcttatacttgaacctagtcttcagatctccaatagtgtcctcatagtctaacttgtagtactcttccatctccttctcaagctccaccttgtccttcaaagaaatttttcctttcattttctgatttgtcccctcaccatttgcaatatcttttccacctttctttttctgagaagccccctcagctgctgcagacgatccatcttgcccatcaagagcccagtccttgggtagcccaagcagttcatcttctttgtcaaagtctggtttttccaaatcaatttcctcaccactcccaaattcaggatcaacatcatctgcttcatagtaattgtcattgaatgtctccttcattttcctgtcatactcctcaggatcaaaatcctcctccaagtcatcggctccgagcttgcaagctgcatcgctatcaattcccgcaatcatcccgatcctctcaagcttctcggcgatctctttcttcttcaagttcttcaaatgcttcaactctctgcctgctcctgcttggcccgtgctatccgctcctccttgttcttgcgctgctgcttcctgctgctctccttcttcctcacagacccctcgacaaaccgcgaatgccccatcaccctgtccattacatccgcaccagtcgcggctgcttcctcatgccggaagttatacctggtctcataatcctcctgctctatgagatgctcctcttcgtccgatacctcctggatatcatccggagagtatttcttctcgctgcccgtctcgagatacggcctctcgagaagaatttcttcaggaacttgctgttctcgtccagctcctcgtctttgccgaaaatatcaatcagtatctgctcagtctccttcttctcctcgtcatcatcctccttgttaccaccatctccacccttcggcttcacttggaacaaatcgtcatcatcctcgccgccatcgccatcgccattgcctaatgccgccttctccgccgcaagaaaagcctccagccccttcctctgctgctcgtcgtaggcgatcttgtcgtacttgctgctgctgtggccgccatggctagcctgcgccgcgaactcggggccctcctcgagcaggtggcgagcgttcacgtccttgaggtacaggggccgctccttcttcgtcttcttgggcttctccccctcctcgtcgccgggttcactctccgacgaggaggaatacatcttggccttcgcgtcaagaatggcggcgtcgccgcgccgaatgcggcggatgacctcgaacatctggcggtcgacgcggcgggacgcgatggcggcgtcatcgtcgtccgacaagaactcgtcgtggtcgtggtcctcctcctcctcctcctccggcgggacgaggcctttcttcttgcgctcctccaggcgctgcagcgcctcccgccgcttgttgtgctcgaagcggcgggcgtactcctcgttgatctggatcttggagagatcctcctcgccgccgcctccatcggactcattgtcggagcccgcgaggatgtcttcttcttcttctcctcctccctcctctgcttcatggctgccgctgcagtggcgacggcgacgacggcggcggcgaagctgggggtaattagggttttcgcgaatcgagaggagcaaaccaatattaaaggaggcaaatgacatatgggtcccacctttactgaaggcccatctgtgaattttacggcccaagaggacggaggcccaggggcaaacgcgtaatttcggcagcgaggcggcacctatatacaccgcgtcgagctaaaccctaaccagccgcccattcgcgccgccgccgcagaagccaccgcgccccgcagctctcgtcgtcgtcgccgcggccgctcgatcacgatggctcccaccaagaaggcggtaaggttcctgatcgattgcgcctccctccccctcctcgtcgcgctctcccgctgcgcatctcaccatttcgttgcgatgtttttgctggtttctgattggtgggttgtggcgatgatgcagaagaagagcacggacaacatcaacaacaagctgcagctggtgatgaagagcggcaagtacacgctcggctacaagaccgtcctcaagacgctgcgcaactccaagggtatcgatcccgaccgattttttgttgttttgttcgatctggtagtgttagtggatgttgattgattagtttgctcgcttaatccgaattgtagggtaggtgggagtgttatgattgattgatgcgttgctagctaatcatagtctgcctatagatctgcgtgttagttcgtgcgataattttcgggtagattggactgtcttatgtttatttatgggtggaattgttgtaaatcctttggaagttgatcggctgtaaatttaagtttagatggattgtggttgcaattatttgggatgcgttgtgaattgagttgcattgcggttgtcttgaatgaatgggactgaagtttacctctttggcttgcttttgcggtgtcttagagatgaatacagtaccctataacaataccaacctcttagttaatagttctccatgatctccattagtctggggacaactggaggttgaaacatttgttgtttatggagcatagatcatgttatatagtgtgatgtctgaaatggttttatcgattttatatgttctcagttacctgcttacacatgacatattctttttttctgttgtacatatgtgcaaaatacggtgcatttaactcaggctgtatttgtattttgatgtgtggtccttgttattgtgtttgttgcttgttgatattagttaagaaagttaaatgcaaacttcccttgaacttaaatttctcgagttgaatgaatttgcagttataacatgtaggaaatttcagataggttgtgttgtggtttctgattgtgacatcaatcacatcttttttatgtttagggaagctgattatccttgcaaacaactgccctccactcaggaagtctgagattgagtattacgccatgttgggaaaagttagcgttcaccatttccatggaagtaagtttgtttcatccttccgaaccatttatgttttgtgtgatagcatctgtattcatctacatgtcacggtttttccgtgatatagtttggtactgtatgtcttactgtgccttcgctttcagacaatgttgatcttggaactgcctgcggcaagtactaccgggtgtgctgcctcagcatcatcgaccctggttcgtcgctaccgacatcacttacatatattttcctctatggcaccctcagaagtactgaatatatttgcctctttccctgtttcaggtgactcggacatcatcaacacaacccctgcctcccagtgaagaagtttttacctatttagttgagatgtagggttcagacgtgcttacatggccaatggctgtttcttggttatctttagttgtgtaattttgctatgctgagttgggatctgccatacagataatactccatattgttgttaaggcatttctatggttttgtttgatgagatctctatttatatattgagcaagtttattctcctgctgttctgtgagcatcagcaaagagagcatcatccaagatgtttgcttccttgcttatgtggttcaaaagctagactatggttgttaactatctcgaagcttcgaatcacttgctttgttttttatccatggtgtgattcgctgattgccgttttggtttctgctcctggagaatctggaaacgtagtgtggcttccacgtttgcttgtcgatttgattatcgccgtttagcagctgctgttttgtgtatgcttttctatattccgtgacgtaataatgcctatctcccagattgtaaggttcatccgtttgtgatacgagcgtacttaatgctaggagtacgtgtgtatttattaggttaatttaagtgagtttctatatattgttgtagtgttagaagtgcatctaacaaaactaattttgtgaaacattttttgtttgaacaaggcacgtgtttactgataagttgatgtgagcaggtcaacaccatctaattgggcacacagattagctatcacgggattagtaattttgtactactagtgtgccgtagttggtagtatcatgggctcatagtggtcttccctattaactaagggtctattcactttgctaccattttcaaccttaccaaattatagtattgtcaaattttagcaaggttgccaaaattttggcaaggttgtcaaattttgacaagattttatatgtgcttagtaaaatttaggaacaaactaaatgtagcaactttttttttaactttgccaaaacttgataagattgaaaatggtagcaaactgaacaagccataatcgtggaccaaagaaaggaaacaaatgttgaccatcacg

SEQ ID NO: 43481 - DNA, 14448 bp, Oryza sativa
ccgccacgtgtccccgagtgcgcgagaaatttgtcctaaatcccaccattaccgcggccgctttcacatctcctcctcctcgtaatcatcttctcttctctcttccccggcggcgacgcggcggcgccggtcaaaccactcctcgccggcgaggggagcgcggatcgggctcgggaggaggctaggggtttggctcgctcgctcgctttcggcgtgcagctgaggcggtggacttggcggctgtggcggaggtggggaggtggaggtggaggggagatggaggggttcctgcagaagctgaaggggctggacgcgtaccccaaggtgaacgaggacttctacaagcggacgctctccggcggcgtcgtcacggtcgtcgcctccgtcgtcatgctgctgctgttcgtctccgagacccgtaagtgtgtgtgcgcgaagcagccgccgccgcgcggatgttgtgtgctgttcgcgtactctcccatccgtggccgtaatggctcgatgtggtttggaattcgaggagttggttcttgccaacaagatcaaagtcggatttcgagttgtcgatggggatggggatttagagtaagatttgaattcaatgatgcggtgggcgtgttcctgctgctgctgcatgcttgaatgtttggaatatttccaggggcacctgaccgcgctcttggtaatttctagaagaaggtgcccttttaggtagacaggttttgcggtgtgtcagggtaacgaactaaagatgggcatgttgcgatgggcattgacgctaatggtgatgtatgctgcgcgcgatttttcttttctttttctttttccttttcgggtgtgagattcctgaaaagttcaggaatgcttttggctgagttcctgcgtctctgaggaagataaattagtttatttttttctgctattacttggatttatgtgctgctatcactgttggttcgtgaagggtaagtttttgtgttgttggctctgcatgttggatcatgcgtgcaaaattaggtcgtcacaaggattatgccgttttcaagttaccttttgagtaaagtctgttgttgcaaaggttctgttttatttggccagcatggccttacattactttggagtttggagaacaagaggttacaagttgtcgaatttttatgctctttttgtttggtgcaatttgttagtgtttatttttttaaaaaaattctggtagtgagaaggttctttcataaaatgtttttgcagggtcatatttttattcagcaacagagactaagctagtggttgacacatcaagaggggaaaggctacgagttaatgttagtatttatttgattgttaaactagattcatgtcatatgttgtacttctattgtttctagtataaaatgcatactcttttgtatgctattcacttacaatctgttgggaactaggtgtgaatatttcctgttaacttctaatgctaaaactgttttgcagtttgacgtaacttttccgagtgttccctgcacccttctcagtgttgataccatggatattagtggagagcagcatcatgacattgtacgcacttatgctatatcatcttctaattcttagtatgtgttgatttgtccatcttattattccattgtttgttgtagaggcatgatatagaaaagaggcgattagacgcacatggtaatgtcattgaggctagaaaagaaggcattggtggagcaaaggttggtgatcactgctttagttacactttgaggttgagctcattaataaactaagtgattccccgcgctttgctgcgggaattaccaaacaattctcaatatatatttttcgacaatcaagatagcagtaaaaaggaaaaaaataatgaaacatcagggtttatcggtacttatcatgaaacaaacaaatgatatccgcgctttaatgtgaaacatataacatattataaaaatgatagatagatttgttaaactattgtgcaaatgatgtgaggggtggtgattagatatgcttgcatgttgatttgtagaattaaataaattgcagatgatgttgtatgcttgcatgtcttaaatatgtaataattgctagtgggtgatgatgtgacattgttgcatgttgagctttagacttagtgagctataactttatagaaagtatagatttaaaatatcgaactagagtcgtctgtacaaattattcttggtgacctagtatatttccctacgatgtacagcattgtagttgttggaaaacaagtggaaatttaagtacttaaatatttttattgtcaataccttattttttacatgaggacataacgtgagcatagcatgtataatattacagattagaatataaccgtttgtggactgtccatatgctgaaaacatactccagtatccacttaaaacatttccttcttgctgccttgtatagatagagagtccattgcaaaaacatggaggaagactcagcaaaggtgaagaatactgtggcacgtgttatggtgctgaggaggtatgcacaatcttttctaatgggaatgtattttgtttatacctcttattatttcagctttctgaacttaccttgttctttgttacattctaactccggatggctttctggacttcagtcggatgaacaatgctgtaattcttgtgaagaagttagggaagcatataagaagaaaggatgggcccttacaaatcctgatctgattgaccaggtatattagttattttggcatggtttacctagatatatccattgtttagatttccgttgagttctcttgggcttagtttaagtttggaaaatatatgtatggcaaataatgttgaagattgcaagataattaatatagtctatatagaggtagtatctcttaagaagccactattactggaagtccctgagaaatgattttattcctcagtcccatatctgccttgtttctctccactaaccaattagaacaacaaaaatggcctactcctgacgtagtggcataccgtatagttagatgcctgttgcgcgtatactctagcctttctatactagtatacttgtgtctagtgacaagctagtgtggcacacctctctttcatgcttttgctttgcaaggcagggctcatttatgagtgaaaagagtgaggcgacgtcatttctcctactatttactggaacttccgccctactgatttgttttccttgggcatgacagtgcaccagagaagattttgtggaaagagttaaaactcaacaaggtgaaggttgtaatgtacatggctttttagatgtcagcaaagttgcagggaacttacactttgctccaggcaaaggattttatgagtcaaatataaatgtgcctgagctgtcggcacttgagcatggtttcaacgtaagtaggtccaataaatgttccttttccttaaaagtgtttttattcagtgtttctgatatgtttgtgtataattttaccagatcacacacaaaataaataaactgtcttttgggacagaattccctggtgttgttaatccacttgatgggtacgtccatagctctagctcattgagcatataattatagccttgcacttattctcctagttatatatttcttttttcaatttttatctttgtaccctcatgtcctaacaaatttcatgaacgtcagtgctcagtggacacaaccagcatcagatgggacataccaatacttcataaaagtgagctcttgttatccatgtttacgtgcttacatttgtatcagttgtttctgctacaaaccatcatttgaaaagaaacttactgggttttgcttaaccaggttgttcctacaatttacactgatctaagagggcgcaagattcattccaaccaagttagtgaagtttattgaatcatgtttatactttatattttttttccaagcctagtgatcttattgttacttgcattcacagttctcagtaacagagcattttagagatgggaatattcgccccaaaccccagcctggagtatttttcttctatgatttctcacccataaaggtagtaacaatggagagaaattcgtatgtagtcatgttcatttttctctttttatgattctatcttagcttgctctactcatcttctcaacctgtggatatgtgttgccaagctcatctgttgaatggctggctgtgttggtgtgaccattcttgctgcacatgcagaatgctccaaattcaccatctgttattattcagtactatttaattactttggacacaagagaagtctacaatacctttgtttcacctttatctattctgacactgcaggaccaaactggaatttgtaggctttaggtcatggagagtttctaaagttagttattatactagtcagtagctaaaagaatcagttcattgatgagatatatctgttaggagtatcctagcataaaatttggtattatccttttattatttttattatttgctgaatggctccaaaaatgtctgcatatgcatcgtaacactttgaatacaaaattgacagtgcatgtctatactcattcaaaagcctctagtggtggtggcagggaatttgccaccccactattgctttttgcagtttttacaaattgtcccctgatatttttctaatattgtggaatagttcaatatttggttcaaacaagtgaatagcagataatgaaataaacaaacaattgatactaagatatttgataaaatatatatttttcttacatattatgatattgtttttcttctgcccatagcaaagcttgggcattttgctagtactcaaaagtcaaaacttatacatgtggataacatacagtttcgtatcaatataacgattaactaattctcatattctcttatcagattgaaaggtactccttttaagttttaactctttagttctgtgacccactaaaatcttagttctccaccttatgtttttgcaggtaatatttacagaagaaaatagttccctgctccactatctgacgaacctatgtgctatagtgggaggtattagcattacctctattttattctcaaactgattaatcttttttattctattgtagtgaatgagtgttatctcttcagtcttcactaacaaattcttataattcttatacatttcaccgaaaactccaatgcttatttgacaaagtttataattagtttgttactatttgcctaagtgatgaaccgttgaaggaattggctctgtttatctatgtgcctgtgtataagtaatgtagcaaacctagtatggatgcaagtcactaaacttttgtctgccttgtatcctcaggggttttcaccgtctccggcatcattgactcgttcatatatcacgggcagaaggcactcaagaaaaaaatggagctaggcaagtacagatgatttacctgaaacatggactggccctcatgttccccaagttcccaagttccgtggcttgtaaaggatccattgcttaagacctgaagacgttgctttgctggaaggttttgctaaggccatcagaattgacgatattgcacattagttgatcaaaaactcgtttacatgtaaaaaaagacaatatcatagcgttgggcctgggggagtgctttgatgtctcagtgagactctttttgagtggccaaaactggcgaaatgagatggatagattaaatcaattttaccactgcgtgtgccatctaacactgtttgacgttttctgtatttcttttcaggaagaactagaacttacattttttttgttctttttttttgcttcatctgagtgcattagtagagatataacccatttcttgtaacttcagggtgttcaaagagacaatttgatcattttcgtgtcacgtccttctgccatcgtttgacgcttgcaatttattcaggaagaactagaaattgcagttttgcttctctgtgagcattagtagagatacaaaccatttttaaatagtatatatatattgtggttatttgccaagttgttcgatatacaaaggatttgaatctctaatcaacgagtgagttgacctagttcctattaaactacatacttgatcagatacgtcacgattaattaactatcatgttcttagtttaagtaagaagatagaattagggagtatattacgattaaattattgttaatctgattcaccttgtactttcatcaggtcatatgcacaatccaaatctctagagttcaatggataagaagaacaaatcagaactcgcatcgactgatctgcacatgaaccctcatcagaatggtcaatgaagagattgcgtggccacgaggttacaacataatatttatcatataaagatttcactgcaattggtgaatctttagtaatttgatccataggcgaagtttctcctataatctccagctttcttcatggaactgcagtttgctgctgatatacaggagagtaaaaccaacttaatctaccaaggcaagtgcctgtaaaagaaaaaaaaagatgtcttaaacaaaaagtacattgaatgaagggtaacaaagcaattgtagagtgatgtgagtttgtcttttaggtttgtttttcaggaagctacgaatttagtcctaagataaacttttgatcctttgggagccctttcctaggttgggttaccctacagaatggtctaaattctaggctgtttgaaccaaccttctgctggaaagcagctttctggaagctcaaagatttgcataaataatttttttttcaggaagttcatgcttgctgctttctacatgtactatttggttcaaaatgatatttactttaaaaacaatgcaatgatttgctttgttttatactcaattttaatttacggaaaatcacaaaagaaacaaagggggcaaacggtaaactaaactgcaacccaaaaggacacccaccattctatgatttgacccaagaacatttcagttatagttagctggggacttttttttttcagaattgaaatttaagtgcttctgcatacgcatctgggtaactgggttgttttggcaagaaatttagtggcaatgtggtagctaatttgttaatccaaaattatcatgaacttcatctctactttgtcttgtgactaaccattgctggtcaaagatggaaatacatgcagttccaacttccaagtttcatgtggtcagtagtgaggacttacatggaagaaacctctcaacttccaaagctcaagttgatgtatggtggtgtttggttggaggaactaaagtggggctaaactttagtccctctcacaaaagcataagtctctatggtagggacttatgtttttgtgagagggactaaatttagtccctagttcccaaacaccccctatatttcaccattaatctgcataaactaaatcgcactctgagcataccagatcaatcatacaccagctatttgttttattttcgaagaacctcttaatccatcagtccatacatgcaaatcactattagcaaatttaatagcccatgagaaaaaaaatttgcaacttgaagtgcattaattgtataagtagttaacgcgcaaatgtacaatgtataagtagttaacatgctctagagttgagacagcaaacatggacattatccaaagattccccatactcccaatcgttcttagcttagtattcgaaagtacaaatgccagctaagttcaaatgcaaataatgtagaaggaattactttagaggcccaccttatgagtgaccctatgaaagatctgaaactttaaaatctcttaattattcatagcaagaatgagcaaattgttgctgttgtgtccaataatggatgtcctaagttgacgtcttctgaagccttcttgtaagaactgccagttcctttttttttttttgtgtgtgtgtgtgtgtttctagtttacaagaacctatcatggcccaaatctcatggagataggactggatctatatcttgcccttaacatcaaggattaatcctgaactgtaatttttaacaaggcggtaagatagataaaaatattagagaatatctgcccatgtagccaaaagagataagattggcactaagtatagtgctaatccactggcaaagtcaacttcagaaaagaaacctcacaaatgtaacaggaatcagcatatattaaagtattaaacacaccaaaatgaacacgcaaatcaaaaatataatggcagctgatatcctgcagaaattgtcagcatcagattggtcgttttcatttcacaatcccaaaatgaatgtcatgtacatggaagaagaatctggccgtctctttttcaaggctaacagcaacctccgtgtatggaaacttcttccaaccattttcctggcagcgcaagaataagttgtaaatgaattagtttattttatccataaagtggtaagaacatatatgcggagcattttgagtgcaatgcaacatctctgtctcaacatgcagatccaagaggataaacacaagactcattggcaagaggacactgagaaaaaatggatatctcatatgtatagtatttattgatgttataatagttaagaattgccatttcaggcatcatccttcgcagaaataaaataaagactagtgagtcatagagggacaaaaagagcaaacaatcagcttgcatgatgttagttgcataaaatcatgacatggcattgggagagcaatgagaaagatacactaacttgatatgatttccatataaccaacagaatgtcaccactgtacagagagctaatacaacagagagcaaagcacaacctattacatagaccagaagttaaaagtaactagatgactgcctggaccaacaagctaggtacccagtaacagcacaagatatctagaagccattcatctccagaaggtaagttcgcctcttcatcagcgccttcacagcaaacttgaatggtccatcaaatgctccggagacaaatgcatccgtttccttgcggctagtatgaccgccattgcttccctcgggtgagggcttgatagcgaccaacgttgcaccttgcaacgcaatgccgccaggaagctcaagatatggagcgtatttgagcttcatgttgcatgctggaacctgagtcctgttagaacatgctgaggccgacaactggttctccctaaattccttaagctgctccgctcccatggacaatgtgccctggccatcagcatcggtcagtaccaagcttgtaagagtgggatgatccttgataattgaccgaagaagataatgtctcgttgatgccgcaatcagagagctgattgtccacacgacgcggagtttcaaccctccattggtatagaaggattccggcatgcttccattgtcctccgaatacagctcatgctctgcaccaacaggcttgcggtcgacctgagtacccccaagaatcacacaattctgaagcgtactcccatactccgctcgccatttcaggagaactccctcctcagtccccacatcccccgagggcagctccacccgcagattccggatgtgcgtgaagttccggagcacctgcgccggcgagtgctgcgcgagctgcgggaacagcggccgcccagcaccgttcgggccgcgcatgctgtggaacggcttgatgatcgtgaacagcatcatcttgaggaaatgcgagaggatgttcctcggcttcggcgaggacaggttaagcgcgtcctcagcttcgccgtcgaccgtcacgacgcggtcgatcttgacatagacatcatggacgaggggcacgagcccgtagaaccgcttcgacacggcggagcaccggccgagcgagcgcacatcctcgacattgttgaggatcaccagcacaagcgagtccggcagccggtcgaattggtcggcctccagcaccgggtcggcatggattcgagccattggaaaccacccgaaatggagaaatggatcaaacgccctccccccctcccccccgcgcgaggttgcagagaaatggagcactaatctttgcaacagaaatgccacgaacagaagctgctgctcctcctcgaccttgtcctctccgaatggctcacgcaaccatctgaaacagaacaagaataagcacaccggattaggcgaaaaagatgggagagaattgaatgccgcgcagcatgcataaaaaaaaagaaaagaaaaactcgaaagaaactcaaatcaagaaaccgagaagacgacgaatccaaagagagaacctacctcagacaccgcgccaccaccaaatcaaccgcgagggccaacctttcgccgcccacacgcgtccggatccgacgccgacgagcaaccgtacggtaccgaaatcgcgaaatcgggagaagggtcgcgccgttttctcaccggaatcgagagtccccccctccacgcgcagctcctctccgaccagccggagatgccgaaagagcttcgatcttggaggccggtgggggcgaatcggacgggattagggtttagggagaggggaattggggatgagatgttcttgttcttgcctctccttttctttcgttttcgcgaagaagaagaagagagtttccctgggcgaagtgcttctctttcttctctttttttttttttctcgtcacaccactcgacgcggctctcctttaatatcgtctcgccgccgttaaggtgacggcctccggcgccgtcagttccacgtcagcagtagatgcgaacaagcgttcagtaaatttttcacttaactgcacgttcaccaccatacatgcaacatcctactctcgggacccgaataaatcacagaaataaaaaaaccgaagaagcatgaaaaatatagaattatgttaggaatgcctctttaaaacatatgattgtaaaacaaaagaaaacacaaaaaatgaccgtataaaagacacatgaattttaaggagagacagagactcaaataaaacttttcatgaggttttccctcatgttaaatttcctctaaaagttacatggaatgagacatattctataagaattttatggggttcatttatttgtttcaaatggctatatgggaaaaaaatcctatagaaatacaattcctacatatttccattaggtctccgtctcatacgctcagcccacgaaaaagcacacccacatatgaataatgttcgttgatatcagaatttgaaatcgagtcatgtatccaggacatcaccgttacaccactgatgttttatcactaaatatttatatattgttagcctcatcgtttgtcatatgctaatcatttgtcatatgccggttataacctgtaattgcttattaaaaaatgtgggtaaattttttatatatactatttaaaagttaatgaaaaaaataaattatgataaaataatatccaaaatcaacttaaaactaaaaattaaatttaaagtttaaattttaatagcggtttataagctaaaagacgaactatggagttaggtatgttgttaacaacaaacgagcaactaagatttctattattttccttaaaaagtattattatttcaccctcttcagtaactactttttattatttaaccctgatttttccagtgtgtggctgtgagctttcaccgtttgagagcagcttcagtgctggtgtgtttggatcccagccattgaatgccatagctacagtattttcgccacgctatagtgttttacgaaacgtccgccacactcctgtggcgagccacgccgtggcgtggcattccaagccaccaaccaagcatctctcaacatgattactgcgtaatctgatttttgccaactaaccgccacgtcattgagattgagaacgaaatgtgtacagatgagttaatttggatgaagtggcaaaaggaaggtgacatggcaggcagcatcggcttgattaatcactataaaagggacatgatgttcttagttgttaaggcaattaatttattcacgttggataagatagaaccaccggtccatcaatattggtcacaaatagatacggtatccttgatcagtttatatctcaaatagtttttttttaacaactcacacgaaacggtgcgaagttctattcatagagtagaaaaaaatacaagattacaaccctagaaagtcgtaaccaaaaaaataaaaaaattataccaccacccacatactaactgcgccaaacacagacccaggagaagtctagcaccggaccggccaccactcagcgtgaccgaccgtcgctaggccaacaatggaacacatccgagatcgcccaaaaacatgacccttacaaccaacgcaaagcccgactctacccacatcttcaggatttagggagagggggtgagagagaagatggaacacctctccccctagacccttcgacatggccaacttgtagaaactaggccacctccacaagagaatgagaatctagagcgtgcttgcaccaaaagctcgggtggtttcggcaaggggatgcctagacgacgtctccaaggagaggagcgacggaacaccgccgccgccgtccgtcaaggactcaagagagccgatactaggctttcgctcagcaaccgcccttgaggggtaagatggcactacaacaccctcaagaggggaaatgacactcgagcgtcatcgttatcggtctggccaaggccgggctgggttttcactggccatccaccacctaccaatataccacagatgcaccattgctccactgccaactaaacctccgccgccgcgtgggcacaccgcaccagtgccccccgccggccagtctccacatgcagctacctcactgggctccacctccattggcttcgcctcccgttgcgcatccatcgtgcgccagccgtccttgacgccgccggccacactgcaaggctaccggccgcaacactctaccggcattggccagccacagcccccggccctcgtcgttgccctctgccgcaggcgcggcctcctgcccctccaccgccgtcacggcctccgcacctccatctccagcacctccgcgctgtcgcgcccgccgctgctagccgcaccctccgtcaccgacgccctgttaacagtgaaatttggtaagcccaaatttaccatcggcttagagtcagtatcggcttcaaagttttagaatcagccgatgggagtcaagtcgccgcgatgtcgtgttcttggtggagtcggatcaatcaaatgaatcttatccagaagagaccgagttcaaagagaatgcacatggcaagttatctattaattatgaatagtttgttagtttccttttatctttagaaaagtgtgtttagtgtcctataaggactttatcttttccttctatctttaagaaagttgctttcttgtctgacaaggacttgtatcaacccataggtataaatatgtacacccggggtctatgtaatctatcctcacgatcaatacaattcggtgcatcgccaccttttaccttttctactttattttatcgaccggcaggacttggcacctgacgtggggctacatcgttgttcgatctccggcgaagggataagtccaatgttccgtcggcccaggcaattgtctcatctacatcggcgtcgttcaaggctgcatcagtatattcgacctcttggattgctctggtttggatgatatatttgcctacctatttatcatatgtctatgttaatctagtcttagcatatcaatttagctctatcggctgcttctcgttttagggtttctgccggtatcggctaaatcgcgttgctatattagattagcttagacatctaccacactgaaaactcaatcaacggcttgattgtctagatattatttttcttttcatacttagtgttgcatcagttaagtttgatctactaagtcgtgtttagaactataatctatagcctgcttcttgattgccaataagggtttcatcggggtttcagccggtgagttatctggacgttgcatcggctcataaggattgcatatacatataagttggatttagccgatgacaacaaaggtttcactgtttaatctaatcttgtggatttcatgacatcggacctccagccgatgtgtgctttaaccttcagatcgatgcttatttatcatatcattgctagccgattggtttctactggattatatttctatattatatcatcataagccagttgcctttatatcattatctacattggacatatagccgattgcttaaaccttatcgctatcggatggtatcagcatcggctattatcggctatcggctggaactactccgttggcttgtcagccgatctgctgttttgatctactatttgcatatcttgt

SEQ ID NO: 43482 - DNA, 1188 bp, Oryza sativa
atagccgatgccgtactagccgatagcgatatggtttaagcaatcggctatatgtccaatgtagataatgatataaaggcaatcggctgatgatgatgtaataaaataataatataatccagtataaaccaatcggctagcattgatatgataaaaaagcactaatccgatagttaaagcatacatcggctggaggtctgatgtcatgaaatccacaagattagattaaacagtgaaacatttgttgtcatcggctaaatccaacttatatgtatatgcaatccttatgagccgatgcaacgtccagataactcaccagctgaaacccttattggcagtcaaagagcaggctagagattatggttctaagcacgacttggtatatcaaacttaactgatgcagcactaagtatgaaaagaaacataatatctagacaatcaagccattgactgagttttcagggtggtagatgtctaagctaatctaatctagcaacgtgatttagccgataccggcagaaaccctaaaacgagaagcagccgatagagctaaattgatatgctaagactagattaacagagacatatgataaataggtaggcaaatatatcatccaaatcagagcaatccaacaggttgaatgccctgatgcagccttgaacaacgccgacgtagacgatacaattgcctggaccgacggaacattggacttaccccttcgccggagatcgaacaccgatttagccccgcgtcaggtgccaagtcccgccggtcgataaaataaagtagaaaaggtaaaaggtggcgatgcgccgaattgtattgatcgtgaggatagattacatagaccccgggtgtacatatttatacccatgggttgatacaagtccttgtcggacaagaaagaaactttcttaaagatagaaggaaaagataaagtccttataggacactaaacacactttcctaaagataaaagaaaactaacaaactattcctcattaatagataacttgccatgctgcattctctttgaactcagtctcttctggataagattcctctgattgatccgactccaccaagaacacgacatcgcggcaacttgactcccatcggctgattctaaaactttgaagtcgatactgactctaagccgatagtaattttgggcttaccaaatttca

SEQ ID NO: 43483 - DNA, 10838 bp, Oryza sativa
gtttggctccaccaccaccagatccggccgccatggcatcggtgccgccgttgccgtcgccgtcccacaacagacaatgacatccttcccgccggcgccgagcgtcgccggatgcctccccgccagatccggcgcagatctggtggcctcgtcctccgcagcgcctctaaacttcgtcaccaccctcgccaaacgccactgctcgaacacactaccacgccgccggctacctccccgccagatccggccagtcggcgcggatctgggcggtttccgcctcccgatgctaggcagtcccccctgcccttgtgcagtgagacggagcgaagctccgccgccaccatccttgtggccgcgtggctttgcccgtggccgctcgggcagcgtcgagatggaggaggagggagggagctgtgggcgataacgagctgggcgcctcccgtgtcacccgcagtttatatctcaaatagtaatgtttaagcaacaataaaacatcttacaaatgaaacaaataatcacacttaattgtaccaacaattggtctcattatcttttacacacatttgattttggacacatcgaattcattagagggcaaaatagtaacaaaaggcagttaaataactaatctaaacaacacgaacattaacaccatcaacgaataataccggagagtccccgcaaaaaaaaaataccggagagaaaaaaattctctggtctctggtcaaaaatggcgagagatgcttgtatcagcacgagaaaattattgcacgagatcaaagataaaaggagaggtaggtgtcctgtttttaattgttttgctaatgataatgacgatacagaagatggattaagaccttaattaccatgtacagggcataattgtgtgttcatactgattgaggccgacatgaacggctacgggcaccaaccaacgtgccgtctcaatcgcatcattttccactgccgatttgggatttgttttttgcgtgataacaaatctagcaaggagatgcctaaccttgcaaaaaagacagaaaataatcagctctgaaagtgttatctgatttactacataataacaatataaaattaacggtctcgttgcaaggaccacttgttgatttctttgtcaatattaggaatactagcatattgcccgttacaaagggattttaattaaataaatttattattaacatgttattatcatctcgtaatcattgtacatgtgaaccttattaaatctatatttttttccttcccaccaaagtaagagttggtgagagtagttgatatatgagcactctaaccctacatgtctttttttttttgttaaaagatgggagttggcattggggtggtggcaccactactcccttttacaaggactcaaggatagatagtaatgggatgataaaaatactggtatgagataaatacatgtgaaaaacatagaaacaatggagaaacttgtttaaaacgtataagaaaaacatagtattagaaatatgtttttttttcactaagatacttaaccatatcataatgtaatcttgtgatacctacttgaaaaataaaaaactatccgcttgtgaaattacttattttattatacataggtactatatatatatatatatatatatatatatatatatatagatagatagatgtgttgtcggtaggcaccaccatacaccgatggattggataggatatcaacgtttttctttttcaagttagataggagtccttaaccggttcacgttctctatcgtaatggtattatcattacatctattataatgatttttcgttatatagatattatattagtagatcctcacctgtacttaaccatatcagaatgtgaatcttgtggtggtctacttgattttgttttatttttaaaaaaatctaacccaagtggtgcattacactgtagtcctcaggattgaaatggacatgacggcataagacggtacgacctgcttgcgacaggatcgtcttaactttcacctgcaatcttcagttaaaaccgtgacaaaacacatgtctcacctacactctcatgccttctcaaaaatcacaacctacttgtactactaactacttctacttaaccatcaaactgcaaaacctgttgcagaattgaggaaatttcagagcagagagcccacagttttttcgttttcgccctgcaaatgctcatcagaatctgccaagaaacggccacctgacgcagacttttctctgaacctctagtgtgccgacaactgatcactgttcctgctgctgattagtaggaccaaacctagctaatgcatcacagctagtatgtgtgtgttaagcagtagcagtaatctacagttaggctaatctaatcttaatgatcaagacacgcatgagtgagtaacaaaaaatgcattgccttggcgtcactcaccttacaaatttgggaagctttgtgggggcgtgtcaatgtcggcacagttttgtgagctgcgtgaaacaggcagtactgttatattcagaattctgaggaagagattcggatttcagatttcatgtgggtactttcttcatcccagaatgtaaactttcttcatcccagaatgtaaaattaaattaaaaggtattataaatagtcgagataagttgataagtatagaagttgttatattatgtgataaattttaaatggtacaagttgctatattctttcgaaaaaagtactccctccgtcccaaaaaaagacaaaccctgatttccgtgcccaacgtttgaccgtccgtcttatttaaaaaaattatgaaaaaaattaaaaagacaagtcacgcacaaagtattaattatgttttatcatctaacaacaataaaaatacgaattataaaaaatttcatataagaagtacagtcaaaattggatacggaaatctaggatttgctttttttttttttttgaacggagagagtatattctacttactgttggtacttcacacctcttgtttgtgtcaccatgtgacttgtgtcactgagctgagctcatcttgtgcatgtttccaggtttggtgcctgcaaatatgcagtgcaattatgcaggtttcaattcttgccatgcagagagatgagtagcaaagatggggctttctgggtcctggatggatgactgaagatttcactgttgctgtgaaagtctggtgatcagacatgagggatcatattgatatttttacatggggatggctaccataccacagtagggcctgtgtcaggagtggtacatgatgtgtgcaggctttgttctggggtgtgggccctgtggttggggtagatatttgtgagcatttgtggctgacagtgagggcccaccatggggatggttgttgtgtgcatttgctgtgtcattgatgtaagtcatttgcctgatattgcaagttaaaaagaacagctgtcttttaccatgagctttgaatgtgaaatatcgtaccccctatgtaaaaaagaaaaaaaaacaatcctacttaccaacctagacatatttatgttcagattcgtagctagggtttatttttttagagtagtacaacttatatactcgcatggattgtttaagttattgggttttagaggtaaaacgaggagatgatttctggatatttggtggagttgtgagtatatgtctcatccactatgttcgaatttgagtgcccatactgaatatttggtttcctagccttaataaagaattgtttgcatgtcttaaatgtgaaagataagatgaaggaacgtattacacatgaaagttacagaacatataaaaatttattaatcaaatgggatgtttgggactcgatgttttggataatttaatagagtctctaatatatatgcctctttattttcttttataacaatatatttgtaaaaactatagctaaatgaaagtgttcttcatgataaatcttctaatattatttttcacgtatttgatcataatattatttttctattaatgacaagattttaagatttaactgcatggcattacctactctttttatctaaaaaaatcaagtatgaatctaaatatagtggacgaagagcaagggcggagctacataggagaaggggtgcccagaaatccggtcaagaatttttttttaagctatagttcatatatttttgtcatatatgtacctctcaatccaaactcaaacattcgtatcagcctaaatctatctaaagtatagtaaagtaagtgagtggtacctttctttattttgttttagctccgtccctgacgcagaaagtatttgagattgttggtaaagtaggcattatatacaaggacaccatgattcacatgacacaccgattagtcattagagagagacatgagcagactgctgccacgtgctatcatcatcctctctgctctacccagtgggtatgtttcttggaccaaggtggcagcatgtgtgttttttgcttaagattctcgttagcaatgtccttaagcaatttgtacattttggccagagacatctcagagatgtgatggtttatgtgttttgtgtcagttcctgaatactgacattgagccttgactgacccagtcttatctaattcctggcacagcgatccctacttaactggcaattatacagataatttgatgccttttggtttcccaaaaaactttgaaaaaacagtagaatatgacggttttcatggttctattcttaaaatataaaatgtattctctttcacttgcaataaagaaaattgaactagtagatcaagggatacataaatcctctccaatccctggagagctcacatattcaaacgaccttttactaattataaaggcgagattatgaggaccatcaacattcatatgaattcataaaatgtataactaatcacgcatacatgatggatccaatcatccattcgtgttcagtttcgttcgtttcttcgtaggtatggacaagccttgacgtcgaccctgtcctaacacaagcacacatctggacatcctgatgactgatcactcacatggcatgtggttgatggaaggaaaaaaaaacaaaactttgttcttatcggatactagtacgtagagaattaggtgcaaattggccacaattttcttcaatgagataataataggaaaaaaaaacttggttctattctatggaagaactatcctgaagacattgcatttgaggtcgagaagatagtaaagcattctcttacctacaggggaacacaccgttatcataggctatgtcttaacctgtattttaggcaaaacacacaacaaattattattattgttttttcatccaaggcttaagccctggttgatagcctcatggacttaccatcactacaagcacgttctctaatgagataatggagaattattcttattctttttatctgtcactttttatgttttccatattctctgatatgcaaattcggcatttccatcttatgattacatcaagatatttcagtaaaactaaaatgtaatgaaagtttcagcgacaaatctaatgaaataattttcatacaaccaaccatgtagcttttaagcatattaatattcaaagtttgccggcataaattgttgaacaaccacataactcttatcatcctaattaaaaggatttttatctcaaaaaaagattaaagggattttgacaacatatttgtggaaatccaatatttcttccctttttgagaggagaagccaatgtcagtagcaggtaccctcatgtgtccaattaaagtgtatacttaagctctaataaattggttgatgcgtataactcaatgatttcgactgaacatcacataccttatgggctcttgtgaagtcagatttgtggtagcgattggaccaggagatgatcaatctcaaacagtgatcagcgtattatcatagcaattatttttctccattttgtttcatgatcattcagtcagttaggtcacttttgtaccaagttgcttgtagagaaatcaaggatgtctttgggaagatgtggcatcaacgacctgataagacgtgagaagacacacattttatggacggcgagcttctgatcaaagaaagttcagaagaatctgatcattcagaagaattcttttggacttagcacatttcacaagctacaaaatgcaaccatatctgcaactctgcaagcatgattgtgggggactttgttctgtttctccttgaattgtgtgacccaaagaggggaagatttgatgccattgaagcaagtgtagtgtagtgtacagagtacagtatactgtagcagctcacatggaaggctagtgtctttgttgataccatgctatgcttccagctgaggagaagaatcttggcacaggacaattgattctcaagtcccaactttctcttattgtagctggtcacagttccaggactgacttcagagttctagattgcgacagagttggaagaacgatatactccctccgttcctaaatataagcgtttctggctatgcacctgaaacaatacggcagatatgtgcaggtgtatagtcaggaatacttatatttgggaatggagagagtacaaacaaggagaaatcaagtgctggaattcacatttgtcacaactgttcaatattctaacctcttggatggaaatggaatatgcctttcatacttacttacactgaagatttatgttcaaaagaatgatatgtgcagtaatagtgtaatatatcatccagttacatacacaacaacaatgcatagcaaaaccttgtgttctgaactatgcaaattgatctgaagaatgcaaatctttcatcacatgaaaacaagaataaagaaaacgtttacatcacaagcaaaaggctatacaagctcggatgaggctcctctgttctttcatgacaaactcttcgctgtcccaaactgacaaaggcttcagtacgtctgctatgcacactttagtgcagttcatcttcgctaaaacatcaacattcttggcaatggcatcagagagattttcgaatgcttcggggaggtatcacggattcgtcaaaatgggcatagaggtacatgattctgttgtggccccattagtgatagcattcagagttccattgttcaagaaatttatcccatctgatcatgtgcctccaacacatataatatcacttcccattgtaggtattgtaggtagctctggtgattcatactctctactagagtcattttttatgttgttacttatgtcctcttgatcagcaactgaagaaatgatatcagattcagtaactgtactcaatgtagacgcacttttgtcactgaattgtctctggaaatcacttgcacttggctcatcaatgtccattgcttcgatgataaaaggtggcttaaatcttgagggacgtctcccctggctgccaatgctgaagctttcatgccttgtgaagaacatgtcctggtggggtattgcgacatgttcatgtagatcactttcatctgattgctcaaaaggatgatcaaacggattcctccatgtatgcagaacggatggagctgagccaggaaattctgtctcatcagaacaagaaagaatatcagatgggtttctcttgcaaaccttatcattatcgatgtctaagttactgtcaggatcaaatactatgttcttccttgatcttctcttaaccatcaagatctctaacctacgatgcctttccacctcagagtacccaagatccatgacattcttatcatcatctacggttccaagaaatgcaggatcagtgctgacattcttgtcatcgtttttgttggccttgctcttgtcagattcataattattatctctcacagttctagaatcctgaagggacatgtggttgtccgagtcatcattttggatgggatcaggatggggggaatcagcactggaaagagggtcaatctcgtccaggacagaagcaatgcgtgttctaggagtaccaggagtggtaccctctgtctgatcatgatcaaaacctggtgaaccatcatggcagccaactctaccaaatggtgaatccaaagatgagtctaatggactgtccacagcagcattgataggctctaccttaatatcagaaagcttcttcctgcgacgaacagaaaaggcacggccccatttacaggtaccagccggtttatcttctgaatctactttcatctcatcactctgtgaatctgttgatcctctatcatgacttatcttgcccaccatctcaacaacttcgatagcatcttctctggaagaattcaagccatctttgatttcaccgtcatttaagctcgccgtgttctcttttgccgaaaatcccttgtttgcttccaaatggatattcctggacaaatctgcatacttgggatccgaaacctcggcgacagatttccgttcttccttgatctcagcaacgtttgtgctgccatggcttatcagcacaccaaggataagagcggcacatatgattacaggagagtgggacagaaggaaagcgaagaaacccggcgaagatctgaatagcaggtagagcagcaggaccgggaagaggagaacccagttttcagaagcatatctgtagctcatcctgattgaacacctcaagatcgtccttatacatggcgtaccatgatctgcctcgacacccatggccttgtcctctatcaacttgacagcacaaatctagcaaagaaacaaacgaaaaaggcaatagttcagccaaaataaggatctactagcaatgaatgaagcaaagagagaaaatgttccgtccataattctgaaactctcatgctaaataattccatgctatatatactacagaattacaagagatcaattcaggtagtgcagtagtggtaagcaatagctgaaatcgaaaactttaagaacaaagatgcaatccgtataatcttaaatctcctagaaccaaaaagcgagttcagcagcagcatcctgatcatcaccatctctgctacgacattacaactgcgactgatcgatggcgcacgaaagaaagattgtttaccttcaggcggcagccggcgatccgacggtgagatcttggtccctgaggcttctttccttcagcgcgccgggaagcaatcgacaatggcggccgtcgtcgtagaaagaacaaaaacaaaggtcgcagcaaggagagagagagagcacgaggagaccagctcaagaaagcgagacaagaaagaggcaggcaagcagcacggtggtgggggcaggtggtgggtgggcccggctggtcagcgtcggctggcactgtaccaacaccgtgacgtcgtcttcgccctcgtcgtcgtcggtccggctggacgccgtggcggtggcacgtgtgcgcacgccggcggtgggcccgccgccggttcacgcgaggccaggtttggcgcggcgcgggagcgttttcccgcgtgttttggtctctcttcgtgtgggtggggtggggtgggtgagatctggattccgtttgctttctttctgaattctgatctctagctctctctctctctctctctttctttctgtggccttttttttttgggggtgaggatggatcatggacggtgccgaaaaggctctctttttagcggctattaattctgtggttctccgtcaatgcagtgctgctcatgatgatgttaacagacgaaagggatctgtgtttagtaacaccgaaaattgtgccttttcttttcttaggagggaggacaatgagatcatgtttattttgattgttcacatttcacatgataatctctactattatttttttaccggtattttggtgcgtcatccgtgtttaggtcggttttttaaatctgttcgcttttagaaatacatatccgtatttaagtcagattttaagttcgtttacttttgaaaatacaaaatgagtcgtataagaaatctctttaaaaaaacttgcatgctaacttgagataaaagtcagactcctaactacatcttatgattttctaaactaaaatatccaagcgaatttccacggtgaatttcaccctagctaaaccggataagaattacaagattaaaataatcttcacccattgcaacacgctttttttggtttctttggaataatgggcatgtggtgaaccagtcatgagtaaatgtgcttgggacaaagtctcaaaggggataattcaatccatttgtcccagacagcacatttggttggggaaagacgaatctttatataatatggagtactccagatctgattagctaagggtgctaccatgaagaaacttaaaaagtgtgtgcttctagaggctcataccacatatgtaaatatcatttcattcattttcatctagcaaaaaaacacccaatgcacctctttcctgtgcatacaaaaactcggcacaccgaaagaaggcaagaatcacaataaaagaacacaaagaaaccctatttttacatgtgtatgaacaccatctctacatcgcaaagactccaagaatacagttaccgcagaatagatcaactgtatacatactcatccgattgtatgatcctaataagctcttgcagattatcaaatacgcgccttccagagctctcagctccaatgtagttcaaaagctgctctgtatcctaaccacccagcaaggaaatgatcataataacgatcttagtttatggggaaaatagattaaacaaacattacaacaaataagcagccagaataaaacattaagggggaaaacataccttg

SEQ ID NO: 43484 - DNA, 26160 bp, Oryza sativa
  unsure (1)..(26160): unsure at all n locations
cttgtgcaaacaaaaaaccctagctttgccgtacggcaaaacatgcatcgaaccgagccagcaaattccaaattttctaccaacagcaaggtacattactgcctattatcgatctaaacctgctagcatacaaggattagggcttgattttactcaccgtacacaggcgcgtctccacctagtcgacgcaatcttgccaccattctctgccgtcgcgtccgtcgatgggtgcagacagaatcgctcccccaccctctctaccaatcctatgatcgattggcgttggttgtcggcgatcaccggcgatcaccacctcctctcgcttgcgtcacccacttcgcccttcccacaccgaggataacgaggagtcggggatttcgtccttcccgcgccgaggaaaaaaaagagtgggggatttatcgtctgagggctggcgaaaaaataaggggcttaatgcataatgcaccaccccggctgtctcctcccctccacgttggcaagccacgtcagcgagcagaccgagtcaaatggggtttggacaggcaatgtacggctaagcaagtttagggacctgtaaatacgatttgagagtttggggacctagatgacacacccttacaagtttgaggaccgctggtgcactttactcttcaaaatatttcttcaaacttctaattttttcgtcacattaaaactttcctacacacataaactttcaacttttccgtcacatcgttccaatttcaaccaaacttccaattttggcgtgaactaaacacaaccatatatgtgaggaaggcacttgacaagctttgcttggttattcgtattttcttcgattccaaaataaacaaatttaatatagagataatccattgtatgccactgagtttgtcatgggtctataatttgccactgactttgtcacgttctataatataccatcgatttttgcttaacttctacgatttaccantgccgnncagttagtctncgntagtnctgtncactttnnttcanatgaccaaaatacccctgagacaaaaactttcaaattttggataaaaattctgaaatatcagactttaagtttttggacaaattttgaatgtttactatcttatgtttataatatggtatttcggaatttttgtccacattttggaagttttatcacaggggtattttggtcatttgaacaaaattgtacagtactaacggagactaactggacggcgatggtaaatcataaaagttaagtaaaaatcgatggtatattataaaacgtggtaaagtcagtggcaaatcgtaaagatgtgacaaactcagtggcatataatggattgtctctttaatataagttctattttataagtagatttgtagtattaaaatatgttacatatcacatgtgtttatttatttttgagacagagggagaattatgtttgatccaatcaatgcaaaagactggcacctcatgatcgatcgatcatcggatcatgcatatgaaccgaagaacagaacagctcgccgtaatcatattattcgatcatgcaacgcgagggtcggcccgggcggccggcgtgtgtgaactgcgcaaatttgacctgatggacagtgatgaatcgagctgaagatggacggcaggatttaatccctgccgcgagaaccggagccgcaatgcatgcgtgtcgactgtatagatacaggatttaatcacgggcagtttcttgtttcacatgtactccgttctattaaaaaaaaccaatctagtattatatgtgccacattttattactacgaatttagacatatatatattcagatttatcgtactagaatatgtcacatccgattctaaattcgttttttatcggacggacggagggtgtacacatcctacacatttttctttctttttttattttttttaagaactacgcatcctactcctacaacaaggtgcattaatgtgagctagctagctagatagccacaactcatatccttcatgcggcatgcatgcatatgccatcatccttgaattgcgttcgatatattattgctgttttcttgaaaacttatactccatatatattattgttgttgtagatagacatggataaaatgctcttgcaccaaacgtcatgactcgggatacatatagtgctcaaatatgaatttcgcaagatgtatagatttatttatttcttcaacaaaaactggaccaaagtttggatatgcgtgacatgctttttaaaaattactaaacgatatgtttcgtgcgaaaacttcctatataaaagttgctctaaagtttggatattttacaaaataaataactaaaagtcaattaaaaaattaatcatacgttgataccatatcgttttgcgtaaaacacttaggccgtgtttagatgctgtaaaaaattggccaattttttttgacgtatacggatatacatttgaagtattaataatgtaaactaataacaaaacaaattataggttccgactataaactgtgagacgaatctttttagcctatgtgctaatcatgacgtaattaggctcaaaagattcatctcgtgatttacagccggactgtgcaattagtttttgtttttgtccacatttgatgctccatacatgtgtctaaatatttgatgtgacgaaaaaattagaagttcgatgaaaaaaagttggaatctatacacaaccttaatcttaatcttcatccttatctatatatgaatttcaaacaccaccatggtgttcgaatatgaatttcgcaagatatatagattttatttatgacgtactacttgtacgttcgttgagcgtgtattaaagcccgtttagttccccaaatatttttccgaaaaacatcacattgaatctttagacacatgcatgaagcattagatgtagataaatgaaaaactaattacacagttagggaggaaatcgcgagacgaatcttttaagtctaattagttcatgattaactataagtgctacagtaactcacatgtgctaatgacgggttaattaggctcaaaatattcgtctcgcggtttctagacgagttatgaaattagtttttttattcgtgtctgaaaaccccttccgacatccggtcaaacgtccaatatggcacccaaaaatttttatttcctcaactaaacacaccctaagtgaacacatttatatctggcaaggtggacgcggtggtgtgtaacctgaatttttttttagaaaaaaagacgcatcactctatatatacgtgtgtaccctgcaggacaagccagtgtcacacgacgcctccgaattcattttcgattcctctcctctcctctccttccaccgcctaacgaaccactcgccatcaaagcccccagagagcgcgccatggcggcgcagcggcggtggccgacgtcgacgctggcggcggtggcagtcgccgtagtagtactactggcggcgtcggcggcgacgacggcggaggcgcagtcggcgccggcggcggcgccggggccagcggggccggtgctggaccaggcgtgcctgacggcgctgctgaacatgtcggactgcctgacgtacgtgcagaacgggagcagggcgcggcggccggacaagccgtgctgcccggagctggccgggctggtggagtccaacccggtgtgcctctgcgagctcctctccggcgccggcgactcctacggcatcgccgtcgactactcccgcgccctcgccctccccgccatctgccgcgtctccacccctcccgtctccacctgcgcaggcaatcaatcacctccctaatctttaatcttattaatctcccccaattatcactttaatcacttctagtagcagtagcagcagcactctctccataaaaaaaaagttaaactagatttatatcttaattacttattattggttgcatatagagatatgtttctttgtttttgttatatgcatactaatatactactatattaggtaaaatggtttcagatttattatttgatttcgatgctactcatcttttggcatatgcatattgagcatacgagtgaaattgatttgacagaatcgagcaaatgattgctagaattggtttggtttttgttatatgcaggatatataggtcttaatgataaaagtaatagctctatacttttggtgagggtatttgcttttgattagtaagcatattatgggctaattaagtttgggaaataattaattttgcagcctttggattcaatgttccaatgggcccaacgccgtcgccttcgccggcagccgtctcgccctccggtgagggcccacagttccctggtaagcatgtacttgctctcactaattatgttgttcgttttgtacttttaagaaaactggagttattaattagcttgatcattcgccatagcttttgttgagtagaattgtagaaatatgaaatatccgtagtttaattttgattgtttgtcagtgatggctaaggcaggaggttcacaattttgaaatgaagtattaggaatttaatgtatgaggagcctccggctatagatattttagtttgatttagtttggcaaagatattgttctagttcagtaaatcagtcccttttagcgtttgaaatatctgaaattgcccaccttttttttttttgaaattccaacatataaaagctgagtaatacacacgtcacataccagcaaagatttagggaagcatctaattttaaccagagatttgtgtttccagccggattttttttttcaaataatcttttttcacgctgtataaaaaagatgctgatgaacacatcactactaatgcatactacaccagtaaatacgtctcctaactcacattgtctaatatgctttgccttatacacgcaaaaaaaagaaaagaaaaaagaagagggaatcgttatggttgttgttcatacaatttgtgatgatgctatcatagaggaataaacatttaatcggctacatgtacaaaagcatcatatacagtttatgatggcaattaattgctcgacagtaaacactgacgtgccgtaccgttaggttcatgtgcctgtcacgtatttatacggccgctaaattcgagttcatgtgaccttaataacttcatctgcagggacctcaccgttcgcctcgccgccgtcgacggcgacgccgtccaccaacgccgccgccgccggccgctccggcgaccacctcgtcgccgtcggcgtcgccattgccgccgccgccgtcgtcgtcgccgggatgtttagaatcgtttgattgatccgctcaactagctatcattttctgggggtgatgtggctgtttgtttgtatggtccttgctgatcataatcaaattcctttttatttaaagacgtattaagtaactataaaattccttttgatgtaaaacttgctggattccatgacatttgtccttgcaaggacgtatatacttatcttgttcatatgtttgatgtgatgactcacaagtcgtcatgtaaccacctagtgtggtatgtgagaaatactagtactttttctggttttatgttgtcacaagaacagcatgagcaaagttcaaaaaaaaaaagagaacagcatgatgataagaaagttcttccttggtgcagcatatctactatacttcctttagttacattttaagataatccaaaaaataccattaacaaacgtccaaatctaagaaataccatcgacaagtataaattctaaataccatcgacaagtataaaatctaagaaatatcatcttacaaacgactttgttctaaaattaccatcatcattagggtttcgtctattccgcaccgttaagtgctataggatgaacaatatattcaatggcgcggaatggacggaaccctaacggcgatgatatttttggggattttgttccaaaattaccatcaccgttaggttttcgtccattccgcatttgggataaaactgttttgtacgatgtttttttttagaactcacatttttcgatgacatttcttagatttggacacttgtcaatgacattccttgaattaaaaactgtacgttgagagaactgaatacccattcaaatttgtttgacgttagaagaacagagtttagtttttccaacatcaacttctttttactagagtgagtactgtttatagctgcagattatctgttcatggttgcaaagttacaggtgacacaattcacggcaaaaaagaaaatctcacagcaaagtagttaaaacagaatgacaaatgcctttgccagcatgatgcacatagaagtgaatgaatgaatgaatgaaggcggttgtgaatgtggacacaacgcaccgaccgactgcacatcttgtacagtactccaagatagcagcaatgaatgaagatggcaagcaacagcatcatcaaattcaattcccaactgtccatccatttgtgagttttttctgttcccatgtgagctgggctgcaaaactgcaagctcatcagggttctcacttctgctacaactgctgccacattatgggcaagcacccaaaaggatcttgtgtgcttgtgcagggcttctcgcagttggacggcgtcatgtcgtgagaaaggaacaggagatgtcatgactaatgagggcaaatatgactaccacctctaaatttgtctattttattcacttatgaaataaaagacacccttctcgcactctttttgaaatttgtgtggaggttgcctcttaatttaggggtgactcatcatcaatcttctcacttttctctttcaccttatcactcaatccaatatggcacttttagaggcaacatatgagacattatagtacttgccctgagatggttcagagttcagactcaaaaggttcaggaccagtttttggggaggtttggcggttacagtttctcccagaatctccggttcttccaaacagcttcaattcttatcaatattctgaggatcagaagctatagaatccataaaatgaaatagtggtttccaaaagctagaaaacacagattatcactagctggctacttatcggctatttctcagaatcttcggcttcccaaacatggccgtagttctggctctcctgaagctttgttcatcatcattggtcagtaaaaagctcttgagttgcacacagatagcaggcaattgaacatattccagtacagaatgcagaattagagtgataaagagatttgattaatgaattcaaaaatcactgaagctatataccacaaatgagaaggattacaggtatgaaaaccaggccagatgtttgtaaattctggcaggatctaaccatgacctagtaggttcaagtcgacaactcaaggattacagatgaaaaccagaccagatgtttgtaaattctggcagaatccaaccataacctagtaggctcaagtcgacaactctatgaaataaaaacaaaaacctgctctccaaagaaattgcactgataaagtgcatctccatctagcataaattatggatactaacaatgagttgctttctaattcctgccagttaccattgaagaatggtaacaaaaaccaagttgtcatcaggaagtaaccaaaactggtagaatttgtgccaaaaacctcatgaacctacttattttaacccattcctgtataaatcagactgccgacaaagcagttaccgttgattatttacaattggatcgctaacatatgttgcaactcttcctgcagtaacctggtaatgctgctgttccaatcatgtattctgggttctttatgcactctcccaaggcagcccatttttcacaactctcattgtcgtcagtgcaattgccttgtgtgtgataaaccttgtcgaatgaggctacacgaatccactttgtagcagaccatttctcaccctttatgactgggcatccagcgtggaggctcaatgaatcttttgaagcatctgggctaaggttgaagaacagaagtgcatccccttttcgtggtttcactgaggtagcagtagtatatcaattgagaaatgcataagatatattacaaaaatcatgggaatcataattacaaacaaaaaaaaggaacatcggtagaaatttatacctgcaacaccttttttagcacattctgacaaggttgaatcttcattgtttgtgccactttctgtaaactcctgtttgacaaatgtgtgtagagaaaatgatgcaataagagatcccaaaacaaattcacaaaaccgctgagaaagtaaaggagcccatgcttggttgtggcctgttggctcagatttctctccttttcttttaaaaaaacaccgtggagacaatggagtaaagaaattacctcagctagagggaaaactgtttctccaccttctgcaacatctgttaagtacataagaacagtagctatgcgatgaccaccacggagagtgttaacattgtcgctgaagtaatcatagtgccgttcatacttctcgccgtgcttataccttaacacttggatatcctcaccattctctgattattatcacataatatgtacaagaaaaaaaataaaaacacataaagttaacataaatttggattatgtatgaaggaagacaacatgaggacacataaaaaagaatccctactatcaatccccacccaaaaagaaaaaggaaaaaaaacaattattgagcgtggttttcaatgacatactgcttgaaactaacctttggatgaattagccccaaagtcaggtaaggaggctcaacattaaaggctttactttgtttattttagaaatgaaatgccaagtggagcataactattttagaggctttcacttcaagactgcccataggtacaggaacgaaaacaaaggcccagagggaggttgattattaggtgtaaaatgacaatatctcacatgtgtaagttatgaattatatagaacatctaagaattgcatgaatagtaaagtgcattgttattgtcttaatggagtcaaatacctttaggaagaaatgtccacgcagcaattttttcctctataccagcaacaattggatcctacaaatttggacatgattgttcattacataagaattatgtaaatttaaaggaaaattctcaaaattgggaggaagaatcctctcatttagccaagaactactttaagttatattgcacatctatcttcatacactaaaagaccccctttattcaaagatacttttcaataaaaaagatgaactcacactccggatgaacaaataattcaaagaaaaaaaaacgttaatcaagacctaacctggctcttgcggatgaaggtgccggagctggtgcgggcgtcgctgagctcgctcttgccggacaggttatcagccaccgctgacctcttgagctccgttctcgcctaaaaaaaaacataaatcctctaaaaactcaatgaatcctgggcatacagagttcaagcatccacaagaactcccgattcatgcagagaaaagaaatgaaaatttgttggattggggaggtggtgggcactgacgagggagacgaggtggttggcctcgtcgtcgctgaggaaatgctggtagaggaacaccctgccatggatcacgcatcagtcagtccatccaatgtcgagatcgagacgaaaccaagaaccaaccgatggcggcgcccgcgcgagcgagagaaagtgaacctgggcttccaggagatctggcgggagtggtgcgggtacaccacgggcgccgggtacaccgagctccccttcccgcctccacctccgcctccacccccggcagcaacgccaccgcctccgccgccgccgcagatgaggaggaggacaagaagcagcagggcgccggaagtgggagccccgagccgcaccggagccatggcagcggagaattctccgtctccctctcgcccaacggaggcgaggaggaggtggaggtggagatggaggaggaggcggctgcggcggcgagctggaggtggaagtggtcgccgcgacggtggccgccacgcttcgcggcggagagggaccgagtcagtgatgaggagggaggagatctgagccgtcgaaatcccgcgccgaggagatcggacggccagggcgcaccgggaaatcgtgcaagcagcgaactactagtaacgaacgggtaggtgaggtgagcaacgccaacgcacataccttggaaatcacgatgttttgcttcaaaattactgtgttttttcatataacggacgttttttttactgagaagtgagaaacacagtattaaacatatgcgtcctcagcgcgcgtacacttacaccctacacatacgaacacctttaaaagactaggcgtatatcggctaccactgaaataataattagccataaatacaagcacccgtgtcaaatctaggatttgaatttgggtggactggttccaccacgagaaatctaaccagtcgtataaaagtcatataaaaatggagcctcaattactcctcaattttaagccatatttgttttaaagttatttacaaaatattaagattaaaaaagttctcttttaatcatactaatagtcaaattttagattatttataattgtaccataaaatatgattagccagaaatgtatggatttttatttattggaatcagtgttccataagttatttagactatggtatataagtgctataaatatttatattttgaaatggatgaagcactaccttttacattctgtcttgcaaatgaaaaagaaaaaaacaaaacaaatggggagtctgttccaagctagtggcttcctgaccagggtgtgaaaaaccgccggtaaccgcgcggttaccgcggttaccgcccgtaccgcgggggtacggttacccgtaccgcgcggtacggtttaataaaattcgtccaaattcaaaaatttaaaaaaaaagaaaaaaatcaaaaaaaatagtgaaggtagtgcttgatttatagtgttttatggtgaagaaatttctcaaaaaagagtaatatttattcaaatttgagagcaaaacggagaataaatttgaaaattggaaaaagaaaaaaaaatgggccggcccgttactgtgcaacccattacacatcgcgcggtaaccgcgccaaaccgcgtggttaccgcgtcaaaccgcgtggtttgcccgaatttttgaattcaaatttcgatttgtaaatttgtcgcggttttgcgcggttaccgcggttaccgccggtaaccgccgtaccgccgggtggcggtaaccgggcccccggcggtttttgaaaccctgttcctgactccacaagaaagtagtttagtcatcagactcggtagacaatggtttttcagcggttgttgcttgtctcttggaccacagtagctacttctacttggattaaaacaggggcatcaagttcatcatgctgtctcatgttaacacatcattccctcgcataacattgtcaaaacagtagttgaggaaagaaaggacaacatattttctactactagctgattttgttcagtgataagaaacaaatcaggtaacagataaggctaattgttgaagccaaataaagatgtggtgatgtacagttcctctgcagaataagcttcgtgcactaacaactgcactcatttgtcagggaaaccagaaatgctgacctttcttgttaagtttgcatttctggcttccagttgcagaaccctctaaggctctaccgttgaacttcaaggtgagcagaattcagatataaaataggtttgcataaatgttcttaatgtgattgaaggaatgaaattcagctgaaaatcacaaaagtttgtactcattcgtgagaaagaagtcgatcgaagccagacaagaagaccatggtgcacttggccaggtgaccaaaattatactgaacaaaaaggaaaatttacagacgtagctcaggtgaaacatccactgtacattgtaatcatacttaatttgtgtttatccatgagatagtcacataataatcggcaaatcaaagacaattatgagatagatagatagatagatagataacataatgtacattttggaataatgcctcgttctcagtacaattttgttacagaaaagttcaaactgatcagacagacacaataatacaagggggtcaatggattctggatagctatgcataggcacacttgttctacccaaaagaacaaaaagaatgtggaaaattgttcgagtataatataatcacctttccctttggaaagtatatatgcactacattttctgtacgacttggtaatcacctttcccctgtcacaaaaaaataatctgctttggaataaatacctacaggtgccgatggaaatattcttcagtatcttagtacaagttgctgttgctaccaatttaatttccaatagggtttaggtcccagaacctgtgcaatgcccatacaaattagttttgtccatgcatatactggaaattatgttgtttttatggtaaatttaaatcaagagtcaagaagctgcatacctttattgcccttatttttattagccttactcttactagttggtaagagttcttcagcacctattctgatgttggtattagatgatcgcctctttgatctgctctcttgtatttcaacatcaacaataaatgttccacagacaggacggtgatccgaaaatttggactccccacggaagtaggacaactgcacaatgccatctccatgccatagtattctgtcacacctgaacaagttgaaactattaacatttgaaatgcaaaatgtgcagcagtagtgcaatgcacacagccagtacaccaagccatttgtctgatatatatttgttagtatgatgcaatatttgttcatgtgaatgatttcatcgttttctatttctacgacttcaaccaacatttgtccaaatgcgcactgtttcacgtcaagaaacccaaaagatgttcctcttctatggtaatataagatgataatgttggattactgaagttgcacacaagcatgtggacaaattataatgataattaaatggtactaacttaccaataaagttgtaacctgacacagtgggaatacatttttatagtaaaactaactaatatgaacacggtacataccaggcgggggttctcctctttttctttgatgttgcagtctctccagcataagaatctgagttactagaatacttgtatgtgggagcaaaatatatcttctcctcactccaacccttgaacacccttccagacttgcgctcgatgttaagctgaaaaagagaaggcaaccatgcatgttaaccaaaatttcacaagatataagtagattatagcctggctagatataattagaacatagagcacacatacacagtagaagttcttgaaagtttggttttatcgtttattactttagtcctttccttctgagaggaagtttcaaaaaacagtgcatcttttgagaagtttacctggtccttttcaaaaagggcatcccagttattttcagtaagaagtttcttggtatcttcatagctcaaggaaatacggtagtttagatctcccagccatatcactcgactaacaaaataagagaaatcacaataattagtaaatgatgattgacaatgaacaaatccttcgcagcatgtgtagcatgagtgcatgacttactcgtggtcaagaattttctcaggaattcttcgcccagctctacaaatcctttgaaattgcgtgagtctcagtatctctaaaacatctaaattccgcctcagctcatcaccctctttctcacctgaagccaaatggctacagatgaagcagaaacttgtctggtgcaccgtcatgctcactgatatacatccctgaagccaaaagcaagtgtggcataaatatgtaatctacacatgagaattgtgaagaaccctcattactatgtcacactaaaaagaatggaaggagctgaaatgtttgctttagcatctgtgttgctctgttagtctgtctggtgtaattctgaaggtcaggagtagtctgagactttgtgtgtaagttggaacctggaatgcttgtagaactactatcatttcattaatgaaatgggagaggtccccctctctttctccaaaaaaaaaaaaagaaagaacagaaggatgacttccggctattaaacattatcaaaaaacatgtcaggctaaatctgtacttattaatataattgtgaccattgtaatgctttaattaacaatgacatcccattacaaggttatgaagataatacttctgaactttgatttaattcttaccttgtttcccagatagcccattattccacgacctatacaagacgttctcacatggcctatatgatgcacaagttctttctttgcccacaccgtgataaaaatcccaaccattcgtttgcacgatacgaggttgtattttagctgatccctggaggcagaggcagcagaattcattccatcaactatataaccacaaggatcattcgatctatcatctgtatcatcttctgaagagtccgtctcattagcatatgcttgtggacatccaaagcaagcatctttgtaggacttcctagtcatctcaactgagcaattgcagagtttgagcagttttctctgggttggcatgtaaggcttcctgatagacttcaaggaggacttctggaagattgcagaactaccactagctgttcttgtgcggctggagaatgaggcatcaaggtttgatgaagacagagacgaggttgaatcaagggaagaagatggcttgtgctggaagatatcagcattactgtcaactggtttgtttagcgttcggtttataagagcaagccaccttgcagctggttcattgtcttctacgacaagcacattaccagcattgagagggacaatttcctgaaaactgcataatatcataagagaatgtgtcaaaaaaaaattagaaaagagacagatggaaacagcgtcttcggttcactgaatgaaacaaatgaacactaaggaaaattagctcatcgtggcaaagcaagcaagttagtaacatcctgaaatcactaggaaacaaattaaaaggagctatttttatttttcatatcactcactaactgaaatatgaaaaatatgtaagatggtgaaaaattggtgaaataacttaccctaaaacataaatatctgaattgtcatcagcaggaaggaagtcatccaggtttaattcagcagtaggcgtgtttcctccgacattccatgtagatacaaatatcctatataatgaattaaaaaattaaagacgacctagtccgatctaagaatgtaaagtatgacaaaccgacggcataaagtatgactcaacatgcaagtttagctgtttgacctgaaaggttcagttttagtagtacttgaagagtgaccaagtaaatggctgaggcgtatgctcctaacttctgcaaaaacttcctttcagtccaaagaaccaaaaaataatccaatcaaaacaaatcagcacatgaatagagtgaggcaatgtggcaaaaatgctaaacagaaggccacctgtaagtgttctgaagggggaagaagattgtgactttgaggaacttggcccggacttaactgcatttgacaggaaaacatggaaacatttagttgctattacgctatattattgtcattaggccaaatcaacgtaattgtattgaagcaattcgggcaaaatgtgaaatttctgacacgaagttatcaagtatgaaactagagaataaatgaatcctagcatcttcttaaacatatttgaactggctgtctcctcatatatttctcattatacacaatgaaacgaggttcagttgaccttatgaatgtagttggctgattgcccaactgacttgagcaattcccctgattcaactagatgagctgaaatttgataaattatgctcatcttcgtttcaatttatcactatcctacaagacaccaattcagtctagatgcacaattcaaaaagaaagaaaaactaacctgcagaacagctttggtaatctgccctcttcacaactttcttatcttttgttccaaaaagttttggccggcaaccctatagtatacaaccaattacaaagtaaatactttgatttaagttcagtatgaaaaaaaaaatattagggccaaaacatgcaaatagagcacagtggatctgagaatagaattatgctgctatgttttatttttgtgagtgtattgtaatgttatatgaatgatgtaaagcgaaaagcacaaaccttcatcttttcatcatcatctgggaaggccatcccctttcaagtcagagaaaaaaaaatggaagcttctcctttttccagtatcaagcctgaacaaaaatttaacagaattaagtatcgtcaactattcatcataattatactaaaattatgacagtgccatttcgagcaacagttgacgtacaaaaatccactacctagtaagtctcatgaaatattatcaatgcggtctctcatgaattacatgcctgtaaatactgtaagagattccaagtaataaatcaaacatttcccgcgccacaacgccaacaaataccaaaagaaaaagtagttttcatgccaaaaatctcctttctcacaactcattatccttctcaaaccaaagaattcttccaccataatttctacaagttgcgaacaggaacaaagagaaatcgagcatatggaatcagaaaacaaaaattcaattctacagatttccagcagcaggatgaaacaggaacccacccgctcgggcgacgaatcaaaatccggccaacccccgcaagaaaccctccacccccacgatcttcctcctcctccaagagcaagcaagcaagccagcctaggatccctaaaaccccagcagcgaagaacccaacggctccccaaccactcccccaacccgagaaggcggcggcggcctcagccagcaaccgcgagcgcggcgcggagctgctcccccctcaaacccgggtcgcggtctgctctgcgagccaaacgaggaggaggacccggccattagccagcccaatcccctcctcctccccctcctcctcaccaccaccaccaaggacttcaagattaaactaatccgccatgccaactgctagcgagcgaattttctattgccccccccgcattcctccgcgactccgccgaagggtgggggtggttgaccgtgccgcggcggcggcaatggagaggaggtggaggcgcacgtgcggcggcggcggcggcggaggagggggtgggaatttggcgcggtggggagggaagtggagacggttgggtggattggcccgtctgtcgtggtgtggtggtggtggtggtggtcaactcaactaatccatgatgagtcgaaggcttgaagcaccatctttctcaaggcaacatccttctcaagagtcaagactattttgcttgatggcagacagccagacagaataatgcaatgataaatatgggaacatctttttaagtaaatttcataaaactacaaatttaaaatcttatatcacaaaactacatgttgaatggagtgtcaaaaaaaaaaaaggttaagtagcaaatatatcacaaaactacagtgctaatttatcatagaactacaacatttatatagctctaatataacgttagtactagggatttagactctagaatttgcggttttgtgataacttcaatattaattatgtagttttgtgataacttcaatatataatatgtagttttatagtaaatttaccgctaaatttatagttttgtgatacgatattttagttttgcgatagattagtcggaatatccgtagttctgtgaaatttacttaactgtttttgttgattgaactgattttggtaaagttcttactaaatttaacatggtttcaaactataccagtgtagattggtcgatatggttgatatgaaacacataaaaatgtaaaatctaagagcgtaagaccggtatatcagatgtaattctacttttttaaatttactgtatacaaattacaaccgtacgtagggagatactcctatatgtgaatattaattctattaccagttttatataaaaaacataatcgtatatgaaatccaatccaattgtactttttatgtagctttgcacggggaaatccactttttcatctttaaacctcgacaactcattttcattagagaaacaattacttacggatgtattgcatcctaaacataatcataacgcttccgcacatcctagcctaaccatttaatggtattttgcggtcaaaataaagcaataataatcgccactaacaattacttaaaaacatagatagtactagtgaaatttttactagacaaactttagacaagtttaaatataatcatatatgtttgcatttaaattcattccaaatccagttgttttaaccaatgaaaaaaatagacgaacaataattaattcatttatagttgacaaataaatccgagtaagaaatgacgtggtccataaaaaagaagatatgatttggtcatgaggccacgagctcgtgggagggatgatgtgggatcatcatctccatcattaaaactagacccctcaagagaattagtggggtgccatgatgggcatttaaaactgatcatgacagcgattttcgccctccatgagagatctagagagggaggggcaatcaagagaagaaagtcatatatgtgcaacccaaagaaataagtagaagtagggggaggcctactacataataacctttaaggtacacatcaaagcttggtcttatctgaaaacaatgtcccttctactttagccacatttagcttgagataacttaacctcgaagattctaattatagcaccagctcagtgcttctccccaaattacagctctgtgttgatcactgccatcatttgttctgagttaacaaaatgttttgacaaaagtagtagtacatctgtagaatttattttggcatatatatatatatataatataatgtgtgtttgtagttttttttttaaaaaaagtagatttcacaaaactacaactatttggtgataactatcaccttgttacaacttcaaccaggtctctcattgcttagagtgaattcggaagagctggctgtggcagcagcagcactgcagctacaggactcagcaagcaagattatgctaggggagctgcagcgccacagcccagctgaaccgaacagacccttaatgtacaactgatgagccgtgaaaaataaataaatgaagcaataaaaataatttatgggtaaaacctttatatgtatgaccttaacatattaaaaggcaatactggacaaatacactacgataaaaaaaactcaaaaccactctaaaattgcgttttaaaattcaaattttgattgtggttgataagctaacaagcaaattatggaattgataattcacaaaattacaacaatagtaaacaattttatcagaaaactacaactttgtacactacatacgacatgtgggcctaaattacaatagcttcaatattccatgtgtgtaataagggctctaaacttatcagacaaataaaactatagttttctataaaacatagttctacacagttctctaaggctgtgttctttcccacattttccaactcgcctctctcgtgttccatacgtacgctttttaaattgataaacggtgtgttttttacaaaagttttctatacaaaagctacttttaaaaaaatcatataaatatattaaaattaagaaaatacgtcgctctgttttgcatgcacgagaggtgaagcctaaatgactaactaaagttgcagcaacatgatagttttgataaaatagttttaatgtcccgaaatttactttaaaaaatggaaccgaatgcttgtgtgcccagcaggcggacgtaatctcctcgctgatgtctcctaggaagccagcacatacgtacagtaacgtacaagacacaatgcatttttgtatgtatgtaataccaaatcaattggagctgctgaaaagaaaaggcgattgctttgctgtcaaagatttgcaatcttgtgcataaacaagcggatgaattgatgcactgttttggctgtacaggacaggagctggaaaagaacagacaacagcttcgctgtcacaggtttttgcatctatggacagacataaatggcacgtacagtagttgtttttcttctcataatcaaatggtacaagttggtcattctttaatcacctgagcaacgagttagctggagcaatgaacgttccaaccttgtgtccaaaattctgattgaaaaaaaaataattagtttcattctgtctgtctggaattgaacagcattggcacaaaaatgatgggctacaggaacttctgaccccaactcaagtaggtgttgttttttgctttcactcaaaatatgctgacctgacattctacttttatcgggtttaaagttcgcctatatcttgattaaatggcactagggtcagacaatttctactgaaggtgaacgaaaatgttgtccatcgctgttatttcggtattgttccactgtggaggcttagaattggaactgcatttccttcgtgtagccaagattctccaggtgttcagccatggctttgttcatgggaggaggtccgcatctcaatatctgaaaggagcaaccatacattgtcacacagatgtcctgcttggtagatggaatacacttcaactattctcttagcaattgtcggttccaagttccagaaggcacgctaccacagaagacatcacaatgtgacacctacctgaatgtcagcagcaggtgccgggcaatgggtttggatcatttccattgacacaaacccaacaccaccattccagatttctggaggctgctcatgaaaacaaagctgatggtgtaaggtgcatggtaggaatttaatgcaagccataatatagtagtattagcagtaagtagtagaagatgggactaccaaagtagacagttcaggcatgaaattattgcacaccacagtacaaagtactagacctcagaacagaaaacaaacctgatttaatacatagtatatcttgaagcgatcgggataggtttcaaccatactatccaattcttcctgcataaatcaaagcgacaagtaaatgagcagcagcaattagcaaacatcagctttcaagcacaacatcgtactacatattgaaccacgttcatcttacagaaactatgcagtagtctcattcagttatcgaaaagcacatatgaagcattacttcaacaatggaaccttacttttctccaacagatctaaagagaaaggactctacatagcaaaacaagctacaatacaaggttgattgtgttcatggttaggccactgagagatagtttgcatatcatctttgactttcaattaaaaagtgggctgttaccagattattaaggaagaagattatcgagacgacatatatggaattctggttatctggtaacaaagtacatgtcctgtatgatattttcaaggtttctgtggtataacctgctaactttgcactacaactagacaaactaccctttattcaaaaaccagacataccagattcttattcttaatatcataagctgaacggatagagcatatagtatccaagtctaataggcacccatgaattgaagcgactttaaatataacaaacaccagtaaggttaatcactggtggagaactacagcaattctttcaacaagatcatacctttagaagaatgtcatcatatgtgacattggcatagattaagtgcactttcgtattgtcacttgggttttcaagaattgctcttgtgacctacagtaagggaggacaatgaattgaagaacacaggtgtctcacatattaaatgccataaaaaaaattggtgttggaaagggtcttacttggaacattggggtaatgcctgatcctccagctaacattccaaatgctcttacttgcccaggttggtatttgaagcgaccctaagtcacagacaaatttatacaggcacaaagatttataaccaagtcagagaaaaaattatacatcacaagaatggccaaatacagcatggaaaatttctgtattacttacaacagaaataaagccataccttaggtcctctcacagataaatagtcaccaactttcatctcatgaaaatgatgagacattcttccttggggatacatcttcaaaatgagaaggaaaaattaggggggaaaccaggaaagggggatgaattgacataattgcatttctgacggactatagctttacattacgcacaaagctagcgagacaagactaacaaattcaaaatggaacatatttgtgaaattttaccttaataacaagctcaaaccgtccaagatcagaatccagcgtagttggagtataaggcttgattacttcctcgccagtagcatcctgccctctgcaagaacaggagataacatttaacacaattctttgtaaaagagaaacaaaagatatgagagaagcaagaagacatatgatataacccccaacctgcaactgatatgttggccaattggaagccccagcacagaagcaggggttggtagagcaaatctgaacttggccacattatgactgatctgcctcttctccacaagcttaaactccttgaagttctcagggtccaagcagcctaatggaacaaatcacagcacaaccattcaggatgagctatgaaccaaagatgatactagcttacttcaagaagacattaacaatcacaaaaccattctctaaatgctgcagaacagatgcaagcaaccgatggctaaggccgaagacatcgctaggtaaatgaccactaaatcagtgtcggtgtatcacagtggtcagtggcagtggaagctgcagcgtcgtcgagtgaagagagatctcgcgggtgcatacccttgggcttcttgctgctgcggaggaggaggaggaggaaggcggcgccggcggccacggcgacgacggccaccgccacggccacggcggtctccgtgctctgcccctgcaggaactccatgccgccaccacctcgtgccacaggtccttcccctcacggctcccgccttcggcagatgcggcggcggcgcggcggcgaggtggaggggagggaggaggtggattggcttctccgccatggctgacgtcacccttgctctcatctccgatcattcatgggccaggccgtgtagtgtgggccgcagtatccggcctggttcacacggacctgtatgggccgggttccggcccatgtatggcccattttaggcccaaaaagtgcaggtggcacgttgacatcggcgagtagaccaccagatcgtcggtccggatttaacatttctttatcttctagaagtaccagcttgtgaatattctatgagaaaaaaatgggatctttctgaggagaaaatttggttctgactaggagaaattagataggtccagttccaaaataagtatagtaagtaggagtactaatcaggtgtaaagtatgacattgacaggcaggtggagtacgtcgtgattaagttacccaattacggtagaggttaattaaccttttggaagcagatttaggttgaccaagtaaaccatatggttgcctttgcccctcttggcatttcaatatttttttaaccttttaattttttgtttttcaaaaagaaactatctaaaaattatttgaacattttaaaaatggcactccatttggcgtaacaaaacatgtgataaacattggacatggcactgctgtcaaggtttagatttagtaataagtttgggatggtttatttttaaaaaatttaaaaggttaaaatattttttaaaaaagaaatcctaacggttcttgtatttgaaacactaagtggtttaaaagaagaaaattgtgctcttttgccccataattgagtgattagtgttcatttgctacacctgggaaatcatcaccaaagccacatgtcatacacatggcatatatgaaaaaaagaagaagtaaacaacatctactcatgtttggccaaattacaaatctccttttaaagaaacgatttttttagacaggatcatttagcaaggcctgaacagtgctgttaacctgcaggaataagcaaaataacatatttgcaaacgaaagtaatttgtgaataaaactttatatgtgttcttagcgatctaagagcaaagctgaaaaataaacttcgataaaaaaaccttaaaattggcttcaaatttaatgttaaaattttaatctttggctgataaatataagtataagcgaaaagataaggccctcgctgcctagctgaaaagtatcacaaataccatcgtcgacagtttcgctgaaaagtatcaaaaacaaaatattttgacaaaatcatttatatctttgacatttcatatcttattatttcgtaaaaaaaagattatagcaagatttttttaataaattgaaaatggcatatagaaattaacacgccaataatacaagggagaagccaacagcatactagtctggtaggtagttttgcttttggatgaaaacgagttcttatcagccaaactccaatttacagatattaaaaaatctcccaagatgatcagcggatttgcgtgatttgtatgcttagtcataacaaaactttattggttggagatttgcgctaggatcatataaaaaaaactttatcttattcaagaacgagagaaaaaaaattggtagtagtacgataacctctagggatggagtaaagtatccagctttgcagccacctgccctctgaacttcttgttcttcgtctcacacttcgcccgaagcaaacgagaacaagacgaccgcctctatccaatccaatatcccagtccaatcgaaaggttagtcacttcttgatttgaattttccttctgcttagtttgatacaaaaggggattctttttattttcgttccagtgttcgaaatcatggagacgatttctatctttccccctttgatcgcttgtatgttaatctagagatttttctctttaaaaaaagaggaaattttggtgggggaagatgagtcctgcgacgaaattatacggggtgcaatggcgtgaatcttgagcagtgccggaatccggtttcttgttcttctaacccccaaaccaaagacttctgctgcgtttttattcctctttcgggggggatagcatcgtgttctctgaaagaattggaatcgagcacctgattcttggagagggaatcttggctcttgatctctgccttccccttcgcaaagatctatctgtcagtgctgtgcctcatcccccccaagtgggtcttttctctgggacagcttgctgcccctgttgatgaagaacccaaaaaaggctaatttatttcgtgtgttggatgcaaagctaacccttgttctttgttcttgatgctgatctgttgtgagatctgtatgccagcaattgtctttgtgaaatccagtcacggatggatgccgtagtgttcatcttgtttcagttcttcttgattaaacttctggcaagatgctggactctctcgtgtagatgataaaaaatgtgtatgtcgtggttgtttgcttgggaatcttacggattattaacttattatggtgcccggttcacagatttgcgttttgatcgtggtgccgtcaaccgaaggatttgcaagatggcagaagctgcaatcacaaggtactggtgccatgaatgcgagcaggccattgaggaggccatggtggatgagatcaagtgcccatcctgtggtggcgggttcgttgaagagatgaccgatgaggagattgagagactgaccaacaggcagccagagccgggtttctcgcaatggaaccctattgagcatccaggagaaacgatggacagcgacgatgaagataatgattt

SEQ ID NO: 43485 - DNA, 27389 bp, Oryza sativa
ttctgcatgttgggacattgatttcgtcttggctctgagaatggcacaccactcatgtgtcatgattggcatattcaggaagtgatggtgttagctaattgccaaccatcagccataaatcaacttcattatttattacaaacaaggcgttacagattcttgtaaaaattcatgagtagggaagtgcagctaagactgagtttttgaagcagttgaagtgttgccgaaatttaaacatgtgggtaaaaagtctacagctctggtagttttacaacgttgttttgatggaatttcttctatatatggagctacttcatgctaagattatgtaaattgtgataatctgccatggctaacactacttatcctttcttcgaaagtgattaaatttcctgagatgttgagatgaacctttgtggactggaataatttgtttttctgcttcatgagatgttctgtttgtctgcttacttgtaacaacagccgcaagtttattaataatctatcatctagcccctggtttattaggcggtttatatataaatgatacgacatcttaggagatcgcatctaaatccggttcaacttttaccatgcagcaatccttaattgaactctggacttggcaatggtccgtggttgtgatcaaaagaaccgagtttagtgtctctgggatcaatgctggctttgcattattcatcctgttattattcgttacgaatgtacgaggtgctcaggcatagtttgatataaattaattggtattggtatgggtattaatttagagaagataatgtagattattttgattcttggatgattggcaagagctcctacctttctttaagctcgtttggtacagagaagtctttgatcatcatgattgagagttttcgggttttcatgtacagagaactctattcatcttttggttgaaagttatgggatccgaactgaactttttttttttcggaatgaccgaaggaggtcatccaatattattaagataaagagaaaatgttacaagaaaagttttacatcgataactggctgtcgaggaaggatgtgcaccagagcacacgtcccgaaccaagtgccaaccgcccaaacacacgccacagagagggaagtcgagcaccgaaccggtcgtcgctatgcgagaccgatcgccaccgagccaacaacactaccacggagcggagactctaaaaaacgacgccctcacgaaggtcgcgacgccgaatgacgccgtcgtcgtccatccaaagactggacaaggttttcacccagaactccttgctgagagaggaggggtacctcaatagtgccctcaggaggattaccactcctgaaagcgtagtcactgttggcccaaagaaacctagtctacatttttagtccaaataagtttgagctgaaagttatacttttggttataactcatcgtaatacatcaaagctacgatgagttataactgagttcagttttccacgtggatcaaagttactcagttttcagcacaaaaactgagtatgtattacgatgagcgagtttttgtgttgaaatttgatccacgtggagtagaaagcgagaaatctcagttcaaataatctacggtaagatttaaaaccaacccatacagaagttgaaacttgggaaggaatgttttctccgaagaaagatatgcaccggaaaaaccaatagggaagttgtgaaaactgaactaattgtaacagcggtactgaggggctctgccgatagtcagaaagctcaaacatatatgggtgtgtttagttcacgccaaaattgaaagtttaattgaaattggaacgatgtgatgaaaaagttggaagtttatatatgtaggaaagttttaatgtgatagaaaagttagaagtttgaagaaaaagtttgtaactaaacaaggcctatatatgttttcacaagaaggcttacccgtcaatatgttagaagaacattcaattttgaaatatgttactgtagttaactataattgttggcagttagaaaactcacatttttacaatagggaatttagctttccaaaagaagaaaaaaaacaagagatagagcctcagctccagctccacatctcctggagctagaacccagccaaacagtttcagctccacctaaaatgagagtggagctggatgaaactctctcacaaaatgaactagagaagtggagctgggtttaggcagctccacaactctactccagacccaactcctgaagttaaatttagaagttggaactctaccaaacaggcccttagctgctttataccactgcaaaaacgaaagcttcaggatttgccccctccaatgcttcatgcaaatgtggctcttaattaggtgcacgtatcaatgggctcctggggattcagatggccggagctcatggtcaaataaagccacgatgaaggcaactgcaaaactgatgatcgtgcgaagcaaaagacagacgcacggccacgcaccaacgcgtcgccaactcgccatccacgaccgcgacgagctgacgatgccattgcatttgcacacgactttcggttagcccagccagacagcttatcagcttcttcagtagatgcgcgcattgacaatgaatgaattgagccgtggagcagaccgggttcggccgatcgccttccaccgtatcccgcaccggggatttgcaccgtcagtcaggtcggcggcaaaagattcggctgcccctctccggcaaccggttcaccagcgcaaaaaaatcatcctgcgaagaagatttgagttgcataagtgtgatactgtttagtttacaagaatgtggtggttttctcagtggatcatatcaaatggtcacttgatcagagatggaatgggaaggcaaagaaagcattccttactgagacctcttgactttgctccaccagcatcatctgggactggaatcctggatggcttgagtccattcttcagttcaattgatgaaaacggctgcaaaaagttgtccataggccacaagctatgctgttaatacaagtacagtgaaacaaatgaggcagaaggactaagcatatgacacaaggttcgatctaattacgactgttgactgatgaaatttctgccacccgtaccaagtgatttgcacatttgcaatgtggcgaaatagcacaaacgaagttttcagcaggtggttggtaacatggagagagtgcacctccaatcctgcgataaaccaggaagcgaaatgtggcacaactgctcacattctaagaggaatatttctcatgacaacgactaatgctaatctgatcattggaatatgaaaaagtgaggaagcccaaaagcactgaccaggagtagaaattccatatgctccaacgatactcccaaggaagaaatatcaaagatgcccccctcattgcctcagtgtaatcttatataaccttagattacgttcaaacaaatctagctactaccacatggcatcagagaacattactacacccgcagtcataaacaaggtaaaacatatagagtgcaaatttggcattagataccatatcaggaatgaatccttcaggtgcttccccaaacccccagtgcccatgaactacaagagcatcacataaccactagaccagactagttgatcaagaaagcatccctgaacagtaactatcactaagcgcaagatagtcgtcgctacgatagtttatttgcacgctcaggcagcatatattctgtgaaagctactgaaagcttctgtgctgcgcaaggaatattgagattaggatgccggcaaggcgcatcagaaaaaagacgagaactgcgcatctaagagcattgatgagaaagaaaattgtattgtgcagggctgcagggcaacttgaagatgaacacagatgccaaggacaacaagaaagaattgatgctgaggagattgcttgagcacaagaatcccttcattcactaagctcatggtgcctggacaaagaacctacatttacaagataagtaacccatgcaactgggatggcttggttccaaccggatttgtactttgctttgtatggtaccaatgaccaatttacaaaggatgatcaagaagattggaaaaggaactcttctcagcaaaaagggtcagaaaattaaaagggtccaatattattgacaattgaaagattctaaaaataaaactgtttccttatttaccacaaaaaattaatagaagaaaaaaaaacatccatcttacataaacaaacaaaaaaaaaagaacaacaagaaactcttatccctttttttctattgacctgatcataataacaattaagagacacctataccctggggtgttgactctgcattgttagctcatacaaacaactcactgcaatcctactgttgaacaggcaaggcatgcttgcagatgcagaggcaactcaattgaagaggttgaaagatagatcagaaagttccaggtcatatgcaacttacaattctagaactgctaccaggatcagtctttacaactgcctgcgctcccacaagtgatgccactttgcaaaagatgatcagcatgggataatgctttagattctctattgataacttctttatatgtcgaaagcacgacagcccaccctccagtacaactacaaacagcaacaacatgtaatatctgttaggtagatacgtcagaaaaataaactatggtaagtagaaagagaaatataacctgtcgtatcatgctccatacccatcacttatcagcactaacacagcagtagatgcaacagctttatgactggtaaaatgagtgtcataaacatcatataacaaagataaaataatctcatatcgcccatctaccctaaatctcatgaggttcttacttccggaaaaagaaacatagcacagtagcatgtaatggtaagcaataccagtggccatcacagaaagctcttaatgggagttaagtgcaacatcaccagtgacagtgaaacaaaaagagagatatattcctgatagttcatttcattgattaaagaacaccattaaattgtgacaggtgaaagctcttactagtggtcccaggtgtcgacatatgccattggcacacttctaatgaggcacctcttcaatcaaccgaatcacagaaaagagcaatggtgcaaaagtacagtaggtgaacacccttaataaattgcatataaggtataaggcaaaatgataacatgtaaagaactctgacagacttggttacaggagagcaacaaaactaagatcagagtatctacagtacaggcatccttaagagccaagcaagaagcgctataattagtattgtgctactgttttagaaacaaacgaagggggaaagggaggggctagacctgcatacatttccaaacagatcacatctagcttttcatgtcgaacttagataagaagcacgatggaacaaactatctgcctctactggcaaaagtactgaaatgatgatagttgtgaaacatatacagaaacatagtacctaagtactgtttctttgactggtgatgattacaatcaaagagatctggttcaaaaggagcttatctcacataaaaagcataagcctcttggtccacagttctctggactgaaatgtgaatatgtaccaatcttaagaaaggacgctgatggaacttatgcttgttcatattccatatgctttaaagtagtaaaggacagaataaaattgacagaatttatgtttatgtaggatgtccttacccacaaggaatctactaccataacattaagtgtcctttttttcatttaaacaaaatatacacataccaagtaccacccagctataaacaactaaacattaaacaggtaaaacaaaacaaaatgcaacagtttcaaaatactaactaaataacaatccatcagctatgatcatagagtactcaaataatttcatctagtgattatctttcacactccaaatagatcagatagcagaatgatatgccagaaagcaacattcaaaacaataatttgttccaattgtgagtccttatcactatagtatatacatactttcagtgatttattcataaaaagcatgaagaggaagagaaaaatggtttattcataaaaagcatgaagaggaagagaaaaggttagtgcatttttaaagactttttttttgttttgggggggggggtggttaatttcagaggtaactataaggacagcaccttatgttagttggcataaaaaatattcgatcattgtttccaagatgctagattctatgttgccccatataaggaacccctcacaacaaactgcttatcaacctgagaagaccaaaagagtatcaatagacctaggcttggagaagagtgctggctttggcactgccaaaagagaagcactcataacagtttcgacgtgtgatagcaaagagaagaaacagactggataacacaagtaagaaaggatagtgtaaatgcttgcctctttatgtttccattcttctaaaagtgtgtattaattttgcagcagatgtatcaccaacatcagggtcggagtgacctcttcactactaggacatcctttccaatggagcggcatctgtttctgcatggaggaaatacacaaggagattctgggctggttctctcaactgacgctaaacctaggttgaaatggacacctgagttgcatcagcgatttgtagatgcagttaatcaattaggtggagcagagagtaagtataagattcttatcttctcaatgcactagaatagctgagttctaacattcattttaatcactcagaagctactccaaaaacagtcatgaggctcatgggcattccaggactcaccttataccatctgaaaagccatcttcaggtacctgacaaccaggaatcttccatttaaaatagtactaaaaaatttcagtgcaattcataatttcttgaatgtttcagaaatacaggctcagtaagaatctccaaggtcaagctaatgttgggacaacaaagaatggtaaaaacaagtttaatttccattgttaccactacaatagccacatagcaactcatggatgatgacaatttgcagcccttggatgtacaggtgttgctgataggattcctggaacaagtgcattagcgatggccagtgcaagcgccattccacaggcagagaagtaagaaatttcccatgtactttataattgtaatccatctgaatagtgaagtaatagtcccttttattgggtgcaagaactattcaaatcggtgaagcactacagatgcaaattgaggtgcagaggcagctaaatgaacaacttgaggtgaggtactgaccctgtttgcataataagatcttaacccacgataggcccatagagtagatggacatgacataagataaaaaaaaattcgagcatccagtcagcatgcccacataccaactaagagcataagaaaactgctatgaatgctgtatcatcttttttgtatccttcacaacagtgattcccaccaggaatgacccccaagataactttctccctctagtaaaagttaagcgatgttcagaatacatccagccaaacctttagaattcggtaccagtatctttatgaataagattggacatatgtaattgatcgggtagatctaccccaaaaattcctttcataacactattttctaactatattctcaaatcattgtacaatagaatagacagtattatgtaaagattagagaacttggatactctcctccagtttggcagcaaactatttttagaaaacagctaagattaatataatgcatatagtatcaacaatatgaattggctcaatggttctaacctgaagctaatttggtatcaggtacaacggcatctacagctgcggatagaagcccaagggaagtatctgcaggcagttcttgagcaagctcaagagacccttgggaagcagaacttgggccctgcaagcctggaagatgcaaaaataaaaatatcagaactggtctcacaagtttcaaatgaatgtctcagcaacgcagttacagaaataagagaaagttcaagtatacacagactagagccaaggcaaatccagtttgttgaaagttcagccaataactgtttgactgcagctgaaggattcaaggagcataggctacaaaaccacggggtactcaaagcatatgatgatagtacattattttgccgaaaacagtcccaagatcaagaatctcaatattcccttaacagaagcttaagtgagcgtagaatgggtcatctgtatagcggtaaacagtatcacaaatcagagggaagtgacagtgatacagaggttctacatgagtatatcacgcctcaaaagaatggcggaggcagcacaaccagttcaacatcaggaagcaaagaaataaatgtagagaagctatatcttgatgaaccaagctgcaaaagacaaacagttgactatcaaagagaaagcaagctactagattttgatcaacaaagttcagggaagaatcttgatctaaatactcacaatatagatgataacgatcaaggttatagacattttgacttgaacggcttcagctggagttgattagctgacaatatgtaatacaatcaaggagaagaaatgagcttacaaataatttcttccaaagttataactactttaattctgtaaatacattatgtaggccgggaaagattgtagctatctagagttgtaccataggttataaataattcaatgatgtatgaacaagctattgcaaatgttgagttgtaccacaggataactaacggaagacagcatattaattatggcactctcaatatgaatacaacggaaagcacgcggatatattagagaacagaaatgcaacaagataagcatagaaaagtacaattaacaaactgagaaatacccattcacataaaagaggcagatttgatgatgtgccactcttcagattgaagcttgccaccccatggcaattacatgtggggtcctctgagtcaatgatgtgtgcgccaagatggcaaatcatcataacagaaatctaaagagtggaaaattatcaaatctcaccagaacctaagcagtaagggggggaaaacaccagaaaccttaccgtctaaataacaccatcacctcaatttaataacataacgtagaagttattcatgccaccatgaagctgacatttcaggtttagtggtcagcaccaacatatcaggtttagagcttagtgctgcttgaaacaaaaaagaatgaaaaaaggacaaaagggaataactcatatattggtggactattgcaaatactgttagcaaacatttttcaaaatgtaagtgcaacagcaatgggattgcttcctccagaaaaccatccatgttacatagtactccatagcacaaataacagccagagtataaattgacaggtctggtcatcaacaaggtatatacgagttatcagatagaagtctatccaccacgcttatttatatacccaagaggaaatggccacttattgcataataatccaattaacagctgccaaccaaggagcaggctacttttgatttggcgaccgatcataataagttcataagacatgtatctaccacttttatttctctccttatgctcaattatactagctacaagagcagagcactgtgatagtattgctatgtatgtaacagcaagttcttatgatgaagcagtaacagcaatagccaaacagttcatggccatgggagtaagcggctgcctacttcttgatccggcgcaccttcttggcgccccagacctccatcctccccttggggcacccgcacggcgagcggaagatgagcacggtgcggccgttgggcggcgccatcttcctgagctccgcctcgagctcgcggtgcgcgtcgccgagctggacggggcgcgccccggcggccgcgagaagcgcggcgcgtcccccggggagcgggagcaggcgctgctgctggccgcggacgcactcttccgtctcgagctggatgtcgaactccaccgccttgcgcagcccctggcaccggggcttcctgcacctccgcgcccggtgccccacggcgtcccacgccaccacacccgccacggccgcgatcgccgccccggcgcccgccgcggcgaacggcgcgtagtatgacgacgccacccccgccgcgtcgaggtcggacaccaggcccccgacctcggccgccaccatcctgacgtagggcgtgacgaggaacgcgagcgcggagacgacggccagcagcgccaccgcgtcgaccgccgccatcgcggagtggtcgcagagggacgtgaacagcctccgcctccccctccgcggcgacgaccgcggcgggggcgggcgggcgcggtgccgcaggcggcggagtccgtggaggcggcggcggcgtggtggcggtggcggtgctcgaaggcgcggaggaactcgatgaggctgcggcaatccgccatggcgaggaggaggaggggagggcgtggcggcctggcgggtggtatcgaattgggaattggggtggaggaatcgatcggtatcttgatcagatgggtcggtgggtggtgtggggtggtccggtgcccgcctgcgaccgcgagccggtcggtcggtcggtcggttgggatgggggtgcgggccgcgtgcgtggtgggtttcacgttggtcgcctcatattttcggttaaatgaagtactccatcaatatgaattaaaacaaggcatgatttcattttttttctttgttacattttggatgattggatggaagtgtttgggcaaaatctccacccaaaaccgctaaactgtttgtatgtcgaatgcaggctggtagcagataacatgtcctgagtgtgcggtctaatgcttcaaagcaatacttatgattaacatgagattcatcccaaacaatgagagatgtttttgcatcatgtaacatcctcaaattttaaactaaaattaactgcatcatgctggcttttgattaaatttgtttggttcaaaaatctatttgattttttatttaaaattggttcaagtattagagcccaaccaatttactctaacttattccctttattctaaaccctagtgaatttgagcaatttctctcaaattcaaaccatagattatttccttagcttatcccaatattagtggagatttactatactctaaaccctagtgaaacctttccaaactcttagtttgaattcaaatcttttctagggaaatattcaaaaattctgatttttactgttcattacactcaaggtgctcgacaaaatgcccagcccaactagagcagcccaccttcaacccaatcttgtgcaaagtctaggtttggtcctaggggatcacaacccactcaaaaaccgtggtttagttggccttctcctccccttcacgcgcgctctctggcagccgaccttgccgcgcgctgagccgccgcgcgttgatctcgggatcgatcgcgcgtgcccgaccgccttggcgcaccgtcgcccgtccgacgccctcagcccaccgccgccgcaccaatctcgacgatgacaaagccgggacgacgaccgccgcacgaaatcaccgcttgacgccgtgcgcacccgtccaagccgccaccgagtgcgatttcgcttctacccggggtgaatcgcgccaattcttgccgcacggttggattggagatagacggtggtatcccctctcacaattcaaaccattcacccctgagccggccgttttcaccctcgccgccgccgcgcgtcgcgctcggattggcgccaacacgtcgccagccgaatcaacacgcggtcaagccaatccttcgccggtaagtattcaaacgtggcctcccgccactcaaatcgatctttcccgccctctctcagcctctgccacctttgcctcatccaaatcccgagctcatccatggcgataacggtgcccgagctcatccgctcctcctagccctataaataggaccccaatcccttccctgtccatcatcgatcatcaacaaccatagccccataatcccgaagctctgcttcaccaatccatctcatcaaccaccctcgcccgtcggtcgaacactttgtgcgtgatcgactccacccctctccatccatcctccgccctaaataacacttagaacacctatatcataccatgttctagtatactaagccctaaccaaagccctacgtcgagttttacctcgccgcaccaagccgagcactgccgcccctgcgctgctctgttcttcgccgccgcgaagtttttccggccgcaatccgtcgtttcaaccgatctcggtgagttcttccatttcaaccatttacatactacctagattccatttgagcaatccctttgcactatcatgtcaccctctgagctgccgacgtgagcacggccgccgcctatgtaggcgctcgtcggcaactatgttccgcaccttgccaaaggttggcaagctgccgaaatccctctagataccccgtagatgctctagaacccctcccctaaccatgtctaactctcatcactccggtcaccatcacaacctaaccgtgccaccgccgccctagccgctaggccgtccacgcatcaaattaactcctctgccaccgctcgccgccgccggagatccctagctccctcccctcctcggccacaaccactttctccctctagcgccaccgcagtcgccaaccctagcgccgccggcttgaaatggggaacggctggaggtagaagaagagaagagagagagactgatagatgggacccacacacagtaccatttcacttttattcgattttcaaactttagaagcccatatcttttaaaatatagatccaatttcagtaaaacttggaccaatattcttctaaaatcatcctctatctattgggcccctttttgctatttttgcattttatttaaactcctttttgaatttgaattttatatgtctaaccctaggtcttgaggattcctctgacactctagataatatcaatcaatctcaggacatcgagcaaggcaagttaccatatacctgttgatcatttaagcctatattttacaaattatttatttatttatagccttctattcaatattctattttctatgcataaattaatcatagaaacccaaataatttagtattgcttattttgcttacaatctggttaaaataccctatacttagattgggacaatacgtaagatttggatgatttccgggtggctagtattgtctcaatcgatataagttttaccaggtacttatgtcgaacgaatgggtacgaccgcagtttctagaatggggacagacctagttattatgttaattagcaatatggcacctctgtatagtggttcttatttttaagtcctcgcgcaggaggcaactatagccgcgaagggcaactttaaccattaccatgtacaggtaaatggtttgtgatactcgggtataaactatatggtatatttctaaaccctgatcgagatgatgtggtgtcatacgatcagttccccttaaatacctcgggaacgccagaactcctcttgctgctgttaacattacgttcagagcatatgaggatataagttcatggaataagtgccataattgttattgacttaatactgagccatgactaaagccgatgattatcagcaagtcatggactgcgggtaaagcgtacatctgctgcagtagaatatctttgaaactattcgaatagccgtactcatggagttgagtaccgggactcatatggtaccttggttagaaatctaaagtttatatgttttataaattctgctataacttttccagattgtccaataccgctttttgcaaagaaccctattatatgtcaatgcataacatatttccatgataatttgctgagtattgtgaatactcatccttgctcttataacccctttttcagatctgggtcaagaggaggacccttataactattactacgaagaccctgataatttagaaaatccctaaaggttatacctcactagttagaatgtatagaaacttccgctgtatattaattagcttaggtgagtacctattattgtaaaacccttagtattgtaagactttaacgtatgcaatgaagaaccagttatattgtatgtatcaatttttactgatccagggattgatacattaatctcagtcggatccaagttgttagttttgggctccgacaggactggtatcagagcatatgtttgactataggatgaaccttaaggactattaactaagctaagtttgaatttatttcaagcttaccttttaaggggggtagatttaatccacgagcatgtattataatatcatttgtgtatttcaggataatggcagaagagcatgagcaagaactcatagaaactgcaattactatccatgataatgagtgcactgatcaactaatcaatttgatgactaaactgaagataaatgagaagccggaattctattcacatgcttatcaacggggagaacgttgggaatatgatatgaccgtaaagatcaatcctccacgaggtgaacgtgatatgtattacttccgaacacgtcataggcgggataccgtgcaagctgcactatatgatgtgtccagggaggcttttctacgtctcaatcatatttaccaagacaggttgcaacactctcagctattcttatcatcctatgcgagagccgggcgaagactattgcaccctccagaatgtggattatcatgaacaaccagtaaaagcaactatgtctatctggatggaagccgcggatgacatgtatgaagaagctctggaacatatggacgtacaacgtaaacgtcttgaagaagctgaatgcagagaaaatgttcttaaacacaaatatcgtatacttcatgaattatatgaggaaagagaaaaacaaaattctatcctcaatatttgtgttgcaggagcagccttttgtcttcatcaaatcccaaatatggtagtgatgacgatgatgatgatgatgatgatgatggtatagaaggacatatctcaccagtacgtgaaggtgaaccagatgggccaaatcctcatgataatggtgagggagttttacaatgtttaccaccatcaccaccaccgttgtatcctattcattctgatgatgaagcagaagaaatgcattcagctatggatatcagtgagcctagtcaagaaccagaaatactaaggccaaatcgggtgtttcatatcaatgagttaaatactgccccaatctggactgaatctccagaggaagaggaagatccggaagaacgagagcttgagacacaagaacatctttctatacatactaatgatcaagaaaataatgaagacccttactcatgctctgctcccaatattactgcatcaacttctgcatctcctcatgaattttcacacttcgcacctgcatcattgtttactaatcccgcagaaggcagtggtggatggctagataaatagaagttatagatagttagaggtcttaagtgtagaatagatagttatcctactcctctctaacttctatgtgtgattacctctttctttgtggttatggttttctttggtttgtttctttgtagcatacatcatgtacaacttgtccataaataaaagctatgtttaattatggatgttgactcccctttgagaagatatcaattaccccattttctagatgagtatgggcaatggcagtacgggtgaaagagaaacaggagaaatcccttcaccaaatcctaccactttggcagaagtaatggcaagacaaactcaattattacaagccatagcacaaaatcaaggaagtaaaggttacagcgcacatgcagaatttatgagaattaaaccaccagtcttttctaaatctgaagaacctatggatgctgaagactggctaagggctattgaaaagaaattaaccttggtccgaacaagcgaacaagagaaggtaacctttgcaacccatcaactagaaggaccagccaatgagtggtgggaagcatatcaagcttctatagaagatcctacacatattattacatggatggaatttactacagcttttagagatgcttttatacctacagctgtgattagaatgaaaaagaatgaatttcgaagattgaggcaaggctttatgacagtacaagaatatttgaataaatttacgcaacttgctcaatatgctgcctctgatattcaagatgaaaaggaaaagattgaaaggtttatagaaggactacgtgatgaacttcgaggaccaatgattagtcaagatcatgaaaattttcaaagcctagtcaataaagtggttaggctagaaaatgatcgtagaatggtcgaaggacttcgtaagagaagaatgaatttacaacgacaatcaccaactaggggttcactacaagttcggaggccttatctatttaagccatctttacccaatgcaagaccaggcatgccaccaatactaccaagacctggattaaaaatggaagactctccatgttatgtttgtgggaaaattggacattttgcaagactttgccctaatcgtcaaaatatgggtggccaaacttcttatcagaaaccatctgctacaggttttataaagaaaaatcctccaattattaagagtggacctaatcttggacgtggtcaagtacatcatattaaagcagaagaagcgcaacaagatcctaatatattgatgggtatgttcaccataaactctaaaccagttactgttttatttgattctggtgcctctcattcctttttatctgcaaaagccagttgaaatcagtctttacctaaagataatttagataaagctatgctaatacattcacctggaggaactgtattagtatcatctatttgtagaaatgttccgattaaattaggagatcaagtatttttaatcgatttgatgatactacctacccaaaccatagatattattctgggaatgaggcgtgtggccacctggaagtaacaaggatacaattcccgatgatgcaacagtcaatgctatcttgccttgccttcttatagaatcgtgcgcgagggatgggggaagcagcatggcgagggggaggcgaccgcgaccacgtcttcggtcatttcattgtttgaaaagtaaagactgaatttcaatgtaaaaatgtcaggatagacaaattcggtctcggtctcggtcctgaccgaaattcaacaacattttcatatttgcaaagaaataatggaaattttcaacacaaaaatcaccaaaaaaaatcgtgaacacgtagaagtaaagactcttattatgttgcatgcctagaagaagtagggaagtgaaaattagagtttaatcctattgaacttagtggattgtagattgcatttagacatttttttaattcggtcatttggtctattcgattaaccgagtaaactaagtgaattttgaccgaacaaaatttggtctttcattacataggaccaaattaatgattgaatttctcagtgtcggttttttcggttcggtctttttctacctaccctaccagcggcggcggctgtgagtgatgcgatccagatggggaaggagaaaaaaccctagaaagagacatgggctgactcgtgtgcgccgctcagatcagatcgaatggttgaggattagacagtgacgtggcttagttcctaagagcaggtataagccacctataaccacgtatcgagaagaaaaaataagagagagaaaaaagcgggctgcagatttgtagccagctgtagcacggacttcaatacattacgtgtgtatgggaccgggtattaatagtgtagtatatttttatagttaactattgtatgaatgggctattagattaggccagtcccaacccaagacactagacatagtttctataaactccacatcattaagaaactagtactagacactactctttcatcaatgcaaacaccactcttccatacttaaatttaatgctacttatctcacatgatgtcttgtatgttgtgtagaaaccatgtcttatgcaagacctgatttccttcgctttcctcatttattcatttaccacatcatctttcatcttaggtggtagtttatttaatgctatggacaccatcctaatcattgggttggggttgggaatggccttagagcaagtttaatagtatagccaactactagctccaattcatatatatccaatctaatagcttattcatacaatagttacacactacactattaatacatggtcccacctgtcatacacacacttcatctttgcagttcgtgctacagctggctacaaatctgtagcccgctgcttctctctctcctcatttattttcttaaaatatgtttacagctagcttatagcctgctattgtacctgctcttagctatagatgatttggagccagtagttggctatactattaaacttgctctaatagggatccaggcgattaaattactaatggcgatcccggcgattaaggccctgtttgtttcagcttaagattattgtaatctagattatagaactagattactataagctggattataataagccaacatagaataagttgctagctgtttgtttctctggattattatctgtttgttagttgttagccacccaataatctaaaaaaacacatttatagtggcttaccagattatattaatctggcttatctataactaatataaatattcgtatttttccggtcgtcacctcataggtgcagtgatttttcgtccccctcgcctccccccaaatcccagttggaattccatcaccaccacccaaaaaaaaatcctaatcggaattcaatcaatcacacaaataaaataaaatcggaggaagtattatacacacaaatatatccaaaaaaaaatcgaaggggaagtcgccgtcgaaccgccgccgttgtcatagggacgccaggccgccgcagctcccctcccgctggatccgacagaggggaggggcgccaccgccgttgggatgctggcgagccgccgacgcctccccgggcgccgccgccggtggtgggggaggacgtcgccgcgctgccggtggtgagggaggacacggccgcaccgccggtgatgggggagccgtcgtcgccgctggcggggggagggcaccgccgctgccgcttgggctcggtgagagaggcgccgtcgccgccgccgctgctcgaggggagggcgccgccgccgccgcttgggctcggggggagaggcgccaccgccgccgcagtcgccaccgctcgcgggaggaggggcgccgtcgccgctgctcgtggggtaccaccgccgccgccgctcagaggcgctgaggggagggcggcgaagagagagataggtgggaaggaaatgggctagggtttctgatgcgaacccgctagggtttgtggcccgatctttcgatgagaggtaagggataactcgattagatgaagtcgacgttcacggcccgactacaactgtccaaagacgctgcgccttagcaaccgatacaccgtctccaatggtcgccgcgaacttgtggtgcgcgtcaacccggccacgagggcactcgtcctgcaagcaatcgaagaacaagcaagaacaagtaggacaagcgctgagattgctagataaagatgaaagtttcactatcaaacacaatatggtggggttccgattacaggcagacgggcggtttagccaacacgcgcgctgcgagccggtagcaagaagctatctctatcatcaaaacctgcctgttcttggcggcgactagaggtataaaaagaggggaagaacgaccatagggtcgtgctccaaccctaggacgcgcccctaatgggcccaacatggatacacagcccattgggccaaaagaggtgacgcagcaccatggacaaaaaatagtcgggagtaaaatgacaattgcggccgctccagaacagatatggacatgtggctggatccatttgaaaatagacttgataagctttccatgaagtacttgcacgcccaaatcggagttcgcatgaagtcgtggcggccgtcagaagttggcgctgccctgcagtccgaatccaccccgcgcgaatcctcttccctttggatcctctccatcgttcctgagtaaaacacgagtgcacgcgtctccgaggtataaagacgaggaatatgaactcaagaaagaactcacctgataatttagttgacgtgcacgaacgtgggtaataggaccatcatgctgtatatggggggacgtggatgtatcgatggtgttgatgtcctcatcagtttcggcggctgagggggttttgtttccccgatctcgaggcttggccgtccgatcaaaaccctagagatcggacggacagcgtcgaccgggccgatttcggcccgaaatgggatcgagagcgaggccacttttccggcccaagccaaggttgcggcctggggaggggaagtgcacccgcgcatgcgcaaaaggccgtgggccgaccggcaagggtctggaagaagtctattttaggtccctctagccgaagaaaaagcagaagtagttcatttttagtgcttctttttttagaagcatttacaattatagttattgaatgtgtttatttcgaatcaaacctaaaagaaaggattttctttctttttccaattaaacaatttgttaaatgatgtttgtattattaaaattagcaattaagttatgaaaattccaataaaattctaaagagtgtgactaatcatggagaatttaataaaattaaatttaaccatgttattttatttctcgcatttgctttacttgtaaatttatttaattatacacatacctacttaaaaataccaaaaatttcaacgaatttgtattttaaataattgcatattttttgatctgtacgcttcccgttgtaacgcacggacacttttactagtatattatattaatctatcataataagctatatgtttgtttcaacttacttctaataatccaaattataataattctaagctgaatcaatcagaacctaaattcatttccttgcttggtacggagtataaacctcgatattagcggggctcataaattattttcctggttattacttattagcgcctaacgcttcggataatggagcgtcgtaaattattttttctgattattagcgcttattaagaaaccctaatagatagctataaaaacccactcttctctcccaccgttccagccgccagcgaccgtccgccaggctcattcccgacgatgccggagcgcttcgatcctgccggccgccggcgcaggggcattctcccgccgcccgtcggcgcaggggcatcgacgggcctccgacgccggcctcctgacgtccatatcgccggcacaggcgcatcggcggaacggtcggagcccgcgctgtcgcctcctgaccgacagatcgaggtccgaccgccggcgtccgacgtctcatcggtgtgccggcacaggcgcatcgacggaacggtcggagcccgcgccgtcgcctcctgaccgacatggtaaaataacattatggccttgtttgtgatgcaagcatgacacaatttctcattgttagttgataaagggattgaattgaggcgctataaatgttaatttcaatgttcaatgatatacgacttaattaactagttttgtggtatgaataggatagatagtcccattttgtatgttttgttaatcttatttatatatttttgtttatataggtggtcttaacactccagaaaattgtgctataattcaaggtagagctaacagaaattgtgctataattcaaagtagagctaacagaagggatgatattctagacgagatggaagttgctgctttagcttctagaatcaattggacaggtatgcattttatattgatgaaattctggatgagatggaagttgctgctttatcttgtagaattaattggacaggtatgcattttatattgatgaaatctgaactaattataaatttacatttcattattttttttgtttatttagagtatcagttagcttcaattgaagctgctgcgattggtaacataattagggatggaaaggtcattgaaattgctccaaactcgaaaggaggacctctacaggatgtgctgagaagtttgcttgaaaagtaagtgtatttactaaacttgtttcatacatatttaacagaataacaaatttgtagtgctttttagctgatttttttctgcagttatatgatcactattcgttggtcacagattgcaatgttgttgatgtgttatccactaacaattgtgcttttgctcatatttatgtcctcagaaatgaattgatgataaataaactgtgtgatgaggatgctccactggaaagtaccgcttcaaggtagttatttttagatctactgcatctcatttgatttcgtgatgttttaaacatcagcatttgatgcaattctccttagatataggagatcctttactgactattttgtgatgatttaaacatctagtgtcattttgtagctcttcctttaaatttttctctcaccgctgtgcaggccgctctcaggcttctttttcaacacattatgtaaggagcctgggtatctcgcatttgacaccatacgctgcggcaagcttctttaccctgagtcacgctttgctgcattaccagagcccgtatctttccttgcatccacgcgtggccttgtctgcgtctgtggaaagacaacaggcttgtactatgtaaccaacacgaccaccttcaagtgggttcagctaccacgccacagttgtgatcatggagaaccagcagttgtcatcacattcgaggaacccctgacatcctgcttcgacggtgctgttgagcattatcatgtcgtcgctgccttccacctcaagggcagcgtctggacatctgagtcatactcctccaggactgggaggtggactattgctaaagatgcccctcctgctgtggaggtgaaggcggagtctggtgttggtacactgggctgcgccttctggcgcacttcccttgggtctatcctctgctatgacccggggaaggacctccttaaagtcatccctgcccctcgagtggtaaaccaagataccgtatgggagcttgggcaaatggagggagatcttactgtgacctgcttcaaggatgttgacggtttcctcacattgggcgtgcttaaaataaacaagcgactgtttgatgataaggttgctgcactctggacagttgtcggctcattctccggggagaaggttggcaaaagggctatgttgctccgctcacaaggcgccgcagaggtcgttgtctgggaacccttggaggagcgcgtcgtcgccatggaccttgaaggcctcgttactggcaactttgggcccctaaccaatgaagggtgtactccatgttttgttccttacgttccatcgtctgtgagtatttgaaggactgacgatgatcaggaataaaccagatgtgattagcatacaattgtatagtataagaaatacacctccatgttacgtttttgagctggctggcaggaccaaccctacctgatatgagattttaccatgttaggtttttatgcttgctggcaggcccaaccaacctgacatgacatttaccacgttaggtttttatgcttgctgccaggcccaaccaacctgacatttcggctggactatgcattcttttttcttgtcttaacccattcattcagcacttttacttgttcttccattctttctgtaggagtactttttaccatgttcctgttgttttctttgctttttctggaataaactacccagtaattttctgtcatgtaattgtaattgtttgcgtgcatgtcttaatacggcaagctaatcacatctcgtctctgacaagttatgctagatcctccgtggcaaaatttgggagttcagtgtgttcttttttgtcaaagttcctcactcaatgtatgctggtttattataacggtcacgcggaataaggtgtgtctagttcgtttgaaaaaaaagttaaaagtttacgtgtgtagaaaagttttggatgtgatgtgatgtgatgaaaagttaggggcatttgggatgtaactaaacacggccataagaatgacacttcataggcagtccccctgcaaccctcgagaaaggtggcaaaggggcctatagccaggtaaagagcaagtataactattggcttcacctagcagtccacgtaatcatagatcaatgtgttaatttataagcattaagcagaaacatcgcaagaccaagtttagacaccgatttgcctttccaagttcctgccaactgtaataaaataattactttattgcctcattttcagcaccaaagttaaattcagtaaagttagattcgataaagcgaagtatataagagcaggtacaatagcaggctataagccaactgcaaacatattttaagaagataaattaggagagaggagagcagcgggcaaacatattttaagaagataaattaggagagaggagagcagcgggctacagatttgtagccagctgtagcacggactccaaaacgcaacgtgtctatgacaggtgggactaggtattaatagtgtagtatataactattgtatgaatgagctattaaattggctatagataaattggagctagtagttggctatattattgaacttgctctaatggcaaacataacctggggtatgcattttttaaacactgaaatacatgacacatggatcaagctgtcagtgaacatgcctctcatcagaataacttttaggatatggagacatgcaaaagtcttagatgctgcaacattactcttcagtttgctggagttatcaactgtttattgcagacagtaagagaataataagagcttaattgttccaaacaaaaaagaaaaagaaaaacttttattcataaacttgaaactgaccttcaaactctccatgcacagcaataacgacctgtcaccagtaaaataaacaggaaatccaatctagcgcacaatggtctgtttcagcaattttcaagttttatatgatctatatttgcacccacttcacaagttgttcttgtggcggcaattcagtctttacttaaaaacaaaatgaaccaaacaacaatgtgttcatctgaagtccaaacggccagactaaaatggatttacatctcgatgaggtctacaaatccacggtctccaatcgctcgtccatccgagctacggttcaaacaatcaacctttcagtccctactcaaagcgcccagtcaatgccaagcacacatgtagtaacataggctagctcaccaatccatggtgtttatatatacaatatgccatacaaggcaaatggttgcatcgagaaaatagtacaagtacaacagaccagttactgaccatttatacaacagaccaattaaagttgagacttaagagagagtatgctcaaagttaatgcctctaactatattatttgtttttgttttgtgggcttattctcctatactggttatgttattttctttgtacacaagcatatatatatatatattccttcttttggtctatatgaattgaatctagttgatgtgcacaaatctagatcagaaagaatgtgtcttgttgtcctggattatatgttcgtttatatatacaacttgatgaagttctttacattgcaaaagaatcataggaaagagtctgaacattgaagttattcaggatatattacaaaattttgtctagatttctgcatttaacatggtgccttgaggcagcgcaactactgtacatgtaactagagatcaaggctgcgcacctagagcttgctcattgggttgccaaacaatgcaagcaccaaacaagtaggttgcaaaaatattttctagataaactgaattaacagccacatgatcaatctaagtaatttttcacataggtagttaacagccgttcgtttgtccaatgtgccaactaatccaaataacaaattttagttccatcactggatatatattcaagtaagattcatgtgttattagttaataaaggtcctaccactggatataattgatattgtatacatcaatgaacgaacaatgagtaaatgataacggttaaactgttgaattttttgagacataacaatatatactaacctttagtttcgtcataataaatgctcaacaaattaatgtgcacaaacagctgcatacattaccagaatcatcacacttgatcttggtctgctagaaaacttgtgcttgtaaaccaaaaaggctaaaaaaaaaaaaagacacgcacacactcccatacgtggaaccatatgcaagatatcatgacctcttagataattaagtagatggtacacaagcataacttagggtgtgtttgaggagaaggggattgaggagattagaaagatacgtaaaacgaggtaagccattaactcatgattaattgagtattaactattttaaattttaaaaatggattaatatgattttttaaagcaactttcatatagaaaatttttgcaaaaaaccacaacgtttagtagtttgggaagcgtgcgtgcggaaaacgatgtgcattctcactccctatcacccaaacgaacgcatccttagtaagaaacacggaacgtcaaaggactactagttattacagtgaagtgatttggggagcaaactgctcttactgcagtaacatgtggagtgatgcaggacacaccagcggcagatggttttccatcaaaatttccgccaatattcagtaagtggctcccccccatcgtcgtattcgcctaactctttttgtaggtaccaagagtcgacaggtagtcctaaatccctatcctttttggcgcgagctaattcctttacgtctttatgaagatactggttccagcaatatgttctctttgcattgaacttgaatatacggaagcggcgaaccatctgagcatgatcatacttcctgttgtatgacttgcaatagcgctcaaataaggcccacacggcttcgtccgactcaaggtcctcttttgtcacgcactttccatcatctatatatcacaaacaa

SEQ ID NO: 43486 - DNA, 2499 bp, Oryza sativa
attgaatgaatttaatacagaccagagatggatgtattcctcctaaatcctaatccccctgcctgcctatctagactatgctaaattggagagctgcaccatgaggacagggagggatcagggagggattggttatgatttacctggaggttcactgctgtagcggaaggagaggcgggcagcgtcgtccagtgggggacgaggcttcaagcgggcggcgcgagatgcggccgccgcagctaagcgggcggcgcgagatgcggccgccgcagctaagccggcggagcgagatgcggccgccgcgtcatggcgcgccaccgcagctaagcgggcggcgcgagatgtggccgccgcttgacgggcgaccgccgtcacgagcttcgacgccattgttagggttcttcggtcgggctttgtctgttgcacatctcaaacaaaatatcgatgatagtagtgtgtatgctgcgtttttcccccttttttgagtttttttatgttgagtatttttgcaaaaaaaaactcctcgcttttcacggaatatcgtatatatcctcgaaccgactgacaccctgttatgttttatttggaaaacccctcggtttgaatagaaatacaatacaaatgccaagtttagttccaaactatttctttaaactttcaacttttccatcacatcaaaacttttctacacataaactttcaacttttccataacatcgttccaatttcaaccaaatttacaattttagcgtgaactaaacacacccgatgaaaagaaaattctgtttataggggtagtgctataaacatgaaaaagacacgggctttcatgaaaagcagtcatatctacctcaaaggcccaagggttaattggatccatgccactgcatattaaaaaaataccactactatttgcgatatcggctatgtgccactggaatttggggaaattggaactatgccaattccgtccagttttttgtcaacctccgtcatctctctccctcttcctttcttcggttcaggagcagaaagcaagcgcgccgggaggaggttggtagctgcagcaacgagtgttggggatggcggtgcggcggtgggcggggtggcgaccggcgcgggggcgatggccggggacctcgcccggggagtgggcgacgacgatactggcgcagtcctgcccgccggctccgagacgaggcgctccatattcagctgggatgacaagttcgtcaaagcgcaagcattggtcaccaaggcactaaaacctatcctccttctgattcgttcttgttcatgtgaatccaaatttctgcttaatttggattgtggatgttaacattatacaattaatcttgtattcctgccgctttcctccaagggaagctcccggccgatggtagtcacaccgagatgaagaccaacctagaccagttcatctgcaacctcatgcagcactccggcggcaatcgaaagatggggcagagaacgaagatgtacactcgataagagcaatcgaaaacaacacatatcgtattaatagttcattcgcataattgccttaatctgttgggtgtttacaccttgttatacattttaatgtcccatgactactataaggaggtaagtaggtctagaggttgtggggtgacacgtgtcgtagctgagtcggtcgacccaccctgcctaatgggtagatccgcccttgacgtgaccctggcgtccctcgtcctcgctgtgcacgtcgaccacctgatggcgacgagggcggcctcgctccagtgcgatggcggcggcggccgccggcgcagttcactgcgtccgctcggtcacaggtggactacatcctcggcgcttgacgacgacgacgacgcaggcgcagccggacctccctcatacgatgatgacgacacctcctgttgcatctacggtggaggagagagaggaaggggaaagagaagagaggggagggatgtggggcccacgtgcagtttggggctaacggggatttttgatggaaaatgtgatgtagtggcatggttccaattttcctagatttcagtagtacgtagccgatatgacgaataagagtggcattattttgatatgccatatttgcacttttgcagtggcatggatccaattaaccaaggcccaaaccctacccggccgtctccccatctcctccccaccgcgccccgcaccggcggcggggacctgtctccgccgttcgtcctccccacgatgccgtcgtccgctctccccccgccgccaccttccgccctccccctgccgcctccgtgcgccatcccaccgccgccgccgtcgacgacgaccctcctcccctccctctccctcctgcccgtcggagctcggcgccccctcccccttgtactctctcccttgtggcggcgtctgtgcctgcggcggtgtcggagtcggcgccggttcacccctattccactcatctcgttgcgtagttcgacccggcgctagctt

SEQ ID NO: 43487 - DNA, 716 bp, Oryza sativa
ccccacgtggagtagaaagcgagaaatctcagttcaaataatctacggtaagatttaaaaccaacccatacagaagttgaaacttgggaaggaatgttttctccgaagaaagatatgcaccggaaaaaccaatagggaagttgtgaaaactgaactaattgtaacagcggtactgaggggctctgccgatagtcagaaagctcaaacatatatgggtgtgtttagttcacgccaaaattgaaagtttaattgaaattggaacgatgtgatgaaaaagttggaagtttatatatgtaggaaagttttaatgtgatagaaaagttagaagtttgaagaaaaagtttgtaactaaacaaggcctatatatgttttcacaagaaggcttacccgtcaatatgttagaagaacattcaattttgaaatatgttactgtagttaactataattgttggcagttagaaaactcacatttttacaatagggaatttagctttccaaaagaagaaaaaaaacaagagatagagcctcagctccagctccacatctcctggagctagaacccagccaaacagtttcagctccacctaaaatgagagtggagctggatgaaactctctcacaaaatgaactagagaagtggagctgggtttaggcagctccacaactctactccagacccaactcctgaagttaaatttagaagttggaactctacc

SEQ ID NO: 43488 - DNA, 6888 bp, Oryza sativa
  unsure (1)..(6888): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccagcttgaaggacataaggcacttctgtgtgacagttgatgcatgctaggctacaaagccaaatgttgtgcttagtttctttgagctatggcattgctgggccaatttgtgctggatatgtgatgcgaactgataataagatataaacctacccttagtttcgagctgtgttgtttcaattaaaagcactggttgatctgccagccggcaatccttggttgtctgcctgcgcctgtaggtgaaccatcagcaaacctttttgtgagttgaagatagtatttttcggtagcctttgctagacttaacaaagctaaaaacaggattcctcaactgatcaagaattacatttatgcccaatattgagttcacaccatgagtttcattcacaaaggatcccttgctgcccgcctgccatgcactcctctaaccacatgtcaatatattattattccttattacaataccctaattactcgaataaagtaaaaaaaaaaagaacaaaggagcgaagtatagtgtagttactccttccccaccgaacatatctcgttccaatcttctatatctacttccctcctgctcacgtacaacaattccaccaccaaatctgtcaaccatgatggcgtacctcgccaccggcgaccactagaggcctctgtacttgggtttttgattttaggcagttccatgacgtgtcttaaaaaagagttgagttgatctggtgttgtcccccaccaagaccagaaccgccagcacgctgttggtttgcccagtttcgctgcatcccttgcctctgcgctgatgatgcaggcagatcaactgcttcctataacgtcttggcccatgcattgttatcatcgaatggccttggcacagccaacattgacacttacccagcgctgtgggcctgcgagatatggtgagaggtatcggtgtccgatgtctgttaggcaggagcggatgtgtggtgaatattgacacgtgaaaaaaaattaataagcaagtcatatctggttgcatgtatgagaagtttaatgtttttgccagattctatgcaattttgtttgaataatactctcgaataattatgtacaattgaacacctcctgttaattaattgtacataagcaattctcattatttctatgttctgttcctgtttgtgtttactattttattctggcatgttaaacagcttgcctctatctgaatcttctggccctgaaaagaagctaaaattatttttctttgtcaagaccaaaaagtatttattcaaaccaaacactatgaccacacaagcttgtaagaagagaagagcagtttatataagcagtgaatcagaagactctggtacagactctgaggttgagggaagcaaactctccaaaaaagatggggtcacgtcagtctatacatgtggtcaccagccaacctctaagaataaggttgatccgatgaatactagcaagtcaaggcagtgtggaagtattctgaagaagctcatggatcacaaaagtggatggatttttaatacaccagttgatccagtggtatatggaattcctgattactttgatgttattcgcaatccgatggacttgggtactgttaaaaggaaactcacaagcaagcaatattccaacccttatgagtttgcagcagatgtgaggctaacattctcgaatgcgatgaagtataatcctccaggaaatgatgtccacggaatagctgatcaattgaacaaaatatttgattcggaatggaaattattggaaaggaaatggaaagacagaaatttggtacaagagcagccatcactgaaggtattaaaggctcagcctgctgttaccccaaaacctgtgctacctaagggggtgactgcaggcacaaattcagctgtgagcaagacactggcaactgcattatcctccaaagtatgatcacagtcatgtaccctcattcagtgatttttcttcttgggactttgatcaaagtactgctctctttgcaggtaaaaattaaattttctgtgcgaggctctgagctgacctcttccaaaggtgtgaatagaataaactctatgcatacaatctttccattgttgattgtatttgacagccattaccaatgcttttcaattcagacacgcctttgcaagcagttggcagaagagacggcacaattaaccaatctctcccttgcaccaaggttttgggcacgagctcctttgtttatacttgagtattcttatctgagtcttggtatcattagctaaacaattgtgtgatccccctcttgtcttgtcttttatttttaggacaatgctaagacaccaaggatacaatcaagtgaggacagatctgaatcaactggtatgtttatgatttccacgtaattttatcccatactgttttattttactaaagcactcaattattatcttaggaaatgaattgcggccttgcgatgatgcttctacttcacctcttgcttcttccagacaaggttggacatgctatctatttatccatctatttgtgcatgttaatttgcatactagtatctctgttctcaaaaggatgatgtcctagattcattgcaaacacagtcaaacctcaaaaatcttaaatcattaataaatgaaaaaataccaggatttaaaaatcatattagtagatttgtgaggaaaaactgtcatatggttatattttaaatattgttcccatactatcataaaaatacaaactgattccatttgtcatccttgagttttcggccatggcgcaattctgtcgatttcctgcacgtgatttttcggtcgtctcatcattgtttgtttttcatctgagtcctgtgcacactgtggtccgttgtctgcatccgagacccactcacatccgttgtccaacgtcccacgcatgaccctgcctcaccttggccacatgcacccctcttccgtgtgcccatggtgctcccctcctgatccatcctttcctttcgtccatctccctcttcctatgctgcgagaagcagagctgccacaagcagaggcaaagcacagagcgtgattcacttagctaagctgaacatgatcccttaatttttctccatcagataagcatcgagaagaagtggaacaaatttctggattgattcattgtttatgtgagtagttctcaagtctggtttagttacattacgtaaatgtttctgatccacacccttcttttcgtaggacgatgaaaaagaatggataaagatcccaagaatacatagtttgatctgaatactcataccttgagaatagcacatctacaagtaggatttcctctgtgatcgtaccaaaacatgagttccatttggattttcttttttatcattggatttcttcaatgctatagtgtcattcttctggcgcttaatgctatctattcccaattacaattgtgtacagccctacacccgttgcaatgcacggtcattttgctagtaaatatataacttgagaaagtaatgataaaacatgtgcattggagactgccgatgtcctaaatgacaaccatttgagaacagagggtagtaactttatcatctattctttccatatgttcctttgctaatatattgcatcttatgatgtgaattttcagaagaggaatatttgcctgaagaacctttatcaccaagcaaggctcttcgtgcagcaatgctcaagagtcgttttgctggtacaattgtcaaggcgcagcagaaagcacttctggatcatgtattatttctgaaatgtgtactgaaatttgtagatttcaattaggctattccttcgcataggacaagttctagtctacgtctgtgtagctcttgctgatgtgcttttttaatctcctaggggaagaaaatagaccctgcgaaattgcagttagaaaaggagaggctggaaaaaaggcagcaagaaggtaagaatttgcttagcctttgatagcagatggcatggagctgtttgattggcaatacattttttctttaagttcatcaagcattttgatattttatattcgcatagagttctcatctggacttaatatgggatggctgctctttgtgaaagaacttttagaacacattacggtgaaacttgattgacatctcaggcttcgagaaactttgggatcaaaacagtccgtcgagagactttggggaacataaccccggtacatgctagagaattgtttgaacagtacagtgtcccacatagacaagtttgttagtaggtagaaattttatagcaaggcatcatcaagagtcgttttttaacaagtcgatcaggcttccgaccatttttttgttccttgaagcaaataaacttaagatttggatatatagaataagaaaaaagagtaatctttttaccagttgtccccacatagaccacaggttggctaattcaatacactgcttcatagtaactttttgagtcaattcatatactttcacgctgtgaatactcctggtcacatcggatctatatctattttggccaaacgtaatcttgtttcaatatatcaaaactgtagtaattttgttatgaaaagcatgtccatgatattccacattatcacattgttggaaagtctaaaaacaactttattttgttggaaagtctaaatttactttgaagtgtaaaaggtggcatgttttctctgatgggggaatgggtttcctttaaaatgggaacgaatgctcataactatagtggtaactatatattgtatgtattattcttaggttatacttttattttgtattggcacgcatgatttcagttgcatggctttcttttcaatttacccataatgcagagaaagcaagaattgaggcccaggtgaaggcggctgaagctgctgcacaattaaagctagacgaagaaatgaggatgaagagggagcaggaaagacgagcagcacgcctggcactacacatggtattacatgctgccattttctgaccaactagtttgtatgcttaatgttgcacggtgattactcaatctcttctcctacgcagatgaagaagactgttgatattgacaacagtgacttccttaaggacctggaaaacttaagcaaaaagtgggagctgaatccccctggcaaacttattgttgattttgtcgacgggatcgatctaccacctggcttagggagtccgctagagaggcttggccttttcatgaagaaggatcttgaggaagaggtcgaacatgaaatggaggacagtgtatcaccatctacggagatcgacgtggaggaaggagagatcagcttctgtcaatagcacggctctaaaatatccattgtttcttcctttttttctttccccccatcagactctgaagcaacatgctcgcatggcttataaaattgtgcgcgagtgctgtgttatttattctgcctcaagacaacatcataacataagccgagtaaaatgaagcgttggttcatctagtttgtgttgtctaaccagaaaacaaaaatgtcagctgaacactgaagtggagttatcggttgcgtggacttcgccccgattttgtcggttctgtgaaaccctgtatgttgtaggtgttccacgtatgcaattctgtaaaaaaaggaaaataaaaaaaaagttgtatgtaatgtgatgttagactgttagtatataataatattatagttactgatgagtgtagatgtttgctattgctggtagtcgcctcttgctctcagcagtctactcgttaccgtgtgttgatgttgtgaccttgtgatgctgttccagttgaaaccctcagcgggcagatcccttcaagcacggctcaattggatcagcaaatcaattagagtagatatgtgttgctgatgatcagcaaatcaattagagtagatatgtgttgatgttcttttctcaacaaagtggccgtagtttagtggctcaattggatcagcaaatcaattggagtagatatgggttgctgatgatgttcttttctcaacaaagtggctgagtagatatgtgttgctgatgatgctcgtttctcaacaaagtggctgtagtttagtggtgagaattccacgttgtggccgtggagacctgggctcgaatcccagcagccacatttataaattttgcttttcaattttatttcagttttggaattctaatattcgtatttttcatctcagtctcttttaacaaaattccactacatctatcgcataataattgtatttctatgatttaaatgtccccaaataattatccaatagagtactaatgtcatttcaattttggaattctaatattcgtatttttcatctgtctcttttaataaaaaaaattactatacatctatcccataataattgtatttttaggatttaaatttatccccaaataattatccaatagagtactaatgattccattcattacttcccttccattctgacctatacactatttaataagaggcattatggtttttcttctcaaaccttaacactaacaaccta

SEQ ID NO: 43489 - DNA, 27244 bp, Oryza sativa
ccttttgggcctcaagtatgtcgagcctttcttcaagcccggcatagaaacttgctgctgctgcttagctctcttctctcgctccctctccttctcaagccgtgcggcctcggcttgttcttgcctcagcttctccatctcctcctccatcgcggtcttgtcctccttctgcctcttcttatggtcgaggagcgaggtgtcggtttccttaacagagaagaacatagggcccaactctgccagccactgcgggtcaacagcggtgacgcactgcatgtactctttggtcgtcaggacaagctcatggtagacaacatagtcaggggtgtaaccaaggccgtagagtgcactgctggggtggaggtggcatggcatcccgttccggcagttcacatactccccgacacccttcaacctcgcggcattatggaagtatgcagagcagatggcttttctcaccacatcccattccatatggcatgatgtcagtgggatcttcagggttttcagtatgtccaatagctgtgaccttacttctcgagcctttcggagacccttgacatggaggaagtggtcattacaccagtctccacgatattggttcgacttccattgcaggtagacattcagaagagttaaatgatcagattctggaacaaaaaatttctcccttgctgcatcactctcctctgctcgatctttgggacgaaagaagactgagggcaccgagagcattgacacaatggtcagtacttcatcaaggcactccagctgttctcccatgagaagcatctttgctagagttgggtccaacgggaattcaaccatcttccaacctattactgtaagagcaccaacattgttcaaggcacccaacacccagagctggtacatggagttgaggatgttctcctgcgggggtgggtccatgaagtcaaagtcaagcaagttttcgactttcagagatttcagtagcagaaccacattccccagattggtcctttggatctcaggcactgggttaggtagcatctcattctggtaagctgattctgtgaacagtctgtagcatgtgccaggaccagttcttcctgcacgtcctgcacgctgatctgcagctgctcgactaactggaaaaacctgaagagcatccatacccatccgtggattgtacaccttcatctttccatacccagtatcaatgacataaaaaataccatccacagtgagcgaggtctcagcaatgttggtagcaacaatgcatttgcgagtgccctcttctgccttctgaaagattttggcctgcaggtcagcaggcaactgcgagtagatgggcaagatggagagcttgggtacagtcttggtggatgatgatatcagctgctccaggcgctcagcaagcgcatagcaggtagcctcaatttcctcttgccctgtcataaatataagtatatccccagggccactggttatgtggattgtcatagcctgcttcactgccgcttccacatagtcttcacatggtgttttgctgaacatgatatttacaggaaatgtcctgccaggaatatggaagacaggcactctgcggataaagaaatgttacaagattagcaaaatagaaaatggattcaaatcttactaggaaaaagaaacagagcaagttatcttaccctccaaaaaattttgagaatttgtccgcatttagggttgcagatgtgacaattagcttaaaatctcgtcgacgtgcaacaaccttcttcagtatgccaaacaaaacatcagtattgagtgatctctcatgtgcttcatccatgacaataacactaaaaaaagtaaggaaaggtgctttagcatttgggaagcagtattttgatactgtatttagttctatcaacggtaagagagctatcagcataccgatatttgtcaaggtcagcatctttcaaggtttcccgaagcagcactccatctgtcatatactgcccaaaaaaaatcccaaacagaagcagaaaccatgttagatctccattactacaacaaagcatcaatcaatttttttaatttcctaaatggcataacattgttctggcatgaagtgtgttgtgttcatttgatgtaaaattcataatgctaacaacctaatagctaatgctgcacccaaactaggctactaacctaagcatattctagttttaggaaacttcctactaccaagtgaaaagacaagtcatcaaccaaggagtatcaaaacacaagaagcaatatacctttattatagtgttgggactagtcatgtcctcaaatcgaattgcatatccaactttatgtcccaactcagtctccatttcttcactaactcttttagcaacactcatggcagccacacgtctaggttgagtacagccaacaatgccggtggtggtatatccatcctcatgcagatactgagtcagctgggtagtcttcccagagccagtttcaccaaccaccacaactacttgattttcacgcacaacctgctcaatgaaatcaaaacaaggtaatcaagaacttgtaccactgcatccttttgaaagaaactaaaaatcaacatcttccaaaggaaacttgattttcaaattaattacaattttctgaagggcaagaattattatcttgacctttctccttgaggatagctgcataggtgtactacaatcatcaaaaccatattcaaaatattctaccgatttgtttttgaataatttacactatagaaaagcaacatacctcaaacataacaaatgctgtaaactagcataggaaaacaaaatgaaaactgcaaataaaatactgaaaatgagtttataaactttagttacaaacctgtagcaagtcatcccgtacagtaaatatcggaagatattgcctctgttgagaaagagattttgattttgcaaagtcgctaacagcttctgcttttaccttcatgtgctgtgaaaattttgcttcctctttaaaatcaatctcaccttggtcaccaacagtagcagtatctgcatcaacctgatttttcaaaaaaaaaataagtaaagcgtaccagctaaacactattaggactatatatattatggcaaataatctacctgttcagccgttttctcaacacccaaaatatttccaagcttagatccagcgagctcccaaaagcgttggcgtgacttattcatgctctgtttttcacgaatttccctgaccaaagcagaacctttgcgtgcaactattgccatatcggaggttgggtccttcagtggcattacaggttctgcttgttttgtgaatacaactcgcccatccaggaatgggggttttgtgtctgcaaaaaattataccgtcagcatttttaagttcaacagcatcaatatattgtaaacaagtagtagtaaaaaaactttgtgaaacaagtatgcagcacgctaggtaatgttctattctcttcaaaattcgatacaatgtagcatgtacaacagagaaaacagagaacatagataactcctaatgcaggttagaagtttcagactgacatagacaggaaaggtggaaatatgtgccctgaaaatggtacataacacctctcctacatatgttcacagctcataaccgctattaattcaatatctgcttgtttcattctttctgcgacatagaagttccgagagtatctacaagaaggatcacatgaagcagccacatctactagcaaatgcacgtaatagtaaatgcataataagataaatagatgcaaggacctcatcagttagtacaactgcgagcttaccttaccaacataaatagtgtctattattttcataagtaaaattgcatatacaccattacatgagaaatagatagatgctttccaaacattttcgtagcttgtttagtgacaactataacatcgataagaggctgcgatattcgaagaacgtaccatgaacaagaagtattactttcctttcgtcctcatcatcaaattctgtctgcacctctgttcctctgacagctccagatctcaacaactgtctatcctcccattgagcattatcagcagtcatctgtgataacttcttgctctgagcaagggtcatcagactgccatctttacgagtctgcacccaataaaaatagtaagaaatcagaatacaagacattctctacaagttaaagatatgaaaaattattacaaaataactatatttactgaaaaactaagtggataattcttgaccatccaattttttgcaggtcttgctgcacatgggtttggcagtcttgaaaaaagttaaatgaatacaatttcctaatgatgatgcaattttcataatatacataaggaacttgaacaaggaaaaaacatacatctaatttggtggtattctcaagccttactttacttcttaccggtgcacttttacatgtctgagtacaaattatcggatgtttacagtaaatcacaaaatgcaagacatttttacaaaggcggagtcttgctagaagatagaagtatcagatccatacattcagtccagcgccacaatagcacgaccttatcatttactaattaatcagatatattcatggtttcatagaggctgtagctgcaataagttctactcaattactcagaacaaataagaacttatgaaggctaacacgaagtgcatggaagcacgggagatgtaaacaagcaaggaacttaccagccgctttggtaattgtgcttccctctttttgtaggaactatcatcttcaagatacatagaattatcaccatcaaacatggtgttgtgttcttcacaatcatacctggagtatatttgtaaaggttagaagaatgtgtaatcaatttgttgttgtataatgataagagaatgtcaaaaatcattgtactttcatatctctacactaccatgtctggatagaactatggcataaaatcagaattttgttacagatatatgaaaaacatcattgtgccaacttacttcagatgccattaccatttttagctattataaatggagccaataaatgcaacagcagcaattgaaaggctttgttgatcacttggtttgcaaatatattttttttctatcagacacctacatcatccttttgaatacaaaaaccagggaaattttatgaggaaagaaaagtaccacgcacgatcagcattataatccatctcctgcatcatttcttcagatatctcatagttgccatcggcatctgaggggcttctatcagattccctgtcctgagataacagggtagaggttattgtcagaatgaccagtgaagaaacaaaatgagaacttgcaatatactataaagtgatccacaaacaacatgaaacttaaagttagttagacttctgtcagtaaataccaaatagactcaatcaagtctattgtttgattgaaagtacatgaaataattaaatgaattacatagtagcctaactgtaatactcttcagacagaaagaggcagaaaaattaaagcaacttagatcagtcacatggtaatttcgtaacattacttcagttatagtttaagtaatgctatacacacgttcagttcatagaaataaatatcgaacatccaatgacaattattctaaaaacacagatagagagaaaaaagtgaacaaaatacatgcttcattacatttatcattgtttcgagcactggtctaaatggttgaattaaattaccagcagagttaccacttctaaaaatcggcattccaggagattcaacattaaaagactgtcgtgctaaaaggaggattaatttctcaatagatgtgatagtgtttaggaatgtatgaatggggcttccaactctctacaatgtatatagcccataggactacaatcttcgtctactctacttcacctcctgggtgtatggatgtcttaaaataatcataccgaacttgcaacatatgagatgaatgcaaaaaaaaaaaacacctgatttttcctgtataaaggcatgttttgatttttcctacataaaggcatgttttgtgaaaacagaatcctgacttacatttgatgcagatgtagacgaaaaagtaagctggtgggatcttccaccagaacgtggataagaagacccttttgatgaaccagaagcgcgaattggtgcaggtgatggagatacgttatcccatggggatgctggatattcaaaacaacaatagaagtatgatttatttgatttaaattaaagaagaaaagtgcaaacaacattgaatagctgagcttttgttacctgcataacgtggcgtattcccacctagccaaggagacactaagcgtgcatcaggggatgcagctgcaagcataggagatggtgaaggatgttgtctatgggaatttgagcgatcatcacggtactcccgacgaggtgtatcttcccattcccatcggccactgtcccaatcagatcttgctaacaatttgcaatcacagccacaattttatcagcaagtgacaagccaattagcctaagcatgaaaagaataagataacaaacatgataccaggtgttcttgagcttcttgagctatgctcatgccgacttcgcttgttcatgtagtcaacggatgtagatctctcacgttcatcacgcctattatgcgattctctatcatcatggtgtccccgccttccactgctactatagccaatggatgcagatctttcccgttctccatgtttatcacgggatcccctatcctcatagtcatcatatctacgaggagtgctacgagaatgggaaccttgagaacttctagatttgtgggtctgtaaaacgacatgaacagaaacagacttggttagtaaggtgaagagaaaataaaacagccagattctttatgaagttcccaaagtaatatgggacacaagtaatcactaacatcttgtcgataagatccatctcggtgactgggtgaaggaccccttccatcctcatcagtgatggtaggttctgaaaatggcgataacgctttagttacaatggacaatcatttgcatttgtaacatacaagagtgtatatatataggacctttgaaagaggttctctcatcagagttggctcctcgatagcggcgagaaacactgccacgatggccactgctcaggctcttctcatcactctccgcaggtcccggcttctcatcttcatcgattgaagtagcagctgccactaccttctgaggcggcggcttgaaggcattgccgccttctgcttcccgtttcctgtgcgcgaggaggtccaaacctgcaaaaaccacatctcagaatcagctcacccgagctctagattttgcaggcctcgacgatttctgagtcaaattcaaattgggatctgctcatcaagttttacacactaatctcgctcgcggaaatcgaactccctagcaactctagaaatccacttaaaatcaaaatttcctgaagtctcgtcaaatacagaagcagaagtaaaaccaagcaccaccatacctagggcggacttccccggcggcggccggtacatgaccctatccctgctcggcaggatcagcccctgcgcgcccgtgtcgtcctccggccccagggttgtcatcgtcgcgtccatgtccccctggaacaaagagagaggaagcgccatctcggcgtgagaccaaaagctcgctgactaccccaaaaccccaacgcgctcgaaacagattactcacctccatggtcgccggcgggcggagcggagggcggcctccgagcaccgggcggcgccggttcgactgggaatcggcggcggcggcggcgagagggaaagagaggggggaggggaagaggtcggcgggtggattttgattttggcccctccgaatctggagaggtgaggtgagggcgtgggggatttgggatttgttggtagcgggagggattgggatgtaaaaatcccaacgggagttttccacttgggaccctgtaggtttgatgttattacaagctgtgtttttactaggtcggttagagaattttgtactctagtgcaaagtaaatggtggtaacggttaaacataatcttggattccgagataattacttatttgccctctaaattattgaatgtattctctacttagaaaaaatgtccatgtgttgcaacgggtaaagtctattttaatcttattatatggtttagttaagataaaattcagtgtgggagtctgcttggatatatatatatttttagaaaatcatgagctgcagttaggaatccgatcgtctcaagttaacatacgagtttttttaaacatatttcttatatgattccttctgtattaccaaaagtgaacgattttaaaaactgactcaaatatggatatgtatttcaaaagcaaacgaacttaaaaaccgactcatacacggatgacgtaccaaaataccggcaaaaacatctttaatttttataatagtatatttggccctcataaaattggctccccttttattgtctcttttttctcaactttttttatttgcccttgagtggttcttcatttaaatttttcaaaaaatgcccatcttacccctgcatgaatagtagaatctaataaattattttctttaaacggaaaaaaataaaattgggatatggtatcataagtatatcttttattcgttgcatcatatgtaaatttttaaaaaaatcgtaatagtattattttctttaattaacatgtgtcatccaaacaacacatattgatgaataaaattatgaacatacagttttagtttcattaatgagaattttttttaaaaaaaagggcagattatgaatttatttggaatgtgtggtaccctcataccatatgggaataaaaagggtaataatgaaaaaggtgttaagaaattcttgagatcataataattagttggtgcatcattaccagttcaattacactcttcatcaagcatcataattatgaattttgtaagtgataacaaaatatttgccatgagagagcacctcttgtgaactaccaagggcaaaaaaaatacttttatggttctttgggcaaataaagaagaatagttaaaaatgaagggtgatgtcacaataaagggagagagagtttccgagagaaaataagggactaagtcaacttccatgaaaaataaagaatttactcttggctttccttccttttattaatttaacgtataaaaagtaacctttgaagcatgaagatgagataaatactaaaaccatttcggatatttttgtcctttttggaacaaatattgaatgttgagtaaggattgtattatagtcttaggcccagttattttcttcaactccaaatttcaacttactcatttttcgttaacacgttattcaaactgttaaatggtgcatattttataataaaagtttatatgagttgtttaaaaaaatcaaataaatctatttttaaattttttataatagttaatacttaataatcacatgttaatgagttttctcgtttcacgtgtgctacaaatctctctaaagtcatggaaagaacgctgcacaaactacatgtaatatagaacacattgctctatgtgtctctctgtcccagaaactcttgcctgcattcataactaaaaattgttacattttaggatggaaagaacggtatttattaaatactcaaaaaatatataatatttactttctactttataggatagtgaattgatgtttgtttgacataattgttccttgatttactaatcaaacaactttagatgggtggggataacacaaatgagaagattatggttgttcaacataattggctaacatcaaggccaagtacacaaggtttatgggtcctaaaataccttatattgcatatcttaatccattcttattctagcacggtactagtaaaacatttcatgactaactacatcctcataggtttgtatagaagattgatattttttaggttaattggatacatgccattataaatttgatgtgttttgagatatgccattataatttgtgtatttggatccgcgccattacaatttgcatgtaagttgaaacctgccactagtctacatattttagccgtattggacataattgcccccgtcttcctcctccatctctcgtttctgtgtaacaccagccgaagccttcttccccacctccggcggagtgctgcctcgcagtgacgtagtccccggcgacacgaccatacgacccctccgcgcggtgagacgatgaccaggaatccggcggcggagaggtattgcgcggctgcccgccgccgggagacggcgccggggaagaacttttgaagttgacgaggccggccacgatggagctccgccaccggtcgtgcgcagctacgcccgagcctccctgtcacagatccaccgacgccgtctagccggagcagtggtgcatcctggcccgagctccgccgcaagtggcttcgcccagatccagataaagcgagagagggggcgccgaatccaccgagagctggccggagcctcgtccgctccgagctccgccgaatcttgagctggcgtccgctcgtccacctcgtatcgccggcttcgtctgctcatcctcgtgtcgccagcgtcctgccgtcttccattcgtcctcgcgccactggcggggccatggccgtggcgacgtggtggtggacgaccactgccgccgtctactgcaacgccaccatcgcctcctcctacctgcccgttgtctgccgcgccttggcgacgccgacgagactagcccccgatgctggtgagaggcaccacgccaagctccaccggcagcatatatctaattaacccacaaaaggattaattagagagtgagtgagaaagagctcctgctgctcctgctataccgaggcaactgagagtctgagactgagaggagagaggttgaagatgagggtatttccgtcacatatatgtaaaatatgtatgtcaatggcaccattacaatttcagacaaataccaatagcatagttctaaataaatgaatagtagtggtaaatttcaaaattaaaaaatttgtaatgttatatatctaattaaccatatttggtaatctttgaatgcgaactaagggtagagccaccatttctttatccattatatctatgacattaatctctatatatcccgtgcctcatgggatcatgcttgtgttggtactttagatccattgagtctacttctcttcctcaatgatataacagggcatatgcgagcttttgacaaaggtagtaaaatgacatgtcccgctcaaatgttaagcccttgaatatcttggtcattgaagtggggtagggtgctttaagtttcttgataattagcccgatgattggttatctgacaatgattatgacaatactatgtttaataaaacaaccaacaaacaagataaatgatcaatgaaaattttcaaatacggcaatctgaaacaagtcatatatagaaggaaaaatgatgagggtgcctaaagcaacaagtgaatttgacaagataaatgagtatacatagaaaatttgagataaatataggctgtgttcggcaccccttttccccaaccactctcccttgttttccacgcgcacacttttcaaactgctaaacggtgtgtttttgcaaaaagtttctatacgatagttatttaaaacatcaaattaatctatttttgaaaaaaaatagctaatacttaactaatcacgcgctaatgaaacgctccgtttttcgtgtgtaccgttccgattgggaaaaaggatgccgaacacagccatagttggcgaggcatccacaaaaaaaatattgggctttcatgttttggtgaaaagtgctcattttgatcgtcatatcctaccttagtataaagttggtatctgttaactcataaagctcaatatgtaagtgtgtcagatcatcacccatatctattttttctataaagttaagacccaaagctgaaacctcagtattccacgtcatcgctaattcttagccgttcgatcggtggatgagatcgcatatgaaccgttggataagaaggtccccggacgagatgttgagcagtgtgtttatgcatgcgttaatttagaatgcatgtaacgcaagcatgtatgggtgagatgttgagcagtgtgtttatgatcagaggccatgggccatggttagtgccatttattctccttctaaatctctattaattcttctagattttttaataatcacatacatgtaactgaacagaaccaacgccatttgagaggttattggttcgatatggaaatgaaaattggtcacatattggtttaatctaaatgcatatatatgcagtagacccacccgattccttttgagcaaatgcaatttcaatttactaggcatttccatcagttatccatacacaaagattagtcttagaatactacaactgaaagtatctcatgtatttccgcagcaatatcaaaccacctttattttacttttcaacgatcaaatcctatatgatataaattgttataaaccccaccatcttaattatttgtagcttttttcaatagttgattaaaactgaaaattatacaagtgtagctattatttcttctaacatcatacaaaaactcccgcaacaacgcacggggtttcatctagtcttactataaagttaatgcccactaactactaaagctcaatatgcaagtgtaccacagcatcaccaactagcaattattatctaaaatgttttagatcacatgcatctgtgccatatcatcacccactagcaattattatctagagtattttaaatatcattcaaacatgacatatcatttacaattttattgtatttttagaactcaatatgtaagcaatgtcatatcattatctccacattattttcatattatttagatatatgcacctaccattttctataatgtataacatgcattcatctacatatctcacggtaagataggataagcaaagttattgctttcttatgtcctccttattttgactttcaacattgcaagcaatttgtagtaaatgagaaagataactataacttcgacgagcaaacttgtttcatctatgcactggtaccaacactctttgcatgactttttgttaacaacgtatacgtcgtgctgttggccccgtctaccagttgatatgccaatttttgttgagaagtaattgttatgtacaagtcatttaaagccgttgcatgtcaaccaatatatagccatcttaacatacaagcgcagtaatcctatgtgaaaaacataacgaaccactacatttcaatcgaatagggtatatttggtgacaatcaatagcacataattcattttttaatacgttgatgaaaaaagaatagagggagtatatgatattattgagctaaactaagattagttcaaatactcatcttaaaattccttagaaattaatgtagaattgatatttcgtttgttccaaaatgctatcgcgcatggaaagcaagtcaaggcgagggaacacctgctcccattcttcggaaactcgaggttattcgcgcaaaatctcctcccgtcggtcgcccgaggtctgacctagggttccggcgactcccatggccggccgccaccgtaacccgccgcccccatccttccctcgcggcggcggcgggggcgtgggcaggggccaccacccgcctcctccctcgctccaccaccaccgcctcccgccgcctcatcacctcgacgacttccgggagccgccgctgctccccccgcaccaccgcctcgacgacttccgcgagccgcaccacctgccgcccccgcaccaccaccaccacctcgacgaattcggcgagccgccgcgccaccacgtgttcgcgggccacggcggcggcgccgggccccccccggcgccgcacgtcgtggcggcgctggaggagcggctcggcgcggagatcgaggaggcgcacgtgctgcttggccagaaccagcggctggccgcgacgcacgtggcgctcgtgcaggaggtctccgccgtgcggcacgagctcggccgcaccgctcgcggccttgccgctgcccaggaggaaggcgaactccgtcttcgcgaggtgcgatgcttttctgatgcgctgattttgtctctgttttttttcccactaaatccttatgagaaaaatcgatctatagcacagaatcctgatgcttatcccttgcatatatttggtctgtttagttcggcaaaactataaattcctcttgcaaatttagttccaactttgacttcctgactcaattgcgctaaaattttattgcggtgggtctgtttgaagtgattatgcaagcataataaccaatgtcgtctattttggaaccctccaaattttgctttgtgaaatattaggtgcatgataatgcgggtctgtttgaagcgattatgttagcataagaacttatgttgtctattttggaaccctctaaattttgcgttgggaaatactgcatgatagtcggagccagtggtatactgtatttgccttgcattgtgcctttgtttgcaaaggtgagggattcagtgagaagaaaattggaaagagggcagtgtaggtacggtagggttaagggctgggcttgcaagcagagccactacaatccatcgtattcttgttttggtagtcttgcaagcagaaccactacaatccatcatattcttgttttggtagtcttcatccaccttagtgttgtttccatccgtctccccctatgctgataatgcacggagctggaggtcagcacttagaagtgcaatgcccgtaactccataagatgtgtgaatatccacattcatgaatcctgggtatggattttattcacatacaaggtgaaccgtgaactgctcacttcatttgaagtcatcttattcttctccctcttgcaagattggtaagcaatggaaatgcggcagggagggagataatgacgagtgagaaactaagaatagaggggagatggcagcaagctagagtagacaaggcgcatgtttatgccttttcgatgccaagcacaataactttccccttcggatgccaagtttgcacaacatttgtccacaagggaaaaagttcattttaatatttgacaaatatgcaacctgtcatggctaagttctagattttcttagtgatacactgaaatttgcatatcataattaatgagtaaatttaaacagcacagagcgttctccctataaatccagaattttctctatgcatgtgtttagttggagggattttggtgggttgggagggggccaacccatttttgtaggtgtttggttgaaggactaggtggaatgggatgaaaccaaaaaggaatattccatcaatatttgggatgagacggtccgccagaaatggccggaccgcgcctatccacttcacccgcgcacatcacgtgacccgcacatacctccatccatacagtgaccttatccttcccagccagagtctattttttccctgtttttacccacccagcgagagcgatgcaacaggagcgagagtggcgatggtagcgtgcgcgccgtcagcgacggccgccactccttcctcctccctcctccatggtggctgccgcgtgcacgcaagtcagcaacggccatggctccttcctccctccatcatgcgtgcgggcgagctgccggcggccacgtgcacaagagtcagtgacggctgcggctccttcatcctcccttctcgcatcctcttgctcgttgctgctgcttgtcctcgcatcctctctcgtcaactgctacgagctgaattctggagctgaggagcagagctagcttggctgtgatgcttgattcgtgattttcgatttctgatagtggatagacatcaccaaagagaaagacatctacgtatatgcaaattaatagctctagcagctctaccagtatagtcaacatgatatatagttgtgaaaatatgtgacggtggattgacatcacaaaagagggcatttttgttagaaaaaaaaaaagctcggtgtgagaggtaacctcactaactcaatgtgaggaggtatctctatccaactatcccaactccatccctccatccctccatccaaacaggtgataggaccattccatccctttttatccctcaaaccaaacaaaaaaatagggttcattcccatccctcaaaccaaacagaaaataaatgacagggatggacccaacccatctcacctcgccctcaaaccaaacacatgctatgcgaaaactctgtttattggagctgtgtaagtattttcacactgcttgatatgatgtttgaaacttctggtcgtacaatggcatatgtaattctttccccccaaaaaaaatcttaactgatctgttcttaatatcttatttccttctattttccccaattatttccacatatcatcttaatccactgcctttaaatacatcatacttaaatgcatattttgtgttgagtataggttcaaagctgcatatctgagtgagaaaggttcattgaaattttcagttgaagagaaactgcattgtttggtaatattttcaaatgtggtcatgtcaagcttatgtctctttgacccaaagctatctgacttagtgagctagtaggttagttctgcccatgccaagtaaaattgacttgtgcctttttggattgtaacatcagaaataattttaataggtctatgagaggtcaatgaagatggaggcagagctgcgagcagtagaggaaatgagggcagagcttgcacaggttcgcctcgacattcagaagttgggtgcagcaaggcaggaactcatgggtcaggtccaggggttcacccaggacttggctcgatcagcagtggacctgcagcaggtggctgcgttaaaagctgagatccaggagataaggcatgaaacacaacatttgaggtagagccttgttaatttcatatgcactttcagtgttctgaaagagagcgatgtgtatttttagtctttttgcaaaaatataatctgtatatgcaaaattgttggtgttatctatttcccactgaatcatcttagctatctcctttgcacttgtgagaaaacaatccatcgctgttttgttttgccattctcttggttctatgaactcttttggtttgtctggtcaagttacgatctattataattaaaatttgaaatggaatgagctcttactttttttttgtccaaaatgaattccagttacccctggagtagtagagagagtgaaattccaagaataaccttatgtttttcaaccttatatggttgtattatttgacctgcagatctggcattgaggttgagaagaaaggatatgccgagagctatgagcagggacaagagatgcagaagaaattgatatcagtggcttctgaagtggagaagcttcgagctgaggccgagaagaggtcacgagctgctgtgtctggaggcaatcaaggtacttaacaaactctggatgcttatttttctctagtactctttttagtggttcgggaccatctgtgttatgtagggatacttaatgttttgaaatcagatcatgtcaaccaaagggcataatttgtaaggttgaccatgtagtttaaatctctttccgtgttgcacatctggaatataacttcatcatgacatggtgctcccatcctgcagtgtacgtcggaggctatgggaatcctaaggccgcatatgccgcaaatccttataatgctggatacaacataaatcaagtatgtctcttattctttgtttccgcaatacctatttgcatattctttcatcctcatttcttgctacttttgaagccacatccccaggcaaacactgctgattccggctcccagtttgggcctggctcaacgcacgctccctggggtgcctatgacatgcagagagctactggacggagatgatttttttttcaggtgtgttcagcaaattacaaaagcatacttttctgggacaaacctaacagctttcatgcaatggtgaatcatgaatgtattacttactagtatactctactgtgagttgtgctgtacatgtattacctccgtttcaaaatgttgcaacctaggacgtgatttatcctaatacaacaaatctagacaaaagttctatccagatttgttgttctacgatgggtcaaatctgtcaaatcccatgatgctgatggagactgcagatttgcgtcgatgtgcattttccacgctagaggcatccatttctggcgcagcaatctctttcgatcgatctatggacgagtgcgggcgagattcgttgagaaacataatggatgatttgtgatgtcggaattcctgtacaggaacagtcacgctgcaggaattggaggaattgtgaagattgtgcaaacaataaggtttcacaggaggaaaaaaagagttaaacttgtgaattatcccattaaacaacgcggtgttttattcttcatcattgtgaccatacgtcaaattcgacaactaatcttgtgggccaaataagcattttgaattctgagcagacaatgacgctacttatgcattcaacaggaaagcacacaaagacgttatggaacagaatcatcaatcaataaacatcattagagaaagcacacaaatacgttacggaagggaatcatcaatcaataagcacatcattagcgaaagaatttggtacataaataactttacattcgaaaggcatcatcatgaatggccaaagcttttagtctactgtctaatctgctgccaggaaaacatgtatactgatcacaagttactaaaacatgtacaaggtagaacaaagaacataccagtcatacggcctaaacaactccaaaaggaccaaaaatcatggcagtcccaaaccaaattacagattttagcagcgcaaatctagattttcaactagcatttggcggtttatgcttgcgggaagactttgtttggcgggatattttcacgcctctccacgtaggcagccgggaaccatcctgccacccccttgcattctccttcggcccaaccattcggagcaatctagagcagatacaaatgaaaaggcaattagatggtaaatttggattgaggtcttaatgcactagacaattcagcaccattgtttgttggaccaatcgattcaaccctacccaactttgtacatcatctggttattccctcgttgattgacaagctaatttattcctgaaagaaggacaatcactagctactacatgatcaggacaagcctccagagactaattggttccattgccagaggaagtaaggcactaattggtcatctagtctagagactattgaaaatcacttaagattctttctgcgggcaatgggggcagtgattaaactgattatcacactacttcgcagatgaaatgattattaggacactgacctgacgaacaacgacataatcaccaacaattaaactcaactccttttctgtggtaccattgaagttatgcaccgcctgcagcaacaagaaggttcaatgcacatgacatgtaaaatatggtataattgcttggtaatgtcagttactcatgttaacctcagcaaggaagtactgggccttctcagcacgcttatgggaatgaatagtaggcggtgcagattctctcttttgcttttcagaggacatctagaaataagaattatgcaaaattcagaaatgcaagagattttgacagtttacatgataagcagagtgaaaattctacctcagcttcaacatcatcaagtatagcagctaacctcaaatgaaataacttttctgcttctaccttcaacaggataagtgacaaaggataagaatcaaatgaaacaactcaatggtgatagatgaattatatgctagaggcaggcaacattaccatgccaaccaggcgctgaagagttatcctttgctgctgagattcaacagcggcaagtgcagcagcagcttcctttcctaacacagccatgcttgctttgtgctctatcattttagattcagactgttgaagcttcgtagtgtgctcagcaagtggagcttctcgtacccgttgcttccttctagcaatttcagcagactgtatgacaaacaagagggttaagatacataatggggaaaagtattctatgaagcatagaagtagcaatagtaagattgcttgcttgcaatatggaacaagttgctaatacatacaaggatctcagcttcatgtctcatccggctataacgttgtgcaagaccacgagcatcttccaggggagcgcctgcagccatagccctcaatggatctatagtctgaaattcaaaataaatggaagtatatttgtaaaatacattgaaggaccaatgcaatactacagatcttaaatttctagagatctttaattgaaggctaagccccagtatgcactgaaaaagaatgacaaaaactgcatcttcaaaataatggtgaattggtgatcgcttgcatgacaactatataaatcacgtgcaccaaaaggtaaagggaaaatgttgtatggtgttttatttccaggcttagatcaatagacctagaaaattgtgtctaagagagaagatagggcaaaaattgggaccaggcggtgagacatcattactgcttggttttaatgcaccgacaagtttccaattattgaataggatgaaccagcataaaaattcggattccacaatcatcagcctaaaggacttccagcatattcaatatgctggactgtaaatgagatctctagtggtcccttccatcagtacacttttaggatatactccaatgtaaagatatgaactggatgagatccatcagtatatacatatctaggcttgagtatgcatgtgcacttctcagcacataaacatttcattgcaaattccagtacattctctctactccagcctaagtgattgagtgctaggctgactgcattatgttggtgatataacaaaaaaaggacagttatttcttgctatggcccaaaaagtcgctaggcgccagatggttggaagagcaagtgcctagtgactaggggcaccaatatgcagtctaggcagctcctagaaccaagttgactagcggcttccaaccaattagcaagcatatgacatacaagaaagatactagaacatcaatataaaaatactagagccctcaaggctgggcagcagcataatgcaccatcaaatgccaaattgaggcagctaccctgtgcctagcaccgacttttagaacactggtagtagcaaggctctttttgtagactagtagctcctcgtacagctaccagagagatacacctatctattgaggcatacaagaataacaaaagaagggttcaaaataccatatatatgtacatactaagaaaaaccaccgattgacaacataaatgcagggtacagagaaataaacattactgtgcacaagccagcaaaatttgtctgtgtgagaacagtactaattaacatccaaaaaagttacctgagaagataaaattctattaaattcttcgtactctttctcaacatttcttagagcacctccatacagagatgctgcttttgcaagggcttcatcactagcactactttcacctccatatctataacaatcctctgaaaattttgttcctgtgaccaaaagaaagaaaaatgtataccggtatcactcgtaagatgttgaatttggggggattcgagcagatcatgcaatgctattctttttgaaaaaggattccttgcatacatttttaaccattgccttgtcttcacaaaaaaggtctcaggctcaagaaattcaaatttttatttgatagtcatattcttttgtcacatattcatcctctgattttgcaagttgagagaacatttctcaattcccaaaagccccttcacaacatttactggcagcccaatcaaaaagtggtaataaatattatcaagttagcaggatccgataatcgatagcgaagtttccattctagtacatttagctaaagatagcaccattcatgatgagcacgtcctactcctattatgatgtcatcacatggtttttgtgggtattgtcattcctcgttttcccattggtgttctggccacgtgaaacatgataaatcatgctctcagacaaagaaggtgaagtttagaagtttggatcaggtgattttacagccagctcatccctcaaattaaacacctcatattctggaaggtagagaggttctatcatctgatcctcattaatattcccaccattcaagcataaaaatgatggaaaagcatgcaaatccaaacatgacataataagctaacagaggatggaaggcatgaaccacatacccacttcaacatgcctgattccaatagaaaccaaaccttcagccgctcgaacaatgtccttttggaaatcctgttagcatatatgcacgcattgagtttaataactgaaaatggaattcttgggaagtatttcacgtaatcatgcaaatattctcttctgtattaatgtcttaaaaacattgtgtaatgaactgaataaatcagacatgtcaaatgaaatacaccagcaatatatcaataacataaatgcaagattaatttgctgccagctgatcatattacataggtatgtattttatgctatctgcaattctccttccttacccttccagaacgagtagaagtgtacaatttctcaagctgttgatgtctctgtaattcaacttcatcaattacaacagcgtctgaatgttcatagcccgtagtactgaactgctttatcacagcctgaaatgtaaacatgtaagcaaagaagacttgaccatgaatatagcacatgaagcactagcagacacttccaagaagaaaatatttagtcatttacagagagcggcatggttttataagtgacaactaagccaaattaaagcttcccatggatataattgcactatgacaattgtatcaaattgtcaattgggcgaccgagcctaataaaggaaggttaacgtacgtgatgtcttccatttgtaagaattgcgaacatacccgaccgacagactgagtaacttggataaaaactaaaattacacataatgttaatgtttacaagcatatgttgcccctcattacaaaattactcctgtattaagagtaaattccacaaaactacatatactttgaccaaaacatcgcaaaaatacagatttaacaccaaatttttcacataactacagattttagagtttaaacccttaacactaatgttatcttcaagctataaaatgttgtagttttgtgattatactggtgctaaacttgtagttttgtgacaatgttgctattaaatctgtagtttgtgatactttatcttaatggttacactctggtggaaaatatatttaatctaaaatcagtaacaatctaacagctggcaaacagaaggggaaactatatctaaaaaggataaaaaatagctcttagtttcacatttcaaccaccacccagagaacagatcaggcgatacaagaatagtaattcacagcttaaatctgatatcccagggacaaaaaattcctgcaacagcgagccatctcgtcgccatttctatttggttttctcatggcgcagaaccctccgactaagtccaaaacggaaacggagaaatcgcacccgctacaaaattaaccattccttccccctaacaaacactgagactgaagggccccagatctgggatccgaacctgctgctgcttggcgacctgctccttgaacttgctcgcctgcttcctcagcacatccatccctctccctccccttccctcactgaagcggacgtcgtgctgcgaccgagacgaggaagaagcgaagcgggggttgggggaagagcgcgaaggtagtagggctaaccctaatcctcgctagttagaaacggaggaggaggaggaactggaagcgcgagggggcggcgaggaaggaagaggttggccgtgtggcggccggcgacgcggcgggcgctcggcgaacggaggaggcggggcggcggagcgagagcagagacagacagaaagcgagcgcgagagccgagagagggagcgaccccgatgcgagagagaggagcagttgggccggagtcagcccggatgggtggatgggatggccaccaaccaaacaatttttcttttttctttttggtagaactagaaagaaaacaaattttaatactccctccattccaggttttaacacgttttgattttagtgaaagtcaaactactctaagtttaactaattttatagaaaaagtagtactcatatttttaacccaagactaatatattatgaaaatttattcaattatagatttaatgaaactatgatggtattataaatattactatttttttcctcaaacttagagtagtttgactttgaataaagttaaaacgtcttataacctgaaacggagggagtagtactaaaccatttacagatatactagtagtacaaagttattgaaaataaagaaaatatttacaaaatttatttgaaaaggtgctactagtactttaattttgaagtaaattgcatcagcggtacacgagcttgttaggtgagtgtaatctagtgtatgaacttataaaatactcgttttggtacataaagttatcttgcacgtgcaaactaaggtcaaaaggacattacataactaattttgttgatttatgtgctaattaggatactacgtaaacatatactccctccatttcgcaatgcaagtcattctagcattttccacattcatattgatgttaatgaatttaaacagatataaatgctagaatgacttacactgtgaaatggatgaagtgtatgagaaggttgctacttagacatacacatgttcaataaaaagatagaatgagatatagtgatgtagagaaagatataaaaaaaccgagcaatgatacaaggattagaaacaaacgaaattcaaaataaagtagagaacaaatttataaatatttatactcactatatgtatccacgccacatcttaatcaacatcagctatgtaaaattaaccttgccaagctattttagacctagttcgcacggatcagataagtttgtgtatcaaaacgagcattttgcaagttcatgtactaaattgcacctacctaataagtttgtgtaccaccaatacaatttactcttaattttttttatcccaatgtgaaatttaaatttttaaaaataatttttttatcgcagtttgaaatttaaatttttagaatacacttctctaggctttcgaaaactgcaactattttatttttaaaatccggatttttcaaccacacgataaaacgtgtgttatcttatatatatttattaatatgtatattttatcttaaagcatatgtaaatgagtaaatctaactctcacattgtaggatcgaacgtaaaatatcaaggcagccttggtagaaacaccaaaaactaaattcttttttccaaaattaaaaaaaccctcaaacttgatggagatgtgttggtcaaacagatcaaagccggtcaaaccgcaatgaagtcgtcacgaaaatgctcacccccggacgaccaacggggtggagaaaaatcggacactgtctgccactgcagcatgccagtatgcaaagaatcttttcttttcttatttcttcaaaagatttttttatcgtaaactatttatctaatctacgatctaattgcaccactaaattcgttacaattaaatctttataacaagaccacacatgattatatttcgacaaaaaaatattttaatttttttattgatttttttaatgttgcatgtggtctcttttgatgtttcaactaatagttttataatgtttcagctaatgtactcatgatgtttcactgtgtatggatcaaatgttgcagtggaacgcgccgttgcaataaatcacccacatattttggaaaccctatattaagggaatgtggtttattttttgttccacaaaaaatgtttcacctagtgcactaacaatgttccactatttatagatctaatgttgcagtgaactgaaatatttcattgcaataaaaaacccacatattttggaaattaagggaattcatttcattttttgtttcaccaaaaaatgttccacttagtgtacttataatgtttcactgtgtatagatctaatattgcagtgaactaaaacatttttccgctatttgctgaaacattgtttttatataaggtgaaacaacaccagatttaaacgagtgaaacattttcgatctacttagtgaaacaattccgatatacctggtggaacatcgtgcaacatttaaaaataattcaataataagcactaggcggtttcctattgctcgatccagtgacggtagtgcggaggaggagggaggaaggggtggtagaggctacgttttgggtcgccacctaaatctcttgcgcggggtgcacaaggttctagagatcctataatccaccactcaacctaatttacaaatttcaactcaaaagtgaagttttaatatgctcaactttttttttgctctttgcaaacctttatgtgttctcttaagaaacactttcaaattgctttgatatatttccgaacgaaactcaaacaaaattaaaactcgcactactagaaaaataatttatcacaaaaaaaatcgtagcatcaatgctaaaattgtggcaatagatacatgttgccacaatcttaaaatcgttactagccgtggtaataaatagcgtggtaataagttattgcaacgatttttatttagttgtaataaattttgatattgccataaaatggatgtggcaaaaaatatatattgcaacacttcacatcgttgcaataaataactatagccaccactccatgtgtggcattagttctacgtaccaaattaaatgtttcaatatctaatttatcattctacctattttcttttgatatcttgtcatggctaggatt

SEQ ID NO: 43490 - DNA, 60397 bp, Oryza sativa
ctaggatttaaacccaagatctctctccctcacgcgcgctctccatgaccaactcacctacgcatcaattttgtttaaaaatgcatataattctatttgagacttcctaactgagatttgaatcatgaatttaagtatttaaaagatttcgaatgaaaaatttaagttgtagatctcatcgagagctataaatttcatataaaattcgtcctaatctgtatccatatgaaaagaataagttaaattatgatatgctaatttttttattgcaacgaatttgttgatcatggcaatagaaaatagtgaaaagtaccctgtactatgtaaattgccacaaaaattaaatttgtggcaatagaacatgttttttttgcaatagtaatgttttttgtggtgatagctcatttcctattacaacaaaaatactgaataaaacatgatcgtaaatcgttgcaataaagtatagttatttgccatagaaaaattatcattgtgatagtacaatatattgccacgaattattcggatcatgatttggataagtatcttaagagaaaaaccagtttaaaaatagttttgcacataaatcgggcgctgacgtcagcgtctgatttttccctaaagcatcggacgtccgacgcgtagccctctccaagtcgtcagtctcttcgccagcttgctgttgttgtcactgccttcggtctgcctgctcctatggtgtacgctagaccgttgggatgtaaagaaaaccacatttattgcatcaaattgtgtttgcaaagtgcatctaaagcacttctctctcaactcatgaattagaattgaaaccccgatatgaccggagaggtatcgatcttcgctagactaaggtgccttttctacgttgaaattgtcttcattagatgaaggggacctcaatattcgatggtgctgttatgattgaaagattcttctctaggtctttgatgatcaaacatgtctttaatggtcaggggttgggaacacatctccaacatccggcaaccaaattttctctaccagaaagtcgatgtattctagtcttaaaccctcatctatttataccacaatgtggcttcctctaaccatgaatccaactagaactattctagtcttaaaccctcatctatttataccacaatgtggcttcctctaaccatgaatccaactagaactagtacttctaatcaccagcaaacctactaaaccagggaagcagtatccccatacaactccacactccaatcttttcaaacttggactccaatccaaatttaattactctctccatacacacataacactatatgtatgccatatgaaaaacttcacctccacactcattgttctctagcttgagcatctagcgtgatattctcgatcgtctagacctcaacttctaccaagtgtagccttaatccatcaccgggtatactctcatagtctcaagcaacacctacacatggaaaaaaacttcatatgtgagtacaatctcgcaccaacttgacttacatcagcacacaataatatcacatatgaatataaaccatctataagtcacaaacatgaagaaaatctataaatttcacgaaatcaacccaaaatcgactccaaccttatctgactgtcggcaacacggtcagaccatccaatcaccactgacctgatcggcctcctagagctgattgaactattcaccgtccgaaaactcgacacaccatattttccaaaacactcaccttttgataatttgttcagcacatagattaaatcaacgccttaatttcacacgcatgacacataaaagtcagtacttcttatttttcttttatctattctctcgatatatgtctattttgccgtaatttatctactattaaaactgctcttgtagtaaaaatagagctgcgcggttggaaacttcagttatggtaaatcgaagacggcaactgtttagatttctaccacgaaacatgtcatacgcttggcaaaaatgtatagcaattgtttcgtaatctatctatctatcttctatctatctatcttctatctatctatctatcttctatctatctatctatcttctatctatctatctatcttctattatatactaaaggtccattaaacttcctataaacgctctcaagccgccacgtggcacttctacaaacgctcctaggccgccacgtgacaatgtctaatctcaccgtcgattttcacttaaatcggtggacccaattatttggaccattagattagattagatgtatttgatttaaaaagaaactaataccttactattcaccggaaaaagaaaacaaattaaactgattttagtcctcccccgtaccccacgcggacatatgcatccatccctgtatatacgtatgtacaggtaacgtactaacgtacatacgtaagaatagaaaacgatgaatcttaccttacattagatgtattttatttaaaaagaaactcataccttacttcaccggaaaaagaaaacaaagacacttacttcaccggaaaaacaaaacaaaaacacgagtactccatatgtacgtacatacgtaagaattaaaaaacaatgaatatattacctattgtttatttaaagaaaaaaactatgcacggacttactgtaaaaaaaacaaagaaaaaacatacgtgtgtagtaccataaaaaatcgattatatttaaaatagagttttctaatatttaaagaaaatctattactatataaatttaagcaaatatcaccgccgatttttaattaaattggtgaaccaaatagtttaaacaattagatatattttattttaaaaactaataacttattactctgtgtacgtatacgggagaactatataacaattaggctagaaaaagaaaaaaaacgtaagtaatccctacgtacatacgacttggaaaaataaataaaacttaaccgctatccatcgaaagttcggaacaaagaaaaatctactcacggtggtctttttaaatagtattttcgaaatcctttactataaaaacaaaaaaacaaaaaaaagcgtatcattcgaaaaagatcgatggtcttttgaaatagtattatctactatttaaagataaatatattactctacaaatttacgtaaatatacgtagttaaactaaatctatattataaatatgaaatgttcgatcttaacatacaaggctgatatatatatatatatataattaatgttttgataatttcttatttcacatcatattttagggtgtcaaatatcactcgacaaatatacaatactaatttaaatttacatttgtgaaaatgaaaacaacacaatttagttgtttcattttacaccgttagattaattgtttctcctatatacatatatatgagaaatatataactgttgaccggaaaaagtactccgtacttatatatggttgaaaaaaataataatgcttatattgtttgccggaataacataaaacgtatttatgataaaggccaaaaaatgggcagtccttaaaaaaaatttctacaatttaaagataaaaatataataatcttcaaatttacacaaatgtaaatataaaatattcaatcaatgcttttaagtattctatcttttaaattattttaaaattatatatccaatttgtgatccggttgtattcctttaaataaataaactactaatatctatagccataaatacatcacaaatatggagccggcatgtaataattaatgttatgataataatttcacatcatattttaagtgtgaataacacttgacaaatatacaacactaacttaaatgtacatatgtattctccaaattactaaaggtgtctcatgtgattagaaacaatagatgtggaaaacaaaccagacaccgaacgaacatgcactacagtatacatatttgtcaaaatatgatacggtactttggagattatcgtggtaatatttagaaaatcactgtcttggttacgtataaattcttctattgttttgggataaaatttacctccttcgatttatgtgacaggggaatataagtaatataagtctatctttgatcagatgaagaagtatcattagttatatttttaatagaaaatatatttcattaatatataataaaattaaaatgttacctaaagtcatctatagcatacaaaacaaaaaatgttatataaagtttggaaactccaaattttttttaaaaaaatcacacacaatataaatagatatgaactaactctattattgggacatattttttctaataaatttgaggatatacaggttcaagtaatatgcccaacagttattaatgaacatacgtttaaagtagagtaaaacaatatttcaaaaatatcatccacacataaacattcataataataaaatttcaaataagattaaacaacatgctcgcgcgtatgcgcaggctaccttctttcgtttaatagccaaacttaagtataatcaccatactataacaacaaggggtgagattacctccacaaccctatacatatattgaaaatactaattcaataaatattatattaaattaagcaagtactgaaaaacacaacttaacatatacatatctggatatattagtagtgagaaaactaaagcatatacacaatttacttgtattactatatactacttcttaaaaaaaagtcgtcaccaccaccaccaccaccactgacatgttaaccataataatatcaatataactcgtgagtactacgttgctttatcctgcaatggtgtggagtactctctccatcccaaaatataagcaatttttggtagatatgatacttcttaggagtctgtccagattcatagtcctaggagtgtcatatcccctcaaaatcccttatattttagggttaattggatccatgccatcgtaaatatgccttattgaaaatatgccactactcttcacattattagctgggtgccattgaaaatttataaaattggaaccatgccactcctgtcactttttttgtcctcctatctcacgtcgccatcctccccgtcaagtcgccatcctcatcatcacctttccacaccaaagtcggagctcctatccccgccattggagtcggagctcccgtcgctggagcagagaggtgcagggccgcggggcgacgaccttaggcacgccggcgtcaacatcggtgaagggaggaggggagagacatcaactccaccgcgccgccggccatcgactgtcgatttccccttgtagccgccggccaaccgccggatccgcgtcaccagagaagagctcgaggttgtccaccaccagatccacgccgtcgtggtgggtggtgttgatggtggtggtgggcctggtggcggcggtggcagagtgtgggtgctggcagggcaagatggcagtgatcgcggcggagaacgagagcagacgccggtggatgagacgaggagagctctgtgtccacagcctccagcagcgtcatgcggctcggcctcctccctggcatggaagaaagaagcggaggggaggttgtcgctgcgcctgggcagcagctcctcatctctcccgtcaccgccaccgcgccccatgctccaacctgttgtcgcttgagcctgtcgatgctgaacgggcaagcggcgggacagatgaacgacagtgggacctcagcggctcggtggtggcttctctctcaccagatctggacagagatcctagcccgtcatcgtcgcgctcatcgacgagctcgagcagatgcgcggcccgctcactgccgccctcaccgaggagctatcctcctatcccgttccttcaccatccgccgtgccctcctcctccggctccctcttcgacagtccacgatcaccgcgtggagtcgtcgccgtccacgaccaccagctagccttcccggagcttgctggccagcttctggcgtaggcgtgctgcttgcagtggcatctacccgaagtagatgaaggcaccattgatagaaaatatgacggagacgacagaaatcatgatggagtggcattgttctaattttagaagatcgcagtggcatctatccgatttcatgaatagtagtgacatttttttcaatatggtatatttacgatgatatggatccaattaacccattttaggacggagggagtaggtgtgtattaatagtgtttaactgctcttgctgcaagatagtcctttatttttccattaatttgcttcttgccatcatgattaaaaaaactcacaaactatttagtttcttttagtttaaaatgagatagacaacataatttagtaacaagtacatactttataatcatataacatctgaaaaaaaaatctagcaatgccttttttttttgccttttaagatcaagtcttgtttttaccaagttgaagctaatatttttttttcaacgaggatgcacgagatatgttttctattttgaataatccgttacaacatataaatatttggctagtacattatacgataagaaagatacttaaattgtgttctttccttccctttcccaacttctaccactcgtttttcgcacatatgcttcccaaaccgatgattttttttacaaaatttttctatagaaaagttgttttaaaaatcatattaatctattttataagttttttaagctaatacttaattaatcatatgctaatgtaatcctccatgttacataccgaaggattagttactaacctaccataccgaacacaacgttaggctgagtttgttctgacggtcactcaacacatgactaattaagtatattaaaatttttaaaaataaatcaatataattttccaagtaatttttctataattattttcacaaataatatatcgtttagcagttaaaaacctgtgtgtgaaaaaaagaataattaaaagttgagagaggggagaaacgaacacaatgtgtgtttagttcgtgccaaaattagaagtttggttgaaactggaacgatgtgatagaaaagttgaaaatttgtgtatgtatgaaaattttgatgtgatgaaaaagttgaaagtttgaagaaaaattttagaaataaactcggccttacatttggggccataaaattgcatgtttatccatcctccacaactcttctctctctcaccgatctgattgtgctgtgcgcttgttcagctgtgctgctcggtttttgctcgctatgtgcacgaaaaaaaatcccaaaaattatattggtccattttatatcttcaaccagttgtaaacactaaacagctgtagtaataagtgggcttaaacctcaaaaatggctacacaagcccaagcgatccgcatcccaaaccattcgaaattcaaattattcccctcttccgctccatctccttcccgtctttctctctccacacagacagcgcacgcatccaccaccccccaacacgggagcggagagctcgccgccggcgatcgccgcaggattctgagggcttcttccggcggccacgggagatggttctgctcgaacgcacgccgttggtggtgcccgaggcagcagcagcagccgccgccgcctccagcccgctccggaggccgtcgcctagggttctgagggaggtgcccccgccccccctcgatcccatcctcccctacctcaggtaatggctagatcagtatccatatcagcacctgttcccttcgatttaggtcctatttgggggcgtgggattccgccgtagcgctgcgtggaataatgcttggtttcgcctcaagttgtgtggcgtacgcatcgtactgggattctgtcccttcctctgagttatgtagttaattgggcgtgtgatttagattttgacacttcgcctctgcgattcctgttcaattgctcagtggcagtgtgcagttgaacttggacgaacggaaatgtgagaaatgggggcgtgtgtgttccgaaaaaaaaaaaagaaaagcaaagggtatgaccaccactgtttgagtgtctggcaacgacagaagtgcattttgccgagacattgtgactggtcactcgtaatgtccagtgttgggacttgggaaggatttagttttggagctgatttgttttgtgcagctaggttgatttttcttgtgaaggattagcttgttcatgtggagacggttctcttattcctttatcagttcttgaactgtcaagtaatgtaatgtgcccactttctgtgctccttctgtactaatgtgctgctttctgataggtccttttggtaaaaactttgcatatataacttatttttatgttcctggtactattatatctattttataaggtaaatctaatctttcatgcacatgctggtattcatgcataatttatctatgtatcactgcggtttgtttgtcctggtcagggccccagtcctggtgtatgcattcgtttatgttagtttctgacttggtattcaggtctatcaacaaggctatggatgagctcaggacaggcccaaaatttgaagcagcagcgcttgatcggctcaagatttgtgtaatggaatgcattgataagtatggtgacgattaccagtactccacagacccccgactcctcaagatctggatcctctatgtaattgtttggctttgaagtttcaattcttaccttatccattttctatccttttgctcatttcccccccactttgttctatgttaggcggatgcaataggtgattttgataaggcatataagcagttggaggagaaaagaatgtttttagagcatgcactgctctatgatgcatatgcactgtttctcttcagtaaggggaaagtgctggaggctggtaaggtgtatgaagttggtatttccaggttagtatgacactgaattatgtttttgttgaagtgaactttttgggcagcaacaatctgatgtcaaatttgtcatgttgatgtgatcgcaaatcatttccgtggaccagaaaagccgagccacttgatcatttgaagaagatgcatacgatatttttaaaacacttggagaagattgtagaagaagcagatgccgatgcccaggtatgataactgtgtggtggaatggacattagttgagtccttgaatatttgtcaaatgattcacatatttcatattcaattgcatttttagtaatcaggacattgtggctgtgttgtagatttgttagtattttagctatggtcagttggtcacaaggctgacaaacttgcagcagtaagaactaagaactgctttgatattgtttcttacatgatatttctctgtggtggaacatttgtttttccaaaaaaggttggcaagcaataggataattgtcttcacatttctgtgcatgtgaactgtgatacattctacataatttattcatttatttgcatgtttgcatgttgtgaacttaatatttatttggggctaatcacaatgatatctactttgtacttgccgatctttactagctcgaacatctataacatctatttcaactaaatacatgacggtttattttacattttcatggaaagagtttctgttctgtcattcctgcaactctatttatacaaaaatagcatgattctagttatttagagtggctttttttattatatgtttagggatatattttatttagtttaatcatagttgggaatgaatttcaggttgtactttccactgattcttgtggtgtatgtgttctattatgagtttgtctcggaaatatattatttatgctatgtggtacattgatagaatcgggagtgcatttgcacagctttaccatagtgaagtcagaacataaatatagggcactatcagcataacagtgccataccaaacaatcttcttatacggttcaattcataaataaatagagaaaatcgagcaaattgcaaaagcaaagaataaaatgaaatatcgggctgaagccacatgatgtgccattgaaagctacatccctgcccctgcttgagtggactaatcattactagataaagaaacatgagacatgcaatttctatatgttttcgaagaacaatatctatataaccctgttaagcttgtgaagtaacttatgcaaaaacctttttttgtttcttttacttgtcattactggccattattgtagccagcatatattatagtcgcctaatgctattcttctttgtggatgattcaccatactaactccatttttttttgttactgtctgctagccgaaaccatcgaaaatacaaaagaaagaacctattttgctggatccatggtctgagtctactatgaataatttattggagaacattaatgttgatctgaagaagttcgctgtaagttgcatttactctatatgattcgctagtgtttatcttagctctcatcttggacggttgcccgaatccttgacagggctatcataagagcaataaggtctatcatggaaaggtgccattaacttcgcctcagaatgttttaagaaacaaagtcattgaattaggtataaactataatttcttgcttgtcagtcttttaccaaaactataatcatttttgtagtttggctcctttatgatccatgctctgtaagtcacaatgaatacataataatgctccttgaaaaaaaggaagaaatatacccttttttatttagaaaaaggccatttatattgatgacataacaaaagtttagttacaaatcccttttgttgcaccaaggtggtagaaagtaccagatcaaaggttctcctggtactggtgcttttgcaaaagtttacaaagccagtgtcgatggtaatacagaagacctggttgctttaaaggtgagtcatacttccatttgtcttactgaagcctgcttttttcatcagattcctctactgaacttgcccgtttgcagattcagaaaccaccatttccttgggaattttacatgtatcgccagcttgatacgcgcgtatctgatattgaggtacagaaattatctttaagaagaccataacatttgtaattgtaaaattatgattcacactgcaaaataattttacttccagagaccaagctttggctacactcatgaagtgcatgtatacgctgatgtcagtgtgcttgtttgtgattacctgccatacggaactcttctggtaaaatactttatgtattaatttttttttttgagatcatgatcatgcaaaactagcattttgtgcccggattagtgaatctgtgtttgataagatgcaaatcttttgcaggatgttataaattctcatctagtacttgaacgccatatggatgaagttctatgcatatattacactatagagatgctgcgcatgttggaaacactgcacagcgttggcataattcatggtgatttcaagcctgacaatatgcttgtttgctacccaaggtaagtagaggtaaccagcttagctttcaagttagaacacttgatggagcttcctccctcttcctcttgtgatctctaactgaaatatgggcaaaacacacacacacacacacacacacactctctctctctctctcacacagacacacacaaaactatccagtgaccattgacatcttacttttcataaaatcgacagatttattctagttgcaatatttgtgtgccgtccatttgcccagtgcccatattctcttgctatttgttttggacagatcttgttaccatgtttgtgggtgatgatgtctgtgctgtaaatattttactccaagcttcacaaccatctacaacttttataaactagatgttatatttaaactgatctaataacatagttttcaatgaaaatatttgacatggatggtcataacaacaagcatgttggtaagtggtcaatttgttggccccagatgttgggtttggtgggggcaaagatccttgctgatttactactgtttcaattactttatatgagcggttactggaatcttgcttgatggctccatcctccatgtttccgctgagatgacgattttttttgtcatttttgttggccatttgctgctattggcttgtttcggccaaaactcaattataacccatctagtacatgttacgcctgaaaaaaaaagaaagagtaaacctaatgctagtgtctgttcctttttgttctcgctatccaagtcttcacctcttcaatctttagcccttgtctcgacatgtaattttcgttcacccgcatctttgttttgcgtgtggtggtctgtgcagtggagaaatcacagacgaaaccttcaaaggcgagacaagatccgagcggaatcaggtcagcttctcaatcccaagttcccaacacgccgagaaacttggttaagatgttctggatatctcctgatgcttataggattcccattccaggggctctgccttgttgactggggccgtggcatcgacctgaacctcttcccatccggtgcggagttctacggcgactgccgaacctccgggttcagctgcgtcgagatgcaggaacagagagcctggacgtttcaggtatctgtaccctcccaagctacttactcaaaacctcctctcacctagacatctctgaaagcaacccctgcctgacgctgccagtttgtttgttggttggttgattggtttcttcctgcaggctgacacttacggcctctgcgtcatcgcgcacatgatgctacatgggacgcagatgagcatccagaagacgcccaggcccgatggaagctacatgtaccagcccacatcgccgttcaaaaggtgctttgatgccattgcctatacacctctttgataatttcctctatcccaaaatatagctactatgagatatttttcagtactatgaatctgaacaggtttagaaaatatctcatcctatgctagttagttatattttaagataaaggtagtagtaattaccatgattcgcagtagcgtaaataaatcagagattagattagatggcatatgtaacaggagctgtttgctgccattttgccccttgacaggtactggaacgtggagctgtggaaaaacctcttctccacgctgctcaacgcgacctccaacggcagcgacgcggccgtgctccggagcctccggatgtccttccaggagtacctgtgcagcaaccggcagctcgtcggcaagctgaaccagcaactggccaagcagaagacctccctgtgcctatcctgaccgagacatatacgcatctcgcgtttcatcctcatcatttttcccgattccctcgtgttgcctgtgtgtaaagtggtggagtataagataccttccgtaacttcgtagcacttcctctgtgcgtgcgtgtgcagcagtaattaacgtgccacatctccactttgaaagctgaaacatctactattgggccagatggaaatttcgtacagtatcttcttctccaactagcggctactaggtaccatgcgtctgtcacgtctagaggagttttttctttctttcttttctttttttctttttttgccatggtggtcgagatcgagtgagatttgtgggcagtgggcgacgagcgagaccaaacggaaacggacgaagcaacgagcgtacggctcgtgaagtcaaagggcgcgatcagataagatgaggcggtgatggtgtgtagtaggccacaggggctgggcccaattccagccgtccccggcccaggctgacggtcgctgctggcagttctgtttcgtgtggtcgcggaggccgggccttcgtcggtcggggtatcgtggacgtgatcccgtcgtcggaggacgtaaggtggggagcgtcatgcgccgcaactagctattcttacgacgtgttctaaaccacactagtggaagtacaaattattcgtgtcacgtttttatatttacgatttccctaaaatcttctgggagtagctatatttatatttatggtgtcatatttttcatcaataaatagtcaacatgtatttacattgtaagtatctaaattacatatgtaatttcagtgtatatgtaacgtaagtcataaaattacatatgtaaatccgaaaattacatatgtaagttttaaaattacatatgtaattatagtgtaaatagtatgtaactatgatgtaaccaacgtgtcatcatccatacaggaaaaatccgatgctaataaaaaaaggcaaaggattaataacgataaaaaggaaagctgcatccctcaagcctttatccaccgtacatcaaaccatcaacggccagagatccgactgttttcagacaagaaaaacatgcgacacataactttttacctcggtattgcttaaaaatatactatttcctaattaagctatttgctagctttataatggttaacttgtcgatatgagcaatttccgtttggttataatctatctattcatgtcatccagttataacgctcaggttgggtgaatattgttgtgctggacggtttcttccaaaacaaaacgtactctgctaacaaaaagtggctatagaagaacgtagatggttcgcgtattgcaaccatgcatctactagtaacaagtacacaccattgtatttagtaacagatctctgtcctaagttaatttattccgggacactgattgtactacggaattacttgtaagtaccagctaccaggtgtagggtgtgttttcacgctaaaattgaaaatttgattgaaattgaaacgctgtgacgaaaaagttagaagtttatgtgtgtagaaaagtttcgatatattgaaaaaattaaaagtttaaagaaaaaaatttgatactaaaccaagccgtagtacagatggctcggtttgacttgccggccggccaggccggttgaaggatcactggtatatatgcggcggtcgtgcacgggcgcgtgtggtgcggttcaaggagtggccgtcatcgtggctactactttccgtcaaaaaatcgtggctactactatagccgaagaatgataaggatgtttgctgtgtgtttgacgccccgttaatccaacaccgtttttgcatataattgcattgcacccatggaccatggtcgcgcgcttgtggcagtcgaaattttctgcgtctgtgactgacgatgagaggtactcctgtagctagctagaagcgtcggaaggggtgaaattaaagatcgatttctggtgttgtacgtacgtggtcgctagatctggttggtgcctcttgcttttctgggctcccctggaaaactgttactgctaattttagccccatttatcgatcggcccgagttccataccatgtctcagctcctgtagccgacctacctctgtcctagctctgacacgtcacagaaacgttaacatggtcagttagtcacgctgatacataggagtcgtagtacacagccgcgcgccgacccgaccgagccaaccaacctcccaccaacccgtccatcgcacggcgcggcccacgccaacgcaggcaagtcatcagtcaggcagccggccgcccgcgcgcgcccgcaccgtagcgtgcaccgaaggtgatccggttgtttccccgtgatcagctgtgcctgtgcacgctgcccctgctcgatctgcatgcgcgcgcgcgctgcagaggcagagcccgatcacatggccagcacggggcctgtagctctccacatgccgttgacgggatgacgggtcggcgcgcgcgatcgatcgatcgcggcgaaacgcatggtgatctctgatcaaaaacccgtacgcgcgatagggtttggtggtttgctgctgctgctggctgctgcggctgtgcaggggggcgcgaccacgcacgcaccggccacgcgcctgcggaccgatcgatcggtcgatcggcggcggtctcgcgcgcactcgagcgagcggcagagcgcgcggcaccgttggtttggttgggtgcgtgggtggttaacagcagctgggtggttgtgattggattggatggtccctgcagctggagctggggtttgtgcggggttgggtcgttggagttagctgggttcgctgctgttgtcgccacgcttgctggctactaggaggagtacgtactaggcgtggtcaccgtgggcgtattgtgcagcgagtagtagggttgtagggcatgcacgctctggacagtacgggtgtacgggtctgtaacacgcgcgcgcgtggtaataattaacagggaggaaccaaatagctatagatcgtaggggggaaatgagttacttgtcgtgataagagcgcaaaaaaaaaaaaacacgtacgactacgtacgccggtatgtaatttcaccttacgtatttttggctagatgatttggaccatcgaccaatcgatcgccgctaatatcaaacctcaagtataagagcacacgatcgattgaccacctccaattaatctccatgccaaagtagcaaaatatcacatcactcatcttcgaagattgtcctccttaaaaccaacaaatctaataagaaataatagaatgtgacatcctataatatctcagatctcatagtaggtatatttactttaggatgaaggtagtagccgtaaacggcgtgtgtccttgcgatgcttggttaataaaggaaaggaaattgataaagaattatgaatgatcaatggcactatttaattctcaggatcaaattaaccgaaattgtttattactctcaccgtcctaaaatatagcaacttttagcctttaaaatctatcccaaaattatatctacttctccaccgacattttttttcaaacaaatcacaaccttccaacattcaatttccctaccaaccttcacttctcatccaatcacaaccttcatcacatctaattctacctatttctcaatggttgtgtccaatctaaaaattcttatattctagatgaatagagtagcatattttagcgcggatcaactaggtggttgatcatctgtctgctagttagccaaaatggccgaaagtcatctgcgcgtacgtgggctgaccatggtttgcattaccatcggtaaccacacggttaccggccttaccgcagggtacggtaatagaaaaaccacaataactttcttaaatttaaataaatttaaaaataatttaaatttttgacaaattttacacggtttcgtacgatttttcacggttaccacagttatagcgtgttaactgtgcttaccgtctgataactgtgcttaccgtcgaggcgcagtaaccctggccggctagccccggcggtttaggaaaccatgtgaccgaccgggcgagtcgtgccggtgggatcgtcgactacacggccgcgcacgggcatgcagcgcacggcagcgcaggcaatttttgatcgatccctcccgcgcgcggttcgactgttggagatgagatgagtgcgtacgtacgtgcagtgcgcagtacgtacgtggtcgcgcgcgcgcgccatgtcaggctggtggtggttaacgcgcgcgcgcgggccggcatgcggcatgccccagtagcgatatagatctcgatgccgagaccgacctgcacagttgcctaggtttgcatgcagagtgcaggctgcacagtgctgtgcacatgcagctagctagctctagctacgggcgcgctcgctgatcagttggccgatcgaattagcgtttcgcgccgtcggccaacgattcagtttcgaaactcgcacttgtggagaaatcgtttttatacggttcgtaacccctatagtcccgatttgaaaatcgagactatgaatccgggactaaagatccatattttagtcccggttcaaatactcgggaataaagatgggagcgggcaatagttttttttttcatttacttactatttaatctctaatttattttctcccaaattaggtgggatgcatattccttaatcaaacccaaatacacaaatcaatcaatcatatacactacagattatacattccaaatcaaaccccaaatcaaagaaacatcccaaatacacaaatcatgtacatctcagatccatacaatgagattccaaaaaagaaattatacatctcaatccatacaatgaaccacagattcttcatctcaatctatacatggatcacaaattctttgaaaaaaaaagaaaaaaaacgaagcaaagccgtcggctggctgagccggctgctgcctcccctcctccccggccgccgccgcgccggcccccgcctcgcgtccctccgccggccgggccgcccaccccctcctgctgctcacacgggatcgagttgggaagggataagaaggaaaagagataaggaggaagggaaaggataaggattagagatggagggagagaggagttggtgtggatgagaaaagagtggatgagaaaagaggataagtaatatggattatatagtgcgttttgatctttaattccggtttgtaacaccaaccgggactaaagagatccgatctttacttcctgttcgtaactctaaccgggactaaagatcctggaggggcctgacaacacctgacagcatgtgaaccgggactaaagatcatgtagtctcgttctacttataaaccgggactaaaaaccatctttagtcccggtttttactgcatccgagactattgtggtttttagtcgaccggccaaagatggtttctttactagtgtcgatccaatatatccacgtgtacgtctcggtgggttattctttgcagtgttacgtactctctccgtcgaagttttagtgttgaacacggttattaagaaagcaggtagaagtgagtggtgaagggttgtcattggatgagtagtagaggtaggtgggaaaaatgaatggtggaggattgtgattggttgggaagagaatgttggtgaagttattatattttgggataaattctgaggaataaaatttgttatattttgggaccatagggatttttttttgaactgataactcgggaattaatcaatctgctagctagcatgcactatatgcttgtagcagcaacagactcgttctaattaaatacgtgaaaaataatcgaagtcattagtaaggttgtagattcataggttagccacatcaaaaaggaaatcaggagaatataaagagtacatactactccctccatctcataatataagacgcgcacatattttaagattcaacctttaaaacacttgactaacacttagtataatattaaataaattttatttgttaaaaaatatattattagattgagatttaaattactttcatatggttataattttgttgctacaaaccttatagtatataagaaattataagttaaacattagttttggagaccgtgccaactttgaccatgccttatattccctccgtttcgaaatgtttgacaccattaactttttagcacatgtttaaccgttcgtcttattcaaaaacttctgtgagatatgtaaaattatatgcctacataaaaatatatttaacaataaatcaaatgataggaaaataattaataattacttaaattttttgaataagacgaacggtcaaacatgtgataaaaagtcaacggcgtcaaacattttgaaacggagggagtattatgccaactttggagatgattgattattctctacggctagctagttccaattacttagtactccctccgtcccataaaaaaaccaacatagtattgaatgagatattttctagtacaacgaatttagacatgctcttgtccgtattcattatactagaagatgttatatctatagaattggttttttttaggatggcgagagtacagtagtacgcatgcaagggtggcaaatgtaagaagcagcagctagctagcaaggccgggttcaatttcaatcgatcgatcgaccgactgcatggaaatttcgagttggaatctgaatgtgatgatgggccgtgcgcagggtgcagtggggtgcatcgctcgcgcgcgtgccgacattcctttctcgagttccgagccaacggatcgatcgatcggggaatcagggaatcagatgcccctgcccccctagctaccttctctcctttagtttgttcttcccatcatactctccatggccatcaccatgatcgatccctctcctctctccacaagctaccttaatcagcttagcttagctatccctggaccaggaataatattagtttacgtgctactggtgaccaagtattggagcactactactactctagtatgtagctactactaattactctatcactctgttaatcgatgctgtcgtttcctccttttaaggccggccggccagccagccaaatccatccatctctaactctagttaatttaatctcgaaacatgaacatgagaataaggttttttatcactataaacactgacatggtcactgtgacacttgctatttgatgttaattactatgtataacagagaaaagttataagagacattaacaatctcttataagtataaaaactacaaaaatatatagtagaaaagttataatccattttctaaagttgcatgaattgaaatactaaaagagatattaacaatcaaaattcaaacatattgactgcacttatttagactagaggagtacataaaaaaaatatatgtatgcatcctaaacgtagagaccgaggatataattcatctttccttatataaaaaggtcagaaccgatgacactagctagctaaacaacatagtacaaatttggctagaggttttcctggtctcacttggatgtacatcatggtatggattcttagtacactagctcgtagtactatactactactattcttatatgtgataactccagcccatacagagaggaacatggatgcatgcttgctagctaggtatacatatggtcccagcaatcaaatattggaagtacgtatactagcttatcaacaagcactaagtaataataatactagtatagttgagaattttgacctgatacattcgcatgcttacccaaaaaaaattgtatatatccagctaacacgaccaatgcaagtcattattcacgagtcttaaatatatctccatgagtatgacttgtgagacgacaactaaaagacaaggccaagctttcttaatttgaaagctcacctaattaattaactaccaccgatcgatgtatccccagccttcttaattagtgcatcaaatgtggctatgtaggcgatgaagggtcgacaaataacgtaacacccaattaatgcaactttcacacacatgaatgtgtgtaggtatgcatgtgtgggctacttaactactccatttcaactctacgtatggtactccctccgtttcatattataaggctttctagcattaatatctagatttattaacaactatataaatgtggctaatgctagaaagtctaataatgtgaaacggaggaagtatatagtactagtagtacctactactatcacatatgaatacattgtgtataaaacatctcaattcatttagacacacatgcaagctaaaccctctagctgcttcaattccttcatcatcaataaagttcaggaataacacagcaatgatacaaagtgcaaagagacaagaacagaatgcttaaaccaaacacccacacagcccaatgcatgctgaagccggccggccatgtaaccctacccatgattgctagacaaggcatccttctccaagaagcaaagccacagacagcagtcaaaatcaaaaatcccagaggcctttaagaaaagtctggttaattaggtttactacctctctctatccatccatctctatctctcttgtctctcccaatagctggagttactagaagaatagatgatcatatatattctacttgcaacagtaaccacttcaactacgacaacaagatcactcttttcaaaaaaaaaacaagatcaagacacatgcatatgcttccctgaaatttcttaactgaatttgcccatcctgtttacagatctggtgcccactgatagatgatcatgtagctggcccattaatatttcatttcaattcaattctggtctatattattttctactctctatggcatctttgtttcatcatcaggtcatggagttggcaaattggcataccccatgtgatggatgcaaccatccaattatatatgcggcatatgcatagctagctagcttagggatgcgtgtgagattcttggcaggagccaatcctttgtttgggccatccatttttgcttgcaagatgaggatgacgcatcactcgcctataaataaattaagcccctgtcaagtagatttgcctgctgtcctctaattagtgtacttttaataataaacatagcattatgtattgttgtgcgattatattctctttccacaatattctaagttcttctaaagtttaaaacaaactaaattattgttaacacgacacctaacactgtcctggaatatgtctgcagtaaaccttgactgaccaccgactgaaatgacaatattcatatatttatgtcacaatttaattactaattaataaaaacagtgtgttacgaagaactttcatggccggccatgcatgtcccatgcccgtcctgtatatttctatgaaactgaagaccacctaattaaacaacacatacagactagataaatggatcagatcgatttcaacttgctcttttattcggatagaatcgtcagcattactgacatgttttccttttaaaaaaaaaggaattagatttcatggttatttattacatttatattaggttagatagattcaattaaacacatatagattgagaataagtgctgcagctagcatccatgcttggaattttacacatactctctctttctataaaagttacacctattacttttgtcactaagatcaaggagtgtatgcacgcatacaaccaataagtaataatatgacttctggggtctgatcaaatatttaatttacctctccatttaagtcttggatgcataaagactacaaatatgattaacttatttgaaaataaaataaaatataaaatatgtctaactcttgtggatggagggagtacaagctagtgcgcccagcattttctgctgaagaacatcaataaattctaagcatttattttacacaacatttcaaaaccagcagtctcaggtggatggccccaaactgattgtgatttccaataaacattccactagaaaaacaaaaggaacagacagacattcccctccgatcaaacaagaagaaaacaagcaacaagtgaccgacattcccctgggattccgtgccggtttaattccacaaataatatataacaaaactatacatatccgtgcatgcaatttgcacccaagaacagcctaaacaatgcaatccgcgtaatacaattcccacataaactattagcacgcgtaggtgcccctcatgtgattgtgcgtacatgttcttcgatctcttcctacctaatcttttgcagtattttggctgtcgattagtacccgttggtttgtttattgctcacacagcgcatgcacactgccccagcactgatctaatccctgccatgacagggcaagagagataattaatcatttgcatcgatttggattggaacgttaggggtgagatatgatagagggagggattaaacaaatgtgcttagtttgatgatggaatgtttttgcaggatttgtgtgtgtatggtggttgcgaggaagatccacctgttcttcacctacattcgattcttttactctccatccgctctgcagctagcgttgtggccgccatggagaccgagatagagagagaaattaagtcccatgcattgtttactccgatgtgttaggccgggctgcactgacattccatgggtcccatagagacagccagctgctctatctcaccttctcccttcacaatctctccctcttttcaccctcttcgatcatgcgtttggtcaaactaatcggttgtatatatgcactcttgatataatgcagaggtcggatgcattatactctttcattgttaactaaaagaaatacgctattaagtgctgtcccttttacatgcctaaaaaaaactacatttgactcttataagggtgtatattggcttggtctaaactctagaattagagacgtattcgcctctgccaagtgtattgatgtggacagtttcatctccttttgggctatagtttcacaatttgtgtataatttttgtctcggtttagtggtcacatcgccaattgtgaaacacgatggatggtggaatgacaaagacagttggagcatgccatgtcgtttgttgctccacacagatgaggctgcattgtgtggtttgcaacagagaggaggttaaagaacacacatcgtcctttgagtttagagtgacatggaacacgtacaaattatgctttagccacctctacgaccatgcatgtcttttatgaagtgatcagtggcagagccagcgacaccgtcgagcccgggtgggtaattaatggtgtttctccatgatctaccaatttttttatacgtcgatcgtaatccgtagtgaagatggcagtgacggagcatgggcggtcgcccaacctgttcaggagatgtccccgccgctagaagcaattgaaacgaaccagagctttgagatatttaaataagaaattatcgaagaaaaaacatatgagagtagtcgcgtacacatgctgctcagtttcaacttttaacatgttttgtttcatcataaaagtatagccaaattcgcaattatttttaacatctgaatatctagcttagatgttatacatacagatctgtatgtataacatcatggtatactacgtacgctactgttttatcaagtcaatatatgtgagacgtgcccctttatttagcaggcgccttttaccttcagtaaacaacaagtgatcagccatcacaatgatttgcatggttgaatcaacattatattcatctctgtactctgcattattactgttttacagagtactaattccactagaggatgcatcagaattattgcatgctgcctgcacgcaggaggaggtgcggatgagaacaaacaatgcatgcattgcatgctcaataatcatccacattttatatatatgcgtcgacaaaaaccgcacacatctccatcctagtacaacgtaggctagcccatgcatgcatgcaagcagcatcctcacatgccaatcgatcgatcgatcgatcgagctgatgtctcttgtacaaaagagtggaccgatcgatcgatctagcttagatggagccaccgtgttttgtatttctgcgacagcaattcaatcagaaaaaaaaatttcatcagagcagatcaagaagcagcagctacgagacacacaccttaacgaaaaagccatatcacgcatcgccatcctctacgtactttgcatccatatattttcgtcagaaacaacatatatactactctagctagcttctctctctctaaccatagccttgttccatccatccatgcatgcattgtctgccctatctagctttgttagctagaggtggaccatgcaaattgcaagcaacaacaagcacaatgagagagagagagagagagagagagagagagagattccaaggagacaagcatggcagatgggggaaggaggagagggagaagaaggagaggagatagatgcaaaatgtggtcctcaaagtactagtgctggtccacattctggcagcagcactttgggggtggtggggtggggaggagttggtcctcactcctcactcagtagtagtgggtgcccagtgcatggatgcatggatggaggtctggaggaggaagaagctaagccaaaggccggtgcatgctgtaacagtagtacaaatatgttgaaaattcagtacaccacaccacagtgacagtaccaccactgattatcagctggatgctgctgctagctgctcctagctactacatggatgcccaattgcccatggaccagagagagagagagagagagcaagaggggtcctggaattaatctggttaaatcaggggagccatcatggctaatgaggctgattattatgatgacattgaccatgatgatggctttggggcaactaatccacatgcatgcatggccagccagccagggcatcatatcatggcgggctatagtacgtggacggccgtgcatatgggtcagaggccggactgtgttgggagagcatgcatgactaatttgctctgattagctagctaggtatagcagctctgacccctgcaagtctgacacctcaacctaatcaataattattcagtgatcaatatgagctcgatcgatcaagcagcgcggtgggggtgcactggtctaggatattgttgttcttgttcgaccgaacctccccctttttcttcgctcggagatgattgatgctgcgaaacacagacagaaatcttcgggcagttaacacggttgctttcgcgttaagaatgggattagttataagggtctatttaaaaatatggtgacaaatataattatagcataaatgtaatataattacagatgtgattagtgtaattacatatataatttaggaacttaaatatgtaattttcaaacttagacttacattgtaaatacagtaaaattacgtatgtaatttagagatttacaatgaaaatacattttttcatgaaaaatatggtgtcacatttatagcaaatccgtagttataattgattgagtgatactatggttcctgagaaggcatatttttgtaacgtaaaatttaataatatctcggtatacctcttaaatcacaatttttttaattgatttggtcatttttcattgtcgctagcttggacaaatgtactttaggccgggttaaattaaatattttccccagaggtctctgtagttcaattcactgttcttgtgctacagtgtactactatatatgcttcaattaattccgagtcatggggaaaaaggccaaaaaagaagaaaaatattacttgagcagaattgaatttactcggttattgattatttacacgcacacggatgcgtgcgcatgaatggtgacaaattttagtacgtaaaattataacagtatacaatcatgcagcgtgcatgcatgcaggcgtatgtatataccactgtagaaccctagctacatcgatgttgccaaatcattgctggcccatgcccgcttggcttggtcctagttgccctgtcactatatgctgagactgttgctgtcgacgactacgacgaatatgtactctctacatactccctccatactttaatttatgacgccgtagacattttaatcaatgtttaaccattcatcttattcaaaaaaaattatgtaattatcatctattttattgtcacttgatttatcatcaaatattctttaagtatggcatgaatatttttatatttgcacaaaaattttaaataaaacgaatagtcaaacgttgttcaaaaagtcaacagcgtcatacattaaaatacggaggaagtacgttacagagacatggatgcatatatgcatgacatgccttgtacgcattcatacacgtagtaatacgtacatggtgcagtacacgtatgcatgcatacactggcgacaggtaggagtgaacagtgccttgaacggcgatcgatcgagggactttcgatcgtacgtttggaaagaatccggccctgcagctttttaaattttatttaaaacttaattacattatttttaatgtggattttcacccgctcagaatatatgtataaaaattttatctataaattatttttttattgctaataaaccgtgttagcttatattagctctcggtaatcaatggaatgtaatgactggttcggcgtagagatgaaaaagtgatccacgccttgctagctcgaacctaccactacagaaacgatttttatctccgatcaaaattgactttgttaggcgggtggatgtcccgtctgcacctaggtgtatgtggaaattgatattttttatgcgggtagagcaaccgcatgcgatgtgggtgtttaagccgtccgaagataaaaagaaaagttagtaaaaaaattccaaaaaagtccgaaaccctagcaggtcccgcgtccagtggtcgtcaccaccattcttgtgcccgggcttcgtcctcgccgtcgccaaagcactccttgctgtcagagtcaagcgttgtatccatgcgcgtaggaagccgaggcggtgggatccgcgtgggagagggacagcccgccgggtccaccgttgccgagctcaccgccgaatccaccgtcgcgtcctccacaccactggatccaccgccgtcgtcccttccctccactgacctccccaccaccagatccagcgccgctgccctccccaccgtccgctagttccccgccactcccgctctcgcccaccgccgatggagagatgaggaggaaagaagaggtggagaggaagcagtggaggagatggaggaagtggagggtgaggatgaggagagagaggggtgacttgatattttaagggtgagctcgatctggtagactggtagcaggcgggcctattaacatgttactttcactattaacatgttactttcacaagtgaacttttaacaaacacacttgcaaaaattgtcttttgcatgcaatttttgaaccattctcaagggaacaatttttgtaggaggtagtagttatggcatatggatggttattgatttttttaagtagaaatattgatctatatgtgatatttcgtttttgcaagtttcagatctcatctaaaaaatcgcacgtactgccgagtagatcatcgaccggcgccggtcggcaagattattatacgatcgaataatgtttcgatcatgcgtgcatgtgatctgtgtacgagctactggctacgcatgcaataatctggtacgtaccaataagcaagtaagctagaggctggccgactgtgtgtggccagactggttagatttgtggctatgtggcctactgtagatgacgtacatgcatactacattacgtgtacaatactattaaacacatgggattgtctggttttttaggcacataaaaacactcacaaattgtagtcacgcctaaatcataccaatatttttggataaagaataattttatatcatgcaattctttctccccacaacgtgccatgttagtgtgaactcgcctcacacacctcaccccatagcgctgtcaccaagcttgccagggccggaagctctccagcggctcttccccacctcctaataacctctcctgatttgacgctctctgccgtcgaccctgcccatctcccccctctagccccatagacccaactacgtacactactgtcacctcgctacatgctcttgtttgccatccaccatgaatccaccgtctccctgcccatccctttaagcctatgggagttgaaccactctcttccaccagccaaaatccccacccccaaaaccttaagtctaatccgtgggtcctctatcatagttaggtgtcactcatgatgcggaagatgaaaagatcgtaaagaagtttgatgttgtcatcgttgttaagccatggctaccatctccctttatctcacctcttttcttgcctccccttattctagatgctgcaggtgactgaaatttctcataaatttgaccacctgaaacaagcaattcactaagtaaatttaccatttctacggacacgttttttaacatgttagagttcagtctcacattggtggtgaaagtacaatatatcttgtttaaaagttatcccctcaactcgtaagctagctattaaaaatgtgtaaggtattttaagtccttcaattagtatcagaatatggctagttcaatgcatttaacccaatgaacattattagtatgagtgcaagcggtgccctgatggtacaggtgcatataaaatacaatcgtttctatataaacaaggtttatgagatgtatatcaaatatagttctagtgcttgtggtgcctaacagtatatatagttatatataaaaggaaaaaaaagaattacccctaaactatcgaggtcaattgaattaacccactgaactcaaacaccagacattttacaccattagctatgcaaaccggataaataaccccctttttcaaaccggagtatagttttggtcctatgtggcaatccagttagcaattttatttttaaaatccatgggccccgcatgtcatactctccccttctctatctctttaatccccatcctctctctcttctcccttccctcacctccatctctctctctctctctccccaaactgagcagggaggactaggccgacgacgctgcttagcggccggtggcaggaggggctcgagcccgtgtgggcatagccgtggccagtgatagaggcagcaggcgacgcatgaaccggcgggtcagcggcgggcgacacttggcagtgtgataggtcgcgatggcgcgcggcttgggcgacaccgtaggtgttgcccctctctgcgtcaccttgttcccatcggaaaaatcggtgctagcggtggagaaattaaggatgtggttgcggcgttggcatggttgccgagcttacacctgaggatggtgccgccaccactagctgaagcgctccaccttgaagcaaatccggtctccgccctcatgccgagcccgcctccctcacgccaagcccgcctccttcacaccattcccatccatggagagagcagagagggaggggagagagggagagagcagagatgaaatgacaggtggaccctacaaatctattactattatttttctgactggattgccacgttgacaccacgtgtgtaagctcttggtcaaaaccgcccaaaacagtcctggagggtaattcgtacggtttagaaagtccagggttaaaaatatatggtatttgagttctaattcgatcatcctcgatagttagagggttattcgtagtttttctatataaaatacaatcatatttttataaataaagttatgagatgtatatcaaatatagttttacttttacaatctgatatacacaaattacaattatatttttgaactagtttcatataagggagatcacctatcaatttgtaataagataataagatgaaattgacagactgaccacaataaactagtactcctatgtcttattggttttttttaagtggtacactggtacaaatacaaaaaaaaaaaaggactgtgcaggaatagtccggtgcctctccaagctagggattggggatacgatcgtcgttgtcgtttccctgtacgcccacaggaataatacagtacagtactgtataatttatattgctttctcgtttgtttttcaccgtggaccggacaagcaacaaagggacgacgtgacacacggtcgtccgtcccggcctccacctctctctgtccctccctcctcctctcctgttcatcggtccattccgacgtgtcacgcttacacttggcgatggcgacacccactacttagctcgagagcttagctccagaccggacgattcttcccttagctttcatttgtcccattcaaacgcacacgcgtcgtacgttcgataatataatctagttaatctgtcattattgagtaattgatctgaaacacactcagatacattcgatctcgtgctgattgagctctagctaatccagagagaatctctcctgccacacctgcaagttaaagtaacactgtgtatcccactcatatatgcatgcatctgtcgtgtaagccacagctagcaaaactgaaaatgccatacttatgaagtttttgacggtgtcagtttcccctaaatcttcagcgcgccagacaaagatttgtacttaaaatctaagattcgatatgtaggtacaatttttttttaaaaaaaatctcatatagttcaaatcttaagaaccctagaattatcatgttctttcttctcagaaatccagtttttctgtattcttatcagctgcacgctttaatttctcagaattagcaactccaaacaagcaggatctcggaaggaactaacgaccccatcgtggaataagccaaacggtatttttacaaatgaaaagtaatggtaatttgtaaataaaattttttatatacgtgttcttagagatccaaaagcaacaactgaaaaataaacttcgatgaaaaaaaaccttaaaatcaacatcaaatttaaattttggctgataagtaggagtatgagcataagcaaacagacgagatcgtaagctaagagcaggtacaatagcatagcagactataaacctgctataaacatattttaagaagataaaagatgatatataaaagcagtggactacagatttgtagtcagctgcagcacggactataagacgtatgtgtgtatgataggtgataccagatattgattgtgtagtatatttttatataactattgtatgaattgactattaagttgactatagataatttgaagccagcggtgagctataatattaaacttgctctaattaagcaataactcgcgctttcaactgacggagtgggtgcgtgtggtgggtgtgcgcgggcgaggcacacggctttgacccccgccccgccgggcgcggcggcgtgggtgcgtgttgcaatcaacaacggcaatttcttcggccgctgccgctgccgcttccgtccacacacgccacgccgcccggccgcgtgcgcgcgtcgacgtcgtacgtcgatcgaccgcgcgccgatcggccaaagccggtctactctcgaatcgaataatattacgcatggttcgatcgatcgatcgatcggtcggtcgtcggtcgattcttttcttctcagcaaagacacggcaggcagatgcacacaccgaccgaacaagaaaaaaacaaagacacgacacgacacgacagatgcagagatgctactactataggagagtaccctctcccccatgtgcacgctcgtgtccacacatgcgtgtaagttaattattggacgcgacttgtcagttgccatgcacggccaccagtagtactcgatcgatcgatccctcaggtactaccacgtttcaattcgcgcgcattctcgtagacgccgagaggccggccggcggccggatcatccatccatgtttcgacagtttgaacatcatccatcacaccagtagcttagctagcgagcgcgacgacacacaacgtgacaagaggcaacgacacatgagctagcgcgcgcgcgcgcgcgcgtgcgtgcctgcgagatggctgcgccgccatattcgcgcgcgcgtgtgtgggtgcaggcgcattggcactgtgcataggtcgtcgccggctggaaaagagtagtagagtaccggccggtgggtcgttgcccagctcgttggctcgtgagaaaatttgctatattgtgccgtctccagacacgggtttcatcggaatgttattctgcggtttggattcgttaagttgtattgatgtatagcgagctagtgaaaggtatgtaaatttgcaattgcctcaaaggtatttggtgttgggggcgacgagtacgtgtagtacgtgtgcctacatgttgcactgcgcgcgcgcgcccacggtacgtacggacacgcagagaccctggctggtagggactagggacggagagccggagtacctaattacgtatacgtacggaggggctctacgtacccgacaggtgggtccccgttatgtatgcgggccgatcgtcagttcgtcaccggaggtagagcgatgatcattcacgtactacataatgactcagtctcagtctcataaaaaaccaacataatatcggatatgatacttttaatactatgaatctgaatatatacattatattcggttctagattcgtttttttttataggagggagtgagtacgtacgtgcgcgtcgctgggtggccgggttgttgggttgtggtttgtccgccaccacgctggacattttccggccggacggggacggccggccgccgggcaatggctcctcggaccggcttaattgcgttgtcggccgcctctatcggcacaaacatatgcgcgtacatgacacactctgcctctcactctctctttctgctgccctctcttctcctcgcagtggaactaatcattctctttttgaaacaaagtggagctaatcattgctggtttggcgaggtgttggccttgcttgggaaacccccccaatctcgggatgcgctcagatcgaccctcgatccatgcttgcttgcttgatggttccttgcatctctctgtctgtccactactctgtctctctggtgttcctctcgttaatttctctgttttcttgttgacacctcgcaatgtagtgtagtactactagtagtagtacagtacagtacagtacagctagtatatttgttggtgacacgtttaacttaacggatgggagcacatagctttgcttttggtaattagtagtacctccgtcctaaaatgtagctatttctagcacaatactttgtcctaaaatgaagttatttttctacctaccttctcctctcaaccaatcacaactattctttttcacctattttctcttttcaaccaatcacacaccttcttcaatcattctcacctacttttttaatacccgtgtcaatctcaaaaatacttacatttagggacggatgaagtaattagagagcttgatatgtaagtacatgtaattgtataacggatatggaccgaattaagacggcggagtgtggattggtggacggacagtggtcaacatagtacgcgcgtccgttgtccttgtcttaagatatgcattgttgattgatgaactgcaatataatggactgtgactgaactgagatatgctcggatttgatcgggtacatgaacgaatttaaaagactttttgctgcgcctttaatttcgagtcataatgtagttgcattgcagctcgttttcgtcatgttcttttcgtgtattaggaccacagttttcatccattacactctagggtcttaaaatatatatgtccttttttacttttcaaagtatacagttctttcgcataactaattaaaaaaacagtttaaattgcaaccagtaaacagttttaaaccagacgagttttgctcctgcatacacgtggcactgatgatgttatctttgatatccagctctttatgaaggcgtctatcctggcatgcacaaagactgtctttatgaagaccatttcctagactctgcttgtgtaagcgtaatccctggaatgttcatctgtctttaaaagactatgtgtaatgggaacatatatccaaatatccaatcacatctaaaacgactagttttttaaatgacatgagtaatttattgacgatcaactatactcggtgataggttattgtttggagcagagttaccgttgtacgagttttttttttctttttcttccttgttttttaatctttgttttttcctctcttgacataggtcggtctggctgagtgtgtcgggtaaaaaaaactctattcttctaatatattcagggctggccctaactttttggtggcccggtgcggaaaaaaattcaccattaaaaaaaagataatatttaaaaactcattgtcattaacgaatttcacactaataagtttaaaatacaatcaagcagtcacgatatactcgatcgtcgatcggtcttctgtttttttctctaagcccatcaagtctaataccatagtattaatattttggaggcccctaatttttggaggcccagtgcgatcctgtactgccctaaggccggccctgaatatattggcgtacaattttttttgcgcgttcgtgaaaaagataggttgttgtttggctacataaattgtttaatttcgcgcgcgcacctctcggtacgttcaacctgcaggaccaaaggcgtgcgtgaaacaggtcgtggtaagctcgtagtggtgtcgatgcgcggttcctgaaagtacgcacgtacgtacgcaggctcggtgctttgcgaattgcgagcggcgtccggttcccatctcgttcgtacgtgcacgcacgcaagagaggacgacagtgttacgtactggcactggctatatctatatagtacagtatatattttgtacagggactgtgtgttgcatgcatatatgcacgcacgcacatatgtaagtgtatcattacatatttatttacatgcgctagctacgcaactggatacgcacgtacacaatgcgctactagaaaaaaaacatttttatatgtggctgtcggtgaaaagggctcgggggtacgcacagtcgagggaagtatccttctaatctaagtcgcgtgaccacgtggcctcgttttcccccgcccctcgggtagcgctgaagtggccagagggcctcggggtgtcacgtcacacccctcgggccttcggggcgtgctaccccgaggcccttgcccggcaaccacgtggcggggagagcaggcggggcgagaaacgctgctccgtgccttcaatgcgcggcgtcccaaccgtcctgcgccgcatttaatgcagcgtgggaggacgtgcggcgccgctcgattgactcatgtcaatcaagcttgaccggtccgtgactagtcgcaggcgatgggacgggtggaagtgcccccacgttccgccctgtgtcaagcggagtaggggcaggtacgccccgtcccattgataacaatctggtccaggtggggttggccgaggcccaacaaattaaggttgtccggaccccaacagttcttcggcacacgcactcggggaaaggcccagtatccctaaaagactagtccaataggggaagggtggctctcccttttaaggtggcttcatcctcccaagctaagtaaggtgggattattcaaagactcacagggttgccgcccgactttggcgtctttgccagcgggtaatagtggaggatgtcctcatcattcccacccccttaacaagggcctagctctgataccaaatgataacaatccggcccaggtggggttgaccgaggcccaacaaattaaggttgcccggaccccaacagttcttcggtacacccactcgaggaaaggcccaatctccctaaaagactagtctaataggggaagggtggctctcccttttaaggtggcttcctcctcccaagctaagcaaggtgggattattcaaaggcttacacggtcgccgcccgactttggcgtctttgccagcgggtaatagtggaggatgtcctcatcacccatcgacacactaccaggggcgcccctcacgcgcatggtgagccgccaaagtctctatgcatttaagagggaatgacagggatgtcccccgtatcaggcggagaatggtgctgggccccacctgggggcgctgaaccatcttgcttccggttgaaggcacggagggcggtctgatccaggataggtggatccccctcccatggaggagtaggtatggacggtgcatgtggtatccccttgaactataaaaggaggaccgtcaccaccgaaaaaggggatgactctcagataacttgagctcgaaaggaagaacagttgggtttcccttaaagctcaaaacctcttgtaaaagttaaccacaattctacacacaggagtagggtgttacgctcgatagcggcccgaacctgtataatctcctgtctttcacagaggctaggtagtgatctagcagctagactgcaagcggaagtacgctcttgatcatcgtgccatcttccccggccgaactaataaaggggggtctcacgaccgcccgctagagaggatctctcctcgacaatggccaaaacatatttttgcaggcggccataacctccgcctgcatccaaacgccggcggaaatcaatgatttttgcaggcagctaaatctacccgcatgcgaaaatattttcagcgtaaaaaaaattggctgcccccagccctacccgccgccgccctcccctccgaccaccaccaccacgagctgtgccaccacgatggttttgagagggagagggagggaaagggagctgcgcgcgccacaagctcaccgcgccagcccgccgccgccgctggccctccccacgacgtagttggatccgagaggggaggggaggggaggggagggaagccgccgtccgaatctgggagtgggagtgccatcgccgccgccaatgatcgcgtcgcctcagccgccgccctccccacaacgtagccggatcatatccgtgagggaaggggaacgccgatgacctcccgcctccgccgacaacctccggcgcctccaccgctgcatgcagccatcgctgcccttcctcacaatgctactggatccgggatgggaggggaagggccgccagccggatctaggaggtgggaacgccgccgccgacctcccgcgtccaccgctgcatgcgtacgttgtcgccgcacggccgtgcctcgccgccgtccgccccgcgccgccggccataggcctccccctgcccccttcaaccggatctaggagggataggggaggcaaggcgcgtcaggggtggatgtcaccgcccccgagcgtcactgtccccgtgccttgtcgtcgtcgacgccaacccagcgcctcgccgtcgtggatcccgccgcccccacgcgtcgccgtcgtcggttcccgccgcccccgtcgccgaatgcccacggtcgctgagggagaggagagctgagggctgagggagaggagaggtgagggagacgagaggataggacttagaaaaaaaatctagtgatgtcgcgtctatttatatttcacgccaatttttgcagtggtctgcctgcgaaaatagattttcacaagcggatagcgagcttcacctcgtttacatttttgtaggtggtcatttaattccgagggttatgtccgcctggaaaaaaaactcacgtctacaaaaatgctttttctaagtagtgatgcaaacgctaggcgatgcttagctttcgagctagcgcattgtccattggattcacatttatacgtgcacggtgaaaattagaactagctgatgatgctcactcgacacatgtcattgcagattattgcaccggccggccgatcgccggccgtgcgaggaagaagatgagatcagaatgaacgagccggacgtacaccgttgccgccatcgccggcgaggagagatctagagagagagagagggaggcaggcggatgaggaggtacgaatgttactgtgctggagcagcgtcatgggagatgtgaaggtgctcgcaccgacgtaccaaccacacacgcacagtgccccgatcgattcatcgctgcagtatagtactataccactgccgccatgctgcgcccccccagtagtgcgtactacgccgtccgtcctgatctcaacacacacgcacagtctctctctctctctctctctctctctcggtcagtgctacctcgagggctataagctaagccccatgcatgcattcatgcatacgcgcaacaagacttccacgcaccaggtgcgtcaacaggacgatattgtgtgatctagagagagagagagagagaggggccgggccggccgaccgatcggtcccggccttcttacaatctgtcagcgacaaaactggtagataccaaactcactgttccttcactttcacctctctctcctcatcctctctctagcttgctaaacggcctattgcagctagctagcagctattgcctgcatgcagcgtgagatcgatcatcgacagataggtagagctggacgagtacagatagatagatagatagatagatagccagtgcactcactcactgactcactcatcgaaagagaaacagagaggcttacctgcacgcatccatccatcgatccatgcaatggcatccatgcgttgcatagtgcgcggccggtagaagggagtagtagtggagctgtgagctgtccgtccacatgccctgtcgtcgtcgtgcacaagcacagcccacgcacgcctgttgcatgcaccaccaccaccaccccgtacgtaggacaccaacggcctcaaccggcctctctctaggcacgaactctctgtacgtgtgtggatcgagactatagtcacgtgaggactgatcgaaccgtgagtttgctatatggtaaacttatcgtccgtgttcaatccaaagcattagtttgaatcaattttcgttgttaagcctctcagccacaaaaaaaaaagcatgtctacttgatacaaattagaattattaacaacatatttaaacttggcggctgtttttttactgccaagaaatcagttggccgttaaaaaaattacggatgcttgtagtgattgttcttggttttgcatgcatcacacatttggcaagataaagaaaaagctaggctaagctagcttgctcacactgagatttttcttttatttacctcgagggataatctggcgctcttggtagtacggaacgttcgatcggacggttctggctggccaatagatcgatcgatcaggcagacaccgttcgcagcacagaggcaacgctagctgcacccggctggccggctcccccaccgtggggcccacaggcaaggtgggtccacgtgtcaatctgccctgccgaccgatgagcagtggacggccgatcgacgccttgtcgttttccctccggggaattcttactcgtgcatctaatctactagtagtacgtactccgtccatctaattgattttggccttttccatttctccgtaaatatattatagggttttaaagtactgctttatcaatctatacaaccactacatttattgcttctttgctcggcataatcttttccagtgagtaaattttcaaggaaatcaaaataatttcagtttaaatcttaaatttcggtaaaataatatgcatggttaaatccctcgtatttatggacggagtattatgcagtcgcactgcttaattccgtgcgtcttttcctggggccaatctcacgggggacccccagcgaaattatgcaaaagtaccagcagtgtagtataaaacgagagcaagaggggacacacgagtaaaaagaaaagaaaagggaagtgactgcaacaacagcgggcaattgttcttctcgggggacgcgaaaaactttgggggcctcgggattctcactgtctacctcagcaaatttcttaattttagctatagctagctagagctaagcatagatggatgagctagaggtagctagctagccagtatctttgttcggtttgttgctactcctacatcgactggtcatttggttgagataatcacagataatataggggtgctgtggtgtgtatatacacccttcgttctaaaataaaccaacttaaaaaacgtaactcctattacaacaaatttagataaatattaaatatttgtacaaattcgttatactgaagagcaacgaatctgaataaatattaaaattttattcagatttattatattaaaatgaatatgaacaaatatcaaaattttatttagattttttatattcgaatgtgacacatatccttctggtttgagttttttttatgaaggaagtgtagcactgtgcgagttgatgctttactgtttggggacttgtagtctatcaggagcggccgggtcctaccgtgggattgtacattgatctgacagcgtcatttatgcacatcgatctaagattgacgtttctagaaatcgagttttacgttggttaatgaaattaacactgtggtgtgttttctccatcccctaaaaactaatctaagatgaacatgacgatttctagtataataaatttaaacaaaccttcgtacaaactgcagcgtagtttagatgtataagttgtatattcaccgagcttgagaagtgagtttactaaacaaagaaaatgatgttagggaaactaacatggtgtactgcaattctctgggacaggaaaaatatcttgaccaagattgaaatgtttatcaacagtaactttttttaatacagtatgtcattacagtgcatttctctttttaagtacagctccagccaacttaaagaaacatagaagttgggtacctctaacttaaaaaaacaaatatcatggagttggagttgcggctaaattaggggaatgagacattttgttcatgttgataatgatattatattgtcaatcacttagttttaagttacaaactccattttctgcaaaagtccaggacctttttatatacattcatttgtacttaacgataacaataaccaaataataaatcatgtatatgattatatatagtcaaattgataatagagttggatcccggagggcaattaagaaaccatagacatatcaaattgatatttgaaaaccaatggcacaagatagggctacgttgattttatggtcttattagtcatcaatgaagtcttgagcaggggtttgcaatttcgtttttcattttccaaaattcagggacgaaagaaatatggagtttaaaattcagggacgaaagaaatatgaaattcagggacgaaagaaatataatgttagtgagatacttctacataaaatggcgcccacaaatatttcatgtttgaattgtctaagatgacatctaatttggaattgatttagtacaaaacacaaatattcgaggctttttctgaatctatgatgtaagaataaagtagtcgcaatccaaattctacttttgtgcgtaacaattagtaatacacaaaaaataactaccctcacatgccaccgacaccaagtatatataaccatagtgcaaattaattaattaattaatataattattaatatatatatatatatatatatgtgtgtgtgtgtgtgtgtgtgtgtgtgtgtgtgtgtgtgtgtgtgtgtgtgtatatgtactcaacataatgctgcacttaatacgaacacaaaaaggggagtcccttgcatcacaaaccagtgatattttggactatgatgcttcctcaagggattgccaagaccacaaattaacctttgtaacaaaattggtagttacatgtcaaactttacctgctatatatgtaaaacaacctcccattttatcatttgcgtgcttccgacacaacgcatgtccatatacacacacgtaccctcacactcgatataacgctatcaaagttaacacggctcgacgccacgcacatacgcaccacacaaaaattcgctactagctagcacagtactagtagcagttagtacaagctaaaacacacttgatcaataacccaagcccccccaggctagctaagctaagctaaccagggaccacggcacacacacttgcataccgtcagtttgttgacaagctagcacgcacaaatggtttgtagcaaccgcggcgggcatggccagatgctatcacgactcgaccaccacaccactggtgctatatacaaatatatactaactccaactccgctcgatcaatccccgttatcgatcgaccacgctttctacgacgacggcatcgctatataactaggttttaaggctacctctcaatcttcctcttcttcttgttcgtctccccctcctcacccaccctgttcatctcgcgtgtgtggcggtggtggtggtattctctctctctctctctctctctctctacttggtgaggaggaggaggagagtggtggtatcgccatcagagctcaataatactagtgcacgctcgccttgttttctagctcttgtcagcgaaccttcccccctgaaaaccccacccaccccctcccctcctcctcgtctgcttctcgctaccctctgtgtttgtgtttgggtttgtttgtttctctctctaggcctcgcgcgccgtgatcgatcgatttctggagtgatctgttgtttttttgtggagttgtgtgatctgggagatggctggagcggggggtgcggctacggctgcagcgggaggaggaggtgggggaggggtggcggcggggaggagtggaggtggtggtggtggtggcaccgcggcggcggctggggcgggggcgccggacccgagggcggaggcgctgcggtgcccgcggtgcgactcggcgaacaccaagttctgctactacaacaactactcgctgtcgcagccgcggcacttctgcaaggcgtgcaagcgctactggacgcgcggcggcacgctgcggaacgtccccgtcggcggcgggtgccggaagaacaagcggtcgaggagcggcggcgcggcgcctggtggcggcgtggggaggggcgggcctggaggcggggcggcggcggccgtctcgtcggctggcggcggtgcagctgggacttcgcccgcgtcgtcgctggcgctgccgcagccagggtcgctgccgtcgctgtcgtcggcgctggggctcaccgggggaacctcgctggcgtcgctgctgctcgggagcggcggctccgggggtgaccacctcgggctcttccaggccatgcagtcggtggtgtccgacgcggccgcgttcgagatgcaccagcagcatcagtcgcaggtggatcacctgctcggcctcggctacggcgccgcgggggcgcagatccaggcggccaagccgtggctgcatgacggcggcgccaccggtggcctcctcgacggcttctacgcgccgctcctgtccggctccatcgtgccggggctcgaggagctccaagtcaaggcggaggccaccaccggcgaccaccagcagaagtcatcggcggcggcggccggtgagcagagctgggacctgccgacgccgtcgtcgtccaacgtcgaggcgagcatcatcgcgtcggacgcgctcatggccgccgcggccgcgtcgatgaacccggcggtcagcgccgccgccgcctccacggcgccgtccgcgcagtcgctcctctactggggcaacggcggcattggcgccgccgccgcggcatggccggacctcgccaactgcggatcctccatagcgacgctcttctagctagcccagcctgccgcgcgcgccgcctccacgccgccgactgtgctagctagctagctagctcgtcgccgttcgccgtcgtcgttaactctattttttttccaccttaattttccctgagttaatttcccgatctcttgactaaaaaataacatgtaatttgtggggaaaaaaaaagctgagatgagagagagagcacactgtggagagagatagagagaagagaagagaagagatcatcatcatctcataggcagaaaaatagctagctagagcagccaattcaacaaccaaacgaagaacccaaaaaaaattcctgcaagatttcatcgccggtggtcgatcaagaaggagatcaagaacacagatcgactaccgaccgcgttcttcctcgtctccggccggtcgatgatcttggaaaggcggcggcgagcggaagatcaatttgggatgcattgatgaacaagaaggaaggagagatcaacaaaatcatgggaggagaagagaagcaaagaaagtgtaagtgcactagctagtgttgctactacttgatttgctagctagctagctctacttggcttcttggcttcttgatctccttccttgggtggtatgtagtagcttattttgtatatagggcatacggtgtggggggatagatacatgagaagagcttgaagttcttgcggcatatccatggcggtgtggtggtgcaagaacatatatgggggaccttttctctctctctcatctcggcattttaatcggtgtgtttaattggttaattaccctaccttggctttgggaagtactctagatgtataagttataatagtactctttagatcaccaccttgcagcataattagagaactgtttttgagttctcatgcattggacttgttaagggtcgtccaattccttgttcctcttctagagtgaattttttctcttctttcttttctcattctcttgggggtttcctttgttcaaaactttgcttgtatcattgatgactttgtgagctatgagaaattaaaacttctgtttgttcattctgatggatatatattgtgaatttcttttcacagattaattaatttgctcatatatacatccctcctctgtgtgtacctaggattatagttctcttcacacatggatactccagatacatatatgtatatatgtagtgtgatagctagctagttactccatcacttttagtgcatggatggatgcatgtctcactttagtgatgctcttgcagctttaacacctttgttagctctctttttcatggcgacggtgttgcgtgatctgatctttgaattctgcgctggctggcttcttctcatggatgtgtttctttctctcctttttttttctgccatggatcataggattctccagtagtggtgatgtactcaaatttagtgctagtatcatggaggtgttgctagcttctggtcagaatctttttttgtgcatgctcttggctgctggagaggccaaaaacatggctgctttgcttgttcttacctgcatgtctcgtagcaactcggagacgcattttgatgcatgctggctatgttcacaccaactgctaggtaattacatatatatagtacatatcactcaggaaagggaaaggtagatagaaacaaaacaattaaatggggggacaaatggagacaatttatgtggagatgcatgcatatgggggaaatgggaaaacgatttgatttggaatttcgtttttttttaaatattgttgcttcagctatatatgtgttttaacttaattatagtagttatattaattatgaattctcatctgagtttagtttgttccttttttttaaaaaaaatactttgatgcttgttccaatgtgctaaatttctttacttctaggctaacatttgtcaaaaatgactttgcatttttttaaaaaatccaaaatacaaaggaacttgatgtcgccgaatttaagtatctcctttctgggccaacacctattaccttaaaaatcaccctttttttttacatatgagtgaaagaaattaattatttgacactgaaagaaaattagccttctgaaataggatgggttttgcattactaattaattaattactgacatggttttaaaattaatgttgaacttcatctagtatatataacagatcttacatggttgagaaattattttaggaacatataaccggtataagctatctatacgtctagcacatatatgtacgtactatataagctctagctagtgagaacatatatctatctatgtatcaaattaatttatttaattagcatgaaggtcggatatgtgatggacttattcagaacctagctagctaggtgatggaataatgtcgtgttctaggaatttgctttgctttgctttcctaattggctagctagctatagtttatttgtcatggctctccatctttttcgagaacacttgtcccattgatctcgcatccatcttattattacaaaaatcaccatatgcatgtctttctacctctgtagctcgcatgagttctggtaggacagttgtacaatcactcaaaatctaggtgtataatccgtacctactcatccatatcattttgattgttgaatgacactgtttgatgttgttgcaacagcttaaaacccataaatgccattaatccttttgttagaaccgtacggttgtataagtatatatgtcggttccacgtcaccaaaaatgtaagaactgacctattaactgtagatgggtacaacagtaatagtactcggaatacgcatatatcctaccttcgataattaatattatgcattttgatgcgtacttaatattacagtccttgctagcttggttgtttctacacatgaagattactctcataagtcataatatatgcgtgtgacatatacttgcatgcaacacgcacatattcattctgaaatcggcattatatttgtaattaatcatcgatccaagatctgcttaaactaaaagtacaatataattaaagttgaaatttatgcatagggataaaaaaaatatagtcacacatacaggccctgcaaaactacagtactggtgtgcatgcatgagccaatttatattagctaagcttaattaccagtggtactgtgtactactgtctatgtgctttacaaccaatgccattactcgatcgtgtactgaaaagacataagtagacaataaaatgtttgcttttctgctatagcagtgaggaatatatatatgtatttccttgattgatgatacgcatgcatggaacagcggaacaattatatatagtcggtgaaaaactagctatagctagtaaaattgttccatatataattaagtcaataatgtgtatatattaattgtaggcatgcattttctcttttatatacagaaaatgttgacaagatatatagagatccatgacgttttctctggttgaaatgtttttttttaagtaggatctgcacttcgtactaacaaattaaatcagtatcacaaaatatgtgaattggataattttactatccttagaaggtacctagaggtaccatattttcaaatgtaaaaatttgtacctctaaatattaagtatctcaagataccaaaaattttagtgtaacatttaggtacctcaaaattattttcttaacgactgtaaaattcctcatatgaattggtctctgtgtgtgtctatacacacaccattctcttcttaaggacacaatatatatggtctactccatatatatataatccatgtgtgtgagcattccatttctatcccttttgttctgtgatctcagctcgcaattatcatatttattaattatgcatatcatgcctaatagtaaaccataagaaggctgtttcgtatcacgtcaccacgaggactattcacaactatccacatctcacgattagtcaacaattagggcttttctgcagtggtgaatggttgtatatgcatccatatgcatgcatttctattttccatcaattgtgttagcatcagtagtgtttacttttagtgtatatatattcgacgtggcacatgcgttgttcagtattgttgtctaacagtgagagtgatcgataaatgattttgaattgtataattaaaacgggggtatttaaatttaaataaagtataactgtgaacagaatttattatgaagttctaggccgggtttgagtacgtacgtaagaaaaaacggcacatttatttatgatgaaaggagaacataaatagatttaatttgtatacatttacaaagtactctccaccactgcaatacacacgtactggaattagaatattgatgtataccaactttcatatatagactactaccttcatcccaaaatatttatcgttctaggttatttagcatatatgtactaaggtttaaagataaaaactataataccccttaattaataatgcatagttggatataggatgatggttggggggtaaaatggggagaaattttaggacaatttttaaatgctagaaagactgggacggaggaagtatttaagaaggatctcaccaacatgtccatcctaagtattttcctagaatatacatgcatatatacgtaggagctacacatctttgttcatcactaagtacaataattaagggtatttgatgaatctgacatgttgcaccacaacatacgtactgtagaagtcatgcttattcagtccaatgtttcttgccatcaatttggatcgatcaatgctcactatgcatggaatacagtactacacacagtaataattaaccctaccgaattcatcaccattctacgccacccctgcaggcttcgactgaataacacttttaaaaaaaatacacaagaacatattgcaaaataaaaaaaaccaaaactaatccttaaacttcatacaaatccttcattagaagtgtgacttgagctttcaattaatccttgtccaaatatatcaacaatccttcgttagaattcaacattgtttaattatacatgtagatcataagaataattcatataagtccactgactgtaaaaaatagatactcccgatggtttcatgctcacaactttgccccgaaggttgcgatcgaaagagatgtgggcttcagctttttcattgcacacaaaataaaataagtcattaggttaatcaattacttcatccgtcccatcatataaggaattttgggtggatgtgacacatccttatgtgacgtctgtacagattattatactagaatatgtcatatccacctataatctcttatattatgggacggacggagcaagcagcaactattacaagcttcaaaactagatttatataatttttaaaaaaacgtttttgtattatttttttacacatagcagttcataaaacgtacggtgagcaagaaaatggggtggtgatcgtctgatcgaacgagaatcaaagccatcgccgaagaaaaaccgcctagccgatgagagcgcacgcgcgcgcgcgcacacacacacaagcgcacaaagggaaagcaacagaggatcgatgtagttggaaagatcggcttggttgcaccggttaaaaatgagaaagaaattaggagtagcaagagaggaaagttgaatcgtctgacgcgggcagcagcggccgcatttgcagcaggcagcgagagattggaacgcgatccttgcggggtacggcggagtaactgggggctctgaattggatgaccgcattcacatcgtgctagtagtagtacatgatagctagcccttgctcccatcaataggtaactgtgctatctacaggagccactgctgccaaagaagcttatcatcccttcactcccatcttctgaaaatgcctgtagcatgcaagaacgaccatatattagtgtgtgtgtgtgtgcgtgggtgggggggggggggtgttaacgttttggatactgttatttgcaagatcaagacgggatacagttttctacaggacgttgttgattaaagaaaatgaagaaattacggacgaaaaaagatgagtagtaagaccgccctcgcagtgatcgcaattaatttttggtttctttaaatttgattaaatttattactgtaaaatttagtcaaaatttgttaatttaaataatttcatgacaaaaaaaaaatctgacccccaaatttcgatggaaacgaaagtatagaccctgcactctcgtgtcgctcccgtgggacgtcatgggaggtgaccaaagcgtttctccatcgctatccaacctcccacctttcgttccctcgttgccaccgaagtataccgatggagctctatgcggttgtgatgacgacaacaacagagccttcatgcatcttcctcggtggccctcgttctccaagaagggccgacggtgacacagtcatgcttaaaaaggatggcaacaagcggatgggaacaaacagatccaacgcttcctcaactggatctggcgtcctcctagctagatatgacgcccttcaatcggatatgtgcatggtgaccagagatgcccgcaaggcgcggttggtggtctaatgcgtggagaggcgggttgttgtatctagggataggcaaataaggcgcactcagtgggcaagttggctagacccgtgtagttcggcgaaccacgatggcggtcgtgtgctcgacggttgtgcagtgcggacaagcaaacgtagaggaaggacaacaacctctatgaagctagttgtccatggccaatggtaggagaggaagtgggagggagagacggccactgcggagtggttcgctcgatggagggacgctgatatggcggaggcacggggcagtgctcatggaggcagaggtctgatctggccaaataacgacatggatggtagtggcatggatgtcataggctcagtcaatgggttagatgacaatctacctccctttattggctaggcttatttttcctccttaggcttatttcttcggttgtacggagcgccatcagggaggaggcattggctttcatggcagagagatgctcggcataggggtgatggactattgtgtctaggtgacccatgcctcccccaatgcagtgtggtggcagctgcggagtggctgtgcgtttgttgattaggcgaagtcagagctactatcactactatagaaaaggtttttgcatacagtcaaaatggatctttgcagacggttgggtgcatggcccccttacacgcagctctgtgaaaatcaacattttcacatgcgagcggcctaaccgcgtgtgaagatcaattaccacaagtgggcctaatgtggccgcctgctataatatattttcgcaagtggatgagttatatggtccgcctagaaagacatttttttccgtatgaatgatttagaatgcctacatgctataacagttttcgctcaaaaaaataaatttcaaaaagaattttgaaatccctagcacttcttggaaccctaaaatcggcatccacatgacaacattcagagatccatccacattcacacaccacaaacaaagattcatccacatccacaaactacaacaaacaagaacaaacatgaaaaactagagcttcaatcaaaacatagtagaaggagtagcagaaccgagttcgcagaggagatgaggtggggaaggagacgaaaaggcagaggggtggaggtcccgcgaagcagaggaagagtgggtggagaagaggctagcggttagacccagggtgcgcagcgacgatttagaggcagaggagcctgccctctcgaggtcacccacgccggagcaggcctcccgttgctgcaggcgagaagaggcgggggaggggaagcctccccgccgcaccgccttatgggggttggttcgtgctagccgaagaaaattttgtcttttgcaagcacgaggtggaggtttaaacccatgatctactggtcacacgaagagcatactactgatgcgctacctccatttttcaaacggaaacaaacatacactcaagatacattgtagtaatgctaatattataatttaattagttacatttgaaagtatttgacaaaataatataaaattttttgtgataatctcaaagagtacccgtattttttctccttcatgtcgataacaaggtactctctctgtcaaaaaaaccaacctgtctataacaatgaatttggacaatcctctatccatattcgttgtattaggagttaaagtttgttttttttagatggatggagtatactataaagcatgcccgaccggccagcccagacacacgtacgtactggcacgcatgcatgcaaaatgcgcttgtgtttctccctgctcgtcgattaccgggttgactcggccgcgccctgcttgcgcacgcgcgtgtacgtgctgtgttaatttgctgctgccatcgatccgatccagcgtcgatcgatcgaacgatacacggatcgatgttttccttgtcgtgaatgatggcagccggagacgacacgtacgccggccggccgcgtttttcctccttgctgatgatctcacgttggaaggagagtagccaccacgccccccgtcagacaaaaatgacatcagaaactgcaacttcgggatttccccaagtgtgcctgtgtgtgacggcactgacaagcggggtcccatgatgtttttccaaacaaattaattaaggacgaagcggcaccagtctcggatcggataaacatttgcaactttttgcaaggttaacattttatcatgttcctcgtaataaaaaatggtcatgttttatttaacgttcgaaatctctcattatagatggttcatatggagtaatcttcggtaaaattatgacatacgtatagttccacacaaaagacactctaagttaatcttaccagaaaaggaagatttgtctgcaatgtagcctttgcatggtctctcacgtggaactgaataacacagccatcatttcctcagcaatttactctctccatccaaaaaaacctaagggtgtgttttagtagaaggggattgaggagaatgggaaaagcgtattgagtattaaatattttatttaatactcatgattaattgagtattaaatattttaaattttaaaaatagattaatataattttttaaagcaactttactatagaattttttttcaaaaaacacaccgtttaatagtttgaaaagcgtgcgcacggaaaacgagactcaatctcccctatctccccagaacgaacgatgccttaatttaggtgaggatgatcgttcatagtataacgaatctagacaatttgtttaaattcattgtactaagttgagttttttttttaacagtgggagtacactatgactctatgactggtaaatcgtgaaagaaaataaacatagcaacttaaaaaaaataaggtaaaacttttatatttatgtcttaattaaacaatttgaatttaaaggcaatactaaaaataaactacgagaaaaatcatcaaaattaattttaactagcatggtggcccgcgcagattgcacggctagcaccattatattttctgtcatataataacatactccatatgttttctcaatgtattattcagatatattaaaattatatatgtcatataattttaaattttgtactaccctgacgaaactactaatatataatatttatattgtattttatatacgtgttagttattaatttaatatcaaactttagttatttgtaaattatattcctatatggactctaggctcttcttccaatattatttatttttaattctgaatttttattatttctaattgtatttctatgtggactctaaactcatctttcaatactctttaatttagaagtattaattctaaattgtattcttatattgactttagactcttcttccaatgtttttataattttgaattttagttattgtaaattatatttttatacgaactctaaactctacttataattttattatgtttattcagaattttagttagttttaaattcttatatggactctatactctacttctaatatttcttatttttaattctgaattttagttatttcctaattgtatttctatatggactctagtctcctcttctaatatttcttattttttaattccgaatttcagctatttctaaattgtatttctatatagactctagtctcctcttctaatatttcttattttttaattccgaatttcagctatttctaaattgtatttctatatggactctgttttttctttttcttcgattaatgtgagaatttctagaccatgagagcgaacgtgaaggtttttttttctattcctttaataatataatagatttgtttttaaaattgtaactttggttgtggtaaaattgcaaacgatgccagttggggtatagttttacttttgacagtttttctaaaccatctaggataggatgcctggaataaccattcagtagcacagctctatcttaattacggccgagaagtatgacagggagagacaaaaatctcaccgcagattactagagtaaaaaccaagcttaactttgctgcgcggccatggtgaggacaaggtacgtgttcttagtactctattgaccagagggggagctgcatgctcgctgaacgctgaggcagagagcccagaggcgctggcttggctgccactgcatgcgcccaactgaatttgttaggttcccagggcggtagcgccaggccgtgcagatgcagatgagcgccgcacgcagcatctacaggacctgccggccggctgcggtgaaaattccaatttactgcacactactacccggtgaaaactctcgtcatcgatccatacataaacctaataatttagtaatagaaaaatagcaaacactgtttcagggattgctccctccgtgccaaaaacacttttatctgtaacgtttaaaatttttggcttaaaaatgcatgttcatttaattggaccttagaaattgtgaccaaaagtattgatgagggaaaacggtaatcatttcttctcactattctatccatcccaaaatataagaaacaatcacttttttttaaaagaaacacacattttacaacctttcataacaaaagatgtgcattcatacatgtattgcactagcaccttcctcctctttaatttgttttttatatcctttatcctcaaaatctctattcgtatggggtatacacattgttattatttggcaaattttactacaggacactgctattgtgtagttttagctgtgggacactgccaaaactcacttttgggggaaaacacttcataaatgtggtaatttgccaatgaacacgatgtcgattaaaataataatttctaattgagtaggagtgagaaatcgcgtaaaatatcaaaaatgcccttggccccatgtcagctctccatctctctctttcttttctttctctcttctcccggtcgctgtttcctcggtgacaccgcccgacgaagcatcgccacgacgacctcctcttcctcccatgccgcctcccttcgttccaccttcgagccagccagcactcaagcacggccacgccgcaccatcaccacccaccacccgcgcgtcgtcggcccgccccccctgcacgagaccactctgccgcgccggccttcccgcttccccagccgagccaccggtgcccccttctttttccccaccgctaccggccaccacctacgccacccctttcctcggcgccgcctccctcccatgccaccgtgccgccttcgttcttcctccgccaccacaccatggcaccgtcgccctccccagcgcgtggccaagccaccgccacgccacctcacaccggccacgcgccgagccacacccggccgccggcccgccgtgcacgccccgaccctccattcctcctctccaccaccgccggccctctccctaccgctgccagtctgctcctccttttttccccgtgccgcctccttctcccccccggtggctgccgagcccctgccgagctcgacccggccacatgctccgccgcaccagctgcaccgccgtcgtcgtcgccgccaccgccgtgcttgtgtgctcggtgccgccgcttgcacctcgtcgtcgttggcattgggtacccggcggtgcgccgctgcttccccggccgcacgctgggccgtcccggctcgggccgtcgtgccgactgtgcgttgcgcaactgctcacccgccgcgggaggaagaagaagaagggagaaagaaaagaaagaaagagaggaagagagatggagagctgtcatgtaggcgcaagggtatttttgacatttcacgtgatttctctctcctccttaactgaaaattattattttaatcgacacggtgtccattggtaaattaccacgtttatgaagtgtttccaccaaaagtgagtttggtcagtgtcccatagctaaaaccacacaataacagtgttttgtagcaaaatttgccttattgttttcattagagtgattcaaacgaggtgataataattctttcatgtctttacgtcagaggtatttgctgggatggaacaaggagggaatattagtttatcaagaatggctataaatatattctttatgaaacggaggaagaagtaggtaataataatctccctcaaagggaatgattagcgtaagtaacactcctggtttgattggttaattcctctctctctctctctaaacagtacacagctgagaaccaggcaaaagaaccggaggattagttgattgattccatggacgccatgatatgatgcacccactcctagcgacatcatacacgcatgttcctccccactaagctgtgggccacattgcatcacacgtgcccttcccgccttctctctctgccatcactaactacaccaaatggcttcaccaatcaccaatgtcttaatccatggaatgtcactcctgtccatcgatcgatcagccaatagtagtaacaaggatcatcagtacgctcatcaccattagttactaactgcaattaatcatgaggggatgaggacaactgtccttttcttattcactcacctcagactcagaggtaggataaacgtacgtactacgtactcatcacgtacacaagcattgcactatattcctagctatatgcaccatagagatgtgtactccttctgtccaaaaagattcaaattttagggatgaatctagacattcaaataacgtgcaaagtatgtgcttgtgaccctgaagccacaaggtaataacacttgggtttttaaagcgggatttttaatatagaaaaaaaatacaagattagattatcttagcactttaaatcctatgattaaaaaatacaagaaaacttcgaaaatgaccatttagatatagcacagaatacactggaatcacaagagcgataggcataggattttttttcaaaaggttagacctcatgtgaaaattcttctaacattcaaatttctatgttttgaaccaatccaaagaaacttcaacggcttgtttggtaactggatgaaatgggattgggagtttgatgataggattaagatgagaatttgatttttaatcccaatatcttgtttggtagaggtgatggaaattgatagagagtttagttgaagattaggtcattaataaaaacggatggctgagatttgcttagataaagtaaaggaggaattccctcccaattacctgccctacccaggtattgaaaaggtgggagttctttcctcaattctccatcctcattccaccaaaattctcatgtctcccaaccaaacaaaacacttaataatctcatccctctaaactctcaatccctcctaaaaactctctccaaccaaacgggctgcaaaggaatttaggacggctatttctttgatcggaaaatattttcattggattgagttcctccaaaaatttcaaaacaccctttgttccaaagaagcccttgattgtgaacaccctcgattgggaaaaggccgaaagttatcaccgcgtagcggtataagaaaacttaccaggcatggtaaggactctgtaaaattcagttactgtaaaattcctctgtaaatcctcttacccaaaaagagctaccagggtcttgtttggatccttcaggctattaaatagccctccggaatcttgttatttaggagtattaaacgtagattattgacaaaatttattccataacccctaggctattttgcgagacgaatctaacgagatatttaatacatgatttgctaccatgctgctacagtaatcaaccgctaaccatggatcagaagtagctgtgaaagagctactagaagtagctgtgaaagaaatggacgtgacaccatggtaaacgacacgtcttaaggcgtcgaaactgtcaacaagacccggcctggctcgctcacgcagggcttggatggatggacgccggtcactccaggctccagtgcccgtatctcgcattccggagattctcggttccacccatccatcaatctttccttcccaattccaaacagccaatcaatctcttcacgcttatcgcgacgcgcaccacggccgtgagctgagctgacacccaacacacgctgccgcaatcgcgcgaaccatcgacacgcagcaacacaacatcgtcgtgactggagacaaacgctcccgatgcttcaggtttcgagtgttaatactccagtgatcatcaagagcgcctgattaaatactgagctctgagccagtagtagtggtaagcagtacactgaaggagaacgaccgatctgatctggggagccattgatttagagcgggcaggaggaggggcgtacggcgtgtacaaggatactcggtgattcgagtgattggcgcagccgtgcagctgtgacaattgatagctctgccctgtctccgattcttctaaacacaagcggacaagcaaaagccgccagggcaggttttgtgttggctgggacatgactaggctt

SEQ ID NO: 43491 - DNA, 10161 bp, Oryza sativa
aattacagcaaggagacattcagacataaagatgagtgtaggtaaaagtgaccttttgttaatgtcgctgagtggactagttcttttttctcattggcttcggttaaacagtagtattagctttgttagtgttttgatgattctgttggtggtaagcagcctgtttgaaaacctcttgccactctatccaatgggagttaaagtgcccttaccaccgaagtacaaaatggtatgcagaacagctgaaggcccttaaaccatgtattgcatagcgacctgcatcatccgggagggcggtatgctcagcgccgcgattcctctcctgcagttcctcctcaagaaggcgtagaaatagttgatcaccagcttcttgacaaagaaggactccttccgagctctgatgtcgccgtggcccaggaggtacaccacgccggactccttggccttgtggatgaacgagagctcgtcgtcgaggcttcccctcccatcgatcgcctcatccagcgatccgtcgaacgacatgctcgatccaatggttgggtgctcggtagtaccagccgcctcggcaggtggaacaccgagagaattgatactgccattgggaccgacgagagctcttgacgaggctgatgcaacctcctcttctgagtctgtaccgtcgtattggtcactctctagggagcgctcttgggcttcccgccgcatgaacttctcgagactctctatcagaagctgctgaaatgatatgtagtcctccttgcgtatgtccttgtacccatacctgcaaccatccatgaatgattaacatgcaacaagaagaagaagattacacaaggaatggctcaatcagtgcttaaaaaaggatagatcatagctacgtaaccggctcaatcatcacacactgcatcattttattcaagacagcagattacatattcaatatttcaatatccagctatatggatggggtctatcaggccagcttcttgacatataactactgatacgaactgctgggggtagatatgcatgggtagaaagttgcaacagctatatttgccaggacgaataaaacaaatgttaatcaacagacatagaatcactgctagtaaatattagcactatcatactttggtacggatatgcataaagggactccacaaaacaaagtagttcaatagctacagacaagtaactgaagataagtttttaaagaaatcaattttcattcactgaagttagtggcagagatagaccccatggcccaaaggaatcatttcatgtcagggactagaaccaaagctcaatagaacctctgacaagaatttaaaggagtatcaaaacatcagagatatagaggaaggcatagtccatctctggctcccccactgtgacaacagtatgatactatatcaaacatattacagctttaaggggataccagccccagctgcacattgacaaaactgtcagatgccaacaaagcaagctgtttttagcagattcaacgcattacgtgaaacacaaacagatggacacagcataaaacacaagtacctacatttattatctccaaccttcaatggagcacaaagagagaatgcaaggcaaatattacttcattttaggagatacttcctctgtttcatattataagactttctagcattgctcatattcatatatatgttaatgaatctagacatatatgtgtgcctagattcattaacatctatatgaatgtgggcaacgctagaaagtcttataacctgaaatggaggtagtagaaacatttgtagttactatcaagtctggaaaagaattgacatacatacctagcaatgcagcgaaacatatgatagctctttggacagacccgacgaaagagaaatctttcattctgaggtacaacaggaactggaacccacttgatgcagacaaaaataatcattgaatgaatggctggcattgtggcgaggaattgaccaaagattccaggaactcccctcgcaagttcgttataaagtaatccaattccagggactctgactgtacccagattacaacctagctccatcaacaaatccattgaaagtttttgcttaacctcagtttcgtacttcaacttggttccgtagttccatatgtacattatcaaatacagtacagcagcaaataccaaaagaacccaactcccatctgctacactgcccaatactgaagaaaagaaaattaactccagccccagggagagggtgagaaaacacagaactacaatgatgttgatctgccatatcaaaagcattatgatggtcaccaagactgtagtcatcatcatgaccccaagttcagctatgcctgcaatagttaccaggcattagaaagattatgcggtagcaactgtggcactggtttcagtagaaaacaggttacttagcagccagctctccatgttaaaaatcatttgttgacaatcttaagacagtgttgttaatataaaaggaaaaatcatacaaataacaattcagtgcttaatgatatagggcatcactttctagttagaaaattaaaaaaaatgatgaatttgctgtatattttatttttgtatggagcaattcacgtaccatatgcatttccaatctcattgatgctcccaaacattgtaacaaatgcaaggcaagaaaccagcaaaaaccagttcatcattgggatatatatttgacccatgaagcttctagaagtgtgaataatcttgaggcggggaaaacagccgagagctgtggcctgctttattgttgagaatatagcagttgtcattgtgcgactagcaattatggctgctagaattgctatgaataccactggccaaaatgcctgatctgcgacacggaatgaaactatttagaatttaggggataatagattccatttcattttgtgtgaaaacaatccatagcaatcagaaaatcagatttaaaagaggtacatagatgaaccagtttatcttactcgggatagataaaaagaagacctgctgattttctgttagattttccataagaaatgcagcttgccctaggtaacccagtagcaggcatggaagaacaagaaacacaaaggtaagctgcaacacattagacatagtaagtacaaggatatgaagtgcaacattgactcttaaaacaacagaaaggactacctgaacagatttgacagagaaatagcataaatcagcaaacattgcctcagatcctgtaagaagacaaacttgttaacatctttactgttcaagtcaaaagaacagcactgctcttttacataagctataaaataaaaggacagcagcttcaataggtttagttatgacctactacgaaataaaagggcaaagacagggtatatcaagtctatatagctcgaacaaaaggaactcaacaaagagtaaagtgcacgggtggtccctaaacttgtgtgggtgtcaactaggtccctggactctcaaaatgaattattaggtccctcaacttgtctcgggtgtcatataggtccaaacgggttccaacccgctccgtgtgctgacgtggcatgccatggtggcacctacgtgtcagtagaacccatatgtcagccacatatagaaaaaactaagaacatatttttttctcctctctttttcatttatttttcaaaattaaaaacatcattttctcctctctttttaaattttatttttttctacatgattgacatgtggatcccactgtgtggagtcatctcacggagcgggttggagcccgtttggatctatatgacacccatgaaaagtttggggacccaaaaatgcattttgagagtttaaggacctagatgacacatctatacaagtttaaggaccggccgcacttcactcaggaacaaataaggaaaaaagacatgcgctagaagtaagcacattcttagataatttagcattcaataatatatcacaaatagcattaacaacatggctaaaacacataccagtagcacatagaagacagcctccaagggacatccaagcttgggttgggttcctttcaaaataatagtatatatacataggattaaatgcctgtaatacagctgaaccatatgtcttcatgttataaattcctattccagcaaggcagcaaaaccatatgaacaaggcaggtccaacagcaagcgccactttgcttgacccaaatcgttgtagagtgaacaggacaataagaactgccacagttatcatgacaacttcacctgccaaagtttcacattaatagtaagtatgatgtactcgtagacagtacagacttaattcttttcctgaatcaattagtgctatgtgtcaataaactgaaattctgaggtcaccttcattaacactagatattccaacctttaagccattgacagcagacatcactgcagatttttaccaatagaaagaactggaattagttctacaggaaagagaaaacctggtctagcacaatatcactcataaaagcatatataatgatcattaaacacggtgaagagaaattcaatgagcaacgcatcagaaatatgtgaacctgacattgctggtgtgacaacaccatccgctatcaccatagaagtaccaaaaagaacaagcatcaaaagcagcttctttagcatagatgaagtctcaagacgctccttgatcttcaaagacctctccagttctactgaaggcacctggagttggaagcttgatatacgagtatcagagcgtagttggttaggaagcagactaacccttgcattcctgcatattagcgagtataaagcaaatgtccctcctgccatagatacagaacacggtttcattaaataaaaagattaaccaaaagtgctgtgttttagtctactcgtagtgacctagtagtacataatgagatataccttctccatcatcgtttccccataaagcaatgagagtatacttcagcaatggtattagaatcagagtgtatattacaagtgagagtgccccaagtacatcctccttcgaagtaatagggtacttgttgaacattacatcgaaagcatacaatggactggtaccaacgtcaccgaagacgacacctagtgtctgaacagccagcacaatactcctgcctacggtaatttcctgaaagaaaatgcatgattgagaaatcagtagagttcagatactcatgcatttagaatgaggcttgcacctcatcgtccaagcatcatatgaagtgatgatgtttggatttggagtatcaatgtccaatgagaggtacttatcaaacaacttgcatgacaacatagaaaccaaaatactgccttcattcatttctagatgttgttttagaataagtgaacctcaaaatttaattcacaaactaatttgtatttaatatgtgaaaatagcattagtagatttcacatgaaaactactttcatttagttatttgttaatacatagtgatttttgtaaatataaaagcaaaaagggcaatgataaaacaagtgcattggagattgtgtcgatgccctaaatgacaagaaaaaaagaacagagggagcagtaatcaaaattgacaaagtctctaaaatactactttggcagataatttctagtgtgataaatttgaaaaatctatgaacactatcatataatgatagacagttttcagcataaatgtactggtaatacatgtggttaattcaatttgactacattaatggtgaagaaagaaagagaaataaaataactcgtctcgctcattcatcaccagtagtttcacttaggtgactcaatgcaccacatgctgttctttccacagcatttagtttcacagaacaatttaactctgaaaagccaaaccaggagatgaaacaaaacttttcatgtcacggctccttattcacatccctaaggttctaacttctgatctcgagtagaagacgaacaatgaattgcaatagaaatcatgctccggcacatggcgaggtatgcgtccattcatggaaaaaggctcagaattttgtcacatcaattatgcatgttttcgtggtgttttttgcaatattgtagtatacattttgtgttgggttcacttagactgcagaaaatggctaaataaaagaatgtctgggacagaaatagaataacagtccatgtgatctgataagcattcacaataaactaaaagccatgactgaacaaatattatatcgctaggtcgcaatatcacatcaacacggccatcgtgatattcctgtggatattgtagcttataaacttctcacatcacaacaaagaataagacatagatatgctatgctgctacaagtatcaacaaaaaatggagactagggtagtaattacaattcttcaaactgtccacaatctgcatgtaacacttacatcctcagatgtgtcacctacaaacaacaagattacgccgcaaaccaagaatttcactcatcgatcaataacccaaccatcaagagcatgcgtgtagcttgtggaccgaattgcactggttcatcagaaaagcattgcaaacacgttgcatccatacacagatggatacaacctagaagaaccacggtacatgctataaactagtatgattttgctaattcactaaccagaccaaccgaatgaaattacgcagtccacaccacaagcatatagtgagctcagtatgatgttcttacagcccaaaacccaataataccttatcggctccaaggctgcaatctcaattgagcagcagcgcaaagccgcctaatctaacactatcactagagtactagaccacgattgataagtgtcaggaacacgcaggcaatacatcgaacagttggcgcgcacaaaagtagaggcagccaattttaagcaaggccccgtgtttcccgtgggggctcgggcgggtgcgcgcacctggtggcggttcatgcctgcgacgtcctgcgcctcgacgtccagcgagtcggcgcgcgggccggtgcgcacgagccgctggcggagcatctccgcctcctcgtagttgtcgtcggagtccgagcagccgccgcgggagcccgaggcggccgccggggtgccgcccccgccgtcggagctctcgatctcgtcctcctcgtaggcgccgccagacaccacccaccgcatctccgccgactccgtcttccgcagcctcatcctgccgccgccgccgccgccgctggcgctgccgctgccgccgcttcgggtctccatttgggtcggcgcgggaggcgccggtggccggcgcgtgggtgtggggcactggctccgtgaagcggaggagaacggcagaaggggaggatcggagcgggggagaagaagacgctggagagtgatgaaacggaaactgcagtagcaggagatagctgccgtcttcgtcttttcccctcctcatttttcacccctcatttcagtgcacttaatagtcggttaatttatgtttttattttctcccacttcttttgaaaaatactccctctgtattatcttttttgttctcaaattttttaagaaaatactgccttcgtattaaattttaatgtatgtcgtcgtttacttttttatccacgtttttaccattcgtcttatttaaaatatttatgtaattatgatttattttattgtgacttcatttatcattaaatgttctttaaacatcacatataaatactcttgtatttgcacaaaaaatttgaataagatgaatggtcaaacgttggtcaagaagttaacaacgtcatacattaaaaaatgaagggagtagtttctttataaaaatataccctacactggctccggtgaaacgaaggagaacgacagaacagagggtcggagcgggagagaagaagatttaagagacttggacacctgagtgatgaaatggaaactgcagtggtaggagacagctgtcgtcttcgtcttttccccctctttctctctctatttttcacccttctttaacttttctttaacacaacagtcggttaacttatctttttttcctacattttttttaaaaaaaatactccctccatattaaatttaaatgtatgtcgtcgtttactttttatcaacgtttgaccatttgtattatttaaaatatttatgtaattataatttattttattgtgagttgatttatcatcaattgttctttaagcatgacataaatacttttgtatttgcacaaaaattttgaataagatgaatggtcaaatgttgctcaagaagttaacaacgtcatacattaaaacattaagggagtagtttctttataaaatgtactccatattggctccggtgaaacggaggagaacgacagaagtgagggttggagcaggggagaagaggacgttggagagtgatgaaacggaaactgcagtggtaggagacagttgccgccttcgtcttttccccctctttctccctctccattattcacccttcgtaagcttttcttcagcgcacttaacagctggttacctttcttttgtccatttttttttaaaaaaatagacctttcatattatctttttttgtccaatttgtttttttataaaataccccctctgtattaaattttaatgtacatcgacgtttactttttatcagcgtttgaccattcgtatgatttaaaatagttatgtaattatgatttattttattgtgacttgatttatcatcaattgttctttaagcatgacataaatacttttatatttacactaaaattttgaataagataaatggctaaacgttggaagtcaacaatgtcatacattaaaacatgaagggagtagtttttttataaaatataccccacactggcttcgctgaaacggaggagagcggcagaaggaaggatcggagcggggagtggggggagaagaagatttgagagagttagacacttgagcgacgaaacggaaactgcagtggtaggagacagctgacgtcttcatcttttcccccctctttctctctttatttttcacccttctttagcttttcttcacggactgttaacacttaacagtcggttaatttatcctttttccctctatttttttaaatactcccttcgtattaaatattaatgtatgtcgtcgtttactttttatcaacgtttgaccattcggtttatttaaaatatttatgtaattatcatttattttattgtgacttgatttatcatcaaattttctttaagcatgacataaatacttttgtgtttgcacaaaaatttcgaataggatgaatggtcaaacgttgctcaagaagttaagaacgtcatacattaaaacatgaagggagtagtttctttataaaatatatcccacactagctccagtgaaacagaggagaatgacacaagggagggtcagaataggggagaagaagatttttgagacttggacactagagtgatgaaacagaaactgcagtggtaggagacaactgtcgtcttcgtcttttccccctcttactctctctctccatttttcacccttttttagattttcttcactgaccgttaacacttaacagacggttaacttatctttttttgcctccattttttttagaaaaatactccctccgtattaaattttaatgcaagtcgtcgtttactttttatcaacgtttgaccattcgtcttatttaaaaaatttatgtaattatcatttattttattgtgacataatttatcatcaaatgttcttaaaacatgacataaatacttttgtatttgcacaaaaattttgcataagctgaatggtcaaacgttgctcaggaagtcaacaacgtcacaaattaaaacatgaagggagtagtttctttgtaaaatgtatcccacactggctccggtgaaagagaagagaacgacggaacggagggtcggagaaggggagaagaagatttgagagacttggacactggagtgatgaaacggaaactgcggtggtaggagacagttgccgtcttcgtcttttccccctcttcctctctctccatttttcacccatctttagcttttcttcacttactgttaacataacagtcggttaactaatttttttcctccagtt

SEQ ID NO: 43492 - DNA, 1396 bp, Oryza sativa
  unsure (1)..(1396): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagactggaggaacaatccattagggttacctaaatggtccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattgaaggaccacgagaatgcaatgcattctgaccgacctagaaggggccgataggttaccgcatgcttgattcgtcggaatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattctaaataggccctaaaaaataataaaattgtattttaccagtcttggagattttaatcttgtatagttttcaatataaaaagatttgataactattgatatttatacaaaaatataaagcacagtataaaatcgccctcccccagggcggcaagggggccgcctgcaaaattccaggccccccgccgcccatttgcaggcggcccccctgccgccccgggggcgggcgatctgatgccgtgcagggggccgtcggctaattatcatgagtgctctcgtccgagagcgaagggaactatgccagattaatttctccgcgactggtgatgtgcattttta

SEQ ID NO: 43493 - DNA, 2789 bp, Oryza sativa
catcgcccgagagcgaacggccgtctgccatgtcactttcgccgccctctgggatggcgatttttaaaaatcgccctcccagagggcggtaggcgaccacttctgtcaattttcaaaatgaaaaattatttttataaaacttttaataaaaaaattaaaaataaaaaaaattcgagaatatacggtattgggctgcgaggctttccggctgttttggtgtccttggcccatgtactaacactggcaggctaccagcccacgtggtagctgcacctgcacgtcagcttcgctttttatttaggagtatttgtttatttttggaatggctaagatttcagttacctgaaattcttaaaatttcagctgaacttacttgctgtcttgtccacattaagattcatgctccggcgatggcaatagagtctttctctaggtttagaatttaggtttcaaggtgagggttgagatgggagggggagagaaggggggatggttttggtgttagagcgatggctatggacggaggccaaaccaacgatgtgtggcgaacaatgcgagcagcaaggtcgatgccgctgacgaatcaaatgtataatgtatatataagagaaacgactagtgatgtcttggcggcgcaagccactgaaggtgaaaaagacagatggtgctaaggtatctcaccatcgctcaagcatagaaaagagaactagtgaacaggagggggagggagggaggaggccggtctagtagagaacacacataacttttacttagggatagcgtctaaaggcatcaaactaggtttagactgagtttgacagcgtcggttgggagcctgtggttgtggttggtagcaagtgcgcactgttcatgtactgttcatagaaatcgtgggcctcccaaacggcgtcgtgcgcggctttacttccgtccaacatctacagtatgtcaaaagcacgtgagcaatccgaacggattaccaacctcaccatcccgctcccaacgggcgctgtcgaactcagatttattccatactagcttgtagaaaggaaagtacactagtacagtactattgtacagaatatacccttgaaatacattgatattctttattttcgcagacaaagatgtaagtgctttttttccataccatcaataatagctaggcaagtcagggtgtgtttagttctttggatgtaaagtttttgaagtatacggacatatatttgaagtattaaatgtaaaacgtagactaataacaaaacaaattacagattccaactgtaaattgcgagacgaatttattaagcctaattaatccgttattggcaaatgtttattgtagcatcacattgtcaaatcatggcgtaattaggctcaaaagattcgtctcgcaatttatatgcaaactgtacaattggtttttttcccacatttagagtctcatgcatgtgtccaaacatttgatatgatgtttttgaccaatattttttgaaatctaaataaggcctcggtaggaaaaatgaaatgtcgcctacgagttttcgcagaaaaaggacagaccacaatatcttatgtgtcctcgaggtccatacagcagcagcagtgaaaaggatttggagaatctgccccatgtggtgcgtgttgtgttgtccacactccccttggacctcactccttgctgaaattgttctgcacaaatggtacacatgaacccaagctgtccaccacccaaaacacacggctagtttgcctgagatatcgacacacaaagatgtacctcggaaatggcatatttttgtttctccatctgaagaacggatcatcgtatcatgggcttgttgttcatatctttagtcctttttttcctattaattttatgtataaacgtgtgatgtaaacttgcgaacaattaagagatcaactaaaaaaacttcgaaatatcacccacggctttgaactctcagaggtctcgctgagacaatcgagttgtcaaatttagatgatttctcatgtaaaaaaactgcgaaatattttttaaaaatgaaaaatagagtttaagctatcagccacacaagatttaggatctattcagattacttttaaaataaacctttttaggcccctttgattcaaaggaaattcatagaaatttttagaggatttcattcctataggaatttttcctacgaagccctttgaatcaaaggaatgaaccctatggaatcttatgaaattcctataaaatgcctcttcccatacaagttttggaggaattttaacaagagctagaacctcatggaagaaatcctttgagggccactttgaatcacatgaatggaaaaacagaggaataggaaaaacatagaattctgacaggaatgtaagtgtaaaacagatgattgcaaaacacaggaaaaacgtagaaatgatcatttgattggaccacaggaaaaacacaagaatttgaggagagataaagactcaaaagattttttttccatgaggttttacctcttgttaaaattcctccaaaacttgtatgggaagaggcattccatattaattttataggattccatagggttcattcctttgattcaaaaggctttgtaggaaaaattcctatatgaatgaaatactctaaaattcccatgaatttcctttgaatcaaatagggcctgagtctttatctctccttaaattcctgtgtttttcctgtggtccaatcaaatgatcatttctacgtttttcctgtgttttgcaatcatctgttttacacttacatt

SEQ ID NO: 43494 - DNA, 25327 bp, Oryza sativa
tctgttttacacttagggcccctttgaatcacaggaatgaaaaaaacggagaataggaaaaacttaggattctgacaggaatgaaagtgtaaaacagaggattgcaaaacacaggaaaaacataggaatgaccgtttgattggaccacaggaaaaatacaggaatttgaggagagataaagactcaaaggatttcttccatgagttctacctgtagttaaaattcctccaaaacttgtatgggaagaggcattccataggaatttcataggattccatagggttcattcctttgattcaaaaggctttgtatgaaaaattcctatagtaatagaatcctttaaaattcctatgaatttcctttgaatcaaagggggtcttacattcctgtcagaatcctatatttttcctattcctccgtttcttcattcctttgattcaaaggggccctaccaaaattttggtaagttgacaacattgttatattttggtaaattatagtaaatatattgttaccaaaattctttaagcaatgcctatatttacgaacaaactaaatgaatgatgaatccacatgtttattaattttaaaaaatagtatggttcaaaattacatcaacctaaacagattcttatattgcaactaggcactcaagttgccatctcaatatccgtataagaaaacgaccatgaacgctgagcaatgccacacttttattaactctacgatcccttaatttgtctttttctttcgtctgcatctttatgcatcacaaaagtgtttttttcttgtaagtggtgttaactggtgagagggataacaacttaaagaaaacccagaaaggaaaagaaattataattacttgtggatctccacaagttacaactagtggagtactactaaagttgtaccggccatatttgaccccaaagagacctacgcccccggagaccaatcaagagccatccaacgcaagcaaagacaatcactcgcatcccacccagagccgtccctaccaattggcaaatcgtcacttttggggcccacctgtcagcgagagatcggaaggaggcgtcatactgcatccacaggcaaaagaaatctatcctttggattttttttttcatggctgctaaattttgacgatccaaaaaggtccaaaagtctcgcaatgatatatgatgtgcgagtttgcgacggctccatccacctcggcttctcccagctgcaacgaatcttcgcatctttgctaaagtttaattaacgcatgccgtgacagtgatggatgcaattaataatgttccggtgcgactcgatcgtaattaacatgattagtgacttcagtgtcgtcagcttgtatgtaaacacaatggagtgatctcctagtgtcgtcagagtgtatgtatgtgtgggtgacactgagacgtctacgcgaattgaaaaataaaaaagagaggaaatattgtgatgagaaagaagaccttgacgttttgagataaaaatagaaacagataagtaaagccatggctaggtgcgtagagtagagatatacgtatgcaagttgattaatgcctaattacaccgtcgtccttactagtatgaactgattgttagtctttaaaatattaaatatgcccggtaaaaaatgatattttttaggtgtccaccaatcaggtaaagttttgtgtgggataataaaatgttaccatgattttcaccatgatgctaatcagtcaactttcttaaaaggcaattatttatgcaacccagattgatcaatatcttcgtatttatgtaataactagaaaaaaaatactcgtgatgaaggctattttaatcttattattgttatatggtttagttaaagtaaaaatttactgtgagcataaaggctattttaatcttatattgttatatggtttagttaaggtaaaaatttactatgagaattcacttgaatatttatatatttttaaaaaatcatgagttgcagttaggagtttgttcgtctcaagttagcacgggagttttttttaaaagattttttatatgactcgttatgtatttctaaaagcgaatggacttaaaagtcgactcaaatacaaatatgtatttttcaaaagtgaacgaacttaaaaaccgactcatatacggatgacgtaccaaaatactaaaaaaaaacatcttcaatttttataatagtagagattaagtatatttatttctaaacagaattagaagtgtctcacaataaaacctttttattgtacgaaagatgagccatacacttggcatcctaccatcacacttttgctgcttctcctagtacctcacgctatctttccattaacttaaatgataattatttcttattttcttggcgtcttacatcctttctttcgttggcatatttgtttttgtacatcatttctaaactagtcatgccgttagcatgtattaggtggctttactcttccgcctgcgtggctgcctgccaacccaacattccaacaaaaataacctattctccaatctccatataccctcccaaaaaatatcttagataatgaagtttagagtatgaaaaataataaagctacacgcataattaattgagctttaactattactcccttcgtttcagtttataagacgttttgactcttgtcaaattttaactgctttaaatttgatcaaatttataataaaaaatagtaacatttttaactcaaaacgaatttactatgaaaatatattcaattgttgatttgatgaaactaatttagtattataaatattactatatttgtttataaacttaattaaactagaaacatcatgtcataaattaaattatttgaaattatttggtacagagagaggcagtagtattgttaataagaaacgaacgaacatgatttccctttatcatttaaccaaagattaccaatgccaagcgtggcatctggcatgtgaggtggctggccggcttggtcgcaaccggagcgaggcagccacacacccggccagctcagcgctccacgctgccacgtggcccccaccggggctggcctggcttggctgggcggcccttcctgtggctccgcgtgacgccactgcttcgatcgccccctccccgtgcggccagccaatgaagccgtgacacgtgtccctcccgtccgccgctcccgattccgtccaggtgcattgaacccagcctcccgcgcgagctatatgtaacccgccctcctctttagcccccgtacgccacagaaaactcgcagaagtgagggaaaaccaagaaaaaaaaacatttcctgcttccaaattttgtcggaattttgaagggaagaggaaggattcggaggtggtgatggcttccgctaccgcttccatctcgtcccactccgtcgccctccgcgacctcaaaggtgagaatttcttgctctcgatctccgctccctcgcgcatccaagctcgccgttcgtaaaaatttagccgaatttgagtgtttactgtggaattgaagtttgcaagcttgaggattactctgatgagctccaatatcgtccaaaaaatcgggaattaactgctgatttgctcgttcaaaaatttctcccagcgaaatgcgttgttttctctggggattcatcctcatttgaggcgagaattatttgcttataaaaattcctctctgtattccgttttttttttttggctgtgcagctgcgaggattggagccgtgaagcagcaggtggccgcggccccggcggcgggcacggcggcggcgagggcccagcgcgcgagggcggtgcgcccgctgcgcgcggcggagccggcgaggcagcccgtctccgcctccgcggcggcggcgccggccgccgcgcccgtggcggaggacgccgccgccgccgccgtcgacgcccctgctccggccgtggactacgaggccctggcccaggagctgcagggcgcgtcgccgctggagatcatggatcgggcactcgccatgttcggatccgacatcgccatcgccttcaggtactacattactcgttgccggatggatccgtacccgttaatttcgcccgttaacccgttaggctcacggtgcactggggctaggcgctttcttgctgagcgcctaatcccgttagtcctgcagcatcacggtatcttccgaaatccaacgggtggtcctgaagattcctagtttcataggagtattttgtatcattacggtgtccctggcaagtgggacccatttgctgacaggtagttggacgacgtttcggtttatagtgttattgtcatacatcagctaatatttccgatttaggaaaataagaaaatttccatcacatgggactaggattattatattagggataaatagtaggagtatataactttttgtttcgaaaaaattcagccgcagatgtataaatatgttcaatatgatttgaacgacagtgagtgtatcatacgatagttgcttcttgcttccaacttagatttatcattaaatttcgtgtcctatctaaaataggagtactacaaatctaaaaccggtcacgttggattcgtgggtgatggtaaaggaaatgcaaaacccgttataagtgcccggttcaatgaacctggacataggtcaccttcgagcaaaacatcagattatgcccgtgtccaggttcactgtatctccttcgccacgttgtttctagaatcatggcccaccaaccacgcacaagcagacagaatagtttgctccactaccacacgataatttatgctttgaccctttaggagattccaaacaaattgtataccgcaacttttaacttgtcgcctagccgtgtaggcaacttctgatgcaggattaatcaaatggagcataaattcgcacaaattttaagtgtagttataaatttatgtgtttaatatttgatcggtcgccttattcatattttatgtgtatttgtgagtttcggtattcaacatttaatcatccgtcatatttgaaaagtttataaaaattttaaaaaataaatcacgcataaaatactataaatattttatcatctaataactataaaagtattgatgataaaaaataatcggttaaatattaaacatataaacccacaactgggagtgtggtggtatttgaaaatgaaaactgatcgagatctcgtcgcgtttttttttttttttgcagcggggcggaggacgtggcgctgatcgagtacgcgaagctgacggggcgtccgttccgcgtgttcagcctggacacggggcggctgaacccggagacgtaccagctgttcgacaaggtggagaagcactacgggatccggatcgagtacatgttcccggacgccggcgaggtgcaggcgctggtgcgcgccaagggcctcttctccttctacgaggacggccaccaggagtgctgccgcgcccgcaaggtgcgcccgctccgccgcgcgctccgcggcctcagggcctggatcaccggccagcgcaaggaccagtccccgggcacccgcgccgccatccccgtcgtccaggtcgacccctccttcgagggcctcgctggcggcgccggcagcctcgtcaagtggaaccccgtcgccaacgtcgacggcaaggacgtgtggaccttcctccgcgccatggatgtccccgtcaacgccctgcacgcccaggggtacgtctcgatcgggtgcgagccgtgcaccaggcccgtgcttcccggccagcacgagcgggaagggcggtggtggtgggaggacgccaaggccaaggagtgcggcctccacaaggggaacatcgacgaccagggtggggcggcggcggcggcggcgcacaaggccggcggcgccaacggcaacgggtcggccggcgcgccggacatcttcgagagcagcggcgtggtgagcctcacccgcgccggcgtcgagaacctgctccgcctggagagccgcgcggagccgtggctggtggtgctgtacgcgccgtggtgccccttctgccaggccatggaggcgtcctacctggagctcgccgagaggctgggcggcgcgggcggcggcgtgaaggtgggcaagttccgcgccgacggcgagcagaaggcgttcgcgcagcaggagctgcagctgcagagcttcccgaccatcctcctcttcccgagccgcaccgcgaggccgatcaagtacccgtcggagaagcgggacgtcgactcgctcctcgccttcgtcaacagcctccgatgagggagagacccgatcggcacagccatcatttgttcttggcatccaatggcaatcgacttggcgacgaccatgatccggtgtattagtattagggtgagatgggttaagttgggaatcggggaggtcagaggaaggggtcggggtcagggttcagatgcagttgctgcatctatagcttttgctgctactgcgggttaatcctggaaagcttctcttctttcggaggaagagggtaatttgggtcgtcgtgtgtacttgtagctagtaataacagaggattgtaagggtaaatttaaataaaaaattttggttatggagctttttgtcatgttataattgtggataggtgctggcagcaaattaacaagcaaaacttcgtcccttggcctatggatcagctaattcaatagacgcaatctaacaaactaacttaagatagtgatgatgttctctctcatggcctaatcttcttatgagtacataactctcgttttgatcgagtttgacgcttgcgacgtggctatcaaccagaacaaatccaagacgccatgcaatcgctacaccacaaacaatgtcgtaccaaccgtgacgcacagttaatgatccttgcaatgcaatcgagggaacaatgtacgaacaggataagatgcaatctaaattttgtgaataggtgattaagcataaaaaaataacacacggttaatgatccttacagtgcaatcaatgcaatcgagggaacattatacgaagaagataaatgcaatctaaattttgtgaataggtgattaagcataaaaaaaagttacaattgaagtggtagatctaatcaacccagcaaatcaacacaccgactattaagggctctgaatctatagtcaccgactaatcgagcgagaactaaagacaaggtgaatgacacttagcaaaatttaactaaataaaacccaattgtttttttagagttaagagctgattcgtgggaggtggaggaagacagttccgagatgggttagtctattacaaggcccaagccaaagttcggttttagatacatttagtggggatgaagtttatatatatatatatatggaattcgtatccaagcaggccgttagcccgtgaattgaactacgctctactcaccaggcttgctagcggaaaaagctcactttaggtccctcactgtgtcgccaagtctaaatttcatcccctaagtgcaatactaggtatactgtgtcccttaatttgtgaaagcggtgtactagaggtcccaaggtagtataatgtacggttttggctgatacgatggttgagtcagcgtgggacccacatatcaaggcaattcagccaaaacaaaacaaatggtggaccccacatatcaggagcaatgtgctatgggagaggaggaggccgaggcggagtcctatccctccggttgagggccacggggacagggttcggtcccgctgcacgagctcctcctttgctgggagtgcgccgctgcgtccttcttcatgcgcgagggttatggccgcacgcccaaggtcccgctcgacgctaccgtcacacgctgctcggctcctcttccgccgcagggggagcgaggacgaggagggtcacgggagcaggggctgggtcccgccgcacgggctcctttgctaggagtgcgatgtcgtgtccttctccgtgcgttagcgcgagggcggcgaccgcatgctcaagagccctctaaacaccgacgctgcgcgccgcacgacttttctcccattggccaccggaacccatcgtgtgccgcccttctcccattggttgtcgtccttaatatggggaaaatataggaatagacgagggtgtcagcatcggcaggagcagggagttggtgcccccgtgggaggagggtgtcggtgatgcggagtaggtgctacgtgcagcgcatgacgtcacaaagcgctggtggtggcggttctcctccatcccgacgacaattctcctccatcttcgactcccacactatcaccaacactgccaccgcaccgtcgccaacaccactcctgggcccctcctcgttgttgccaccttacatgaagggaatggcgatctcgatctctccagttcccttgcctcccatttcctcgccacggatcgctgcgtccctcctcctcgctggctgcccaccgccactactaccttaccgtggaggggatggcgaggaggaggatggaggtgacgaggatgttggtgatggagtaagagggccaagaagttgtcggtgccctaccattttcatgcccagccatatctctgtcccgatcagttgacactcgtcgtcgcccttctcttcgccacctgcgtccagcctccctacctcctccctctccgcctggcttcggctcaccggtgaagagaggagatagaggtagagagggtgaggtggaggaaattgaacccactgacatatgggtcccattatttttatctttttgtttgactggtatgtgggtcccacatattttgttttaactttttagtcttttattttttttatcaaattgtcacataagcgccacgtcattgccacagggcaggggcggatccaggaacaaaaaattggagggggggctcaattacatagtttcttcaacctctaaccatctagagacctttagcttattatttatggtgaaaaaaatcgaaggggatgctccgggggtatccatgagtcttgtgggtgtaggggggactcgagtctccattgcacccacgttggatccgcccttgcacatgggacgaagatctagtcaaaggagccatgtaggcgtcacgtcagttaaaaccggggacatttgcactggttttgtaagttggaaaagcgttgtattcggttttataactttggggaccaattccagattggaagacaaattgagggatctaaagtgagcttgtttccttgctagttctttcggcccaataacgggacagcccgtttgccagttctaggctttctcgtagcctcacccagctacaggtggataagcccccaacgtggactcctccacgccatcacccccaccgcattatcaatcaattctccaacttccacgtgggccccagaacaaaaatccatccttccaagaagaaatcgaacagaaaaaaaaatccatcgcgttttcccatggctcgcctcttcccccaaaacccccggtgagaaatcaccccgcaaaatccaacccccccaaccattcccctcccctcgcctcgccgccgcgggggatagagagatcctccaatggtgctcctcccccaaatcctcccctccccgcgcctcgccgccgcggccgcctcccccaacagcgcattccgcccggcgccccgcctccactcctccgccccggcccgacgcgggcgaggggcccgcctcgccaccgcggcgagcgcgtcggggtcggggtcggggtcgtcgccgtcgtcgccggagccgtaccagccggcggagtcggacgacgggctggtggagctgccgctgttcccgctgccgctcgtgctgttcccggacgcgacccacgcgctgcacatcttcgagttccgctaccgcatcatgatgcacaccgtgctccagaccgacctccgcttcggggtggtgttcgccgggtccggcgccgggggcgccgccgacgtcgggtgcgtcggggaggtcgtcaagcacgagcgcctcgccgacgaccgcttcttcctcatctgcaaggggcaggagcggttccgcgtcgcgcgggtcgtgcgcaccaagccctacctcgtcgccgccgtgcagtggctcgaggaccgcccgcccgccgagacccccgcgccgggggacgacgccgaggcgctcgccaccgacgtcgaggccctcatgcgggacgtcatacgcatcgccaaccgcctcaacggcaagcccgagaaggacgtcggggacctgcggcggggcctcttccccacccctttctccttctacgtcggcaacaccttcgagggcgcgccgcgggagcagcaggcgctcctcgagcttgaggacaccgccgccaggctgcgccgcgagcgggacacgctccgcaacacgctcaactacctcaccgccgcctccgccgtcaaggacgccttcccctcgtcgccgtcgtcgggatgatgaggtgaatgctttccttcctttcttcctcctctcgtctctgccgccacgatgataaggagtttgtggatggtataggactaaactttcttatcacttttttttttggccttttagcttttcctctttttgtcacaattctatggctaggttttacttgaatgcagctagcatttttagcgtgtaaaattgtataatttcggtgtgtattaactaagaaaatgtgggctgtgatgatgatccatgataatgataagaattttgcttttctgaatctgatgcttctgccttcagtctgggaatagaatgtaatactcattggttcacttttgtgaattttgattcgcaattccaatggaatgttcagctggaattctgctgtcggtcagataccagcttagctttaaaatctaattccatctgtccgctttttattggatcattgtaatgccaccagcctacctacgaatgtaaattgatcatcatgtgcctcaggggtgtgatgatgatgatggatgctacagggttttgaaaatcaattgattttacatgtttctttcatttccatcttttgcagaagtgttatctttttgtgggttaaactaactagcatttccactcaccaagtatttgataacatgatagtaagagctttttatacacctagtagaaatgtgtaacagtgtataagcttttgatggcatattggcatgataatatcatagtagcacagtacacaacagctgaaaacaacctcttttcttttctagaaataggacaaattgacaatggttgcatcggataaaggaaacaatagagaaacaaactttaatgccagactcgtatgttatgacctatgatttcactggtcatgctttctgtgccttggctagtaacgcggatgaggtatttctacagaaagtatgcagaattgcagagaatcgagcatctgattataaactgtccatacgcaatgatctgctcggtcattaccatgaactgttgcttgatttcgatgaaaactggcgatattactaacatgtgctacatcataaaaatgttatgccaacttcaccttggcaaatagtgctcaatcatgtggaaaccatggataatgctcctctagcatccaagatgtctctctcagtagcacactgcttttacagttgcatgcatgtaatgcttgagacttgaagcattttctccacatctccgaacacatctatcgaccggttgacgagcatacttgaagtaatctggcgtcctgtggctgacgagctgccagtgacggctgacatgaacatgatgtattgatgtggcaaccggccgccatggatggcaggagacctgacctcagctgcaacatgccaaccttcatcttcttgttcttggctctactgctcgctgaggtagaaaaacggcgagcaatgatcggatataagtgctactgaaaccgtaccccttgttcattgagcaacttgagcaaacgcaggagctcgtcgttcgacagcttggagggcctcttgccggcgagctcacaggactccaacgcaccggtgatcttcgccttgaacacggcgacctcttcctcactgaagctgggtgctccgtcgtggccttcattgctgtcgccgtcgctcatgtcaccgtcgtcgtcgccaccgccaagtgcgatgagtctgctgccgccaccggcattggcattgccgtcgcagcgttcctccgcgcaccgggatctcctgaagagctccaagaccttcctcttctgcttgaagatcgcgccgagggtcttgttcttctggccgaagcacgaccgcgtgaaggccagccactcggcgaggtcgacgttgggctcgaccgccctcggccggatctcgacgagggaggagtccaccttgggcatgggcacgaagtccctcttgctcacgtccatgagcagcctcgcgtcggcgaccatccgcacgttcgccgccaggcggttgtactccgagtcccccggcgcggccacgagccgccgcgcgaactccttctgcagcagcagcgtcgccgcgcggaaccggtaggggccgaacagcagcttcgcgatgagcggcgaggagatcccgtaggggatgttggccacgcacacgtcgaactccgggaactcggcttccacggcatccgccctgatcacctggcaaaaaggagaggaggggccccgttagctttcttggaggcatttgatcgagccgatggtgggcacggcgagacgaaccgtgagcttgtgctcgaggccgagggtgtctatgcggacggtgacggcgtcgaccatgcgcggatcgatctcgacggcggacacgcgggcggcgggggactcgaggaggcggacggtgaggttgccggtgcccgggccgacctcgaggacggcgtcgcccgggcgcagcgcggcgcggcggacgatggcgtcgaggacgcgcgggttggtgagcaggtgctgcccccgcggcttgtgcagccggaaccgcccgtcccacgcctccgccgccgctggcgagggggcggtggcggcggcggcgaggtgggccacgtcgcggctgcggatgctggagacggcccgcttcatgtccggtttggttttggttcggctcaagcaacagctgctcgcgggtcgcggctgctttgccctcccctgcggctacagaacggttgtgtgtgtacttgtgttgtgtgttgacgcaactgatgatgatttttgtgattgtgagaaggtcatttggtagagtagaatcttcgcggtctatgctataaaagttagtcgatatagcggaacggcgactaacctttccgatcacttcagtcattaatcacccaaaacatgtctacgacgacacagtaacacaccatatttgttaacggggttcagccaaagcctacatccccagagctctgattatgggccctcctccccaatcaatatagcacctagccgctacgagtccatggccttgccaccatcctctccctgcgtgtctacgctacattgtagtctccatgattacattgtagtgccccctcattatttaagagagattctgggttatagagtccgactctaactccatcccctaccacctattataactccaagtccaaccgtaaccaaatagaactagtatattcgacacctattctaccttggcgaatatacgtcacctagaagtagtagaatcaccatgccgatccaccggtcctccagacttgggttgtcttctttttcgcagcttcaccatgagccgctcgacgagtctgtgccagacccaccgctttcaacagactccgctatccctgcaatttgtttagatggactccacctgcaacagtgcttcacattctctcctatcatcacagccgtcttgccaagcgaaattagacctttcctagctgtcacatcatagacttctcaaagaccatattcaactccatctaccatcttaaatttgacttgacataatccatagccaaacaacccccgtcatcaccaaatagacaaatcaaactcaccagactgataaagaaaccctttctttcttttagttttatgaactgagctaataaatccatccacgctttttccgcatccttagactgagctccatgataaattgagaagttcactgttgcctcgaatctcttaaagaattacaatgacaaccttcgctcttcctttttagtgacgtagattttcatatatccccatcatgcaaaccccgcagattctagatatatcatgtactgctaaacaggccgttgacgccctcaacgattttcacccgctgttgcccaagaccttttcttcaattctggaccaactccatatatctcaacctttcatcgagtcccagatatattatgttccgccagataatttcatatgcgatctgactagcctgttgccaccagtctactcgccccacgtatcaatccgaccggctttgcccctgggtctaaccagccaaatctgatcgaaccgttcggcccatcctcgtttgatcgaaaccatcactctgttgaactggtctgatcagccaaactctgcaatccaactagtccagcacctgtttctctgccctgtcggcttgatctatccggccacccatgcctgcatactttcgccttgagccaccttagcttagcccttgatcggtctccgtcgggacgcacagttgcccttcaagcttccatagccgtgaggtcttaagaccgttcaaccaatcagtacccgagtttggatagttgaccctgttggaatacggtccgtattcttgcaccggtgacctgtgaggctaggaccgagtcggcctcagtctccacgtgacacccccgtcttgtaccgaacatgctgcttggcttctcatcaagtatacgagcaaacgttgcccacacatgcatatgcaccacccggacacgtccttctcaatgcatgaacagatgccctccctgatcatagcacatgcacatgcacgtttatgtgcatcaacagaccagcatgcatgttcaggcacataatttgcaggtaccagttggtgatcttccagcatatggcgcgcacgtccatgttagaataatattagtttcgaccgtaaatattactaaaatagagaactagttatgcttgcaatgcgtatccatgttagaataataatatttcactagtatttggttcactaaccttttacagagaataaccataaaagtggagaagaatcaacatcgtcaaaccagacgataaatcaatcggacgatgtcgagaatcaaacttatgtatgaatgggccaaaaactcagaaatgacgcgaccaattaggctaaaatttacaagtctgcggggaagagaagtccaggagaccaccagccaaattgtgggctggttgggccggcccctggttcggccgaaccgggtttagctgaacccacctctctaccgttggatgtggggtttggtagggacgctctagatcttctcctgatgacggttgcgggatactttagatatttcgcaacagttacaaccgtcatacctgcctatttaaggacttcactttctcacttcactcacacacctcaagcaaagttctatcatattctctcaagctagtttagtgttctcaagctagtggagtaggaatagagtagaaatcggagtccggaagccttcggaagagttcgggtatggctccagtagctcttctcttttctttcgtaagctttgtacttttgttagaatactcttctttatacatttatggtattggaatactttccgagtatatgaatgccaactttacattatgttcatgttatactgattatactgctagcttatctgggagatgtattggtatgagtatagtgttttcttatgcaattactctatgtcatgacgatgatattagagtagtatctggtactttaggcgtggtgtctagattacgggatatcattatttggggttatatgctgcggatgagatgtgggccgctaatggtgacagctcagtacgggtattcctccacgcgtgtatatagttctaagttaatttcctggggagggtactcctccgtatttatcctcggttgtatggtcatgacgggctgtcgtaaggaacttggcagtcacgggtggcttctcgaagtaccaggagggcatcagatagagggtattagctagtatgtcagttaactaggatgtatgtatactatgtatactagaagtatatgaatatactctctttctattttcttcccacttagcttagatattttagtatgagaatgagtagctccctgcatgtgtgtcaatctacccttggattatcacaagtaacatataagttattagtcaggttctctctactatgatcttttcacgggattaaataaatacgatacccttgtaatactctcgagtgaaatgctacaatggtatatccgtgcgcttgcagatgaactctgtaaccataatatactaggaatatttctgcgccattgctgggaattatatttttagtaatgtcgttaaaaaataccaacatatacctcagctcctcgcgtgtatcactagttcgtgtatagcacatactccatatatgttgttcgtgcccttgcacgtactgcagtcacagccctcatgtccaccatccacgatcacatcgtcctcggccctgcacgtctgccgcgctgcgccacatgctcgccggcttcgcccttccgtcactggcctccctgcctccgcggatctgtgatcgccgcgtgcattgggcgccgtccctccgatctctccgaacgcctttggccactccctgccccgtcttccagtcacgttccgccatcgccggtctgatcgcgagcgaggacgtcacctccacaaagtcctcgttgtcgccatcgatctcattgccacggctgacgatctcctgtcgatgcgcagtcctcacctcgtgtttcctcccccacatgttttcttgatccaatattgaaacattctgctttgataccacatgttgtaaaagttagtcgatatagcagaacgacgactaaccttcccgatcgcttcagtcatttatcacccaaatcatgccagatgacgacacaggaataaacgatatttgttaacgaggttcattcgaagcctacatccccggggttctgattatgggcgctcatccccaatcaatatagcacctagtcgctatgagtccatggccttgccaccatcctctccttatgtgtacgctacattgtagttgccatggttacattgtggtgccccgctctctatttaagagagatgtcgggttacagagtccgactctaactctattccctaccacttattacaacttcaagtccaactataaccaaatagaactagtatattcgacacatattctaatagtctagaaaaattatttcgagaagtaaattttccgaaccacggacatataggaaaacatgtttattgagcttgtagcgaggtttttttttgtctttggctttacaatcgtatatacaacgtcgaaattccctgttgatgaggacatcctccactattacccactggcaaagacgctaaagtcgggcggcgaccgtgtgagcctttgaataatcccaccttgcttaccttgggaggaggaagccaccttaaaagggagagccacccttcccctattggactagtcttttagggagattgggcattttcctgagtaggtgtgcctatgaactgttggggtccgagcaaccttaagttattgggtctcggccaaccccacctgggccggattgttatcacctggttacgtggctttcattgaacatacaatcatattttcggcaggtcatggctgcactataaatcaaaatcaaaagttctatagtatcttcttggatgggtatatagaaccgagagttttgtattattgtcatcttcacacaatattttatagcaaaataacatatacaatagataaatttagtgcatgtcggtacaacaaaaactagttgcttggactcctgtgtcgctccattgggtggcccgggaggcgattctttcaaaccttcagttcaccctttacatcctctccaagaactagttaacgctggtcaccggccaccgttaacggtagcactagcgtccatgcctatcttccttcttcccccaatttcttgccctaaccggccaccacggtagcactagcggccaccgctttcttatttttcctaacctttttatgatccttaactttgagatctgcagtttaacaactcttttaggtttgactatgtgtgcctagattcctatccaacatataaaaaccttgttgccggtcttaatatgaattaattatgttttataaaggtgttgctgcacgtactataaactctatgttaaccaactattataagctaaccgattgtttacattttataaagaaactactccctccacgttttaatgtatgacgttattgactttttcaccaacgtttaaccgttcgtcttattcaaaattcttgcgcaagtacaaaataatttatgtcatgcttaaagaacatttgatgataaatcaagtcacaataaaataaatgatagttacataaatattttaaataagatgaatggtcaaacattaataaaaagtaaacaacgacatacattaaaatttaatatggatggagcattttaaaaaaaaaattggaggaaaaaaagataagttaaccgactgttaagtgttaaccgtcactgaagaaaagctaaagaagagtgaaaaatgagagagagaaagagggggaaaaaccgaagacgacatctatctcctaccactgcagttcccgttttatcactcaagtgtctaagtctctcaaatcttcttcttccccgctccgatcctcccttctgccattctcctccatttcaccgaagccaatgtggggtacattttataaagaaactactcccttcatgctttaatgtataacgttgttgactttttgaccaacgtttagccattcatcttattcaaattttttgtgcaaatataaacgtatttatgtcatgcttaaacaacatttgatgataaatcaagtcacaataaaataaattataattacataaatattttaaataatatgaatggtcaaacgttgattaaaaagtaaacgacgtcataaattaaaatttaatacggagggagtatttttaaaaaaaatgggaggaaaaaaagataagttaaccgactgttaagtattaatagtcactgaagtaaagctaaagaagggtgaaaaaatagagaaagaaaagagggggaaaagacgaagatggcaactgtctcctaccactccagtttccgtttcatcactccactgtccaagtctcaaatcttcttctcccttgctccaatcctcccttctgccgttctcctccatttcagcggagccagtgtggggtacattttataaagaaactactcccttcatgttttaatatatgacgttgttgatttttttaccaacatttaaccattcatcttattcaatatttttgtgcaaatataaaagtatttatgtcatgcttaaagaacatttgatgataaatcaagtcataataaaataaatgataattacataaatattttaaataagacaaatggtcaaacgttgataaaaaagtaaatgacgccataaattaaaatttaatacggagagagtatgttaaaaaaattggaggaaaaaaagataagttaaccgactgttaagtgttaacggtcactgaagtaaagctaaagaagggagaaaaaatggtgagaaaaaggtggtgttcttttcttccgaagatgaaggtgaagatgaagattaagttttttaacaaaatgaggtggtattaacgtatgattaattgagttttaattatcacaaacatgaaaaatagattaatatgatatttttagaacaactttcgaaagttttcgaacgaaacacaccgtttaacagtttgaaaaacgtgccacgaaaatcgttatcttcatccaactcttgttggagaaatgaacgggacctttgaggggaaaagacgaagacgacagctgtctcctaccaccacagtttccgtttcatcactccagtgtccaagtctctcaaatcttcttctccccccctccggtcctcccttctgccgttctccttcgtttcaccgaagccagtgtggggtacattttataaataaaatactcccttcatgttttattatatgacgttgttgacttcttgaccaacgtttgaccactcatcttattcaaatttttttgtgcaaatacagaagtatttatgtcatgcttaaataacatttgatgataaataagtcacaataaaataaatgataattatataaatattttaaataagatgaattgtcaaacatttataaaaagtaaacggcgacatacattaaaatttaatacgacgggagtattttttaaaaaaatagagggaaaaaagataatttaaccgactgttaagtgttaacagtcagcggagagcggggggaggggggggggaagacgaagacggtagctgtctcctaccactgcagtttccgtttcatcactcaagtgtccaactctctcaaatcttcttctccccccactccgatcctcccttctacccgagctgatctctctcgtccgcatcgccaccgacggtagctcaccgatctgctctgcccgcgccgatctctcccgtccgcatcgccaccgacggccgccttgacgatctcctccgtgcccctgccggaacacccacgcacaaggtgtcataggccgattccaaacaggtacaacatacatcctgtcggagtaggaaataagctgattgttcttggtttctgtctaacctgttattttcagtgggatttgtgatattctaatagtttgctatggtttttgggcttggaaggtgcttttttgaagatgttcctgggcaccgaggaaggaggtgcagctcaagacggaatataatagctacagggtatattacaatcgtgctatcgatgataatctaagcatcaacttgtattttgaaatcaacttatggggcagcatacatcttctttcagataccatatgataaagtgtttataaatttagtttgcacattgatctgagagaagaatgatatctttgtgttctccatatcttttgcaatgtagattttgtgctacagcaaagtatagatcagccaagactgacaggttcctcttcaaggttatcctacggttccgattttctgctttctacactgtgtctacatcttatatattcgttccctgaagctacagattgatggtctagctgttagctgtgcatgtgaaaaagccaaatgatgccgtatcaaccactcagaccttggccttgtgggcttgctgttgtgaacaacaccaagcatccatataggttgtgtgtagttttataaatataaggtgctcgtgaaaaatcctgacactgagcattgagtgatacggttgaatattggtgcacatatcactccacagacatacattgcattatcacataattggtcagtatcacctttgccttcttgttaatccattgaggacaaatagctgcagctacagaagaaatttacttatgtacattttaatccggtattaggatcgatgctttgatgattcatagcttgtttattctaccatcttcacatgaattggccgtatggagtgtgaaaacagccctgtaggaaatacctactggtctctgcttgctctgtattttgctgtcagtaacaaacttctagcaaacaatttaagtgtgtttgccgcaggatgagcctcacgagggcctgagggctggagcaacacattcaaccaggtgtattttttgtacacatattgtctaggtctggacaaaagccaaatatcgcataatcctgcattttttattcagatgttcaatattcccataatcaatccaaatatgatggattatcgcctttctagctaatgtggtaaatattagtagtaatgtttgaaatctcgtatctcataggtttggttgctgagctaacatgaataatctgtttttggcttttcgatatagctggcaattcaagtttatcgttttcagttgagcattttgacaaatgagtgagttaatttccctgttttatttccacttggacagttcaagcacaaacataattaggtgaccattatcgatttactgaattttgctaccaaatttgctgagattttttttcgggcacttgaattagattgtagcatgcgtattatcattctgttctctgaactaagaaaaagtttgatagggagtccaaatgcacaatatatttctatgcagtgatgggtggttccaaagtttgattggttgcccattgtattttttgtcattgcagaatgccaggataaaagtataggcatgcaattttctgtatgacaaatatcaatattatgttttgcatgtctcaatcggcttgctttgattgctctacttctgatataacacgaagtcaaggatcgtgatgcaaggatctaacgcaaggacagaatagcgactggtgtatgatcacactaattgatgtctgattcaattgatgtagctagatatgcaacttggacatgcattctatggtcattgcagggaaattttaaatgagcttctagcatatttatgacaatatttttcagtaagaaatttaaagtacattgtgtagtgccttctaattaatgcttgttttgcgtagttgtgcctaccatattcttgtcttgcccaaaataatttctcaattatatatgaagattctgagttatacgaggcagctatttggtgctcctgcgctagcagcttaggaggagaaagaggacctcgagcttgtgttagtgcctcagttgcataggagcgacagctggctttgcggatggcaggtatggggtgctcaccggcgtgttacggagaggagaaggatggggagaggagcagcgaacaagggcggaggagtggcgtctgacctcaagctggactgttgtagggggctgtacaagcgaggctgggaggagctggaaagaggagcgggttgcgtggcgttggaggaggcaatgcagcgaagaaaatggggaggtggcgatgcggtggggaaaacagcgggagcaatggaatctgattcccaagctcgcctagcgtaaggtgtggtagggatttaactatttgccatttttagatttggcatttaactatttgtcacccctatctcaatgacgtgtgggtctacatgtgtctatgacatgtgagtccagtggcaaatagttatttgccacatctaaaagtgacaaatagttaaatatctgcgcgaaataggaactctggagttatactgattcaagatatagattagacataacatctttgttttgtcagagtaatgattaggataatttaaatgacaaattttacacaaaattttgtattgccggtagcattggatgatcagagtgatttttgtgtccattttctacgtgctctttcaactttgaggtttttttatatttattttataccatgtacaatgatggagatgtgtattattgtatcctcaaacacacttgtattttaatacaacgttgtttgaatacatgcctatttattacttggtgacataaatttcatatgcaaagtaaacttttccggctgcactaccagactatataaacatcattaaaagagttgtatgcgatatatgtttgatcctatgaagtatgtgatgtggatttgggtgattttaccatcttgttggcttttacatggcatgattgactgtgcaaatacaattatttagtactatgtaagaatatatgttgcttgttgatctccaaatgggcatggataatgtttaatgtttagtaagcaatgaaagaatagccaaatagaactacgatatgacgtagagttacatccctcgttggcgtgctaaggatcacgttttctattgcttgctgctctacaattttttatcgaatgtattttgtatctaataaaaataataatagtactttactgcatggtatggattttatagtagattacggtgtttttggaacataactgacatggttcatatcgtgtaaataattttactcccgagcattattgctgactaaatggagattttcaatcatattattacattaggtacgtatggacacaaatcgctatgacagggaagcgcgtgaagccctcggattatatgtattatatatttgcatgaattagtatatcatattattatactatatgtgaaatatttgatgtatgagataaattaaattaaagctcaaatgcacagttcatataataatatttttttgctaccacgaaaaattttaaaattattaaagataaataggagttgcaacatagcgtttagcacgtgcatattactaatgttaacagtcagtgaagaaaagctaaaaaagggtgaaaatggagagagagaaagagggggaaaagatgaagacgacaattatctcctaccactgcagtttctgtttcatcactccagtgtccaagtctctcaaatcttcttctccccttctccgatcctcgcttctgtcgttctcccccgtttcaccggagccagcgttgggtacattttataaagaaactactccttctttaatgtatgacattgttgatattttgacctacgtttaaccattcatcttattcaaaatttttgtgcaaatacaaaaatatttatgtgatgcttaaacaatatttgatgataaatcaagtcacaataaaataaatcataattacataaatattttaaattatacgaatggtctaacgttgataaaaagtaaacaacgacatacattaaaatttaatacggagggagtattttaaaaaaatggagaaaaaaagataataaagagggagtatttttaacaaaaaaattggacaaaaaaaataagttaaccgactgttaagtgcgctgaaaaaagcttacgaagagtgaaaatagagagggagaaagagggggaaaagacgaagacggcaggtgtctcctaccactgcagtttccgtttcatcgctctccagcggcctactctccagcgtcctcttctcccctgctccgaccctcccttctatctttctcctccgtttcatcggagccagtgtagggtacattttataaagaaactgctcccttaatgttttaatgcatgacgttgctgacttcttgagcaacgtttgaccattcatcttattcaatttttttgtgcaaatacaaaagtatttatgtcatgcttaaagaacaattgat

SEQ ID NO: 43495 - DNA, 1787 bp, Oryza sativa
cttattcaatttttttttgcaaatacaaaagtatttatgtcatgcttaaagaaaaatttatgataaatcaagtcacaataaaagaaatcataattacctaagtattttatataatacgattggtcaaacgttgataaaaagtaaacgacgacatacattaaaatttaatacagaggaagtatttttttttaaaaaaatggaggcaaaaaaagataaattaactgactgttaagtgttaatagtcaatgaagaaaagctaaagaagggtgaaaaatggagagagagagagaaagagggggaaaagacgaagacgacaactgtctcctaccacagcagtttctgtttcatcactccattgtccaagtctctcaaatcttcttctcccccgctctgaccctcccttctatcgttctcctccgtttcaccggagccagtgtggggtacattttataaagatactactcccttcatgtttcaatgtatgacgttgttgacttcttgaccaacttttgaccattcatcttattcaaaatttttgtgcaaatacaaaagtatttatgtcatgcttaaagaacatttgatgataaatgaagtcacaataaaataaatcataattacataaatattttaaataatacgaatggtcaaacgttgataaaaagtaaatgacgacatttattaaaatttaatacgaagggagtatttaaaaaaataaagaaaataagttaacccactattaagtgcgctaaagaaaagcttacgaagggtgaaaaatggagagggagaaagagggggaaaagacgaagatgacagctgtctcctaccactgcagtttccgtttcatcactctccagcgtcctcttctcccctgctccgaccctcccttctttcgttctcctccatgtcaccggagccagtgtggggtacattttataaagaaactacttctttaatgttttaatgtgtgacgttgttcacttctcaagcaacgtttgaccattcatcttattcaaaacttgtgtgcaaatataaaagtatttatgtcatgcttaaagaacaaattgacgataaatcaagtaacaataaaataaattataattacataaatattttaaataagacgaatggtcaaacgttgataaaaagtaaatgacgacatacattaaaatttaatatggtgggagtattttttaaaaaaatggagaaaaaaagataatacagagggagattgtaatgtcccgccttcccccaggccgggcccgcttacatctgatagctttcataggtcataagactgccctcacagaccaacacatgtcttttctgcacactttgtcctcactcgtgtacactcgggaagaatttcccagtcggtcacccatcccaaattgccgggcccgcttacatctgatagctttcataggtcataagactgccctcacagaccaacacatgtcttttctgcacactttgtcctcactcgtgtacactcgggaagaatttcccagtcggtcacccatcccaaattgccgggcccgcttacatctgatagctttcataggtcataagactgccctcacagaccaacacatgtcttttctgcacactttgtcctcactcgtgtacactcgggaagaatttcccggtcggtcacccatcccaaattgctccaggccaagcacgcttaaccctggagttctttggagattgacttccggaaaagaagttgcaacttgttgatatgagtattctattaatcctattaagccctaggccgggatgataca

SEQ ID NO: 43496 - DNA, 1334 bp, Oryza sativa
atttagatgactccttggttctaatcaaatgtttaatttatctcttcatttaatttaagtcttcaatgcataaagactaatataggaacaacttatttagaaaaacttaaatataaaatatgtgtaacttttgtggatggagggagtatttgaaaataaaggtgaatgagtactctctccgtctaaaaaataaactcaacctcgtaagggtgtgtttagttcacgcgaaaattagaagtttggttaaaattggaacgatgtgacggaaaagttgaaattttatgtgtgtagaaaagttttgatgtgatgaaaaagttaaaagtttcaaattttttttgaaagttgagtatttttttttaacggagggaataatgttgtgcagtaaaacccgtcagactgctgtgtggactgttgtcccgtggttcagtcaaagatgccatttataaacccttgccttaaaatatggagggatgtgtagctcagctcctggagctgacaactccgttagaatagtgcaggtatgtgaagaagacttgtatggccaaacgtaagggttagggtatgtactcctagggttagagtaaagatggaagctttgccgtgacaacatatgcggactgtatcaccgcgttaggttttgaagctgggaggggcggagggcagcgattttggttggtagtagtacgggacggcggcgaaaaaaaagaagcaaaagcagtgctcccgctcgccgcgctcggtttcgacttccaaaggcaccgccgcggcggcagcttccccgtctttattaccccaccacgccatcccttttttttcacactcccgccacgcctcccaacgcccccgaaatctcgtgtccctacgtgccggagcagctgcgagcttttgcacccacgctgtgagccccacccgcgtacgccgcggcctacgccgcactccactccaccccaccctactgcgccgcgccgtttcaaacccgttcctttcgtttcaccgttcccaccacgcacccctctatttatccccgcccccaacaacctcgctgcactccacactccacgcctccgcccgctctcgtcgcagcgcaccccgtcgcgtgcgacgactccatccccgtcacaacaatgtcgtcccgccgagacgtcctcgctgttgtcctcgtggccgcgctgctcccgccggcgttgtcccgtgggctttggctggggcaccacgggctggggcacgggcacgggcgatggcgcgcgccgcatgtcggcggacacggccagggacaggggccgcagcagcacgcgccgctcggcggcggcgggtggtcgtcggcgcacgccacg

SEQ ID NO: 43497 - DNA, 709 bp, Oryza sativa
agcatacaaccaaccaatcatgtctgttaggtaatgtctagtgtagatgaaactaagattatcacatcataccatgccacatatggtttataatatcttctctctctccttaggctacattaggcgtgatctcataataaaatctagggccactagagaaaataccttgcactcagcgaataaagcctgtgcgggtcgccgcacagtggcagtgctaactggccacttcgatctcagcttgactgaaactccccccaaatacagaaatgtatgggtacgccatcgactcaatgcaatagagtgatactcggggagtagtattaagaaatgcttcatcgtggttatatgtgtgctaagagaaaacccaacgaaatgagtgcttggagcatacaaccaaccaatcatgtctgttaggtaatgtctagtgtagatgaaactaagattatcacatcataccatgccacatatggtttataatatcttctctctccttaggctacattaggcagtgctccctccgtcctataatataagagattttaggtggatgtgatctaattgggagaaatactcgctccttcttcacgcacacgcttcccaaactgctaaaccgcgtatttcttataaacacattttatagaaaagtttgctttaaaaattatattaactctcaattaatcatgtcataatggatcatctcattttgagt

SEQ ID NO: 43498 - DNA, 712 bp, Oryza sativa
gggatacataccgcatacgggttgcagaacgcagatagtactaccagcacagcgcatcgcgatagataaaggcaagcaaacaagggatggtccaaaccgagctcgggccgcgctgccatctcgcctaaataaaaccgcgctacccatcgaccgatcctactcgcacgcgcacacacccaatcaaatgctcctcctccgccgcctcctctcgctgagctgagctgagctgtgaaatagtgccaccgagtgagcgctgagctgagctcgaagcaagagaggaagaggaggaggagggaagagggggggcgaagatgattacggcggcggacttctaccacgtgatgacggcgatggtgccgttgtacgtggcgatgatactggcgtacgggtcggtgaagtggtggcgcatcttcacgccggaccagtgctccgggatcaaccgcttcgtggcgctcttcgccgtgccgctgctgtcgttccacttcatctccaccaacaacccgtacacgatgaacctccggttcatcgccgccgacacgctgcagaagctgatggtgctggccatgctcacggcgtggagccacctcagccgccgggggagcctcgagtggaccatcacgctcttctccctctccacgctgcccaacacgctcgtcatggggatccctttgctcaagggcatgtacggggagttctccggcagcctcatggt

SEQ ID NO: 43499 - DNA, 1791 bp, Oryza sativa
  unsure (1)..(1791): unsure at all n locations
gtgacactatagaatactcaagcttttgtcccaagctccaccaaaatcaagagcgcaagctctcaacatatcttccaagatttgattgacccgctcggtctgaccatcagtttgcgggtgataggccgtgctgaaatttaaacgggtccccaattcttcctgcagcttctgccagaattttgaggtgaactgactccctcggtcagatacaatctttttgggtactccatgtaggcacatgattctcgaaaggtaaagctccgccaaccttttgcccgtatatgtggtatgtactggtatgaagtgagcaaccttagtgagtcgatccacgactacccagatcgaatcatgacccgacgatgtccggggcagtcccgttataaagtccattccaatctcctcccatttccattccgggatttaaagaggttggagtaaacctgctggtctttggtgctctgccttcactcgttggcaaacatcgcagagtgcgatgaattcagctatttctctcctcatgctgacccaccaaaacttttctttgaggtcttgatacattttagtgctgcctggatgaatggagtactgggtctgatgagcctcggtgagtatcagatccttcagttccttgtcgtcaggtacacacaatctttctcccaaccagattgtgccatgctcatcttcgtggaaatcccgggcttttccgactctcatgttctttttcagctcttctatttcagaatcatttacttgagctgctctgacttgatccacgagcgtaggccgtgccttcagagcggctacaaaaccgtgttcaacaattcccacgttgagatgctcaaactcctgccgcaattcctcacacatgccctcgatgcatagggcagtgcagtaacttttccggcttaatgcgtctgccaccacattggctttacccgggtggtagtgaatgctcatgtcatagtctttgattagttccaaccatcttcattgtcggagatttaggtccggtgggtgaagatgtatttcagactcttatggtccgtatatacttcgcagcggttggcaatcagatagtgcctccagattttcaaagcatgaaccactgctgccaattccaagtcatgagtgggataattcccttcgtgtggacgtaactgtcgcgaggcaatacgcaaccaccctgccctcttgcattaggacacatccaagtccgtggcgggannnnnnnnnnnnnnnnnnnnnnnnnnnnnnnnnnnnnnnnnnnnnnnnaatcaaaactggtgcggatactaatttcttcttgagctcctcaaaactcttatcgcactcagctgtccatttaaacttctcatctttcttaagtaactgagtcatgggtcgggcgattctggagaagttttcgatgaatcggcggtaataacctgcaagtccaagaaaacttcgaatctgcgacacggtcttcggcggggtccatttggtaaccaactccacgttcgatggatcaactgccacaccctgagctgtaatgacatggcccagaaatttgacttccgtcaaccagaagtcacacttgctgaacttggcgtatagctggtgctccttcaacttctcgagtactagacggagatgttgttcatgttcttcttcggattttgagtagataagaatgtcgtcgataaacaccacaacaaacttgtccagaaattccatgaacactttgttcatcagattcatgaaaaatgcgggtgcgttggtaagtccgaaagacataaccgtgcactcatatgg

SEQ ID NO: 43500 - DNA, 15642 bp, Oryza sativa
gttggtaagtccgaaagacataaccgtgcactcatatagcccgtaccgagtggtgaaggccgtctttggaatatcctcttcccgaattctcaattggtggtagcctgatcgcaggtctatcttagaaaacactttagctcctttcagttgatcaaacaaatcatcgattcgcggcaagggatatttgttcttgatagtgacctcgttgagtgcgcgataatcaacgcacatcctcttcgtcttatcctttttctccacaaaaatgaccggagcaccccaagatgaagtacttggtcgaatgtaccctttctgcagctgctcatcaacctgcttcttgacctctgctaattcgttttgagaatttaaataaagcaataaaagactcaaataagggaatcgaataagagcgaaatttttatgcatagatcattttgcatgagagcgaataaataagacagactcacataacgataaaataatgagaaattagatacatactaataataacaaataaagcataaataccttgcaacccatgttcctgagctatgacctaatgcatttcacccatcagatcccaactgactgacgaataaacctcaacagttttactaaaaccctagactgactcgttttgaaaaatctcacttaaacgagcgaccaagatttttcccttgaaccacaagaacagatcccaattttcccggaacaaatccaattgcaaagaacatatgcaatgaaaaggattcagagggctcttaggtttttccatttggcttgtcctacggtcaaggtcggctctgataccaacttgtcacgcccagaaattccgaatagaatttcaagcagaatgtgcattaaaatccccgtccaggaccggccggggtacacaaacgacaatgttgacattcagatccacatcttacaaacatcataaaagtcttacataaatgcagcggaagaaaagaaagacaacaagagctaagccttgactaaaactgcagcgggaacaccactccacaggcatcctcgacggcacggacaaagcctactcctcggagaaaccttcatctgacccgaactcgaactctggggttgggaaaagtagagcaagactgagtactacccactgtactcagcaagtcataccggaataggggtatggtgcagggaatcatcaaagaagagctaaagtggttcatttgcataaagcgagcatttataaacaggaattgaaagatttaaacagttgtaataattaattaatattaatcatccgctgtccaacgctatcccacgttgcgacaggcccagccatccacctaaactatccaaattcaaaagattacactaaggtgagactaatcacggtgaatctggttgaccgcccataaccgcgggcacggctattcgaatagttttactctgatcagaggtgtacaactgtacccacaagacacagccccacgacacgtttctgtgcgccgacatgtcaccacgacataccggaaagaggccgtgacaggacccttcgcataaccccctctaaccaagcacaccacacctcaggtttcacccccactcctcgcaaggcagcgggcagtcccctctcgtgcctaggtgaatccgaaagccgcataggccgtcgcagggcccatccaaactccatcacgcccacccttgcctggatgcgtcggctagaggaaagctacgctacaagcctagccgttgcccacgctggcttgtggtaagtacgataagttcttccagggcatcccgcgaaccggtccttaactgccatgggtgcgaccagcaaaaccatgcacccacagcccaccatgtgatttattttaattaaccaacaccaaagcggtgttactaatccaacaaaccattagaaccaacagtctaaacattaataggatttttccccattgtgaactagttgaactaagcatggctaagcaatccctagtccaaactctaatcatgttataaccccaagctgacaaagaaacatggtacatcaatagcatggctatgacaataggtaaacaactcatagtaacattataaaacgatgcagtatttgaaagaaaacaatagagcatttgcaatataggatcaacatgttcaagtgacaagcatgacttgccttgctctgctgctggaggaacctcggcgactatctcgaagtacaccggagcgtcggaggaatcggaatctagcgacatacaaagcaaacattgcaaacaggctataagactactgaaacagggaacaaaaccatttttaatggattctacacatttttcttgatttactgagacttgaatgggcttaaacggagctcggatgaattagttatgaattttagaagattcactgtttttattactatacaagaaaaaccttaactcatttattgcgcaatatattccagggctgacgtcatcaaggcggggcgcggcgccgacatgcgggccccaccggtcagcggctcggggagggaggaagggcgccgacaagcgggccccaccggtcagcggctcggggagggcggtccacggcggatcgggtccacggaccggggaggagcggcgcgccacgcggcggccgaaccgatggccccgatctacccttgcggcgggagctcgcggccggtgcgcgcgggcacggcgcaaaccggcccggcgaccatggcgcgcgacggcgcggcgcacatgcggcagcggcgcacatgcggcagcggcgcaagacggcggccgacggcgaccgaccggcggcggagagcggcggctagaggtgaagcggcagctacgcggctaagcggcggcgcgacggctaaacggtgcgggagagagagaaagaggaggagaggcctcaccgacaacggtcgacgacggcgggcgacggaggacgatggcgacggcgggacgagctccggaacctccagcgcacgacggggatggggcttcggcggcgaatctctacggaggaggggtggacgaggtggacctcggccgcgcgaacccaacagcggcgacggcgcggtgcggcggcgagtgtagcggcggctagaggcgaccggagtagcgggagagcagcggcggatgggcgcacggcgcgggagcgatggggagctcgggagagggaggcgaaatggggaaaaagcgagagggagcgacgggggagcttaagtagggagagagagggccggacgtggccgggagaggcgggaatcgccggctgacgtgggggagtgggggaggagattcgaaaatcgaatcccgaccatctcgggcgcgggtgcgagcgggagagagaggggagtgggcgcggggaacgcggcgcacgcgcgggcgtggtcaacgtggcccggagaagacgaaggcgtgaacgcgccggcggtttcgggcgcggcggttgctggctcggcgtcggccggaggtgggggaaggacccgacaggtaggccccacctgtcggcgaccccgggagaggagggcggcggtcggcctggctgggcctcggcctgcagccggccctgcagggaggggggaaggaagggaaaaaatgggccgacggcccatttgaaaaaaaggaggaaaaagagaggaaaaagaaaaagaaaaaggaaaaaggattttccctggaattaaaatattgcttgctcaattttaattggttcaaattatttctagagctctgaaaattccactaaaaatcctgttaatgaatttcgacatgtagaactcaagaaaaattccacatgccaaatccgattattatttgcattactttcttagggttttctcttgatttgcacctgcattttcttggggtcgttttaaatactcaattttaggcaggggagcagatcttgggggtgtgacaggaatggaggagggggaggagagggctgggatgggaggaggaaggggaggagagggagatggatctgaggagaggagaggcggttgttgaggagattgaagccggttttgggggagatgacagggaatagggattatatactacgcgtgattttagtcccggttggtattaccaaccgggagtaaagatataggagatctttagtcccggttattaataccaaccaggactaaagtggtgatctttagtcccggtttgtgacaccaaccgggactaaagatccccgcccctctgacaagggactgacaggggatgaatcgggactaaagatcatctttagtccgactaaagatcgtagaatggctatggggttttaaactgggactaaagatcatatttagtccaggttctttttataaccgggactattatggttttggggcgaccgagcgaagatcagttttccagtagtgtatgttaaacaaagggaaggtgatttcatcccgtatatcctcttgtttcgtgcatatcacgtaaataatcataaaaaagattaaaaaaatagtaagatagattaatataaaatatatcactccacgaacatctaagttaaaaattaacttatacaaatctatcttctattatatattaaaagtccattaaacttccttaaaatactctcacactaccacgtggtaatccttaaaccgctctcaaggtatcacgtggtattagtaaaaatcaatccctcaatttttacgtaagtggttggtccaatatttttagccatccaacttaattaagattaaaacaaacaccgcccgaactgctagctcggggccacacagagcgaagcttccctagagcatcgccatggtcatcctgctcctgctcgtatttcgtatacgcccttgcctccttcgactccacctttcagcatatgtgaagcgctgatgattaattcacttttggcttttgaattttgttattcacacgcctatgcacgcgtacctgtggtctctttatatatacactgattgatttgcttgccggttagtaataaatacactccatctctaacctctgcttccctcctatttctctcttctttttacatatagcagtgtcagataaaattttgggataatgaattttaaacagctaaaacttcaaaattatactccctccatcatataatatagcatattttagctacgtatctggataagtgtgtacaggttcaaagctaaaaattggtattttttgagatggggtagtatgtctcatttttatctattcatcattgtatttacaactaaattgataattttatcaatttaagacccgtattgacttctattttaacttaaaattgatatattattattattagcgacctaggctgtttcaggaggcaaggttcccaaccttgccgctcgacacggaacaaagaacacgattatagtgagattaattaagcattagcctaaaaaacttgaaaaatggattaatatgatttttaaagaaactttcataaaaaaaacttttgcaaaaaatgcactatttagtaatttgaaaagcgtgcgcgcggaaaataagggaagtgagtttggaaaagaggggaaaagagcgcagccgtagagtactcctaagaattttctatataattcaaaattagtagactaagccaccacttaaacattaataaccttgtaaaacataattaacatgctttttagttacatagtatcgtatccatggagcattcctaacctaccatgtgacgctccaataaattatgaaagattcctacgaattctatgaaaaaaaaaacatctagccatcaatttttacttaatgtgataaacccattattttcaaccaagcttaatgaagaaaaacccatgtcctaaaccccaccctggcctatacatggacacagacatgcttactcccatcttctgtcccctctcttattattcactccctctctctaaatcacgttccctatcccattttcttgctataccttagaaagcaaattttgagacaaaagattattaagaacaaaaatatactttttgagaatatttttccttccttggcttcttggatatattcccttaagggtgatctctttcttttgttgtttagattgaacgagagagataaagatgtaattttaaactggattaggttgttgtaatctttttggttctttctattattaataattttttttaacacgggggcctcccctgctgtgatgttttcaaaaaaaaagaacaaaaatatacaactaacttttcaggttgtttgaactgttattttatttataagtgaataaatagttcatgatccatattaccaatgggagaatatatatgactcctaaagaaagttcactagattgaaccaattggagaaaatatctcaaattcattaaaaatgcttcatattttcacttaaattggaacaaacattgcctattctattgccataaccatcttaagtgtttatatactaataatgtaattcaatctatcatgtaccgtataccatagacttaggtgtttattaatatattattgcatatatacaagccgcactaaggcagcaagtagttggtttagaagttatatttgttactataaaatttaaattttagcacttatgttgaatacgtatttaaataaattctatagatcacatatcatatggaaacaagatatgtggatatattttctttattcattcatatatatgtaagaatgtaacaaattgtgtgagcatgaaccaattagaaagaggggcagctttatggtacaaataaaactcattgttagtaataataattttctaggatttgttcaaaaatagagcaagtaaacattcaacttgcaaggaaaacaccttatttttaatttacacttaatttgttagaaatttgttttaaacaaattaagtcaaccttcctgcaagataatgagaaacattataattaatttcttaccggcatgaataaatattgtatagtttaaagctaaagataggttggaaaaattatgcaagcaatgccgatgaagaaaatttgtagagaaatagtacttttaaagcgtggtaggtgtcatcgagttgatatatattctattattataagtttcttaaaaaatacgaatccgcgtgaatgccctcgcgatacatgcccgcacaaatgcacgagctaccttcctagttgtaataaaaataacaaatatatatgcgaatgtacgttaactattttcagtttaatttgtttcttttattgcaacttgtagaagtcgaatttggtcttacatgtttgtggagtgatatatttcatattaatctatgttgttaatttttttttcaaatttttttataactatttagatgacgtgcaaacaaggatggaaatccatacccgaaacagaggccttgtttagttgcggaaaatatttaggtttggttaccacatcggatatacagacacatatttgatatttgaagtattaaacgtagtctaataataaaacaaattataagttctgccaagaaactgcgagacgaatttattaagcctaattaatccatcattagcaaatatgtactgtagtaccatattgtcaaatcatggtgtaattaggcttaaaagattcgtctcgcaatttacacacaatctatgtaatttgttttttttttgtatttaatactccatgcatgtgtccaaaccatttgatgtaacagcgtaaaaatttttgttttggaaactaaacagggccagagtaacagaaaaagcattgtaatgactaatgagagtaacagaagcattgttaacggaagcgacctgctctggaagacgtcataaatccgccccttgatcgccatgagtagcggcttctcagggttggacctgtcgtactgcaacaactcctccggcatgatctcccccacctgcaccggctccggaggcggcaggacctcctcgctgggctcctcctagggcctcgccggcggaggcggtggtggcaacacgaggagactggacctcaccttgtagaccaccacggcgatcaccaccaccggcgacgcactcctcgccgccacccacagcaccaccgttgccacgaccacggctaccgttagattttccaagcaaaaaaaatcccacgcgagacaagaacatatcttacccttcttcgagatcccaccgcttataggccgaccactgcatcacacgacactgccgcgtggcggccgaccagggaggtagacagaggaggcggcgcgccgccgcgccatggccggctacatgacgacgatggctgggcgagtgcaagcagcggagcaagtcgccatttcgaaataacgcttaccaaacagactctcgtttgtttttctacataaattggaaccaaaatcactcacggtttggacaaataaatcttaaaatcactcactgaaaagtcaagtcaaaaattcgtcaatgacttcattcctagtcagtttaatttggtcaatgattaaaccaaattagtgagcaaaagcttaggaaaaaatttaaagtacagatttggttggggtgcaccgagacaaggcagcagtgcaaagcctaggcgacacatgagggccccagtagcgagctaccgtggtgggccctccctcacaaaatactaatttaatatccgtggacacatggcccacgtatcatatattaaactaataagaacagatactacacttgatcttagtcaaaaggccgagaaaggtatgctttacaagacagtatcgggtcgcattatatacagcgcctcagtctcccctctaccgtggctgggcgaggtggtactaaacaattctgcagcgttttagtttttactccgttcggcccgagactagcgctgggaacatcggtgcaggaagcccaagcgacgtgacctatgttgttttcgcaagtatttccagatttcatgttctagaaaaaaaaatgatcttcagattctttggaaaacagaagaattctaaactgatggaagaaaattagtactccacaagaaaatcaacgtgccagttgacgcgccggctagtttatactcgtgcaaactacatataatataaaaagttactttacatgagttctttaatgcccataacctttcaaaggacatagccttttaatttttaaaaggacatgttagtggattttaattgtgtttgtagaaatgaactgaaataggatttgattgtcaataattattttggattcaggatatactatttaattttgacgatattaggaaaaaaatagagaaaatgtatgttttcttaaaattgtagcgacttcataaaacctaaaaaattgtgtataattcattacagattgtagtattaggagaaaataaatattgtaaaaataatatttttcaggattataaagttttatccaacttttatattatttatacaatttacttttcataattattgttttaattttgtataagtatagaatatcgatgtgacccgactcaatttttaagttgaacccatactatgtttatctatccaaagattttgcaaaattatttttacttgtttctttcttctatgtatcctttccacgtatttctgcttgctttgtgcatgagattaacaaatacggcaacgcgtcaacactcatatgtactacctccgtccaaaaatatagctatttctagcacagtactttgttccaaaatgaagctatttttctaactaccttctcctctcaaccaatcacaaccattctttttcacctactttctcttttcaaccaatcacacaccttctttaattattctcacctattttcttaatatccgtgctaacctcaaaaatacttacattttaggacggaagaagtactaatataaaaaagagttcacccctacatgccaaatcaacgggttaaatccctaccgtccattcgcacctcaggtgtaatccgtaccatccacccatctccgacgcatgatttcaccctctccacgcgcggtctccgcgcaaagaatacgcctcatcaccctcttaacacgcgactcgctcctcctcgcgtcgtcgtcccattccgccgccgccgccgtgcactccaccgcctccgctgcgcactgaaccgaggcgaggtcttcccaaccaccgccggagccgtggtcttccccatccgccgcggccggccgcagcaggagccgacgtcgtccccatccgccgccgccgccgccgcaatgcaccgctaccctcgaggtcgtcgctttcttccgccgccacgcactgaaccggaggcgaggtcttccccagccccccatggagccgaggtcttccccatccgccgccgccgccgccgcgcactccaccacgatttctccgcccatccgctgctccatcgcgatttctccgccgctgcaacctctgccccgccgatcgcaccctatcgcgtcgccggttcctcgcgcctgttgccgagtccgagtcaatccgatggttcatccgtcgaggttgcccctgccagggaggccaagccgatccagcatctgatccacctactggcccctccccgttctctgctcctgacaccgtctgacatcaaccacaggccaccagcaactgcacctgcaccctgttgctcgcatgattgtgatgacacataatctcgatctgcaactcattgtctccattttctcaagccggaacatttgggatattatggcaggagcagcgtggagtcaaagccctactccgtagagggctcgaggctgagcggatccggccgcttccgccacccggaccactcaaccggcttgcctgcaccctgatgctctctcagcaatcgcccggccactcgcttcctctctttgaacatagctggggtgtgcgacatggctatggtggaggatctgcccccacccaggtgaaccctcacttcagactgtagattgcaacagctgtatgtaaattacaataacgatttctctattaactattatgatgaacctgcagtttaatctgaaaatttaggcaaaatgtaaccgttgcagtgctttgttttctttctcaaacacaccattccagtcttttggaatgaccctaaagctgaccaatcacttgtgaaagaatcctctactttgcagaagcagaagcgttacttggcatatatactttgtagaagcagaaacacaacttggcggtggctggtttatttagcaatctctacttggctttgatggccagtgtggtaattaatttcagaaatctccgattcttgttgacaaaatttcttttgtaggttgaacatggtgatttcatacatttatcaatgatggattatctgcttgcctattctttctgttacatcagttgtgggatgtttttctgttaaattaatctaggttgctctcttgatctggtctagacagaagcaaaggttgcaataaggaaaacaaaaggaaaaggtgagagaggggcttagtatacctcttgactgtagctgtgtcaattttagttcaaatgtttattggttttgtcatttatactgcactgttgttcatgaagaacaagaagaatttgtatttggtctacttaattgatctaaattatgtagaacttcatgatttccttcagtgcaaaatatttattaaaaactgccaaatgtagttttttttcattttttttgtatccctataaaaaactgctagaacctttttttaccacgtgcaaactaacatttgcaatttttttaacaaagaagcagtcttacatcatgtgtgaggccaggtatcaacattttcttcagtgcaacagtcttttctattctaatctgctactagaagatcatgtgcctcacattttacaggatcattgatgatatgagtgcttaaggatgctattttaaattattggttttctcagcaagcaaaagtttccatggttttatctgatttatttttattacctcacacttaggatatatagcatattgcattatgttatctgatttggatattcttgaactgtagccctttaaaattaacacttatattttagttacagaattaagttttatgacttggttttagttttacatatctttcttcaaagttcaaaaataaaaattgtaaaatcgtatctgcctgccaccttatatcttgcataagttgaggctttttaccatccttaggaaaaaaatgttcttcaggtattggaagtataacatttgtatttgattttacaatgagggcatgaaactcgctttctgctagactcaaactgaaccattttggttgataccctaacattttgctctaccatataacttatttcactattgcaactttatttagactgaaagaaatttctggagtttggaaaaatcggttatgctcattcaaaaatgtatgtctaacaacacatgtgatactcttttccaaaaattgtacaaatacttattcagtttgagagtatttcaatgttcctggtttagttttcatttttttctccaagtagtgatattctttggttaattttgtttttttttaatgcagctcaaaatatccatgtcaacttgaagttattgtggattgcagattgtgagggttacatttgaagttattgtggatgacacgaatcaattgtgtagatacttgtgttcttttctcttacttaggggagttctcttgaatgcacctgaagacaactcttttgctttgagcctttcaagtgtttgttaagttgtgaaaaagtgtgtccattttgtaatgttgtctactttgcacctccacaacaagtgtccaagagggggttaccaaagtaggctagatcatgttagaacatattgttcttaaacttgtgtatttgtatgtttcatgcgacatttattgtggaaaacacaataaactttcagggtattcatatgtttcttgcgatttaccatatatggaaaacgtattacacgtgtacgattactaggcaacgcaaacaccagagcgatctgcatgatgggcgaacgatcaggcccacaccagtggctttgtacggcccagcttggtgccaccgtaccaaaccagcacaacgcccaggaccgcttattttctcttttcctttcgatttttaagcgcgatgtccagattgatcaaatcgctgagcagggtgtcaagctatatatggccaactaaaccataatttgctaatcccttcgtcccataatacagtagcatagaatcatatgacatatctagattcgttatagcatatcattggactttatattgctatattatagaaggaagagagcactagtatatatatatatatatttgacaacatatacgaagacatgataataatacggcgacatgcatcgctgttcttggtcaacgtatacggctcagtatttttcgccatctcacatatcggtatagcttactcgattttattgccacattttttatatagctaaatcgtgtgttgtatatacaagttttctatatcaaagttcttcaaaaatcaaataaatattgttttcaagtttttaataattaatacctcctccgtctcattttaagtgcaaccgtaagtttccgtgcccaactttgaccatctgtcttatttgaaaatttttataattagtatttttattgtcatgagatgataaaacatgaatagtactttatacgtgacttatgttttttatttttttttaaaaacaaattcagataagatggacggtcaaagctgtacagggaaatcatggctgcacctaaaatgagacggatggagtacttgattagggcaagttttacaatagatgtggtagtcacctccaattttatccacatcatccatctaaaaaattaaaattaacttatataaatgcattgcattttatacactagtcccaccaatcagccatctcattttctcatgtttctttaagttttgccccttacatgagaggtggctcatcccctctctcttctcttctcttctctacatcatcatttaaacatacatgtcactttagagtttgtgcttagaacttgccttaataggttatctcgcttggcatgccaccaaaatttctgccaaaccacccatcagaacaagcccttaggctaagttctaatcacattaatggattatctgttttctcaattttaactaagcacgtttaatttttcaaattactaagcgtccggtgtctgttctctaaaatatttaacggtaaaagtttttttaaaaaaaatcaaataaagtttataaatttacagtagttactctaatacttaattaatcttacactgatcctatcttattataaagttacagcccactaaatcctaaaactcagcatacagaaatgccacacgtcatcatccactaacaattattattttaaacatcgactataaagttataacccactaaatcctaaaattcagcatgcaaagacgcaacgccgtcatctactaacaattattatatcttaaaaatcatataaacatgctatattatctataattatataatttattaaattttagaactttagaatgcaagcatgttaaatcatcatcccaattaattcaaataatattttaatatatctctccatcatttttataatatgctatatacctatacagtttatcctcactttgattaatgttatttctttcttctctcattaaactatatcacatcaattgtttttagcacttagatgattaatctatggtccaaattattttcctcattttcttctcacattaagtcatatcacatcaattgcttttaatccttagatgattaatttatagtccaaattaccccctccttttcttttctcatgaaacctcgtcaccttacttttatatttggatcgttattctatatactatttaaattatcacaaactatatcaacttatacgagcttatatcatctatcttacatattatttctacttactgctatcatactaaacttccgcagtaacacgagggtttcatctaatgatttatattttttatgcatgcaagggaaaagctcaagacaaccactcactccaacgcagtcttagtgatttatattgactccctccaactaatccattttatgattgatgcggtcttcaataccgctttaacctttaatatctataaaattaagttattaaaataaaaagacaataacctttgtgatgaacatgcacgctcaagctgaagccaggacgacgttgtacgaaacaagcggccgttcttttaatttatttattaacatacatacattttatctcgattttcattagcgtgtttttcaaacagttaaatagtatatttcgtgtgaaaacttcttatacagaaaatgttttaaaatatgagataaaattcattttcaagtttgtaataataaaaatttatttaattaaaccctaatgattttctttattactctagtatcatcttaattagaaataaactataaataccaccataaaaagaagctattttttgataaataatctagtagcatcattctgacgtggttagtctatattagaaagagagggtactaacatgttactaataattttctttatttaaaatcacattgcaactcatgagtaatatgctagtttaaataaataaagttatcatgtatttaaatgcaaagggtaccgagctcgaattcgccctat

SEQ ID NO: 43501 - DNA, 78185 bp, Oryza sativa
  unsure (1)..(78185): unsure at all n locations
aggattgattggatgggggggtgatctaagttgaaacaaaagataaagctagttggtgttaagtgaaaagatgtgctgaagggttgtccaatataaaaatctgataagaacatctatcccaaactgcgatttactcttaactttttaatgaaaagagtggattgtagtatacaccaccgacattttgcacaacataacagcaaggtatacagaagagactaccaaacattatccattcttattattgcacatgattttcactgtattgacaaagtttatacgaagaaacacagtatcaatgattaaaaatttcaagatacagcacagaacattggtaactggggcttgaatcattccgaaccacctagtagtattgctcgagtaccccagtgcaggaattactcaaatgtcaaggaccaaattggattcatgctctattttttcttcctgcccttagctcttatactacctaactaagctctttattcaagaaacaagccgcaatgaagcaggaaaacccatctatctaccataccacacctatgatgatattgtagggctgtcaactgcaagccccattgtattgagtccattgtcaacgtaaacagtcgagccagtgatagcggaagccaatggagacaccaggaatgctgctgtgttccccacttcgtctgttcgacatacaaaatgctttcgttagagtatatctggatgaaaagttgttcttttaaataaaacaagaagcatatgtaacagagaaataaggcggttttggacctgccaacagttctttctgcaacggtgcattaacataagagtattctatcatcttctcaatgaatccaattgccttggcagctcggcttcccaaaggacctatgagtaaatttaataaatcagaatgaactcacaattattcctacatcgttaaagtaagagatcctaaataattatgcaaatcatatccaagggaaatagcacatcatatgcatgtgctgacaaaccgaaattcacatgtaaaattagaaagaaatgttgcatcatttgtcattaatttccaaatggtatcgcataggcaatcacctagttccaagatttacaatgctagctttattccaagagaatattcctacagaagaaaatacctgcagatatggtgttaactctgattttccctttccttccagcttcaaaagcaagtacctacaaagatttgcagaaaaagattaaaaaagtacattcatggtacatactccctccgtcccaaaataagtgcagccttgtagttcaaatttgaactagagggttgcacttattttgggatggagggagtgttgaaaataacatatatattctagaagaccatacttttgtgtcactctcaagagctgctttagctgaactcatgccaccaccatatctaaaaatatatataatcagaattaccaccggtaagtaatgatacaaaatgctttgtattttaaatctcaaataatgtagttacccaggaattgccctttcagatgcaatgtatgttagagagatggaagcaccacctggaaatattaaacatatatgaggcagtgccaatgaaaatagtataggttagtataggttgagcgtcataacaagttatttcttaatgcaattggataaatttcagcattgctgttcagtcagaaaagcttgatccagatcagagcaggagacaagttacacataagtaaacagcagcattactatgattcactggacaaataaaactgcaaagatatgaaaggcagtaacggcttgatttatctaggagtgtataagatagcggttcaagtgcaggcgtggagagttagaactgcggagtaagcactacctggattcattataggaaggaagtgctgaagcaaagagacgaaggagtaactcgatgctgacagtgcagcaagataccctcttcttgatgtctccaatagtggttttgttaccttcaaacagaggtaggtgatcattagttgaaagcgtaacacgtatggacaataatttcatcactagcagtaagcacagaggaatataggcagaggcactatacctctggaccattagctagagaatgcaccaaaatgtcaatgctgccaaagtcattcttgactgactcagcaacttcctatcaaataaaaataggagtagtttagtcaaagctcaaaagcttaaaaaacaatccaattatagaaattgtataacgcgcctaatgttgtttttgcacacccaagtatatcaactgggtagacatatggaatgaaatggattgcatctacacaccttaacagtccaatttgatgacccagcataccttttgtttcctttgacctaaaattaaaaataaaaatgattgtcataaagccgcattgggagctaaacagaagaaaataatagataagaaaattacatcttcaggaacatcttcaggggaatcatagacagcatcaagtggatagactttaacaatttccataagagatccatcaggcagcctgtatcaagagatagttagataagagttaaatgttattttcagagcaaagctagataaaacaagaaaaatagaaatataatacaaactttcgtgattcatcaaactttccacgccttaggcttgtctcaaatatgtttagtgcctgtgcaggtagaactctccattaagtgaatgacaaagaggaaaaaaaaaaatgatccctattgaacactgcaagagttggatccacttacaggcacccatgtaccaacaagaatttcagcaccagcagcagcaagagcctttgcaattgcccagccatagccattgtcatcagcaactccagcaatgaacgcccttttacctgagagatcatacaaacattagaagagtggcagcaattgagaaggatttgtactactaatatgctcgagttctctgtttttttgaaaaaaaaatctctcctttagtttttcaatcaaaccaataacaaaagcaatatgacaacaaatcaaaatacttgtaattactatgcaaaattctgtataattgtgaccatctgttaataattggataatgctatgggccactaaacttcattacagctgacgaaagcatttatatttgacctttttttaatgagcaagcacataaagttgatacttccttaatatgtagagttcatgaatgaggccttcaaaaggcacataagttctaaaaaaaaaattctcaaataattaaaagaaatttagcttgatatttctcatcaaaattttcaagaccctaccttagcatgaatatacagtatgtcaaacccaacttttgcttttctttagaatatttaaagcatctacatcaagtaaaaatggaatttaaaacactttcatttgcacaggatatgctccctggtatactggtaattgctcatatgttagtctacacggtgatgtatgaggctggctcttacagcattatcaaagagtagtaaacgcaatattactactgaatcaccattagatcgtccataaaagataaccaaaacagcagtaacctttttcccgaggaccagaatgtaaaatactagattccataaagcacgcagtttttacaattagatggtttgaactaaataagcacacaccattcaaacattcaccacagctgacggggttaataatatttggcttcaaccatatagttaaccaaaaaccaacgtatgccatgagcatctatgcttgttagatgcaaaagaaaaattgagaaaatagaagctaagcaatcaaaatgttgcacggaaacatgaatgcgtaaaggaaaagaacatgatcacatagcattgctaggtgcatgattactacagatatgcagctaaagagttacctctaagatcaattggtaggccttgggggccactttcgcttgacattgctctgatggcgacaccgctgcgcttggaagaaccaagagggctggagtagcagattctgggacaggttgcaaagccagtggtggtgctgagtgcgcggccaatccgggagaccgccgccctggaagtaagcattccctgggaggctgagatgcaggggcgtgcagccaccatctgcataccggtagctgcagaagcgcccatcgtcctgctgcatcaaaagatcatcacagcacacattacacgaatgatctgtccttctactaactcagcctcaactgttcaacccgtattcaggcaaacagaacaaatcgaaacaaagatacaagatttgtatcacctccattctccaaagctcactcgagaaactagtatttcagaactatggaatctatcaaaaaagaaaaaaaaaaacaagcctaaagaacctatcctgcacaaacaaatcaagagagaaatctaacatgcaaaaccggcgacgcagcgctcaaatcattccccacccaggccaggagcacgatttggacagaacaaacatttcgctgataaaccctggggcaagaaaaaaaaaacccgcatcccccacttgacctgtccaagaaacaaaacaagacaacacaaacaaaacatctccaactctcctcctttctcccgcaaagcacagatcagtgaaacaccgcgccacgcacagcgagcgaggaggtgggcggcacggatcggggacgagggaggaggaagcgggtggctcacctcgggagaaggtggaatgcacgagggatctgggagctcggcgcggctgctggtcgctgtggaggcggaaaaggcgagggggagtggtagtaatagtgggggttttcgatgagaccaagggagggaggaaaaaagaaggggggttcgtgttggcgactccgcggagttggccgaacgggcggagtcgagtcgctgagaaaccaagggaagcgtggctgcttgtttgttactactaggaagggttttttttgggcctttctgctgcgtcggtgggcttttcattcggccctgagtggtgaacatgatgagctgagaagcccatcgcttgtggcacctactgcttgagaacagtgcattccacataatcaagagagagactagaggataggatacttaagggtgtgtttggttcacggtcatgcatggatgggatatgtccatacatattttgatggatatggctatccaaatttttgtttggtttgtatagatatggcgatccaatttcttgtttggttggagggatatagcacggatgggaaaagccataagttagtgggacccatttgtcatatatatttttttatcaaaaatataatcatccgagatcttgttttaaagatttaattgtaacaaatataatagtgtaatcaaatcataaattagataaacggtttaggagaaaaaatcatttggagcttgcttaacagaaaatcaaaccaaccacacccaatcagaataggccatatcacccagaccaatcagtgctatcactgaatcctccctcttcttttcctatgtatagctgagctttcgcatgcaagcaaatagcaactgtacttattgtttttttttgtctcgctagccacatcaacagaagggaagaggggcacgttgaggagaggaagagaggagatgataggatatggcagcagggagctcactagctggcctagcgacgatggcgtgcgttccctcctttcacctggtacttagtacctgatacctgtgggtaccggctggtacctaggtatcagatcttggtatctggctaccagggctgatacttgtgggtatcagtcgtgattccccgaggtactatgcctgatacttggtatcagctgtgatatcctcgacgtttcacagctgatatctgatactagtctagtaacttacctacctataatgaagaggagcagcacaacgagctagcgaggagtaccacaacctcaagacccgcataaactccgaggttgacctcacgctgagaatgaccaactatgcattaccattgtccgttggtgcccctgacctcatccccctttccctgacctcctccctcttctccctccccagccacggcaaatggcaacctcaccaccgcagttaccttcctccttgccaacttgatcgattccatcaaccatataacctcgttggactccacatgcccaataaatgcggtgtagggaaggcgaagagaatgggacatgccatcagtgttagggatgatggcggtcggtcctctggcgaagggaggttggattgattggagtggaggagttgggggagggagcaaggtggaggatggagagaatgagtttgagagaaaggaggagaaatagttctagggaagaagaaacggaaggatgttggggtgttcattattaagtagtatcctatctcatgggattccgttcactagtttttctgcataatcaaatccttaaggtcttgttcggataatcccttttccctcgatgcactccaattccttccttttgaggattaaacgaaaaaggcttattgcaacagtgcttcgcatacacatatccacaaaacaagcacctatatggtcgtctgaatctgcataggctttgatcatgaacctgtggattagtcgacacaaatcaccagcctttaggacttcatctgcaccaataactccattgcacactgatactatccatcacgtaaaattaaagcatttgaggagaccacgtccgaatcaggccatcaatatgttactcaatattttttttacgtagtggatagaaatatcctgctgtatatggctgtatatccgcaacacagccaaaagttacaagtctcataaccgacaaaacagaaaagaaaaagaaattactataagactaagctttggccttctattgtctggcgagacctaccgcacaaaaaaccttactgggtcaatcttgatatgcaacccgaactcctaaaaccctcatccatatttcaatcacattagatcagctccttccactactcttcccttgtcgtcagtcggacccattcgattcgatcaaacaatttatggcccctagtggcttcgcttgcaatgccaaccagtggaggtcgaaaagaagaaaccccttagcttgctgctagcctgctatataaaaagattcaggaacgagcatcgcagatctagcggcatttagaccctagatccaacgttgtgccccatctttcgtcagctatgccaacctatccaccatctcattatgtcaatgccgctcctcgttgtagacaccttgcattctcactacaacaacctttttgacacccgggagtgatctggccattaggttgggtcaatccaccctggatgtcactggcaccttcaacgatctaccaccaccgactccagcagtcttcatcaccacttggaccatcaccttgttgccaccaccaagatgctcgtagcccctaaggatgttaagcgcaagacatggaagaacaactcatactttgctaaatgatctattttattatgttagagatatttcgcttgctttcctaactctaaagtctctaatgttggtagagttaagtttaatatgctaatagttcaattcatttacaatcaccgagcaatataaatcttattatccctaaattttcatttgagaaaattgcaccgccggtgcatcaacttggtaggtggatgtaatatggtgcaagaacttgagaaatgagtaatctagtgcaacaacttggcaggtaggtgcaatttagtttaagaactttataagtgatcacataaatgcaacaacttgtaaggtaggtacgattttgatataataaattaagaagttatgcggcaactttattatttggtgcatatttatattgttatcataataactagtaactgaaaatcaattaaactgaatgtagaaattattatatttgattgatatttgagaaggtgaagaaaacaaaaaattcttaaaaggtaattggatgtaaattatatgtgcagtataattattaaagattaaattcaatattataaggtaatatccgtaggattactatgtaatggcatattgacatcgtgaaaaaaatcacctagcatatgcttagccaagttgatgcgcaaaaatactaaattgtcaagttcttgtactagaacgcactcacttgtcaagttattgcacttggacatttaattctcaacttgttgcactatatcgcacccacttgccaagttgttgtatcattggtgcaatttactcttttggtttcctaaagcttctaaagtttctaaatttgtccatcatcattattttaattatcctcattatttcatattctaaagcactataatattaagggtaaattggatccatgccttgcaaatgtgcgtattcaaataaatgtcattacaattcatctattcgtagtcgttccactaaaattttacaaaataggaccatgccactgtcgtcacgttttccatccatctccttttttgtttcattttcttccttctttttcccgtcttcttcccttgagcgatattccctgcggcgggtggttgctacaacaatagggcgatgggtatgaccgtgccactgtggtgagcaacacggcatgaccgtgccactgtggtgagcaatgcggcacagagcaagctgtcatgcaacaacagcagtggggttagtggtgtccgcggcgctgctgccgatcccggggatgatgcagctggttgtggtggctgcaccgatgagccgattggtggagtcggcaatgacgtcaatgagtgggtggttcgtggcctcggctatggcggtgggagatgcactactgtcggagttgtgaccacatagagcgaagattgacgcggtggtgcggatggagtgcgagtggatgcgcgccgggctgaagtaggtgcagaagcgacagtgccaggcgctggtgcgtgtggcttcagcagcgcgacgactgcgggagaaggaggtcgagcttgacgccaccctcgaccacctcctcgccccccgccccccgcccaagccgccaagggctttagcaactccgcccccctcgccgccgaggtcaatgatacctagtcctactgcttcgagatgaaggcgtgcaccgtggcggcgcctgtcgatgatgcctccaccttgctgaccacacccaagtagtcgttcaagtcatgaggtgagggtgacgccactgtgctgctactcctcccatgttgccatatcatcattgtcatctttcacttgctgagaacatcacttaagggaagaagacgggagaaagaaggaagaaaacggaaaaaaaagagatagatggaaaacttgatgcatggtggtggcactgtcctaattttatagaactagcatggtggcccgcgcagattgcgcggctagcattattatattttctctcatataatagcatatatgtttctcaatgtattattcatatatattaaaatgacaacataattttaaattttgtactaacattgcgaaactactaatgtgtaatattcatattgtattttatatactctacgtgttagttattaattatttttaatattaaattttagttatttgtaaattatattcctatatggactccagactcgtctttcaatatttctttttttaattctgaattttcgttatctgtaaattgtatttctatatagactctaggctcttcttctaatattatttatttttaattctgaattttttgttatttctaattgtatttttatgtggactctaaactcatctttcaatattctttaatgagtaaattgcacccacggtacaacaacttgacaggtgggtgcgatatagtataagaatttaagaattgaatgtccgagtgcaacaacttgacaagtgggtgcgttctagtacaaaaacttaacaatttagtattttggtgtattaacttggctaagcatatcttaggtgagtttttttactatgtcaacatgccattacatagtaatcatacggatattaccttatattgaatttaataattatgaattatactgcacatagtagtacaatttacatccaattgcctttaagattatttttttttggttttcttcaccttctcaaatatcaatcgaaatatagtaatttctatatccagtttaattgactttcagttattatttattaggataaaaatataaatatgcttatacaaatccgcactagtatattgtcaaaataagttcttaaaaatagacttatataaaaaaaatgttccaagtaattaagttgtcacataaccttttaatttattgtatcaaaatcatacctaccttgcaagatgttgtagttatacgatcacttataaagttcttatattaaattacatctacctgccaatttgttgcactggaacactcattcctcatgttattgcactaaattgcacctacctaccaagttgatgcaccgtggatgcaatttactcttctttaatttttaattttgaattttagttacttctaaattgtattcttatattgacttttgattgttcttcccatgttttttttaaattttgaattttagttatttgtaaattgtacttttatacgaactctaaactctagttttaattttattatgtttattccgaactttcgttagttttaaattctatatggactctatactctatttctaatattccttatttttaattccgaatttctattatttcttaattgtctagtctcctcttccaatattccttatttttttaatttcgaatttcaactatttttaaattgtatttctatatgaactctatttttctttttctccgattaatatgagaatttctagaccgtgagagcgaatgtggaggctcttttttctattcctctaataagttaatagataaatcaatagatatatttatatttttattttgtaattaatgtttgttttcctagacaatttgaaccaacatgaaggttccttctattaccaacctaatatgttaatttgcagcacacaaatttatttgttggacgatcctttgctataagatttctggcattcttgggtgccaatttgttaatgaagtggattccggctgcaaaacttccgtcttgctaatttgttggcaaagctgattgcggctagaagatttatgggtgttttgtgtatttgctttcattgctaggagtatcgatctatttattactacgggataaatcgtgtacaattcgaaagcgtataaataaataccgacatggatgctaattccatgtacgaatctaattatgattggtttgttactgttgtccgtttcctacaccataaccatacacgaatatttattgttatatcacatttccaaaaaacaatcctgtccgtttgttttctcttctaattttcatccgattaagagttgtgattagtttcctaaacctatacaatgcatgagtatgtctctggttgtcacgtttccaaaagaatacatgcccgtttgttttttttctttttttcttcgattaacgtagtaatttctaggccgtgaagcgaacgtgcaagtctatgtttttttacatgtacgtagagagtacaatttgaaatagatacatatgcattactctgcttttgtttctgattggtttcactttgataaccatccttttttcttcgattaacgtggtaatttctaggccgtaagagcgaacgaggtggtaagtctatgttttttttttgacatgtatgtagagagtacaatttggaatagaaacatatgcattactctatttttgtttctgatttgtttcactttgataaccatgtatgactgttattttccaaaagaaaatactatttctaaattgaaaaagaatccagataagcaatctatagtatagggtgtccgattgattttttttttgtttttctttttttttcagcagttaatgcggtaccgtctaggatttgacttttattttttttcttattttccttcaattaatgtgggattttctagaccatgagagagaacgtggagtcttctttttctattactttaataaattaatagatttcaataacacagttacgaatagacgaactgtagtatcatttacctaaatagccatatttgcaatgtcaccaattcaccctcttctttttcatattggaaattaacaattatgcaacggttgacactagctagcgtacacaaatgcaagtgtcaacttgatctgacacaagaaataaatctaacatgcacagacatcggtccccctctctctccctctttctctcacacacacaaaaaaattatttttttaaaaaaaaaagagagaaaagaccgtgcaagggtaattgggccgtggtctaaagttagtggtcggttgagatcgtgttttgaccagaatgaaatcaaaaatccacagcgcgcgcgcgagcgatcgatcgatcaagtagtgggaggttacacttggcacctcgggctactactactcccctcccttactcatgcagatcgctacacactagtgagaacgagtggaatatgctcggcctccaccgcccgcacggcacaaccgccgcgcgaagagctccatgctgctctaaacttagcccccttccgaccgctataagaccagattttcctccacaaaaaccactctcgttgatcactccgcacccccctcaactctctctatcgatcgatcgatcgatctgtgcctccatccccgatgcccccatcaagatctcatcatcaggatcatctccctgccgccgccgccgagtgaaatcaactagtgtatgcctctcactgtggctgagatcaagtgaccgaggaagaagacgaaggagacggcggccggcggtgtaaagctgtatagctagctctctagctctgcgtgtgctcggtccccgcgccgcagtgctgtgcctgtgcctgtgcctgtgcgctatctagctgtggagatggaggcgcggctgcggctgctcgtcgtcgtcgtcgttgttgccgggcactgcgccgccgtcgcgtccgccgccggtaactcgtcggtggtggggtaccacggggacccgacgttcaacgtcaggaactacggcgctaaggggaacggccaaaccgacgacagcaaggtagctgaggaacaatcgatcgatcaagctagctccttggttgaattatcccctagcttcttggctaactgcgaggtgttcgtccgcgacatgcaggcgctgatgacggcgtggaaggcggcgtgcgcggcgaccggggcggtgacgctggtgctcccgccggggacctactacatcgggccggtgcagttccatggcccctgcagcaaggccaccaccatgaccttcctcatgcaggcaagtatactgtataccaaccaaccagcaggcagtttggtcccgtggccatggccggccactacgtgacatggatgcagttgcattttgcatccatccatctcgatcgagcaagtacgtggggctgggctgaccgattgatccatcgatcgaacgatccgtggtggtgtgtggtgggtgggtgcgttttgcaggggacgctcaaggcggcgaccgacctgaagaggttcggcaacgactgggtcgagttcgggtgggtgaaccacctcatcgtctccggccagaacggcgccgccttcgacggccagggcgccgcctcctggcccttcaacaagtgccccatccgcaaggactgcaaagtcctccccaccgtgagcatcttgcttcttcctttcgtcaatccatcatcatcgccattagcagagtgtgcagctaattaagcttacattataatggcgagtatgcagagcgtgctgttcgtgaacaacaaaaacatggtggtgcagaacgtggcgtcggtgaacagcaagttcttccacatggcgctgctgcagtgcagcggggcgaagatcagcggggtgaagatcagcgcgccggagagcagcccgaacacggacggcatccacatcgagcggagcaacggggtgtccatcgcggacaccaccatcgcgacgggcgacgactgcatctccatcgggcaggggaacgacaacatcgacgtggcgcgcgtccactgcgggccggggcacggcatgagcgtgggcagcctcggccggtacgtcggcgagggggacgtcacgcggatccacgtccgcgacatgaccttccacggcaccatgaacggcgtccgcatcaagacgtgggagaactcccccaccaagagcaacgccgcccacatgctgttcgagaacctcgtcatgaacgacgtccagaaccccatcatcatcgaccagaagtactgcccctactacaactgcgagcacaaggtgcatcttcatcttcctaattcattcgccattgccgtcgatcgatcggcctgaccgtcgtcgaactgtgcagttcgtgtccggggtgacgatcaaggacgtgcagttcaagaacatcaaggggacggcgacgacgcaggtggcggtgctgctcaagtgcggggtgccgtgccagggcgtcgtgctgcaggacgtcgacctgcggtacaaggggaacggcgtctcgtcgtccaagtgcgagaacgtcagggccaagtacgccggcttccagaaccccaagccgtgcccgtagccccatgacgacgatctgtgacgagatcgttaattttttgcatgctgtcttggcaagcatgcacctagcaagcaacaaagacactagcttagctagctccgattaatgtgtcgtgcactgagcttaattaatttgtgattcttttcttttccctttatgctacttagacgattttcttttcttttctccttcatgtacgtttcttagacgattttgttgctttgatttttttttcccctctcccttgacgcttaattatagtggattctgtacgtggtataagtgagctgccgattactggcattagtttctgaatcactcaacttgtgaataccccaatgtcatgcttaattaattggaacaaagactaaactgtctcaaaagccgtctggttcgatccatcattccatctcattagagttgctgctgtcggataccccttcgtgtgtcgcgtcgtccccgcgccggtggctcgggacaaaaccttagcccaattcttatccgacagcagtgacgtcttttgccgccgtaaccctcttgagaaggttgtcgaggtgccttcctccccctctttaatgttatcctctaggagaaaacaatatcgtttcgggatgagcgatggtggcgtttttaatgttgtaatctttttggagacgttgttttgaaggttctcggtgtggccgtgtttccttatattgtggtggtggtgtggtgtgacgcaggatttgaaagttccgaaatctcggtaatttcgccccccccaccggcatgctcaaatatcgctcgaaattttcggttttttgcaaattattgtgaatttggtcacattttattcaaattcaatcaaatttcaaaaaatttcagccagaaattttcgaaatttcggtcacccccggcatgatatccaattttgaaattgaaaacctattaattctttatttctttctgaaagtcttaataaacagatgcacaattctattggaaattccccaaaaatactaaactgtctcaaatatgcactaataagaacacgaagaagattatataaaaatggtccaggaaaatccggctcggtttagaaaacagtggcttcatctcccttcatttaaccgtgaactattcatctcaccatcggttacttcggctgcataattttggataaagaaaagatgtacacaatccctttggatcggcagtgaagttaaatcaatatcccaataatctgcaaggattagatacggtcatttgacatcatagggagaacttgctaaatctgatcaaagatgtgtccagagcccaagcaagtagtgtactacatccaaatgcaccgttaaatagctgagctagactttactcacgatgtgctcacgtccggcaaaccatatggtggaaacagttgggtaacctgtcgtgtttggtgtaatatccagttttcattttttttttttggggactggaatacacttccataagtttcaagtgacaatgcaacaaactttcaggtagataaaaaggccatacacaggagaatcacaccatataacatttttccgccccaggaaagaatgcagtctcaaaacatctacaacttatctgcagttatgcagaagtagggattaaaaagccatacacaggagaatcacactatttaacattttcctgccccaggagagaatgtaatatcaaaacatctacaaccatatctgcagttatgcagaagtagggatacaaaggacaggtggcaaggaaatctagttaacaactgacatctacaattaaaaaaaaatcaatcaaatactagaaaaactaaactaaagagcacaagacccacgaatggggaaaactattggttatgtcagtgtggatcattgaaggtgccatctttcttcaaggattgatgttacactcccgcaggaagggctggtcataatcgaggtatgccgaccagtagtttcggaatttgggcagaccaatctccagccaaggcttcatattgccattgtaatgtatgaccgcggcacgttcaatatctctgctgctcacatgcgggttgtaaccaagaccaaggacatgccatgaacgattgaggggaagcgtcttattccagaatgtaatcaaacctggaggcagagtgccaagtttccatagtaatctgtcctgattctgcaagcaaagattgatatatttcagtacatatgtgaaccaaaatgaacatgaaagtacacaactcaacgttagtactaaaagcactcaaagccacctgacacttatgatacacactatattttagttatcatttccataaataatttctacactaattacaaacctttctaaaaaggtaatttcatagattacaagtgattacacaggattgagaaaacgtaggaataggaaaaacacaagattgagaaaatgtaggaataggaaaaacacaggattttcatacgaatgtaagtgtaaaactgaggattgcaaaacacaggaatggtcatttgattgaatcacaagaaaaacgcaggaattagaggagagataaagactcaaaggaaagtttccatgaggtaaaacctcatgttagaattcctccaaaactagcatggtattaggtattccataggaatttcataggattccataggattcattcctttgattcaaagagctatataggaaagattcctataggaacgaaatcctctaaaactcctatgaatttcctttgaatcaaagtgggcctaagccttgatacatggtttaagcggaaaaataggtatgttcattgtacataaaaaccagccatgtagcagttcaaaaaaaatttagtacgctgtcacattctttacgtacagggataaaggcatacagccctcaagctagtattggttcaatactaactactcactacaaacaacacgatttcttgaatgttaagaagtatcttggcttcaatagatagaaatatttctagcaagtacttttatttatgcaaggaagtaaagaatatgtgaatcttacaagcttttgccaggagtgatagatttcagttatgttctgccgcctccattcagccagatcaaagacattcattccaaaagcccatccacatgcatgggggtcaaaattcttcacaatgacaggatttgagaaattaaggtaacgatcaaaacgatggaagctctctccacaagtctctacaacaccaattactttccccttcatatcaattgaccagaggctggttaggtccttctttatcactacatcatcatcaagaaagacaatcttgtggagatttgggtaaatctcaggtagataaaatcgcaaatgattgagaatagaaagatattttgggtttctgtacttcaagtttgaatctgagtttgcacgatgtgtcctgaagtagtaatcaatcattgattgtgattcgagctgtttcagcactgggctgtagctggcatttagccatgtgaactcttcaatattccgtacttcaatcgttgctttcccaggagggttagagaggaaccacattctcattggagcatagtttagtctgtcagttactatgtggaagacatgatgagaaggatgctgcaaataaaataaaatctactcagtatgatgcttgctatcatcttccagcgtaattcaaactaggacagaatattacataccttggcatttaacactgttgaattaacaactacagctgctgccaatatattgtcagagaacaatgcatagtgatatagtttggggtcatcaagtttttccttgtttgggaattgctgatggctaggatccaataaaaaatattcattagctagcctcaaggggaggcagtgaagacccttgggaagggttttggctgcaagttgtgttaggaaaacagtttgcttcttgtgtgcatgcagttgctcctcagctgagtgaagcatagctcgaagctttttgacaacaacagaacaatcatcctgcatcagttttcccttgatcagtgtctgctcaagtgttttcaccttctcattggcactgatcaaatcaagacagatgaaaaggttacagaacaattgatgaggctgctatcctgaacataataactagctacaatgttaaatacatcaatcggacaggataggaaacccttacttcttgggtagatcggagtccttggatgcatcaccaagaaccttttgaacttcccgaatccgctgcctcaagtctttgaggtactggggatttgctcgaatggctccaagaccaaggtagacctttgccttgattaacagatccctgatattgcggattctagtatcaagcaaagcaccatctttgtttccttccagagagttttccatggatgtctgttcaggcacattctccaatgaacttgcctgtaaatagaagaccatgcaataaaaaagaaaccatttagcaagaaatcattatctcaacatatggcaaatgaattttgttaaaaaggaaattcaagaacagaattatgataccattacttgataataaaatggcacaaattctgcatgagtgctacagtttaggtgaccccagcatatggatgcacaaacatgtgaacagatctaccaaatctagaaatttctagtcaactcaacaaaaggaattatgaaaatgtgtgtgcacgtgctcatgtgagtagccttttaaatgtctggtagtttcatttcccaaaacgaaactttgtctaggttgctatgtgccttgtatttgtaaaggttgagggaatataatgtgaaatggacttcacatcaggtgccaagattctacactttagggatgccttgcaaagttggtacaagaatctcaacttaagaaacggtttgggtggacaaacatgaaaggcaagaatattgggagtcaagttaacttacaggaaagttaaggaatggctgaaagaggcaagcatattaacaaaagcgtgcacaaagaacattccataacaaagaaacttaactttagcctgaagcagaagaccgtaactgaaccaaatacacacattctcaaaattgataaacataaatgctttgaatcttgacatactccatgattaatcattagtctagttgtttaacagcataaatcttgttacagtaaactgtgcattaacattgtcagataaactatgatcatcatcttttctgaaggacacccttacagcattttacccacacatttgaaaacaaaacaactgagttactttgtacggagctacattgcataaattaattcatgttcaactaaaaaatatggtttcctctaacgacatgagcagaacaatttaccaacacattctttaatgttgaaaataatgcatcattgcatcttaggtactttgacctactacgacaagaaaagaaagatacgtcaagatatgagtagccactgtcttttcacaagaaaggaacattaccagatattgataagttaggtataataggcacaaaaaagactttccctacctaccacaaattcagagtttggccccaacactaataatgcaatcccaaatagaagctaaagcacatgcggaggtcccaaaggtccagatgactaatccacaggtgacaacataactaaatttggtaagatgcacataaaaacttgacaataataaactatcaacctcagaagcagatcgctgttgggatgccgtggttatctgctgctgatcaactgacaccgtcgccaagccatcatcttctccatccttgcttgtcacttgctcgatcaagtcatcgtcttccgatctggcactatcagcagccgtggcctcagagagcacccggttcttgtgctcccctgccttcctcaatagaaattctaggaacagttggcgtgcaaacgaactcagagcacaaactcaaaatatcatagtttaatttcacagagcgataccatggacctaggaacacaagatgcaaacaggaccaagaaaataaaatcccagaccttggctatcgggttcggtcgatttgcttgcagattcgcgtgactcctccgagaagacgatgccaacgggttctttcaaagaacccacagtttcctgaaccccaaaagaaaaaaacctccagttttattcgtcgccctcgccaagaaaaaataaacaaaaaatgaagaaacgaagagcaataacaaaatttaccagaggaagtgcatttagcttgctagccttaacaccacggccctagcaaaacaaaaaaaaatccataaaaaaatgttctcatcaaaatccaaacaaatctcccgaatccctcgcaagaaccccgagaaacacgcacctgattcacgatttcgccaggcaaatccctcctctctgcaagaaatcacacggtaacaccataaaccccaatgcccaagaaaccgcccgacagaaggcaatctctacaccaaaattacaccgaaaaagaaagaaaagaaaaggaacaagagaaaaagaagatgcgctcacggttggggttcagcgccgccgagagacggcgcgtgtagagcacgagcggcgagagcaccgtgagggcgaggaggagcagcagcacggaccgccgccgccgcctcaccatctcctcctcctcctcaatggggtttcctctcttccttcctctccactgatgaaaatgcgaggagcactcatgtcatggctgaagtttaggggagggagtggtgggcatttacagtttggtccctgtgtttttcgtttaattaggaaagaggtttcggtttggatttgatttggggtttggggaatttggtcggtgagatgagaatatctgtgctggaggttatccatttctttttttatttggtttcatattttttaaaatttgattggtataattgacctttcaccttttttattcctcatggagtgtacatcacgtgagaatcctactggacgtgttgtactaaaattaaacatgccaaagttcaaaaaaaattaaacgtgccagttgccaatttacaattttaggtacagcacgccctatacagctatatgtacctaggacaattctgtgctgttttgtgtgaaaagggacaaaacaaaatgtaacacatggtgtttatcatttgttacacactattagttctcgtatttctcttttgatttaatatatgttggataagaatgaatttattaactcgtcaaatgaactactccctccgtttcaagttataacatgtattgctttaagtttgactaagtgtatagtcaaatatagtaatatttacattaccaaattagttttattaaattaataattaaatatatttttataataaatttagcttaggttgaaaatattttttatatatataaacttggccaaacttaaaacagtttaatttgatcaaagtttaaacatcttataacctgaaatagattgagtatttaacatagttcaccaaccagcagtgaatgcttaccacaaatagcttatccgcgtgactgcatcgttcacattgcctaaactaaccttctcgtgttaatatggtgtttttttattcggtgttaatatggtgttttggtcgcatggtattgtgagtaaaaaaaaaaacaagaagttttggtcatatgttgggtggcgcgatcccaacccgcagatatttccgctagttttttcaaaattctagcccaacatatttgcaaatgaaaagtaaataaaaattttatatatgtgtcttagctaattaaaagactgaaaaataaacttcgatgaaaaaaccacaaaatcagttccaaatttaatgttaaaatttaaatttttgctgatatggataaacataagcgaaaagatgatgcccttcgtatgtaaatgcaaaatcgtgaaaaaatattcttaaattttatttggatatgacacgagtttaaatttaattttttaatgctcttgtcacatatatttggtcagagaaaatattttgtttttctaaacaaagccaaaaagtgtagttttggaatgaccagtagactagcctatcattctaccatgtgttaggaccatgtcattagtacgtgtgacggtgtgaggttacctaaaccacatgtgccgccaatgccctgtgacggaaaaagggacgccaatgctctggaatcagctagtacagtacacaaaagcagacatgcttaattactctccacccaacattaattaacgttaattatattagcactactccatagagaaaaaaaaagtgattcgctgtcagtaaatctggcatggtacaaattcgtagtttaagtggcagttgcagatcatgtaatactggcgtacgtacgtgcattttcagtcttttctaaacctcgccaccgttgccacttgctacccttccagactaattggtcatttatttgctgttgagccacgaattagctggcgtaattaattctggtttctaaagttaactgggacactctgggtctgggtggatgatgcatgtgctggtacacctctgtttcacgatagataagattgttcgctgttgctgacttgctgtttacattttgactactccctcatcctccctcccaaattaaaagcttgttcagattaataccatttcgaactatattacttttaaaaaaattaataaacatgtagatgtattcagttcgttaccaaacattggtaatgtctaaagaattttagcaataacatagttaaccgattctaccaaaatttggcaatgttatcaacttattaaaattttgacattgccaaattttagaaaggtttattttggcagaaacctgaacaggccctaagtttatttttttcatccatccaatacataccaatacaaaaccaaaacactataataccattactttatcaaatctcaatacaattatttttcaatttatcgactcccaatataagaattatctatttttcacaaattctaatacaatgattactctaaaaataaccttattttgggacaaatggaatgagctaaaaatgagtacatgatggagggagtactttttatttagtaattttgcagaagctaaaattatttatttaatattgttgaagtatattttaaacaaacataacagtaggaatgaaaacggatcgaatacggtcggaaactagctctatcatatttgttttcatattttttcttggaatcgaaatcggaatcagaaacccggatacgaaaacataatcaaatattgtcgaatacagatatggagtgaatacgaatcgaaacgaatacggtgacgaataattatcaaaatatcaagacccctcaaagtaagcttcttaaatcgaggaagagatgtagccattagttttaaaaaacaaaacatcaacattttcaaattttatctctatttgcaagggcaagggggagatagaaaatgttgtgtttattttctatacaaatttatgttatcctgaaacaaataaattaattgtatcactgaaattttcgcaggcacattgaaatttttgaaaattggttgaatattttaaattttgggttgaacatttcaattggagttgagaatttcgaaattgaattaaacattctagaatttgagttgaattttttaaagatgggttgagagttttgaattcaaactgaaacttttcaatttttgaattaaaagttttttaaagagtaaattgtatctacggtttatcaacttggcaggtgggtgcaaattggtacaataatttgagaaatgagcgttctagtgcaacaacttggcaggtatgtacaatttagtataaaaacttcataagtgatcgtataaatgcaacaatttgcaaggttgctacgattttgatacaataaattaaaaagttatgcgacaacttaattatttggagtactttttttataaattcaatttttaaatatttattttgaatttatacgatcacttatgaagtttttatataagtatatttatataagtatatttatatttttatcctaataactaataacaaaaagtcaattaaactggatgtagaaattattatattttggttgatatttgataaggtaattggatgtaaattgtactacaatatgcagtataattcttaaagattaaattcaatattataaggtaatatccgtatgattactatgtaatggcatattaacatcgtgaaaaaaaactcgcctaccatatgcttagccaagttgatataccaaaattcaattgcaccgactgtacaacaacttgataggtttgtgcgatataatgcaagaacttgagaattgaatgtctgagtgcaacaacttgacaagtgggtgcgttctagtacaagttgttgcactcagacgttcaattctcaagttcttacattgtatcacacaccacctgtcaagttgttgtacagtcggtgcaatttactctttttaaaattttcagaattgaatttaaagtttttgaaaattcgagtggttatttttcagaattgaatttttccatttgtttgtatgttgattgttattccttggttctttttcatatggtttgttttgttccacctaagtaaagaaaagaaaaacatgtttttgcataagaatccgatggaaatatcggatagtatttgaccattatatgattccgagggatatcacctatatcatattcgttttcatttccgaatttgaaaatttccggatatatccaatagaaactatccgaatccgaaaaaaaggtctggtcggacggagactatccgaatcactttcaaccctacatatcagtaattctttcatttgttgtaatcaaagaagtaaaaagagtaaattgtgtctacattatagaaacatcgtagataggtgcgatctagtacaagaacatgaaaaataaatatattatcacaatatattatatattaaatttaatgaaactaatttggtgttgtagatgttgctaattttttcaataaacttgatcaaacctaaagaactttgactaagaaaaaaaagtcaaacgacctataatatgaaacagttaaatttatcagacgattcaacgagaaaggggaagtaaaaattagggaaacatggcaaagttgtcactcatttaatttgtaaccaaacttttgtcattgacaaattatttggtatgaaatacttataaagcaatccaaacaagcacatttgcttcttttttttttggcaatgggcaaatctttaccattcccaaattggcgacacaaacaattacaaagaatcaaacaacctctagatatcgccctttcatgcctcaagttcatcatacccacaaaaaccgttacaaaggataagccaaacaaatatttggacaaccacagatcacagcatctcacatagtacacacaaaatgcaattttctccctttccagttcccttttttggctatgttcctttccccccaatcttatccatgaaacagccagctaacttcagcagtgggagaccagacagcaaggacaatgaatggctgggcctgtagcaatctcttgtcaccacccaatactatgtcggtttcaagtgtttgggagtagtgtgttcgagtgtgacccaaaaatataaaatttgatgcatcacatctgagttgggattagctttaatctcttgatgtgatcagatgtggcaagtgctcgcagtgccggatttggataatgctagaaagaatgtgttggttagctttgcttagcttgagctggaatgagtgtgaggctggcatgacagtgacactaatggcgtcggcatgcccagtggataaggtaaacgtattgccgaaagtacaggggcaggtagtatctgatggcatagctttgtgggaaaatcttgtggaatgttgcagatctgaattggattagacgtttaataatgacacttggtatggggtaagtaggattcttccttttctaagatgacaatatgagtgattgatcgttctcaactttacgtatacaatttgtgttctacaataatattatacaattgcaattaacctgaaaagctcctaccatcgtaaattagatgcgattttgtaatggaaaactgaagccgagcgctgtcagattttctttttgttattttaccctggaggggtagaactgcgaacatgactcaatcatattgaaaatgttgtaaacaacaaacggcatgaataaacatctgcaaattttttcttaaaaaacatttatttaaatccacctaggtacccgtggctatgttcggcagcatcttacagcggctgtaacacaaccagttaggcagctgccactactagaaaaacagttttgccgacgttgggtatttattttcgtaggcggacatgatcttcggagccaaatagccacctacaaaaatgtaaattagggtgaaacccgctgcccaccagtgaaaatccatttttacaggcggaccacttaaacggtcggctgcaaaaataccttatggtccgcctgcgaaaatacatagggaatataaatagaggctacatacgctagattttttctaagtcctctttccctcacctctcagctctctcccgcacctcacctcacctctcttcctcagctctcagctctttcctctcccctcacctctcctcctctccccgacgctgacggcggcggagggcggcagctaccggtggaggcggcggcggagggcgggggccggcggcgctcccctcccttgctccctcccagatctggcctgaggggggcggggggagggtggtggccacgcgtgcggcggcagcgacggcagcggcgggaggttggcggcggagggcagtggctaccggtggaggcggtggcggctcctggctcctccctaacttccagatctggcccgaggggggtggtggcccgcggcgctcccctccctcgctccctcccagatctggcctgagggggcggggggagggcggtgaccactcgtgcggcggtggcggcggcgggaggttggcggcagcgggaggaagggggccgcgtgtcacgccagaaactcacgaaccataatttctaagctgaatgtgcattaaacccctgtccaggaccagccagggtacacaaacgacaattgttgacatacagctccacgtcttacaaaaatataaaagattacagatgcagcggaaaagataaaagcgagctaagcctgaagacttgactcctgcagcgggcgactccattccacaggcaatacttgacggcagcgacaaaaccaacctcaacgagacagctccaactaggaagatcttcagctctgttatgggggaaaagagagcaagactgagtactacccactatactcagcaagtcataccggaagaggaggtatgatgcaggatatatccaagggaggctaaaggtccttttgcataaagctagcatttaaaagcagtagttgaaagcagtaaaacagttgtagtaattaatcaatattaaccaatcattgtctaacgctacaccacgttgcaacaggcccaaccaaccacctgaactacaccagttcgatagctaactaggggtaagactaatcacggttgtcggtgatatgggaccgggagtatcatgaccagaggcttgaggcagacgcaatcgcccacgtggcctggcaccttcgggaacgtcgggcccgagggtgaggtgtccgccctcctcctgatttcccccgaggttgcgcttgccccggccccgagggccgaggcaccccgaccccttaaggaagtttgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcggctggcggtctgacgcacgccttgccccatcccgtcaagacgaaagcctctaggcactcgtctcaagccggagctagcgtgttatctcttagagatggcacgttagccctggtcagatttataccaggcttcatcctaaccattacaggcaaggtgttacacgaagaagggcaaacatgcacgttgttaagctgacgcgtggtggacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggggcatgtggtatccccttgagatataaaaggaggaccttgcccatttagagaggggacttttttcccttttggaaggcggaggggaaaggaagtgaatcctttgtaacttgtccatacacaaatccacaaaaacacaggagtagggtattacgcttggcagcggcccgaacctgtatacatcgccgtgtctcgtgtgtcttgcgggggggtgatctttccacatacagagagagagagagagcttgagatctcaccctaagcccccggccgaactggcaaaggggggcctgcgcggtctcccggtgaggggccacgagctccgtcatctggcgcgccaggtagggggctcagtgtgtgttttctgagctctcagactcttccgtgtgcgccaagtttttcttgttcagcctaatggccgagcaaggaaaagcgcacgacctctctccgagtgtgagcggcgacgacggggagccgaatccacgccgttgagctcgtactcccccacctcctccacaccaaaatcctaagcagggggaggcactcgagagagtcgaaaaatccgcagcatcgccagtcgcgggtggtgcaggagaacggcgagatggggagcgtcgcctcctcgtctacggtgacggcagcacgcctcagggcgcgcttcaggctgttggcgcgctcctacgtcacccgcctgtcgtccctgacccggagtctccagcccagcgatggctggacgacgtggccaacttggtcatgacggcacagcagcgcctgggtgctggtggacggtccgccaccaccaagacctccggcgccgctaccaccggctccgtgtcgtcaaggcggagggcgcggcgagcggcggctgctgcgcgccattcggccgccactccctcgtcgacacctccaactcgggaggatcagcatggagagccggatgcccgcatcgacatcgagcgccggcgtaataaccggcgtactccccgtgcaacggagggcgcctcttcgtccagagtgtcacctcgacatggacgtgaggatcagccctccgtgcccccggccggtggtgttggctgtagagcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaatttccaaggcacatatccgcgcccaggcgaagaagcggacttgcatgcagtacagcgaggcgatgatgagtcgcttcgctcgtacattcagcggttctgccaagtccgcaatactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaggaggaagcgtggacatggaactcctccggttccggagtgacagcttcggccgcccccggatccgccgctcagacagggcggcgtgacaggaggaggaagaagaggtcggaccgttccggcgacgagggtcatgtcctcgccgtcgagggcgctccgcgggccactcgaaaggggaggcctgcgagcgacaaaaagaaagaggctggtactcccagcagggagcgccccgccggcaggtggtgctccgtccacaatacctccctccacgatctcgcggactgtcgtgcagtcaaaaacctggctgagcgaacgaggaagtgggaggaggacagaaggcaggaacgccgtgagggcaagtccccggcggttccttccggcaaacggcgaagtgaggccaagcagaaggcccccgctgttgacatcgatgatggtgatgatgacctaggtttccaagaacctggggccaccattgccaccgtcgatggaggagcgtgtgctcacgtctctcgccggagcttcaaggctatgaagcgagagcttctggccatggcccctactcatgaggcgatgcgtcgggcgcggtggtcggaggttgctctcactttcgaccagaccgaccacccaccgtgcattgcccggggagggcaggttgcgatggtggtttcccccaccatctgcaacgtgaagttgggacgtgtcctcatagatggaggagcggccctcaacatcctttcccccgcggcttttgatgccatcaaggccccggggatggtgctccgaccgtcccagccgattatcggtgtgacgccggggcacacgtggccattaggtcacatcgacctaccggtcaccttcggtggacccgccaacttccgcacggagcgggtgaacttcgatgtggtggacctcagtctgccctacaacgcggtcctggggaggcccgcgttggtgaagtttatggcggcggtccactacgcctacctccagatgaagatgccgggccctggtggccccatctctgtccgtggcgaccttaaagtcacgctcgcttgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagaccgtcgactccactgcggggtgcgaccttttgtgttttctagacgcatactctggttaccatcagattcgcatggctagggaggatgaggaaaaaactgcgttcattacccccgtaggaacctattgttatacatcaatgcccttcgggttaaagaatgcaggtcctacttttcaacgtactactcgaatttctttgggtagccaaataggacgtaatgttgaggcttatgttgatgatttggttgtaaaaacgcgcaaccaagaaactttactttcagatctagcggaaacttttgagaacctccgctccgcccgcataaagctgaaccccgataagtgtgcgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagctgagcatgcccttactcagttaaaggcatatctcagctctcccccggttctagtcgccccggagccaaatgagcccctgctactttacttagcggcgaccccccaagtagttagtgcagcgttggttgtggagcgcgatgaagacaatcctcatttcgcgcacccccgccctgtgctgacttggcccgggagcgagcagggaggagaagcccccgagtcgaacggtggcctaaggcccctgacgaccggagtcggccctctgcccgcttgtcagacggtgctgggcgcccccgaccctcaggaaggccccgaggccactgcgggaaggccgcacctatcgccctttggccccgaggctaaccctgtgctgactcgacccgggagaaagcagggagaagaggcccccgagccgaacggaggcctgaggcccctgacgaccggagtaggccctttgcccgcttgtccgacgacgccaggagcccccgacccccaggacggccccgaggccactgtgggaagaccgctcctgtcatcctccgaccccgaggacatcggcacagaagacgagtgcgccccgagaggccacttggacgaagaacgccccggggatgcggcccctagcaaagagggtcggccccgccgaaaggtgcagcggcctgtctactttgttagtgaggccctccgggacgccaagacccgataccctcaggcccagaagatgctttacgctattctgatggcctcgaggaaactgcgccattatttccaggcgcatcgggtcactgtggttacgtcttaccccctcgggcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatacccgaggccagcacggacccctctcagctgcctcacaccgcccactgggtgatgcagttcgacggttctctgtctctccagggcgccggtgcaggggtcacgttgacctctccgaacggagacgtcctcagatacttggtccgtctcgactttcgagcgactaacaatatggcagagtatgagggactccttgccggactcagagtggcggccggactggggatccgccgcctcctggtgttaggcgactctcagctggttgttaaccaagtctgtaaggagtaccggtgctctgacccgcagatggacgcctacgtgcgccaagtacggcgtatggagcgccattttgacgggatagagcttcggcatgtgcccagacgggataatatgattgccgatgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggtctcgggacccgaagggagcgctccaagctcccttagattgattgcttggatctctgagatccaagcatacctcacagataagactctacctgaggaccgcgaagggagtgaacgcgtccaacgcatttccaaacgctatgtgctgatagaagggaccctctatcggcgtgcggctaacggaatcctcctgaaatgcattcctcaggaacgaggcgttgagcttcttgccgatatccatgaaggcgaatgcggagcccattccgcctcgcgcaccttggttggcaaggcctttcgtcaagggttctattggccaacagctctcaatgatgcagtcgacatggtccggcgatgcagagcgtgtcagttccacgccaagcaaatccaccagccggcccaggccctgcagatcattccactttcgtggccatttgctgtctgggggctcgatatcctgggaccgtttaagcgggccccgggcgggtttgagtatctgtatgtcgcgatcgacaagttcactaagtggcccgaggcttatccggtcgtcaagatcgataaacactctgctcttaaattcattaagggcatcacggcccgctttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatccttaaaggcctcaaaaccaagaccttcaacattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgttgacgacctcgtcctacgccgcgtccaaacgcgtgctggactgagcaagctctcaccaatgtgggagggcccgtatcgagtgatcggcgtcccccggccgggctccgtacggctggccacgggcgacggcactgaactgccgaacccgtggaacatcgagcaccttcgtcgcttctacccctgaggggaagggggggtcgggtgtcaggtttcgggctcgggctaaccccgcacccccctcgggtgtgcagggttagccgggggctaccacacatgcacagtcttacttttcttatttcagcatttcaataaaagcggtttcaatttcctaaaggttgtgtctgtgccgtttttccttctgaagaatcttaacttgaaataaggtcactcgtgctcaaccttgccctcgggggctcggttcggtcagctaaaatcgccaagcggggcccagaaccgagccgtgccccggggcgtggtgaactccgggggggaatcggcaaaaacccacaatcgggtcacccataaccctcggtcaccatgttcccggcctggccagtctcgacatgtggatctccccaggcactagccccgacccgagccatttgaggatcggacttgagcacgagcccttaaatcaagctaaaatgcaaaagaaccacggcacaaatcatcctcaactcatatgtatagcaaaataaagttaacatagaaatttttcatcatttttgattgcagattaagttgatctatacaaaaagaaaaaattggagattggcgggggcctgggggctcattctgacgcgcccaggtcgccggcctcgttgccaccgtcgcttccactgctggcgttcccctcctcgtcggagtcgggggcgaacgcgagccgaggggccgagccctcgaagccgttgacgatgtggtcggcagcatccccgacccgcgcgcgcgcgtcgtcctcggtcccgggagggaactcctccagcgccatccatggagagaagttggggtcccgggcctggtaactcgccagcacgagttcgaccgctccccgcgcgaggtccctcgaggatgacttgatggtcttctcaagctcctcggggagttgttcgagaacccaggccatcctgttgaggtgcggagcgaggccttccagattggtggggggcaccgtcgtctggcctttccagaggcccgcttgccgaccggcgcgcttcaggcgggagaccgcatcccaaagcatgccgggcccaatctcgcccgccaagcgaagggcctcggcctccccggtggaggagtccagcgctcgctgcatatcggcgacggtgtgttcggcagctgcgaggcgggcggctaagtcgctttcgcccgcggccgccccaccgatatgcgccctcgcgtccagctccttttcccgctcctcgaggtcagcagcccgctgctccagtgcggctctctcggcgcggacgcattcaagattgcggcgcgcctgctcctcctgcgccgcctcgcgaagggacaggctgtccgccagccgtttggtcgtggcctcagcctcctcgagagctcgctcccgctcagcgagtgcgtcctcgcggagacggagcgcgcactcctcctcggcgtaggcggcctcgtgcgccgccagcgtcgcctcccggagagcagcggcggcctcgcggtccgtcaagcctttctccacggcgccggcgtgttcttccagcgccatagcacgggcctcaagggactcctcgcgccgccgggacgccgcctcagcctctgttacccgccgctctcgggcagcggcggagtcaaggactccctgggcggcgtcgagcttttctttcagctccgcctcccggctggcgttttgaaggcggagggcgtcttgcgcctcaatcatcgtggtggtagcgatgagggcggccgctcgctcctcctccacctcacgagcgatctccgtcagcgccgccttccgggcttcaagctccgagacgtgacggcggtgagctttacggcccacctccaccatggcgtccaccgagcgccgcccctcctcaacgcgtgcccatgcggcctcgagctccgctcgttccgcgcgcagggcctccacttgggcgctgaacccatctagcaccgcggtgtttgcggcggccaaggcctgcagaatgggctcggcgctcagcggggcgacggaagatgaggagaagagccgccttggagagaaggcgatgcggctcggccccccggaggacgtgctgggctcggggatgtcccccgaacccgtttgatcctgggcgtcgcccggggaggtgggcccaggcgatgtgcccgcggcctcgtcgcgagcctccccggaggctgtcgcctgagggttgcccgaaggagtgggcccagttgacgcgccagcagcagctgttgcctcagcctggcgagcccgggcggcctcctccttagcggcttcctcagcccgggcggcctcctcccgagcagcttcctccgcttggcgaatccgggcggcctcccgggcggcctcttcagcttcccgaaggcggtctgcggcttcacgccggtcagattctcgcctccgctcctctgcggccgcaggatcttcggcctcggactggccggacttggggtggcgggaggaatgcgacgggacatcgctgaagcagaagaaaaaaccagaaaacgaacaaaatgagtaagaaaaaacttccttttgggagaaagatggttgcaatgagagtgagacgaacctgcgaaggggtcggttgaatgaccaccttggaggggaaatcaggtttccccggcatggttccgtctcccccgtcttgcggagccgtttcttcttgcgctccccctcgggctgcgacgtcggcgcggccccctccgggcgccgactgctggcacgcgccgccccgccccctcggggaggagatgggggaggtgttcctcccagcttcctcttcccctgggcgtcggcagggcggctgctccccgagcccccgacgcagggcccagaagcacgaccccctcctggggcagattgttccccccggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccacggagctaagattcagcaccctttggaccacgatcttgaagtcctcgggagcccaatcccatctggctccctggtgggtccgcatgtagtcttcaggcccagtgtactcccaggcgctccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggcgcccgccagctggagacctgcgccggggcctggcttggaagtcggaggcgcgcttcgttggcgaggggggtgtagaaccagtcgctcttccagtcgtcccacttcttgcggaggacgcaagggatgtagcggttcaacaccggcccccgcggctggaagtagcagccgccaaccaccgacggcggtgacaccgactgcacggtgaagaaccaccggaacagctgaagagaagggcgcaccccaatgaacatctcgcacaggtgcgcgaagatggccaatgtcatcaccgcattgggggtgaggtgcgccatctggagatcgtagaactccaggacatccatgaagaaagaagaaaatggtgggaccagcccagccattgcgaaggggaggaagaagatggaccgccccgggtagtctggtgccgggcgcccctcgcccagcatcactatctcccgaccggtggcggactccggcatgaagcggcgcggcagtccggcgtgcctctcgctcacgatgcgggaaggcggtagtacactgccgtcgagcagagcagagccccgtgccatggcggtggaggaagagatgattgagaacgagcgcgtgtggcgaaagtagggcgtagcagagaaagagttagagctcaggcggcgaaggcaagaggaacaacggcgaaaggaaggaagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttacggcgcatgaagtggatatgcgtttgtggcaatcgaaatggattgtatcgtgcgcgcgttaattacgctcgccgaccgaagcggcgttaccgtatctccgggcgagaccaatctgctcacccagattcgcgcgctgctcaagtggtgtggcagtcttgaatagaccgcccattatggacaaccaaagttaccaataccaatgtgcatggattgagaccgttgggtattgtgcccaactacggagaccggtcccacctgtcaccaggctttaggggtggcgtcacacctgaccgcttcccttgagaagggaaattgctctggcataacgccgggggctactgtcggtgatatgggaccgggagtatcatgaccagaggcttgaggcagacgcaatcgcccacgtggcctggcaccttcgggaacgtcgggcccgagggtgaggtgtccgccctcctcctgatttcccccgaggttgcgcttgccccggccccgagggccgaggcaccccgaccccttaaggaagtttgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcggctggcggtctgacgcacgccttgccccatcccgtcaagacgaaagcctctaggcactcgtctcaagccggagctagcgtgttatctcttagagatggcacgttagccctggtcagatttataccaggcttcatcctaaccattacaggcaaggtgttacacgaagaagggcaaacatgcacgttgttaagctgacgcgtggtggacaagaatgaccggtctggcactggtcgcgtcatcgacagacagctacggtcccgcgtcatctctgtcttcgggggaggtgggggtaggtgtgggatgtcccatcagaagggctcccggatggaaaccgtaccgatctccgcccattaaagagaaaaagaacagtccagtttggaaagagaaaggggcatgtggtatccccttgagatataaaaggaggaccttgcccatttagagaggggacttttttcccttttggaaggcggaggggaaaggaagtgaatcctttgtaacttgtccatacacaaatccacaaaaacacaggagtagggtattacgcttggcagcggcccgaacctgtatacatcgccgtgtctcgtgtgtcttgcgggggggtgatctttccacatacagagagagagagagagcttgagatctcaccctaagcccccggccgaactggcaaaggggggcctgcgcggtctcccggtgaggggccacgagctccgtcaacggtgaatctggtcgaccgcctataaccgcgggcacatctattcgaacagttttactctaatcagaggtatacaactgtacccacaagacacagccccacgacatgtatctgtgcgccgacatgccaccacgacataccggaaagaggtcgtgataggacccttcgcataaccccctctaaccgatcgcaccacacctcaaggttcgcccccgtccccagcaggcaacgggcagcccccctctcgtgccacagtgaatccggaagccgatcaaccgaacaccccggccgacccaactccatcatacccaccctaacctgggtatgtcggctagaggaaagctacactacaagcccagccgttgcccacgctggcttatggtaagtacgataagttcttccagggcatctcgcgaaccggtccttaatcgtcatgggcacgattagcaaaaccatgcacccacagcccaccatgtagtgtattttaattagctaacaccattgcggtggtactattccaaagctataccaataatcaaagtctatgcattaatgtgattccccctttgtgtactagttgaactaagcatggctaagcattccctaaaccaacatctaatcattttaatacccaagttatcaatggcatcaggtaaacaatatatggctgagtagtaggacccatcccatatgatattgtaaaacaatgcaacatttaatagaaatgcgggacatttgtaaggtgggtacaatatgatcaattgtaatgcatgatttaccttgctcttgcactgatgaggtctcagcaacgtcttcgagaaaccgcggatcgacaaaacaaccgaaatctacgcgacaaccaaagcacacaagcaaaacatgctataagactactgaaacaggaaacaacaccatttttaatggattctatgcattttttatgaatttactgagacttgaatggacttaaacggagctcggatgaatcaaaagtagtgaaattattaaagtttctcaaaacaacattgagccacgtcatcaacaaaatatggaccgtccgattcctattcagaaagtttcaggccgttagatcctagatcggcgaaatatcttcttattccttctagaaatttctttcacaacgaggtccttccacgtccctgcggtaaaaaaagaagaagaaagaacgcgactcttctcgtcttcacgccgcctccgctcctgaggcccagccgccgcgcgccgcctcttctcccaagccgccgctacctccccctctagtcctctctgtctccattgccggcgttactcatcccctcatcaccgcggctccatcccacccctgccgccgccgtataccccaccggcaccggcgcatcacatccacctctaatctcccgctaccctgaagaaggggggaaagggttgacagatgaatagcgatggcgaggaggagggtatccgcaggagctgcgtccacacctattcaccaaatcggtatccagggcagaacaaccaaggtcactctcttctctattcctcattctctgtttccttctctatcttcctttcttgactgttgattggatgttagcctttcaaatactactatattgatttgtattatatgtatgcaccttatgaattccaatattaattatctttattaggctttatttcataagcccaaaaatcgtatcaatttaggctccatgattggctataattacaattgagaaaatcaagtttgggacaactgagtagaactgcaagtatcagcaaataaaaatattttgtagaatgtagatctgtttacctatactcaaagtaaatgattctctaaggtatcgcacaacagatgatgaagtgtatctaaatgtttcatgaatcacaaacaaatacaccaaaagaaaaatcccagctttagcttcagagggaccagacaaattagagactcatgtaaatcgattatagttagtattaatttacagatgcatatactgtacagctcaagtcaccaatgcttaattacactaataatctattcatggagagtggattactatcttcatttatgactgacttagaaaaatatttgctcatggaaaggatttcagcagtttacataagggctgcaataatgtatacacttctatcttgctaaattgtgtgcactactattaaaaaggataattattcgggtaccagctttagttggtatagccttcctgattcctattatttaatttttttctagaagttatttatatcgctgctactgaagacatctcgactgaaattatttttccctgcgcctgcaacagtagaaagttcagtagcacatgttgatttagggataaccctaactgtttaaacaaaaaaggttaactcacacaagatgtagttttggccaacatcggcccgtattaggatgcttcattctgatcctattttattttgcatcagcaggcactgcacggctgcagcgttgtaattaaatcatcgacatcagtggtggggccttatgcttgggtacgcagcggaggagggagaaataaattatctgtacagaccatcggtaagtaatatttacacctatccttatttttccaagtgccagtaaaatgtcttagactacttgatcaagcatagaattgagctataagagcaatgagtttcaatgatattttgtgtgtgtgtagaagtgtgaatgatgtgtcgacaggaagaatgggttctcgtttaaaattaaacaaggcatatttacaagaaagaattataatacgttaattgctagctttgtgattatgcaccacccataaatcttgcttagaagtttaattaacggtattatggtaatttccacgaacccgtagattctttactgtcctaataggcctaggtgcatttcttatcaatccaaaggcaataccatgcatactgctattggaatatttggcagagctttagatattggattatcatatgacacctatctatatctgtaatactgtagtactccatactcattaatcattgtacaaattgaggagcatatctttctatcatttttacatgagactatgtccttactggtccttctcatatgagattagctcataagaatttcatactttttgtttttgtgggtgaataccaacgtgcatttggtggaagaacataaatcaactggtcctgctaatctatgatttgctcttaaaaagattatattttttatgtttccaggtgaataccacggtaccaccatgcatttggtggaagaacacaaagctactacatttgtttttgttattttattagatttgggatcaaattttttgtgggcatgtacattataatgtactactacgcatcacaatataaatgcttaggatcaagttgttactcaggggtcttggccacgtagatgattgtgtttgtgtatgggtggatgccattgacacaggttcttaaacatgtatttagagttgcgcaaagcgcaaccatgtggctagttagttatgaatttaagaagattatttgtgtttttactataaaagaaaaaagtcattaattatttattgtgcaatattgcctagggctgacgtcagcggggggggggtggctggtgggtcccactggcagcggctccaaaagaggggaggaggcgcctggcgggtgggtcccaccaggcggtggctcaaaggggaggggagggaggtgccggccgggctcggctcggcctcaaggccgactggccggttatggcgagggcggcggcggcgagcggtcgccggcgatggcaaccggcggcgcgggtggcagcggcgtcggccgaaggcgacggcgcacgggcgaagcagcggcgcggcccggcgctaggggggagagggaggagaaacgagcaggagggagcgcctcaccgtgagttggccggagtggggaaagacgacggcgaacaccggcggcaagcggcggacggcggggtgcgcgggatggacgaggcggccctcggacccacgaggccaacggcggcaacaaagcggcgcggcaatggcactatcgacggctagtggcggttggaggcggcagtaggcggcaactgagtggcggccgaggtagcccttgtgtcggcggagctagagcggcggcaggtggcgtggcgacggcgcgcggccggagtgcagtggcaggcggcggcgcaaggggcgagcggcgcgggcgcggtggagagcacgggagaaggcggcgagtaggggaaacgagagagggagctcggggaaggcgttttatagccgagtgagaagcgggcgaggccgggaggtggccggatttggaggagtggcgccggcgacgtggggtggagagagagagagaggggcggattcaaaatcgaatcccgccctctcgggcgcgcgcgcggaggcggtaaggcgtggggaaggtgggtggcgacgtgggcgcggagcatgggcggagtggggcacgggaagcggggaaagcggcggtgtgggcggcggttgccagcttgggcgcgggcggctggaggtaggggatgaccgacaggtgggccccacctgtcggcaccctagagaaaggggaggggagttgggccggcccagcaaggagggagaggtgcgggagaaaggatgggccgacagcccaagaagagggaaaaaggaggaaaagaaaaagagaaaaagaaaacggatttcctaggattaaatattgcacatgctcatttttaattggttaaaattatttccaaggctttaaaaattccactaaaaattctgttaatatatttgagcatggggaactcaaaaaaaattccaccacgccgaattcgattattaaatgtatttattaattaaggattcaactctaggttaatttgaagcaacttctttaggcgatttattttatgaatttaaagcaagggaggtggaacttcagggcgtgacaccgcggcgacgtcaaaggaggaggaaccgatggcctggtcggcgcgcgcaaggagaggagcaaccggcagccgtcggcgtctcggcgcacgcaaggaggaggaggcggcggctctgggcactaatcctctcctttcgttccccctagacgccggcggcggaagaggagccgacggccgcgggggcacagacagcaccagccgctcccctcccagatctgagaagggagccagccggcagtggcggcaaaggcggcgctcccctcgccctcgggcagcggcgccggacagaggtggagagccgtcggtcagagggggatgctggcgccggcggcgtcacctgcgggtagcgccggattttttttttgttccctaaaattattttcgcaggtgggtcgcggacccgcctgcaaaaatcacctattttcacaggcaattggatagcggcggttgtctcccccgcctgcgataactgtttttgactgcctctaaaaactatttttctagtagtgtgcgctacataaaatactgtgcgaggctgcagcatcgtagccccctgtagtgcagccgaacaggcccagtattactttagtataacacctggagatacaataaatgatgttcacaactatacacatggatgctctttttaatgagagtttagctatatttatggatttgttattggaatcggcctctttatcgtgtgttaaaaaaagagggtgcactagctctcactgttatatgagtgtgcatatgcatagtggtgtacatgattgtacgtatatattctaaataatgaaagaattaacagcaaaaattaaatgatacatgataataccgtggtgtcttaaaaattactcaaggtttgaaatttgccctttcgacagcttatgttcaatcttggtttgaaatttgccctttcgacagcttatgttcaatcttggatatatgtcgaatgggtaaattttaaacctctagcaatttttaagaccctcgccatgacaaacaacaaccaaaaaaaaaaaaactaaggttaagaattttactaacttctagtagctgattacgttagatctagtgcacctcccattggcgtatctttcatctttcttaacaactatagcctataactaatataggcactaattatcattatcggctatttcttttgtgacaaaaaggtttaattttcgaggaattttggtttatggtgaagggtgcctgaatgctggcattgtgcgaacaacacgagcacagcgagacatatccatcgacggtatacgcgtgcgtcgggaggagccctcctcgctggagctcctgcaccagcgtgccactatgcttcggcggaggagggaggaggccgactagttcgctgtcttcatcggatggttgcccatgaagaagaggctggagatccaacgacgggagagaagaaagaagcaagatctaaacatgcactaccacaaactcaactagccctgacagccagaaaccatctggaaaatttcgttacaacttgcttgtcaggaaaattttagtttgcatgactagtctccatgaggacgaatattaatcctcacaggtttgatcgtcacaatgaatttttccgacgttgtcaacgccgttaggttcattagaatctcactaacaataaagtcacgtcataaaaattaaactatatttcactatttatatcgttagtgttaaaatttgagttgccactcaataaatgatacccactaggccaccaatttttctggtacgtacaaaattcatatactaaatacacattctcatcttcagagaaatttgtgatatcgtgacggtgttaaaagcacgttaggaaaataatttttttctgacagttttacacacacttcagaaaaatttgtttgctcttgacaagctaatagatacacgtcagaaaaattttggcactcggggctaatcgtgttactggtaatgatgtacattttgtgatttttcaatgtctccgtctaatgtatttcgatatttcacacgcgatagagaaaatgttttggctagggttagacggtattgcatacatgtttgaaacatttctgagctagtaacgaaacattttcctaaacgtaataaaacagcacttgatttattgttgtgtctaattttttgttgttatcaacaaaacctacaaattatgatgttaaacgatataattgttactacctccgttttttaatatatgacgctgttgactttttctcacatgtttgaccattcgtcttattcaaaaaatttacgtaattataatttattttgttatgagttgttttatcacttatagtattttaagtgtgatttatatcttatacatttgcataaaatttttgaataaaacgaatggtcaaatatgtgagaaaaagtcaacggcgtcatctattaagaaacggaggagtatttttttaaaaaaatcattttacataccaaaatatttgcaaaactataaaacgatgataaactttgaaactagacaatatttaaccctaaactttccgacctacaccttccataaaaatataaacaatttctcagtttcaatattatttctatattcgtaatcagaatttgtttttaaatggagggagtagaaaaaacagtcaattaaacctacaaatttaaccataaactagcagcgtgcccgtgcgttgcaacggggaaaaatcacactgagtgaaatgatggtaaataatcaatgagtgtaaatcaactgtaacaaaatatttaatatagaactaataataattatgtcacatatttataattttcacatgtttatagtattcacattttagtaccccatataacaaaattgattaatggaacggaacattaagaacctacatattgatacacttcatattttcacgcaatactttggaaagattgtctatagtttcatctgcttctcattcctaatgcatcaaatgaaacataatcctttacaaaattctacacaatggttaaagttctttgcgaaattctacacaatggttctcattctatagcaaaacaaataacacaatggttcccatggaagatagggttttgcagaagaagtttggtgctctacacttgcttcaacaccctcatttccttatagtgccagctctgcattgccatcaactaacacatacaacgacttaataagtcagaggcttcatatatttgtattttttttctccatgccaataaacacatcccaaaagttgagtccctggacaataagacaactttgagctcaaggtctaaatgtcaaagtaatgttcatgcaaagcatcttaaaccgttaacctcctcatttcttcaaatttaaaaacacaatactccatacaactaataccattgtcaaataaacaatttgtgctttctattttagtaaacataaaaagtagaaacgttcagtgcattctgagaccaagtaaagaaatatacaacggtggtgatggctctgtatacaagaaagaaagaatatgcatagggaagagggaacgtaggaggaagaagagaaaaggggaacgataattatatgagcttggagattgattagtttattagttgccataacagtacgattacatctcctatatagacttgaccccttaacaaactcaagttaacttaatcttgatttaactcaatatatatctgaacttaacctgatttaacaagacttatatctaaagtaccactaacaagacttctctaaagtaacataacaatcctatttctcgacgatcgttgttgagtctggccctgtgaatcttctgacacaaccaaccgtactgcaactcgccccacaagacacaaatcagctagttgcatatggtattttccagctttttcctgaccttagcttgccagaataaaaggtttacatttttgcacaacagaaaagcaaaaggcacaacaaatgcatgattcagctattgcaaatctaaacaaaagcaacagtggaatctaagtaaggaattctgctatactgagcaatagatgacatataatgtcatgacaacaccttagtattccctccatttcagggttataagatgnnnnnactntngnnanngnncanctggttnnnatttaactaagtttatagacaaatatagtaatatttacattatcaaattagttttattaaattaataattaaatatatttttataataaatttatcttgggttgaaaatattattatttttttctataaacttggttaaacttgaagcagtttgactttgaccaaagtcaaaacatcttataacctgaaacagaaggagtacatagaatcatcaaattacatgttgttcactaaacactaaccactgtccaaattttgagacaataagggcaaacatagggtgcaaaagaataattaatagttgaggaatcatagtaaatgaaaatttcgtgatgtatggaagaacagaaattccatgatgtatgatctcggtttatgcactaagcaatctccggattcacaagtaaacagcagaaaagatcacaaacaatattacaagaccaaaacccaacaatagcagaaaagagcgaacattgaatcctaacagattaggacgcaatgctgaaggcagtactactaaacaataccttagaaaatccagcaacggatggtgcctacaaccacccagcgcagcatgtgcatctgtcttggctggacggatcagatcagcgttagcaaagaaatctttctggcggacaaaactgaaaaaccatgctcggaaggtttaccttagtataagtagaagggtgaaggtcccctgcaaacggtacaaagtgcaaatttgacatcccctgcaactgatttttttttttagaacttccatctacactgcagatggtagtatggtacacaaattcatatattttgcagagcaaattttctatctcaatctattttgaacacatattgggcccttaatattgctctcacctgtacaaagaatcctccttctagcatgcacaggcgccactgcatgccgtcgccagctactgagaatctcgggactcctctcctgttatcacacgcctcagcagcagcacgatggctataagttcaatagtatagcccactgttggctctaatttacctatagctaatctaatagccaattcatataatagttgcttactatactattaatatatggtctcacatgtaatacacacatcgcgtcttggagtccgtgctgcagctggctacaaatctgtagcccgctgctcttctctctcatcttttatttcattaaaatacgtgtatagctggctaatagcccgctattgtacctgctctaatggatctatcagatagatccttgagctccattgtctagcggatgacctaggccatcggtgaattgggatgcccgacgctaatgaccggtcaaacctctggctgcggtgcactccgaatcaagctccacctgcgagtgcatattgtggaagggagagcccgcttgcgcttggcttcatcgacagagttccgcacgcggcaggatccaaggcccccgtgggcgaataggcttgcgacgatggcgaggtacgcggcgagatggatatatatggcgttgatgatgtgggtaggctgatggcattaggataagatgactcccgtggccggtggactgataggcacatgatcagaagggcgcgtcaaattcaggtgaggatttggcgaggcagaagggccgcgtcggtggcggtagcagaatgggagaggcaaggaatcgcaatcgtggcaaggctgaggagattgcagttgggggttggggtagaaggacggcggcgcgatgcgttggcaacatcgggggcgggcgtgatgcgtcggcggcattgggggcgattggggtgggcagagggggctgcgaggatgtcgtcgggggcggccgttggcgtgggcacagggaggaacgatggacagcaacaacgattcaaggggcgcagcgacgaggcacggaccgcgatgacagcggaggggagcgatgcggcgccgagagcgaggggaccgcagcggtaacgggcaagggcaacgggaggcaagatggacgacgcccgatctggaggaatcgatggtgacggcgacagcaaattgaagggggatgcgatgtcgccggaggggcggtatgcggcaatgacacgacgattacctggcggcaggtgcgacgggcgctggcagcacttggtctcaccgaggactcctctgtgcggcagcggcggttggacgaaggcagtggggggagcggaagagcgggcgacggaggtaggtgcacgaatagtggggagtgcgatgcgctgtttgtgggtggggtcacaggcggatcgagggggagaagcgcgatcgtggtatgggactggggatcgatcttagcagttggatttggcgatctgacagctcatgtttcgcgtgtctgtcagggttggagtcaccaccaccactacagaatttttaagtagtaaagataaagatttatcacataactatatattgaacgccaagtatcacaaatctcaacaataatctaaaggtccacaaagtgaaaatcttttggagaaaaaaccgtcgacaactttacagcaattccgaaaaaatatccaaccttattaacaaccaagagatctagcctctcactctataatggactataatattatccctctcaatcaaaaaataaataataaaagaacacctaaaccctgatctgcgcccgtcttggatcgatagcgcgcgcacgaatctcggcgcctcagtccaaggcgttgaccacgacggggctcctgacatggtgggtcccatccgaccagacgagcctcccgaagacgtagcccttgccgagcttgtccttctccgacttgaacgtcaccttgaactccttcacctcgccgtccttgccgaactccagcgccgccggctccaccgtcatgttgaccccgtacggggcgcgccacgtcgcgcggtacgtcgccggccggccgacgcacttgagccgccgcgccaccgtcgacgtgtgccgcagcgccggcaccacgatggacgggtagttgaggtcctccatcggcgggaccttctccgggcaggtgaagttgccggcactcagcttggcgaggtcgctggagttgaaccccatggagcagaggaagacgaagtagtcctccttggagaggtcgtagacgaggcccgggtcgacggcgcggttcgggtggatgttgccggcgccgaacgcgaacgccgtcgcctccctcccgtcgtggtcgcgcatcggcgcgccggtgttgtcctgggtgcgcgccgtggtcatgatcgcggagcgcatcgcggcggggctccactccgggcgcgccgccttgaggagcccgatcacgccggagatgtgcgggcacgccatggacgtgccggacaggatggcgtactccgaccgccgctcgtcgttggggacctccgtcgggctgacgtactcggtgaacgccgccaggatgtccacgcccggcgccgcgatgtccggcttcagcacgcacggcagcgtcccgcttggcccccgcgacgagaaggccgccaccgacggcgagttcttcacgccgacctccgtcttggacggcgagatgttcgccacggggttcttggaggagtccatgtacttgtacagcgacatggcctcgctgtaggtgatcatggtggctgggagcacgtgcgggtcggcgacgatgtcgtcgccgtccatctcgccgttcgcgaggatcatcccggtgccgccggcgttgaggacggtcatgcccttcgtcacccttgggatgtcgccgccacgcacgcacaccacgatcttgttcttcaccttctccgggtcaagcgtgcctggtgggcaagtcgacctgaaaaaccatacagatttttttgccatgattttgacacgaatcagttcaattcgatctcatatcatctcacacaaattagaaagaaaatttcacgtgttcaaaggatggtacgtacgcgacggcggggtcagagctcgcgagcgcggcgtcgctggctttgatcatcgagtagagctgggtagagtgcaaggtcgtcgtctccaagctcatcccctgcgacgcacgcagcattgggagagacaagcttgcaccgtgagccatgtcgtcccaagtgttcgtccatggatatagctatagttaacaatggcgtgggacgaggtgatcattaccgtcatgtgcgcgttgttgccgagcgtgacgacgttggggaagtcccggtcgacggtgctggcggcgacggtggtgacccacggcgcggcgttgacgacggtgtcctcgaggggcccggagttgccggcggagcagacgacggagacgccattcatggcggcgtggagggagccgagcgtgacgggctcctggaggaaggaggcgacggtggcgaccggcgcgtcctggccgaaggagacggagatgacgtcggcgccgtcgtggatggcggcctcgaaccccgccagcacgtcggcggcggcgcactcgccggaccagcacaccttgtaggccgcgacgcgcgcccgcggcgcgccgcccttggccgtgccgttggcgtagccgaagaggctggccctgggcacgaagcggccgccggcggtggacagcgtgtgcgtgccgtgcccctccgtgtcgcgcgaccagttgccgtccaccgcgcccgggttgctcaacagcatgtccttgttgaagtacctggcgccgatcagcttcctgcaaaatctcacatgaacgaatccaccggcggatgcaggaattttatagtgtcatgataaatttaaattcgacaagtgtttattgtaaaaacactatcccctgatcggtatgactaactgcttatagtcaaaaatgctctctttaatataatctatcgggttttaatatttcacttacgatacattttttagctcgatttttcatccatagaatctttgatcaagattcgggttcctgtagactaaacttgtagttacactcagttatagagcacctacacttgattatagaacaataatactcggttacaatgcaaaagaaaaagattttacaactgtttttcccctagatttaagatattttgacatgcttcttcctctctctctcttttttattttcattttaaacaggttgtatttattggttgaaaattctgtaagatttgaaactccaaatctgtctttattgtatatgatgaactattaatgaggtgggtaaagaaaaaaaaattctgcaattcaaagacggccgagaaatggagccactcacttgttgcaggagacaccgtacttggcggtgtcagagcaggagcccttccagcgcttgggcacctcgccgaccacttcctcgtcggtgaagctgttggactccggccacacaccttgattcgatcaccattaacggcagagattaattagtaatcaaccatgggagctcgaggaacccaaaaacgcatcaaaattaagatggcaataagcctgtgtatttgctctctttgagagaattttgtaataggtgactgtagtttatttgaagcaaaggtcgaaagttttattctattatttaaaaaataaataaataaataaagatagcgatgcgtaccgctgtcgaggttggcgatgatgacgtcctggccgaacctgccgtgcttccagatggagtccgggaggatctggccgtccctctccatgtccatgaagtcccatgacctcgtcgtgtgcagcttcagcatcgtgctcgccatcaccgtcaccacgtcagggtgccctgcaactccaaacattttcgttgatgtgccatcgaatttgtcctatgtattctactcatcggttcttgatcaatttagatgttctcttcttactcgcgatctgggttgctacctcctcctccagatgcgccgcgaagccgttgatgttcttggtgtaggagtagagtatcgcgtccttggccaattgcttactgcgtgcgtccgtgcattagtccaacattttatttttgcttactgcgtgcgtccgtgcattagtccaacattttatttttgtttccatcaatcaagaacagaaagaagaatcatagaaacacagtctgtaatagcgattatcaccaatctaggtgagtgagtttattacctgccaagaactgatcctagaaggtcgtggtgagactgcgtcgcacgggcgtgctcctccgccgacgcatctgggccgtacgggtgtgatcccagatacacgatgtagggctgcgcccaaacattgtggccataataacaacaacaacaacaacaacaacaaaaaaaaagaaaaaaaaaagaaaaaaaagcatcagaaaggatcacacccagtttgtttcactgaatcgaaatgacacaagaaattcatcagaaattatagagtagatgaatgaattctgtgtggttttgtgcttgccttcttgaatgcttgggcggaggaggcgaggcacaggagggcggcggcgaggaacagcctactgctcgccatggatgatgaggatgatcactcgtcgtcgtcttgatcgatctccagtgagtgtgactgagtggtataaataagcttggtgatccaggattttttttttttgttcgtttcgttttgcttgcagggacggtttctcaagtcctaaatttggctaaccttgaccgcgaaaaatagtccagatcaccggaggaacgcttcaacaccgggcccggctgagcatctggccgggcagagtactttcctcgattttttttcctgttggtttttcacattttttacttcctctgtttttttaatataaataaataacatgttgacttttttcctatcacttttgtctaacaatatttattaattactagttaaggcaagtgaaaacaacattggatatatgtccaaattgataaaatctaaccggcgcgcacgcacgaattaatcttacggcgagacgcatacaatagcctccgacaatgtgagtaatacatgtatactgtctatttaaatttttttgatggcttatatatttcaaacatatatttttaagatccgttttaaccattgaactccattcaaaataatgataaaataagaaaaaatagagagaattaaaataattagagaggtcattgttcaagaaaaattgtaaacaagaagaatcagtagtaaacctaacaagatgaatcattgttctgcggtgatatcggcattgcagcgacaactcttcggtgagataagctacaacggcttggcgaaagttttggtctgtaatgacgaaaacttggcagcggaggtcctctgatgagataagctttggccgctcggcggaggtgggcgatggggcaacagggtgtcgtttgcattttggggtgttggttgtcgtgtgatgtggtgtcagtgtagcaacgacgacttttggcgagataagctatggcactatggcagctcgacgaagatggttctctacagcgacgacggcatggtagcgatagtagttagcaccgcagatgagtaggttgttcaggcagcatgagacccttgcttggcaactacaaggtgattagactagaatgaagaagcttttatggtggttgcagtgacagcaggggggtgtggaagggcgggctagctccgcatctactttctagtgttttcttttcggttgttctttttcatgtttctcaatcatgggttttagagtgtatgcacttgtgtaaacaacctttggctgtgtatatccactttagatatagaggctggattttatccattatctaaaaaaaaacctaacaatggatcagacacatcctgcaccgcagcagtaaaggttgccacagtaaaggttgccagttagtgttaatatatttcgacgctttgcaattaagagctttgttttttcgcttatgctcatacttatcatccaaaatttaaattttcaaccttaaatctgattttacagttttttcatcaaagtttatttttcagcttttgcttttagatcactaagaagaccttatataaatattttattcacaaattactttttatttgtaaatatatcgtttcacgatggggccataaaaaggaaaaagatgctcaatcttcagaatgcaatgccataatcgagcagtcaattagccaacgtccgctaaaaccagaaggcccaatgactccaacgtcagttttcaacaccaataatctatcctaaagaatcaatatgaaaaaaaaaatccatatccatagatggcacatcccttttgtctaaaagattctgtcctaaaagaacaattgaaaaaaaaaatccaaatcctgtagatggcacatctctttgtctaaaagatggggggcacaagggataatgaaaattttgtagcaacaaagatttactccaaaagataaaaggtcttcaaaggtgaagatatctattcaagaatagaaagcacagttaataagtgcagttcaaagcttttctcagttcaaaatctatcacaggttgacaaatagggatttgtcaaaggatgtaaacaaacaatctagtaataaacagctatatgtataatatgggaatatgttgatattcccactccattgcagcataaaagtaggccactccacggcatcagaattcagagcacgaagttcctattcccattccactgtcgcaggtggcttttgcgtgatgtcctggacaacacggttaacacctcgcacattgttgcagatcttgttgaccacatctaccaggaactcacgctcaaaataatacctgagaaaagagttcacagggcaaagttatcacataagaaaacatgcaagatttcaaaagattcacacacacaacacaaaacaaatgtatttctgtaggttcgaactatcagcagacctaagcaataattgcacaccaagaaataggcatacaggacaagcaccagagacaaatataaaattaatgaacaccctaaatttgtatttgtcaaataatttaaaaatatttcaaagataaccaagacttcttgtttgctatacggctgataaaccaagactctcgttgtttgctctacggctgataaaccgatgaaaaatgaagcagcaaattattaacataaatgatcaagaaggcaataggcaagggtataaaggtgaatgctgaactatcatctcatcattcaaactactggaaggtgggcatgattcaattcacaagtatcctattgtgaactgtgcaatgtatataacatatctgtcgaaccacaagaaactgctgcaaaatggcacaacgaaggctgcgacaatcaacaaattgcaagtgggtgtaagagccagaacgtcagtgttacataccaatctgcagtcatgccatcctcactagtaattgccctcaaagcaactgcattggagtgagttctctggtcaccctgaactcccactgtttgtacaggcaaaaacacagcaaatgcttgccaaattatatcatagagacctgcatctttaatggcttgaacaaatatttcatcaacctgacaaataaatgacaatgcgaattaacatcatataccaaagctgatgtagtgatttttcaacagtttgaaaggcttcaaacctgacgaagaacctccaaagcattgccttctgtaacatcacctaggacacgtacagcaagaccaggcccaggaaatgggtgtcgcttcaagaatgactctgggacatttaaaatactccccaacttccgtaccttttggaatagaaaaatatgtttgaaatttacttatcagaatctttccatcaaaatgtaatttatgtaaattttattgcacaagatcatgcaaaggataaaaatggagagatattatgtaaataaatttcaatgagacctcatccttaaataagagcttgagtggttcaattagctttaacttcatatcttttggaagaccaccaacattgtgatggcttttgatggtatgagaatgtgtccttccgcttccaggaggtgggcatgattcaatcacatcagggtacagtgtcccttgaactaaatatccaggtctttttcctatcttctgttctaatttgtgagcaaaatcatcaaaaactgctatgaattcccttccaattatctttctcttcatttctggatctttgacaccctttagcttgctaagaaattgctcagatgcatcaacacatgtgacgggaaggtgcaagtcactttcaaaggttaacattacccgttccctctcattgtatctgtacaaggggtcttatgtcagttccattgcatactgattctgaaaatgttatcactaaataacataatgaaacaaggactaccttaataggccattgtcaacaaaaacacagtgaagtctatcccctattgccttgtgaaccagagtggcagcaacagttgaatcaactccaccagataaagcacaaatcacatgttcatcaggcccaaccatgctttggattgtcctaatttcttcatccagcacatcttgcatcttccaatcagcttttatcccacaaacatcaaaaaggaagcgccgcagtgtttccattccttggggtgaatgtgtcaccttgtataatgaaaagaatgaatagttcgtcataaccatgcttcggtgtaaacagtttaaattaatacttcgtcataaccatgctttggtgtaaacagtttaacaacatgtttgccatgcatgcatgccaactacaaaagaaccaaattgagtgcataataataaatcccaatcaagtgaacacacaatcaacagtatgctaagccccaaacacaaatttattttactctgtgcagaaaacatcagcaccatatacagcagttgcattataaaacttagcacaagatctagataagcagaaagcatccaggttaattcaggaaatacgaaacaaagcaaaatttaaagttgtagcgcaatcacagtcgttctaaagttgcagtttttcatattgtggaactaacaaccttccttacaccaaaggatacccagctatttcactttttcatattatggccccaaaagatacccagctatttcaccttttcatattgtggaagtttagatataactgactattttccttccccaaaggatacccagctatttcaggaaaagaagacccactatccaaaaggtcaaaacaaaaattgaccttcaaaactaaataataatcaatcgtcaataaccaatcagtttcccacaaaatttacatcttatatgctccacaaaatgcacatttcaacaaagagaactaataattgcaattgaatttgttggttaatctagacaacatcgaccgaaatacaaaatgcacatttcaacaaagataattttccgagaaagagtgataaatgcaattgaatttgctggttaatttagataacatcaatccaaatacaaaatgcacatttcaacaaagagatgatattccaagaacgactaataaatgcaattgaatttgttgattgatttagataacaccaattgaaaaatgtgtgtaagaatcgtaacggtcgctacctcagggtgatactgaagcccatagaagcgcttctcacggttctcgacggcagcgacggcaccctgcacgctgcgcgccaccacctcgaacccctccggcagcctcaccacctcatccccgtggctcatccacaccgtctggcgcttcccgacctccccctccccgtacagcgccgaggagcgggcggttacctccacctccatcttcccgtactcctgcttctcgccggcctcgacggcgccgccgagggactgcacgaggagctgcatcccgtagcagacgccgaggacgtgggcgcccgcgccggcggcgaactcgaggaacccctcggggaacgtgggcgcccccgaggcgtgtacggagtggggccccccggagaggacgacggcgcgggggcggaggcccgcgagcgaggcgagcggcgccgtgccggagacgcagagggagaggacccccagctggcggacgcggcgggtgatgaggtgggtgtactgcgagccgaagtcgaggatgaggaccaggttctcgccgaagccggcggaggccgggagcgaggaagcggaggcggagcccatggcggcggcggcggcggcggcggcgggagggaggggattagggtttttgagggtgtctggggtttaaggtggggagttacccacgggatcctgggtttcacgggtatttatcaagggtgtggctagctgacaggtgggacccaggatggaagcggttgagatatggagcgtctgcgacacgtctctctcttgttggttcgttttctcagaatctgcattccaaattgtttcaaaattccatagtctcattatttggaacaaaggactaaaaatacataaacagaaaaaaaatacgagagcacaaaataaatgactatggaattgaaaacatacaaattttgaaacatgattaattaagtatattagaaaaaaacggtgtgaaggattttgttttccttcagcttttgttggttgtgaaattggaggaatgggaaccattctaaaagattataacatttttgttggtgccaaacaacttgtaggaaaaaattaaagtgactcctttgaaacgtgtgataggaaaaccgtagaaattaaagtaacatgtttctctaatcctacatgaatagaaaacacgggaaagctcaagaaggtccctttaataccatcataggaaataaacaaagcaaattatagttcccgagaggttggatttcttggcttatttccctatgaaattgagccatatgaaggtcttatgaaatttttttaatccttttcctatgaatcaaaagctttccatgggaaaattttctttggaaattgaatcctccaattcaatggggctccaaaattcctaagggatggtttagtgcatataaattttgaagaaaagttagcaagagctctaaccttttgaaaattttcacttctagtccacctctctcatttgatttttgcatttttcatgaaatctaatcaaacaatcactcatagattttttttttcttttgcaatctttttttttgcacttgcattcatgtcatccactgttttacacttacattcctatcaaagtcatcatatattcttaccattcctccattttctccaccctacgtctcgaagagcctactaggaatcctattgggttttgttgaaaatattgtttgttccaatggatttcctagtcatgcatagcaaaaagatcattttgtgcccacctcacacacatgtaccatatcagatttggtttgttaatgctatgtcttttcatgctctctaattttgtattcctaaccttgccctagcactcttgtactttgttttggtgatcatatgaggaaagttgtgccattggttatcatacccttacacaaagtagtactcataacttgttggtgcacaaaatcgtttcgcctgtcaacatggcgaaaagacttattccaacagtcacccaattgtattgacacgcgaacttacttacacataaatatgttgttgtcaaatcatcatgttgtaccactctttcatcctccttgtcttagtgtaagtgagcctcgagtcacattcttcctccttggcatgccgcccatacccctctccctactcccctatgagctcaaagtacctttcttcctccttactaacaagcccctaggcctaatccccgtgacatcgatgaggccttgcacctctttcttcctcagacctggccacaagctgacctcatccctggattgaaagttttttattatttgagataaaagtttgttcatttgggcaaaatgtttgatgtcatgagtgaaactttaggagacttgagttgagagtgaaaagttataagtaaaagttttgaatgggttaaaattggatgaattatgattcaaacgttttgacgataaagtttttgagattgccgttgaaagttttagatcataaagtttttgctattcaaattgaaagtttgaatagaaagtatcaacttgaaagttactgaacataaaggttttatatttcaaattgaaaacttcgattaaaaactttgaagacttcatattgaatatttttaaaattggattggaagattactgcattggtgcttagcagctgcttaagcttataaccatccctgattaattgttcttgcaaccagttgagcactcatgaaaaggtgcttgcattggagaaaaggaagcttataaagatgctttattatttagaaatactctaccctttaagcacctctagttgctgtggaagaggaacttgactgtgaggcctttgatgtaattccttgatctgatttgaggaacgcaaccaacgtttgacctggcattaagctaggagtaataaaagaggcctgatgcaactccgaattgacatgggcacatggctgccatttcttgtacctgtatttttgtgaacgagggaacagcaaaacatggcgtttttatgacattctcatatagcacaatataatggatgtcaggcattgagattgcacaaaaaccctaatgtatatccagtggacaaagctagtcaaacaaaacaatttctcgtgattccaccagtatgaatttcagcggtttcatgaggtatctttaagaccacagcaataccatagcctcatataccccctacaaaagaaatatattcgccccaaatcaaaatggtggtaccaaagaatggcagaatcaggttgcaacaacatctaccatcttcatttcaatctagagaaagcttttggccaccttagcatgaagatcggaagttgcagaattggacagcacaatcccaagaacaagctagtgatcatgtacatctaacagtgtcccccctttcctacatctagaagccaccaattgacgaagctacttcacaaggacatgggaagtgtgcccaagggagctgtttaaagtcgactctcgacaaccaaaatcacaaataaaccccaatctgaaggaacccaattaccaagaacgccaagatccacaatccaaagcgcctccgagaacagtcacctgaagaatagattgtagatgttctactgtcatctataccaacaagaaagcggcagtcaccgatggatgggtcaaggtaagtgatcatgccaagtccatcgaaatcacagctctgggcgtcctgtttccgcagctgatagtagctgttgaaagcatatgagatgttgcccttctccccaatagcattgcatgagccaccatagtagagggtggtgcaatcagccatagtacaagcaagctttaggtgattctcgacattgttaagatctcgaccagggttcgcaacacaccaccgtggaggaagatatggcacatctttggcgtttttcagaactggactgcccaatccaagattcagagggtacttggcttgtccatcaaatgagaaaactccccagtgtcgctcgaaattgccaggtaatgtgctcttctgctcttcatcaagaaggctgaaaagatatacatccatcggaggcaccccaggacgtagaggagttcctttgttgcttaaaacatgactgatcaggccttgggtgaatgcccttgctgcagtcaggtttgcacttggtgccccttcagttggccaacccacctcgccaatcgcaattggtagctgcccatagccaatcttgctcaaagcagaaactaatgtgtcaaaattgccatcgaaagcattgtagtacacattagggccatccacaactgggtgactagatccatcaaagaaggcataatcttgtgggaaatcagactctggtaaaggctgaggaatggatagatattgaccacgaaaggagcaccacttgagctaagaaaagcagcgagctgggtaataatctgaatcagatcaggtctgaacactccctgtgatggaacagatgcactctgatatgcatcagcattgcatgggacaactagtttgatgtaccttgcaagattagctttcaccaatgattgctgaatattggtcattgctgaagaacatatgactggaattgcccctgatagcttgtcaggaatggctcatttcccacagcaatgtacctgtttaaattagggacaagtataagaaaatgaataaagtaaagtcataaacaaatttagcagaggaagaaagtaagcaacataacagatttcagagaaagaaagaaaattctcaagcaagtaaaaacagctcgaatagacatccataggaatataggtacaacaaaaaaaaattaagcacataaattaacttcccagcaaatattctgaaataaaggattctctagcctgtaatttaacccatactcaacattagtatttttttttagaaaagcatgcattttatgttgctttccactcggttcacacttcacagtcctaccaggctgaccaccttaaatgaaaacaaaaattatgttccatgatcacaacaatccattctatgtcattggtttacaatataccaccgacaaagcttaattctacaatataccatcaaacaattcgttttcttccttatataccatcaccgttagtcaaacgccgttaagggaaggaaaatgacaattttacccctaggataaaattgagattttgcacaatgccatatcacatcaaatagtcttacatgataaaaagacatgctgtttctatttttcatcaatgagaaaaaatagtggatcatgaccaataaaatccacatgtagcatgatatcctaggtgtaaaatagatattttctctcccttaacggagtttgactaatggttgactagtggcgatgacatataagaaagaaaacaagttgttggatggtatattattgaactaagttttgtcagtggcatattgtaaaattcatgctttgacgatggcatagaatggattatctcatgatcaaatcatttgatcgttgctgggatgacccatttggttactccgattaaaacttcatgaaatagagaaacagtacatattcaatagttcatctattcaatacctacaaaagaaattgtttcaacaaaaatgtagtcatgtaaatgcagccaactgctgtgtgttctgaaattgagcaaacaaatgcaggcatgtccacagaaaacaacaaaaacataaacagtacccaagtccctctctcatccctagcagccgtgccgctcagctatcctcccagcggtgtttaccccctatgcaacccataacaaacatagtagaagattaatcatgccaaatgatcgggttagaacatataagcttgactcagcaactgtccaattcgagagacaagtgacaacaagtgatgcaacggtaagcccttgccagttaccagatatagagagtaagagagtagtaagaaccactttcctgtttatatgtcagataaatatgtttatttcctttccttgctttaatatttggtatttggaaattatttgcttcctctcaccagctttgcagtgatgtttgcaccaaaagcttttgtacactagcacatctatgtgactgaattagacagagtatgggtgtaaagcttttgctagattgctatcatggctaaggtcggcaggaaaagctatgtcatacaacttattttctctcattttccttcttttgacatggaaagaatgtctgctacccacaatctttctttatccattttcctgttctgaatgccagcacctttttgtgtgggtagcatgttaacactaatacagtatgacttaaaaatacaatatagatgaccacaaacaaataaagtgcagggccattcaagctcaaaggctactttagatacccctatttcctaggatatgaacaaaaaatggataagtgttagcaccaacaaatgttgagttctattccagtgtatactccatcagatagaggaatagtggaatatacaactattgacatccggtggattgcatggaaaagctaaatttgacatcccaaagcagtagaaaattaaacgctaaattggactcatgatgtgcagatatattctggcatctaacacgtgcatcaatgaatgaaatctagcagatggaaaaagacactgtctcttgaaacacattttactatgctttgcaaggataattatcacattttaatccttgaggaatcctgtatattgaaatgttctaaaaagtaacagaaataacttcaaacatagtagcacttgcttaacaaaaataaggctggtggctatacattgctttgggcttttggcatgtcaatactgtattttcaatgatcgttcagaattttgacagagcttttgtttgccaaatgatatctagaaatcaccatacacatggtatattttcaggatgtgtatcatagaaaattaccatctttgcatgccttgtgttctactctgacaagtagaagcttcatagtgactaaaagatacagaacagaaggtaccaagtgttatttatgtttttattaatgccaactctcagagcagaacaaaaacatcttgacgtgcatttaagttttgtaagaaaatcgtgtcttgttttatgtgcctgaaaataaattgaaaacgcaggtaacttcataatctacataatgacaaggacgtgtattgcacaaagcaaaatttcagttcaaccattaaactgaaaccacagacacaaaggcgactacaacagaatcacagggtccattaagtcaagttcatcataaataacagtgcaattgtgtggtccaagtccgacacaaatatgtactggcgcaattgtccataaaaggcaatcgggtctgcattgcacttgcactaactaaattcaacttgaatcagtataaggagcattacactagactgcatcccctgacaatctataaacaaacttccagtcatcaagagaaagatacaccttaaattaatataataaccccagatcaatcaacataagagaagagaacgaacagtgaccttccgaaaaagaaaacaagcagaggcacttaacactgttccgagtcagtagactagcaatatctcattgactaggcaagtaggcattaacacaaacacagtgccagcaagaatccaacaaacacaatacagcaagatgtaggtatgcaagaacgcagagattcttccattgcagcgagagactcaaggaaaaaaggaatccatttttttcccaaattacaggagggagcgcggcggggactcaccgtatgtcggcgccgccggggccgacgtagcgcgacacgttccgcgcgacccaggcgtcggcggcggcgggggaggcggcgatgccctggagcatctcgttggtgatcccgaccatgacctgcaggccgctgcccatgagcgcgcggagggcggcctggtcggcgtcgaagagcttgaccctgccgatgcggttggcgcgcatgagctccaccacgacgggcgccggcatgcggtgcgccgacacggtgccccagttcaccccgaccgccgccgccgccgcccgcggcgcgcatggcaccatcatcaccagcaccgccgccaagaacgccgccacgaagcgcaccatggcgccggcgttggccgccgccattgtggtggggtgaacccgaatggagggatccttaggcgcttcttgcaggggcctcctccatggagggacagtgtaaggaggaggagagagtggaaggagcactagtagtagtgatgctcgctttggtagagaattgcaaagggagaggtgatggctgatgaggaggtggaagccatggagagcaaaaaaggaaaagaaaaaaaaaagaaggtaaaagaaaaggatggggtggtggtgagcttgtcgccgagcgagcgcaagtttgaagtcaaaaaagaggagagagctcctgctctgctggcagctgatgtggtcaaggtggtcgggctgctcgactgctcgcgttctgttctgcgtcgccgattggggacaggagactgggggcttggcgctgcgattccggccgacgccatgtttgatgcggccgccgttggagttgcctagtgggctggactaacagaacaggcccaagtgatttttcggcctcgtctttttttttatacttatacttatcagccacaatttaaatttataatcttaaagtttattgttgattttagggtttttttcatcgaagtttattttttaacatttgtttttagattgctaagaacatgtatataaaaattatattcacaaattatttttcatttgtaaatatgtcgtttcgcttattccccgaataacaatggggccgtttacttccacattgggagtgtttagggggaaaaaagtacatatcaggtccctcatcttgtcatcggattacaaaaccacgagatatatgtcatctatcaactaacaaaactaggttactttgggtctttaggcagttttaaccctggttatttccgacgtggcaactgagtcaacgtgggccccacatgtcagggtggccatgtcatcaccctctctttcccctcttctctcccttcctcctctctctcactcttttctaggtaggccggccagcaggtgaggtggaggtcagcggagtgaggcgggagaggatgagggcgtcggcgccagtgatgggtaacacagtgttgtagaggccacaggcgcggaggaggtggggccaggaaggccggcaacaacctcctcactggccgcgacgtcgccatcaactccttccccaaccctcgccatggcctccacggcggcgaggatctccaccccacgcccatcgattgggaggtggccattctcccccggcgaaggtggacatctactcctgcactgtctcctccctctccttccaagcagaattttaaaggaataagtctattttgccccccttctcaactcatgtccctggtagaagaatcacacatccctcaaccgcaaaacagggtataaccccctaattcccaaaaccgatgaaaatcaactccccgaacggtttcggaggcaattttgtcccacgtggcatctttgacttgtagactagctgagtcagcttgtgggacccacatgtcagtgacaagaataaaatgaaaaattgtgaggcccactatcagtggccaccatcgtcgacgcgttccctatgcaacccttcctcctccgcttctctccctaaatcggaccaactaaaacacactcctctcctcccctgcaatcccctccccccggccgttgccatgcctagggatgacgccaatggtagcagcgccaacctccaccccacgtgccaaaaccctagcagcacccctcagcagcagcacccccctaggcgccatgggaaaccccaacctagggctcacccttgcctcctctgatcacatggctgcaccactgcctcctccttcccgcatctagccaagctgcgccacgtggcgcccgcctactcctcccgctcccgccagcagccaccggcgtcactcactacggcgtcatggaatccgtttggctgcggcgacagcggtatagacgacataggataggatgggatcggggagattgggccgagcggtgttggtgttggcaccaacggcgacttcgtgtttggcggtgccgctcccactatgagtcagcagcctctagtggcgtcattctatggagaactcctcttcatgttcgggagcatgagggacagcttgcctcggttcggggaaggatggcgatgagcgtgagcgtcatccaatttgctgccgtttgtcggtgaaatgggaatcggggtcctcatttatccggaaaaaggatcattatcaaataaatagcatgctcagaatgtatttaaaaataaaaaggtaaccctagggtgacgtagctaggaaccccttccgaaaggccctgggcccacctaagatttcatatatgggattctctctggctgaggagggatcctatgtatatgtctcaaaactctgtgtatagaagtaacttggggcctggcttgggtcacaaaaatgcccctcctctgccttaaggtcagcctcgggcccggctctgtcctgggccccgggctcaccctagcccttgaaggttctacggtcctcggcaagaaaggcatagaaacatgcaagacctatatattaagaggataagctaaggtctgcctcaggtccggtctagtcctaggcctcggactcaccttagtccttgtatagttcgcgttcctctgcttagaggggcgtcaaaatatataagacggataatcttgagatattcttccatcaacgataccttcaagaagctcatccaagaataatcaaccttctttaagcacgggagggcgttacctcataaacttccaggaagttgggcatgctccacatccagcttggaggtagcacgcctcatcataagtgaaatagctttatggggggagtctgagttgaaaggaagtggacaagacgccaacgctgagtcactttggacggtggcgcctgggacacgcgtcgcacatgccccgtgccacttgatttaaccaaacgggcaaagaagcaagcgtggcgctatttcaggcagatcgggcctcgttgggcccaccacgcaccacgtggtgagcacattggcgaatgcccaactatctcagacagagcctgggagcccggggtaatatgaatcgtaagacttgaagggtttcttgaggactgcgttagggaaccagctggcagtgacaagacggctgatgagacaacactaagagtagatttgtaataatttaagcccctccttggactataaaaggaaggggactagatacgaatgaagggttggattctcttaggtgagtactatcgctttgtagcctgaaaaggtctcctttgtacttgaaaggaccttaatgtcgcctagagggggggtgaataggcgttcctaaaaattaacacaacttcgtagcatattagaatgatgagaacttttggttcaaataggaacttccgatatgagattggaagttccggtctcaatcaaaaagttcggcggataaaggaataaaacactatctatgaacttgtagctcaaataaacaaaatgtatatgaatcaaaaggtgacaaataaggtatctaaataagatataaggtcaccaactaaatcaattaagcatgcaagtagatcgggtaaaaacaagctcaagcacaatatgagagaatgcacaaatgggcaaacaaagagaggagacgcgtgatttgtttcctgaagtttggatccacggatcctacgtctccgttgaggagccacaagggccgggcctatttcaaccctttcctcacgaggttgcacaaatgcactcctcggttttacttttgatttcttcccttgcggaggcgaaatcgaagccttcacaaactttccgtggcacaccacagccttgggtgctcaccggcgacgcctagccgtctaggagaccttagtccccaaaagtaataaacacaatcgaagaattgcttgctatgaactcgagtgctcaaagtatggagtgaaactcactagctctcaacttctcaatcactcaatccaactctttccccttctcaaatccctctcacaaagaggcaccacaaaggatggagtgaagctcactagctctcaactcctcactctctcaatccaactctctccccttctcaaatccccctcacaaagaggcaccacaaaggtagggaaatagggatggctatttggctttggatgtgtctaatactccccaagagcagcagccactcaaaggaggggtggaggagtttatatacccgagcccctcaaaaactagccgttggaggccaagactgtaattttcggagtttccgaaaagcattttcggacaagtccgaaaacttatagaagcaaatctcagattcgcagccattttcggaatgtccaaaaattttcggagttgtccaaaaaattatcggagtttccggtaatttttcggactttccgaaaagcacagagtaaaacgactataacttttcgctcgggagtcctttttgatgaacttggactctatggaaagctcactcagaggactacccaactcaaccaaaaacaaggtctaaaaccactcaaaggataggttaaagcttgggtttctctcaaggtagcactatgataggtcactttgagcaccgagacatacacaaacacctcgacgttgcatccctcttaatagtacggcattcctaaactcaaatgtaaataagaagagaactataccattaggaatgcctttttttttatctttctttcattgtcttgagggacgccaatgccgataccgtttcaccatatattcttcaaatgattgatgcggttacttgtagctttaaatggtctcgcacggtccatcatgacaaagccgtcactcgcccttcaccaccggatttggttcttcggcgccaagccccttgcttgcccttcaccgccgcatggtccatcgcgaccgagcatcgcttgcccttcaccgtcttgccataatagccactttgtatcacacatcttcaatatcttcactttgtcattcttggtattgttagatgtaatgatatcacttgagcatcaacacctttgtaatccttgggacctatttctttcattcaactcaataaaattattagtcccaatgatccggttgtcaacctacacatgttgaccaaccgatcgcatgtataaaaggatatgaataaatgatgagtattaatcaacaccacaagtgtcatatactcaaatatatgttcaagtgtaaagatctcaattaaatgaaggtgaataatttgaatcgattacatgcataactaaagtataggatttgctccccctaaatgtatgcatataaaatatttgtgtgaagcaagagtatgcataacaagatattaaacattgagagcttatcctatacaagaatagaaggcatttatcaaatatagacaataaaataaaaacatacattcatcatctccacgtctcaatgtaaatagactaaataagagataatactcaaacaaaacattagtctcacatgcatatgccaatcacgtggaaatattatatacgaacatatcaatatgtacatgaagagaaagagtgatacatatagcttgatctccatgtatttcattcttgtgatttaggtccaccaacactccactttcatatccacatgagactaggcaaagaaatgcttataaaaacattagtctcacataattggatttgttattaatcatcaaaaccaaatcaatggcacttgaactttcagttcttagccgatctagagaagacaacgaacaccaacacaggagtagggtattacacctccgggtagcctgaacctgtataacctcctacctcctcctcctcgcggggtggtcgggccccgcgaatccatcacgatcgcagatacctcgcaccgctcgccgactaaccccctggtcgaatctccactctcggggaggggtctccactccccgctgtctgagggactgcctcttcggtgggcggggaaaatgacccgctccgattgcccccatctcccgttgcattatcctctcttttcttgatttcctcaactgtcactactacctactcccatccccttttatttacgctagatttttgttgttttcgtgcgtgcgaacaagactcaacggctatcggcggggtggggcagcgaccatcgagcttccggaggagggagagaagggcctagagaagaagagaagtgtgtctgacagtgggcccaaccgtttttcctttttatccttgtccctgatatgtaagtcccacaagctgactcagctagagtgctagacaacgtggacaaagatgacacgtgggacaaaaccacttccgaaaccaccagggtagtagatttgcaacaattttgagagttatatatatatatatatatatatatatatggggttttgcggttgagtgttgcaaatcaaaggacatgagttgagggaggcaaacagacttattcacttttaaaagcaaccgggacggcccagtagcctatggacggccgcggcccaagtgacgcctcctaaaccctaatcctatggacggccaagatgtcccgagcccctcaagctcgcgccatccgacgagctggaagcattcacgtcgtcccgactcttcctctataaaatcaccacctcgcctcgcgtcaccacctctcgccgccgccaccgcctccccctccaccccccgcctcgccgtctcccgttcggaacaccaagctccagcgccccccctccggcgaaatggtacgttctcgccgccgctgccgccgcgtcttttgtgtgccagtgctatcgcagctgctccagcggtttcctttctgcgaagaaaccggatcttttggtgatacttttttctgtggtgtccttcgtgtggtttccttggatcttgtgaacgctgtcttggattctcgcagcggctgctagcttatctcgagacctcgcttggaggttgcaactttacatatgaatcatgtatatgcgctgatgcgtctggatcgtaaatctcgcaggccccgaagcgaggcggcagggcgccggtgccggcgaagaagaagacggtacccgcaatcatctatctcttgctccgttgtcgcgcttgaaatctttgttgttgcggggggggggggggcgtggtttgatttgggatgttgatgggtgcaggagaaggtgacgaacccgctgttcgagaagaggccgaagcagttcggaatcggcggcgcgctgccgcccaagaaggaccttcaccggttcgtcaagtggcccaaggtggtgcgcatccagcgccagcgccgcatcctcaagcagcgcctcaaggtgcccccggcgctcaaccagttcactcgcaccctcgacaagaacctcggtatgtaattcgccttgattcgttcatcgtcccatcagtcagatttgtcgggtttggcattgcacctggaacgctacttggttcactgagatggttaggaaaatccacctgtatatatgttcattgcgaaccttgaattgtggtggtttgtatatagtgcccaagtaatgtaatgttcttgattatggcttactactagcttagtagtacatttctggttagcagggtagatttctttcagttgaacgaagcttttcatcactagtgtttgttgtttgctagtgtctaggaaatttgtccgtgaatgaaaaataagaacaggaaatgctgaggtattactactaaagtcttctttagtattagtatagtttggtcatctgtccactgtacgtagcatacgttgacaccattgttagtaggatgtcggttgctaatgtggctggtgtgttcttagtattattgtgttcatagtaccacttcaaaacaaagtaacaggacttacatgcagttcaacttgaattgctctgtacgcggcatttgttatattttacaattcatggtgtcaaaaatatcttatgtgcatagttgtttgcagcaactaatctgtttaagatgctcctcaagtaccgccctgaggacaaggctgctaagaaggagaggcttttgaagagggcccaggctgaggctgaaggtaaaaccgttgaggcaaagaaaccaattgttgtgaagtatggtcttaaccatgtcacatacctcattgagcaggtacagaacctaagtgacctatgcatatctttgttagttaccaatcaaggcgtatctttatgggaacaaacaatcaaacaaaattgttgagataagtgaatggttttcttgcagagcaaggcccaactggtcgtcattgctcatgatgtcgatccgattgagctggttgtgtggcttccagccctgtgcaggaagatggaggtcccttactgcattgtgaaaggaaaagcccgtcttggatcagtatatttcctcctgaaccttgtttgtacttgttgaaggtataggtgctagtataaagagtctcattcttcacaaataatcacttgtagattgttcacaagaaaactgcatctgtcctctgcttgaccactgtcaagaacgaggannnnnnnnnnnnnnnnnnnnnnnnnnnnnnnnnnnnnnnnnnnnnn

SEQ ID NO: 43502 - DNA, 721 bp, Oryza sativa
cgtgcgaacaagactcaacggctatcggcggggtggggcagcgaccatcgagcttccggaggagggagagaagggcctagagaagaagagaagtgtgtctgacagtgggcccaaccgtttttcctttttatccttgtccctgatatgtaagtcccacaagctgactcagctagagtgctagacaacgtggacaaagatgacacgtgggacaaaaccacttccgaaaccaccagggtagtagatttgcaacaattttgagagttatatatatatatatatatatatatatatatatatatattatatatatatatatggggttttgcggttgagtgttgcaaatcaaaggacatgagttgagggaggcaaacagacttattcacttttaaaagcaaccgggacggcccagtagcctatggacggccgcggcccaagtgacgcctcctaaaccctaatcctatggacggccaagatgtcccgagcccctcaagctcgcgccatccgacgagctggaagcattcacgtcgtcccgactcttcctctataaaatcaccacctcgcctcgcgtcaccacctctcgccgccgccaccgcctccccctccaccccccgcctcgccgtctcccgttcggaacaccaagctccagcgccccccctccggcgaaatggtacgttctcgccgccgctgccgccgcgtcttttgtgtgccagtgctatcgcag

SEQ ID NO: 43503 - DNA, 904 bp, Oryza sativa
ctcatcagattcttgggagatgaattatccctaaagtaccacaaactactcaagatcacgaacttagatctaacccttaagtgtaaaaagttgaacaattcttaggggaaatgaatagagcttggtacctctttgctactactatggtctcttacatcatactggtcaccttttgttaccacaagatccccactatcatttgaccgaacatcaagacatgcaatgacctggaaattttaaggcaataagaagggcgagaatggaagttgcattgacgctaaaacatttggcgatacaaagcttactctctttgcaaggttcgatgctttcctacgagatgggacctgtgttataaatgcaagtatgaacttttacatcgaagaagttaatgaaaaggaactagcaacaataagcatacatatagcagctacctttgatcctgaagtgtttggactgagaaaatttttcaaaattgaaagcccagtagctgcagtaaaacaataatgggtatgcttagaaaaatctgaagtatctatatattctgcattattaagtattaacagaccttggtgatcaagaccagtcaagttatcagaactcaagaatctacatgtttcaatcctgtcttaaaatacattgtacatacttggctatggcatatcataacacattcaatatcaaactgcattttacctccgctcttttctgggtgaaactgaactgcctgaatgttgcccattgagatggatgatatgaaactctcgccatagttgcacacagaagaaatccactctttgttttcatctgactaagcatgtgaaaagaaagaaataactcacattccataagtccactaacgaaagagcatctaaaaaagagctgttccttacaggcagagcatgat

SEQ ID NO: 43504 - DNA, 1595 bp, Oryza sativa
acccctctcctctctccttttccccttcctcttcctctttctgcgtcctcctcgctcccctcgctctcctttctctcggcccaagcgccgccgcccacctgctgcgtcgcaccggtttatgcctgaccgccgagctccggagctgccgcctcacctcctatccgcgacgccgccgaaaaccacttcggtcttaacgccgccgcctgtcctggagcaccgccgcgcacagggttcgacttcccactgtcgtcgcatccgggaccccgccggtaacgacccctcccagatttcagcttgaggaagatgcttgtcacgcccagaaatttagcccaaatttccagactattttgtgtattaaatccctgtccaggaccagccagggtacacaaaacgacaagtaataaacagttccgaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaaataatagcaaggctgagtacaacctccgtactcagcaagccacaccaacgatgcagacgtgcaaggggaacacaaggacggtttgtggctatttgcataaaggcgggtgtaaaacattttattgagcaaaacagtaaaaccgttgagtaattaaagtaacattaaatctccactgatcaacgctacaccacgttgaacaggcccaaccaacccacctaaactacagtgtattaggtcgatttattgaggtgggactaatcacggtgaatctggtcgaccgcccataaccgtgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggataattacgaccatgaagcatggccaggtgtctcgagcacgcagctcactctgatactaaaaaggtctaatattgtaattatcccatcaactgagctagtggtaattaagcatggctaagcatatagttctagctaggtcacataagtaacatgagctagtcgattcattacccaaggttgacaaaggatagatatcaagtaaacatgggtaccgagctcgaattcgccctatag

SEQ ID NO: 43505 - DNA, 1436 bp, Oryza sativa
  unsure (1)..(1436): unsure at all n locations
nnnnnnnnnnnnnnnnnnnnnnnnnnnnnnnnnnnnnnnnnnnnnnnnnnnnnnnnacgaaaaatgttggatcgatgtgcagctaccggtagagtttagctagcttcctataagtttcatgcgtgtctgttaggttctgtcagtttgtctagcttgacggtgtgtatgcagtatgctccattcccccttcccctgtacacatctctattttctgaattggaatttgaaagcatcttgatttgatcatatgtccagtgcttgctcctctgttactataccatcagacacctccattctgccctgcttgttccattttgatgaatggattaatgagtatgcttcttgaactgttatacagtatgattttttataggaaaaaaaactaattacatatgaatttcttacaatactgttctatattcattttctaactttataataattattcatttgtttgtaccttcaaaaaaattattctcacacattcaacacaaaaggaatacacatatttttttacgataatacaagtacaacttacgataaggaggttcgttcccttcgttaaactgagaagatcagaactgcacggcatacaaatatcccagagaaattgatcgtgtcagcattaagggaatcacttaaaagatttccaagaaatgttgttagtcagaactatgacttttgaacctctctcccgagaaaaaagtaaacgagaatcttgttcacccaccgtacactggtacagcactgctgctctggtacgacagccgtttgacataggggtgatttccttttcatggcgacgccatggattagtgcaatatttgctctgccaattcgttgtcgaaaggtcagcgataatgttgattaaacgagtgataaccttttcaacatagtgccggatcgtgcacgagtggcaaactaccatggcttcttcctgacattttctctttgattaggattattcaggcataaccgcataaaagagtaatgaagaagggggctgtttttcaaagaaatgaacgacaccaggtaaacgttgtggtgctcgacatcatcccgcacgctttatattgcagtatcaaaattgagcttcagcttcaagaaactaaactagcttgagaaaaaaattgagaaaatttatttgagaaaattctagctttcaagaatggagatgttagcatggaaggaaccatttgcaaccatatctattgtctatatttcagcttgcaggagttttggtgagaccattcaaatgaaagcaaaagtgatattaggaattgtcaaaaaaaaacaagcgatttttccctaattattgcacacgaattggaccttcgtctgtgaaattcttaaaccgtgaaatgtggtcatataannnnnnnnnnnnnnnnnnnnnnnnnnnnnnnnnnnnnnnnnnnnnnnnnnnnnnnnnnata

SEQ ID NO: 43506 - DNA, 2533 bp, Oryza sativa
agcaaaagtgatattaggaattgtcaaaaaaaaacaagcgatttttccctaattattgcacacgaattggaccttcgtctgtgaaattcttaaaccgtgaaatgtggtcatataacatggctaaatgttttctccagacatatggacccaatttcaatataagatactgtgacattagttttctttctataaaagtgcatgtatacattatccacaaatattgtaacagcaaggcgaccctctttacaagtcctttattgaagtaaattatttgagttatcacaattagaatctataattcaagtgagacaagctgttagaatcctaaatccaatcttatgtaaatgctcaaaatttacagtatatatataatcactaccttgtggggctttgatttcagaaagcttcaatacttcagttctcacttctcagttgtcagcaatgagtaggaccgttgttttcattttctggctgcgcagaacaattctcagcttcagtttccaactctgatggtggatcagcctccaacttcatttcctcagagctctgatcatggcagttgtgttcaacactcgccatcagtggctcactgggggcattttcctcatcatcttcactagaagatgacatagaggcgacctcaggaattagaggtgtcaagctgcttgaaggcaattttgctattgtggctcctccagatctgatcttggactcaatagccttgatcagcgaggcagcctcctcaggaggcacgacacgagcaccacaagcaagagcagtagcatgcaccagcgagtttggaccttttcctcgtttgtacagtttaggtagaaaaccgggtagtgggccctgaattaggaaaacttccctgtggttgttggatgggttctgcaggacggtatgaaattggaactgcttcaataggagcggccaacaacctgtattggccatctgcattccaggaaaatgggaagatgtcaggagagcattctaacggcaggtagcaatcaatcaagatccactggtagatagttatcaagtagggaaatcgactaaatgatgaaaagctttatgatgatgagtaagcactcatgtgatcgctggggaattgaaaccaaataatactagtaaatgttttaacaagtacagtgcaaatgctttatgatagtaaatactcccagtgattcactagaaatgatataacctctttttgaaagctaccagcaatggtatgaattatacccatatttgcacaactatacaagctttattaagtatcctaaatgacttatgttcttggattgcaaaaaagaaaaaaagtacccagataaacacaatgctccaagccacctatcattccaaagaaacaaagaaatgccaaactgaagagtttcaagatctatcgaactaaattgtcaggcaaactactatagtaggcaaaacaattggtaaatttttgcagatgaggacaacagaccacacacgaatattcttgttccttcaaaagaaaatggtgtcaagaggcattactaaacatataattattgggtcatttctaaaattttagtgttgtaaacttactatcttatcttgccacatatgatgaagaaaacaattgacaggcataaatatctaatagatttctaaactgatgcatctgtaatttctatctagaattttaaatattacttttacacttatttcctgtaaacagcagaaggaaatggattacctgcagaatctccagttggattcttcattataggcatgtacagcgtgagaggtatcgcaggaatagcaaccgtagtttctttagaaagtacatgaaacctttcatcctttccctgtaaggcttgattacaagtggaatccgcggtcagaactacgcataagatctttctagtccaatacagaatacacaaatcgtctaggtatattagggcctgtttggtatagctccaactcctaaatttaactccaggagttgagtctggagtggagttgtggagctgcctaaacccagctccacaactctagttcattttgtgagagagctccactcagctccactcccagttttggtggagccgaaactgtttggctgagctccagctccagaaggggtgaagctggagctggagctgtgccaaacaggcccttagtaacagtatgacatataagcaagcaggtaatttgtaacctgggatttctgcgaagagtcttcctttctgttcgcagccaaacaagaactttctgatacatgcttgacttcccccgctgttgatacaaaagcaacagttacaaataaaacaattatcccaacatcattcggtgtggagaaagcactaacaaagcaatggattagcttatcattatcataacatagttaccatttatagttaaatcacatgagagtggaatattgtcagcacaattcgagcttgaatgagtcaaaaggttggttggtattagcacaagactgggactgggctcttgcaaaaacttgagctgtggtgtcattgttttctgtttg

SEQ ID NO: 43507 - DNA, 1577 bp, Oryza sativa
  unsure (1)..(1577): unsure at all n locations
tagttaatatagaataatttagcagcttcttcagattcaaattccataccctcgactggctcatcaatagggtccacctcaatagaatgtggattttccattagatcacaatcatgatgttctccagcatgaggttttcttggtggaaccggtccatgattatggatttttatgaatttggtaacaacccatttgtcaggcccaaactttttaatcattaacatggccttgcaaccaactctagttcctacccttgcttgctgtttctggtccacatggaggttttcacaatcacgagtttcatgaaacccctcttttgagcagacaatacgacgagaaattattgaattatcacgtctagaacgagtgtacctgctgattcgaattctaaaacctgcatgtcttgcatatttgctgtagaaatccctcgcagcatcttcagactcaaattccattccttcataagggttaattcagtatcagctccatgtccaaattagcttttgagcttcaggatcatgcatggctgaagtctccatgtcagtaatgactctgggaagttctattgaagaatcccttggctcatttcttgatttggttcccactgactggttaccacacctccaccattnnnatccacgttcagccaaatcacaacacccaagagaatcaattcccatcaagtcactaagctcaaagtagcaaagcttcagaaccatcatattgattgcagacttgttcctgtgaagaacttaggagaactggtccaaaatccgaaggtaatgattagatattgccatattgggggaaaaatcatcatatcttgtaaaggaaaactgtaatgactcgacagttataagcccaaaaccttagcttagcaaaaacatatgaaattaccgagaaaaagtactcagttactcaggcagtaagtaaatatggacatatggataccgaaaaggtatctggaacaactatttggataatgcaaaaacaaaaaacagatcgtatttacctgaattatttattgattttccataaagtacataatttaaggatcttaacaaagttagattgggaagttaaaggtatatggtgactaaaaactttaatatcaaactggaactgctaatttatgagcatcaagagaagtactctgtggtgtgaatattcttaaacatcttgaagatgaagttcataaaagatatttaaatgataatcaagtgcaatatgcggacgattagtcggatgattaaacaaaaagtggctgattaatccctaaaaatggagatgaacggtgcactggtcggaggttaaagcacctagttgtgagctctaggagataaaacaagaaattgtctaaaaaatcccttaagtttaatggctttagtataaggtaagataagtgtgaagggcgtttttttagcgtgtccaggaaactataggggctaaagtgcagagcaaacatcctagtcatattgaaagtgcacctttgttgttccttttctaaaacttactattgttgaatgtgcactagtcccatcaatgaaattaacaagatcttagaaagaaagtttcca

SEQ ID NO: 43508 - DNA, 906 bp, Oryza sativa
atgataggtggggtccacgtgggccccaccattttttctattattgtgtgtgtgaactgatatgtgggccccatatgttttaatatttttcggatcgaatttccacgtcaatgccacgtcagatgaagaccgagtcaaattagccacgtaagcgccacctcagccaaaaacggggtcaaatactgccgatggaccttatttaaacggtttcgtaagttgggggacctgttgtacccggttttgctatcaagggacgaaaatcaaactgggcgacaaatagagagacccaaagtgaacttattcccctgaatattacacggttgctcctttgcttgctcggggcatagggctatgtgggccttccaataggccgttatatgccttaacatctcgaattgcattcgacccaggtaagatctggcctggcctggcctggtcaacaaagaactggagtaacaagggtcttgttcgtgtgcaacggcagtagttccaatcaaaaaacaacaacggcagaaacggtttcttgcgaattctgattcttggaggcttttatctgcacttctcattccgcataataaatttgacaggatatactttcctattagctcgttgggtcactccaacgtctatgttctgatcaagcagggtggtatatcatctttactataaaaacccaactcctgacattgaagtataaaaacccaacttctgacattgaagtactgaagtactccctccgttccataataaatgcaattgtgggttttagtgtctaactttaaccatccgttttatttgaaatatttttatgattggtatttttattgttattagatgataaaatatgaataatactttatacgtgacttaacttttcaaatattttcataaattttttaaataaga

SEQ ID NO: 43509 - DNA, 1676 bp, Oryza sativa
gtagtcgtgggtggttagttttaattgtaagctccttctctgtttgctggtgctgtgtggggttttcagatggtgacgaccaggagaaatgttaacaccggtgaaggcaaccaacccgaaggcagcaaccccaaccaccaaggcaattcacctccaccaccaccaccagacaccaacgccattctcacccagatcctcgcccaacaagccaacatgatgactgctttcttccaccacctccaaaatccaccacaacagaatgctccaccaccccctccccaacactccaaactcgccgaattcctccgcatccgcccacccaccttttctagctccaacaaccctgtggatgcgttggattggttgcatgccgtggggaagaagctggacactgtgcagtgcagtgatgaagagaaagtcatcttcgccgcccatcagctgcaggggcccgcatccctatggtgggaccacttccaggctacgcagccagcgggacagccgatcacttgggcccacttcaccgccgctttccggagaacccatgtgcccgccggagtcgtggctcttaagaaaagggaattccgagagttgaagcaaggcaaccgctccgtgatggagtatttgcacgagttcaacaatctggcccggtacgctccggaggatgtgcgggaagatgaggagaagcaagagaagttcttggcaggaatggaccctgagctgtccgttcgtctagtctctggggactatcctgattttcaacgactggtggacaagagcatccgcttggaagccaagcacaaggagctggaatcgcacaagcgccgcttggcgaatttccgcaatcagcagggtgctaaccagagggtccgctacaccaatccctacccagggggatcctcctcgcagcagcaacaacagcagcagcaacctcgcccagcgccccgacctcaattcgtggtgcgcgtcccacagccgcagcaacagcagaatcagcaagggactcgtgcgccccgtcctcctacgccagctgggcagcccgttcaaggccgcagggacgcttcaggtccgcagcggctgtgcttcaactgcttcgagcccggacactttgcggataaatgcccaaagccaaggcgtcagcaaggccaagcgcctccccgctccaacaacggcgggaaggatgtcattcggggtcgtgtgaatcacgtgacggccgaggacgtgctgacaactccagacgtcatcgttggtacgttcctcgttcattccatccctgctacaattttgttcgactctagagcttcccactcgtttatatctgtgccattcgtggggagaaatcagttgggggtagaaaggcttagaaaccctctgcttatcaccacccctggaggggttatgacagcaaagtattatagccctgccgtccctatagaaattcaggggattccttttccctcggatctgattcttctagacacaaagaacttggatgtgatccttggatgaattggctggcacaattccaaggagtagtggattgcgcgagacgcactgttactctgtaccgaggaccagaacaaccggttgttttctttgcacctccaacctctgtcagaagttcagaactgcatcagataggtctgtcagaaatccccatcgtcagagagttcggagac

SEQ ID NO: 43510 - DNA, 1551 bp, Oryza sativa
  unsure (1)..(1551): unsure at all n locations
agctcggtacccaaacaagtaccctcttccccggatcgatgatctgttcgatcagcttaaaggtgccactgtattctccaagattgatcttcgttccggatatcaccaattacgtattcgtgaagaagatattccgaagaccgcattcaccacgcgatacgggctgtatgaattcacggtatgtcgttcggcttgaccaatgctcctgccttcttcatgaacttaatgaacaaagtgttcatggaatacttggataagttcgttgtggttttcatcgatgacattctgatatactcacaatcagaggaagaccatcagcaccatctccgtctggtgttgggaaagttgcggaaacatcaattgtatgccaagcttagcaagtgtgagttctggttgtccgaagtcaaattcttggggcacgtgatatctgctaaaggagttgctgtggaccccgaaacagtgaccgccgtcaccgattggaagcaacccaagacagtcactcagattcgcagtttcttgggtttggcaggatactaccggaggttcatcgagaacttctccaaaatcgctcgacccatgacacagttgttgaaaaaagaagagaagtttgtgtggagcccgcaatgggagaaggcgttccaaaccctcaaggaaaagctggtttcctcgccagtgttaatcttgccggatactcgcaaggacttcatggtgtattgtagtgcttccgccaaggattggggtgcgtgctcatgcaggacggtcatgtggtagcctatgcttcacgtcagctacgacctcatgaaggcaactaccctacgcacgacttgaagttagcagcggtggttcatgctctaaaaatctggcggcactatctcattgggaaccccgctgtgaaatatatactgatcataagagtttgaaatacatcttcactcagtcagatctgaaccttcggcaaaggagatggttagaactcatcaaggattatgatgtgggaatacactatcatcctggtaaggccaacgtggttgccgacgctctaagtcgaaagagccactgcaacactctcaacgtccgaggcattccacccgagcttaatcaacagatggaagccctgaacctaagcatagttggtcgcggattcttggctgcgttggaagccaagcccaccttgctcgatcaaatccgcgaggctcagaagaatgatccggacatgcatggactcctcaagaatatgaaacagnnnnnnnnnnnnnnnnnnnnnnnnnnnnnnnacacggaaccttatggaacggaaagcgggtttgcgttccagatagcagagaacttaaacagctgatacttcaggaagctcacgaaagtccttattccattcacccgggcagtaccaagatgtacttagacttgaaggagaattactggggggttagcatgaagcgggaaattgcagagtttgtggctctatgtgatgtgtgccagcgtgtcaaggcagagcaccagcgaccgggcggacttctccaacctctccaagtgccggaatggaaatgggat

SEQ ID NO: 43511 - DNA, 3732 bp, Oryza sativa
  unsure (1)..(3732): unsure at all n locations
catgttgatatttatttctaggtattacgttgtgcatctgagaaagtatttgtgccacttacagttggtggaggtataagagacttcacagatgcaaatgggaggtcagttccatttatgttcatgagtaccatggatcgaaatgtttttcttctgccaagcaatcccttctcttactgacttgatgagatagttttttctgcaaatgattcccaaagtaccttttccttctctaggcagacttttttttttttgtattccatctttcttacgaattaagatagcctgtattttatttctttttcgtttttttccctgcaacctctgcatatttatgttctgatgttcaatcttacaaccttaagtgcctctcccccatctttttgaggtgttatttgttgtttgtcaatagtcaatactgagaaggaaaaggacagacagagtaattatgtattcttcccttgtcagatactactcaagtttggaagtagcgtcagagtacttcaggtctggtgctgacaagatttcaattggtagtgatgccgtttttgctgctgaagcctatttgcagactggtgtatgtattttatttttccatacaatcttcatctatttcccaattatacagttctttttgtgtatcaggtaaagacaggaaaaagcagcttggagcaaatctctagagtatatggcaaccaggttttccacgagaaatccagttacaatttgtttattaccgtatacaaccaaaacattatttttagtattcatgttagcagctaatcttcataatatatggaaaacattcctcctttttttcttcctaaaaaatatcacaaaaaagtttttgttcttccatccatgtgccactaatttcagaggtgtatccattgttgggaactctgctatttatattgaattggtgactgataagttttttgaataaaaacatataatgtatcttctgcatttgctcaagatacttggtgtgattacttatgttcaaccttgttatatagcattcaccttagtcattggtataccatatatctattcatgtcctactattatagttattaacctgtcaatcactaattgcagtgatgatatttctcttattaggcagttgttgtaagtattgaccctcgaagagtatatgtcaagaatccggaagaggtgcaattcaaaactgtaaaggtgtccaataaaggtgcaattcaaccactcatcctgaatctccatttgcatttcaagcattaagatctcatgtacttttttcaggtccattaggagaagaatatgcatggtaccagtgcacagtaagccatttgttttccatttactgctaatttcgcgttactctcttatccatgcacataaggggtatttttgtatattcatatgaaaagtttttcccagtacgcaggaatattattacccaaaacgcccataccaaatttcagactgattaaaacatgtgctttcttcagatatttggtgtactaccttttaggcaacattaaatgactttatgctggcataatctactgtggcatgctgtcctttaataagattgctcttttgttccaacaagtgttgtttatgtcttttccaggtaagtggtgggcgtgacagccgtcctataggagcatatgaactagccaaagcagttgaagaattgggtgctggagaaatacttcttaattgcattgattgtgatggtatgttcatggttttgaacagttcaatattatgctttgcctgatttttatttacgcaatatttgtagattttctgctaagtaatagcaaagtggaacccactaacaataaccagaacattctagttatgtttttctttcaagaatccaagttttccttttaagcgtacaatcacagtaaactttgtcgtcattaatagcccagtggtaatcacacatgcatatttgactattggtagcagtttgaccatgtatgtacaccnctaanagtntcggttaggggtggttttttgccagttgactttatttttcactgtctccattactcatgttaagaggtactccctccatcccataatataaggcatggtcaaacttggcacagtcttcaaaactaatctttgacttataatttatcatatgctataacatttattgcagcaacattataaccatcttaaagtaaatttaaatgtcaatccaatgatattaattttaacaaataaaatttaatttatattataataattgttggtcaaatgtttttaaagttgaatcttggaatatgtgcacgtcttatattatgggatagagggagtataaaaaacaggtgaataaagacaagacgaatgccaatatgccatgatgttgttttatttttcaggccagggctgcggatttgacatagatctggtaaaaatggtgtcagatgctgtgactatccctgtcattgcaagcagtggtgctggtactgtcgaacatttttctgaggtctttgagaaaacaaatgcttctgctgcccttgctgctggcattttccatcggaaagaggtattgtcccgccttgtactttttattcagcatgctatgcctggagctctacatgataatcctttattccctttcttgcaagttctggaaaactttgacctagcttacgttatttgcatttgctcagcagtgttagtctgttctatatgatcaacagagctacgtgctcagttaataatacttgcccacgttatgttagaatctttgttcacgttccatagtacctgtatagtaagattatttagggttgttggacgtaactgagcgcttctgctttatcacaggttccgatttcagcagtgaaagagcatctggtagatgctggcgtggaggtcaaagtgtaggatggaaatcctttgatctattgggaaaataaatcagggctttgtaacagttgtgtgttctattttgggaataagatggtaattcataggccatggattggaaatgcaatttcgtaataaattgtttgaaatcttctgtttgattttttttctgcctgtatattactttttgtcttttcttatatcagacaaagctagaaaaactaattcagtcccaattagttgctactcatgcaaacaaatttggattctgtttggtttactgcaaatattgacaagatagtctggtaacatcaatattgtgtgacgaagcaaagtggacgaaatgatccatttcaataatccggtgaatgatctgaaaaggaaaacgctcgagaaccccaacctttaaccagtagtccacaatgtggaatttgcacgagcctttgaaaatactggcagtgccaagggccacaataaagaaacatatttaatcagaacaaccagtctatctggacctgaccaaggattataatacagctagctgctctgtatagatttttatagcccatctctcaattcacttgtacagtgggtaactcttcactataaatatatggtctacctatctgtttacaagattttcttgggtcatgtgtctaagccagctgtaatctaacaacccgcttttatctctcctctcctctctcatccacctcagcattcaacctttttatagccctctattatacttgctcttaggctgtgttcgagaggcctcacttcccgcacacgcaaaacggagagacgtattttcttatgattaattaaatatttacttttttgaaaaatggattt

SEQ ID NO: 43512 - DNA, 2711 bp, Oryza sativa
  unsure (1)..(2711): unsure at all n locations
nnnnnnnnnnnnnnnnnnnnnnnnnnnnnnnnnnnnnnnnnnnnnnnnnnnnnnntggaatagaaatgctaattgagaactttgcatgcaccacatagtacagcaactactcaagccaagttctatttactagtgaagccatttccaacttatatcaatccatttattagaaatatgcatgtacattgtgtgtttactgagtttttacttgtagaatgtaccatcctagtataattattttaaataaaactcccttagttgatctctgcaaattaggtggctagctgtccttgcagtgagttgtcgtagtacaaatttgaaacagtcttcgggcttcagattttccatctacattaattatgaaaatgtcacctacatacatctcaattctaatataagttaacatttgcaagtgggagccaattaaactgtacttcagcacttatcttctttttatttatttactagctatgatttgcgacctgtgggtgagcaatcaacttcttgctgaagtgtcagagaagggtacctgaaggaacagaagatcaacactaacttaaaggctcatacatcatgtaagctaaaatcagtttgttcccatagtttgtgagataaattgcaatccttgctgcttgtaaattgtaatgaaatctgtacgattgcaattatactgcttcaacataaatttctcataaaatggacctggtaatttaatattggtggattgtgagaatatcgaagctatgctacagattgaattaaatggaactacatcagttatgttattgacacttatcctgcacatttgacactgatcttcaattctgtattgaaatagtaggtgttgcatagattacttatcattgaatggagtattattataatctatatatctgacccttaatacttttgtctttctgataatctgattcaagtttttagatgctcaacttatcatggcggtcacaagatattttggagtggcatttctcttcaagggaaatgccttgcctgttgtagatttgccatcgttttgtctcattttgtagattgtataggagaatttctctttttgtacaactaacctatgtacatggcatttgtaattaaatggaattggtatattcagtactagtggaatgtggatgcatgagaactgttggtggtatattcaattctagatcagtaggatttgattccatgaactatattttttttaacccaatgcagggcacactaacagaatatctgtcagaaaaactgatatatgcaaactgcgtatctgtcagtaatccgttaactgtcggtaaaggaccatctgtcggtaacttccgtctgtcggtaattcatttgtaggactgtcgagttatctgtcagcaaacatttatctgttggaaaagacctttgccggcagcacttggcctgacagaccctatctgtcgggaaaagttatgctgacaaataatttgacagcatataggtcctttcctgacagatatgtagtaagcaaacttggggcatggtgtagtgtcggggaacatattttgctaaatttttctatattcaagagtaatagcctaatgggtgttgccatttgttcaatctctcaaatagtatttgggtccacatgtatgtgagataattcggtggcatgtgtgaataagaagatgaatgcaaaatacgatgcatgccacaagttattagtggtaaaaacattttttcccttgtctttcatttacatgtttaagtgttacatgcacaaggttttggggttgatacttgacacctatagcccgtttctttcttaattagtttgtttattctacttttggaatgaaagatgatatgctttgaataaattgggggaagctctaatcttcttgtgctagtaggaaaacataactatacttcttgtaaaaatattcttccatttaaataagagaaatttatagttggagttatgaattatagggacagaaataaatttaaaataatagtggtggtagtggtgaatctcctgccatgccaccacctctgctactattctttctacagaattctccctaagcatgcattttcatattatttataggtgttttacgccattcccttcttatttcgtttattagaaccacaatgtaacaagaaaaaaaatctaagatgttccaagtattgtgtatatgtggaattactctatggaaaaaagagcgaacaatagatttgatgcaaaactagatgcagcggctaaaagatatacatttggttattgatgaaaatataggcacttatattcttgagatcttgggcataatactaaaattatattgtttatacatgggaatatttcatcaacggctataaaaaaattgtgtcgcataattagatatttttgttggcattggtcacactacttcataaaaaaatataaatttttcattacttcaatgtttcttcaacatcgatacatatgaggacagtttcacaccaaagaaaagaaatcacataactcggaaatcaaactctaccaaaaattggctatatacatacccttgaggggtgagacagcacgacaacgccctcaggagggggaatgaaccatcgttgtcggtccggccaaggcccgactgagtttttacccgccgctcaccacctgcaaatccacggctgacgcaccaatgctctaccaccacacaagctctgccgacatgtgg

SEQ ID NO: 43513 - DNA, 1286 bp, Oryza sativa
  unsure (1)..(1286): unsure at all n locations
nnnnnnnnnnnnnnnnnnnnnnnnnnnnnnnnnnnnnnnnnnnnntagtgacttcaacaataccggaggttttgttgaagacacgataggcatgtgcatttgattcatagccaagtaagaatccctcatccaccttaggtgagaatttagatgagcaaggcctcttacttaaaataaaacatttgctcccaaagacacgaaaatatgaaacattaggcttcttaccactcaagagttcatatgaagttttctttaggatcttgtggaggtacaagcggttgatggcatgacatgcggtactcacggcctccgcccaaaagacatccgaagtcttgtactcatcaagcattgcccttgcggcttcaatgagggttcggttcttcctctcaacaatgccattttggggaggatcataaggggcggagaactcgtgcttgattccttcttcatcaagaaattcctccacttgagtgttcttgaattctcctccattgtcgcttcgcaccctcttgatagtgagatcatagaggttttgggcttgctttgcaaagcgcttaaagacatcttgagctttgcttttgtcatggagaaagtacacccaagtgaagcgtgaaaaatcatcaacaatgacaaaaacatacttgttacctccaatacttatgtaagccacgggcccaaataaatccatatgtaaaagctcaagagggcgtgttgtagtcatgatgttcttgataggatgtggattcccaacttgtttccctgcttggcaagcactacacacacgatctttctcaaatgtgacattagtgagcccgaggatgtgttccccctttagaagagttgccaaattctgcattccaacatgggctagtctatgatgccatagccaacccannnnnnnnnnnnnnnnnnnnnnnnnnnnnnnnnnnnnnnnnnnnnnnnnnnnnnnnatcgacaagatagagatcaccctttaacttgcctttgaatgctacagaggagtcatcccttcaaaagacggtcacatcctcatcggtaaacaagcaattgtaacccaacttacataattgagaaacggataataaattgtagcttaatgaattgacaagaagaacattagagagagattgattattggagatggcaattttacctagaccaattacctttcctttaccatcatctccaaatacaatattctcacgagttccgttctcctcatcaagacttgtaaacatactcctctctccagtcatatgattggtgcaaccactgtccacaaccca

SEQ ID NO: 43514 - DNA, 2266 bp, Oryza sativa
aaaatcatactgtataacagttcaagaagcatactcattaatccattcatcaaaatggaacaagcagggcagaatgaaggtgtctgatggtatagtaacagaggagcaagcactggacatatgatcaaatcaagatgctttcaaattccaattcagaaaatagagatgtgtacaggggaagggggaatggagcatactgcatacacaccgtcaagctagacaaactgacagaacctaacagacacgcatgaaacttataggaagctagctaaactctaccggtagctgcacatcgatccaacattttcgtcatcatcattggcaaacacgcatagacccacttctttattgtaaccaactgactagcttcatcgcgttctttatctgcatattttttattcttcagtaactcaaaagtttggtccagcagcgaggatcttgtctgtcaggctgctgtctcccccgatcttgtagttggcgaacacctcgaagttcttcttgaacaggccagccagcttcaggagcgtctccttgtacgcgcccttgtccgtccactgcacagaggccacatttccgacgaagaacaactcagactctgcattttttacatgtatagcagaaatggcatgaactgatgcgtgatgctacggagcttacggtgttgatcgggtcgaggatttcagaggggatgccgtcgatttcagtggggatctccaggccaaacacctccgtcttcttgtagttggcggagaggagctcaccggagtggatggcgtcgatgatcttcctggtatacggcagcctgatccgcttgccaactccgtacctgaacagtgaattcagagttagttcatgccacaggtaaatgtgcaatggtgtggacgctgttacagtggacagtagcagataccttccaccggaccaaccggtgttgacgagccacccggtggcgccatacttctgcatcttctcggcgagcatggcggcgtacttggtcgggtggagcatgatgaacgctgcaccgaagcaagcagagaacgtagcctgcggctccttgatgccatcctccgtgccggcaacctgttgaaatggcaatgcaataacgaagattcaggctaaattcctttgttgatcatcaaggtgataggaaggtaaggcaggtgactctgcttctgaacaaaaattgtttaccagagcagtgtagccactgatgaagtggtacatggtctgtggaaggtttagcttgctgacaggagggaggacgccgaaagcgtcgcatgccaggagaatgacgttcttcgggtgtggcccgacgcacggtatcttggcgttggggatgtactcgatagggtaagcagcgcgcgtgttctctgcagaaaagttcagagttgtgagatttccattttttgttttttgctgtaacttttgtgactgactgaaaccggattgcgctttggagataacttaccggtgacagatttgtcggtgtaatcaacttcacgggtgtgctcatcaaagacgacattctccaacactgcagacgccaaacattttcgatcaatgaaatggcaagcgggagaaactagaatgatcgactaaattaaactgaaggttcaggcaacttccggtcccaaacttgatggcattccaaatatcgggctttttctcctgtgacaagtcaatgcacttggcatagcaaccaccctcgatgttggacacgccagtgtcactccagcagtgctcatcgtcgccgatcagcagcctgttgtggtcagtagacagagtattctttccagtacctgccgattaaaataacacatactcaaaatcggccaaaaggatgacagtaaacaacaagggcactaacaacacaaattcttcagtgaaacaggcatcatgcacacagcatcttaagatctcaaacagatatgatgtatgcagttattatatatatggggatcaaggggaacgcgtcagatgagactgacaggtgacggcaccacgggtgttttttcatttcatccaccgtggagagccatcttattacctgacagtccaaagaagagggcgacgtcgccctgcttgcccatgttgcttcccgagtgcagggagaggatgcccctcctgggcatgaggtagtgcatcaccccgaagagccccttcttaatctacccagcgtactgcgtgccgaggatcaccatatccctcctagcgaggttgatgtctacgctcgccgacgacgtcatgttttgcgtgttccggttgc

SEQ ID NO: 43515 - DNA, 2010 bp, Oryza sativa
  unsure (1)..(2010): unsure at all n locations
ttcccattttcatttgtcattcccttgttagttttcttaacaaatgcattggccagtggccatttccaattcagattgctcgttaggaagcaaaaggcaaagcctattattatacgagcgttctcaaaaaaaaagagagagagagagagagaggccggggagtcacctgatggactggaagctgctggcgctggcgctcctcctcggagagggcggcggcaaaaggcgaggaggcgccgtccttgatgggcgtggtgggcgccgaccgcttccgctgcagcgagtggagctcgtcgatggtctgcgcccgcaccggcgccgagctgtcgtcgtggcatatcccgttctcgtgcttcttcgtcttcgccccgtgcgtctcgatccgcgccagcccgttcggcgtgctcgccatggccgtctccggtcgcgcgaaaccttcaaaaaaaaaagtaaacagtcacgttaattagcaacgccaacataacagcgctagttacgatttacgacccggttctgccattgatgcttgcagcatccaaatgccggtgcaaaaaccacggagaaattaaaagagatgatgaacacgtacgaggcagtcgaggaggagatcagcaacgcgatagtgtacaagatgacaggacaggagtggagaggtgtggggcgtattgggcggagtccgggtgcgcttttaaaggggcagcgagttaaccatggttaggtgctctaaccatgagtaggtgttccaacctgagttacgaggcccaaataccgacgtcgtcgatcaggattgagaaatgggaaaatatacggtgaaaactatgtatacggtgaaaacttaaaacctaccattaaatcgaaaaataaacgtctaagattcatctacgttatcacgggtaaaaattttactcgtaagtttacttatgagtaaaaattttattgagacttatattgacatggacgattctcgtacatttaattttcaatttaatggtaatttttgagtttctaatatatatgatttgcaccgtatatttgtcggactttctgtcccacgggaggttgtggttaacgtcggaggctcggagcgagaggaatcaccaccaaattcgctgcatgcacactttgcacggttgcaccaggtttgggacttggataaatgaattcagacggcggttaactggaaattggttggattagctaagctacgaaatggatttgtcacacgcttttccttttgtatagatgctcagagtaaattatagtttacagtagttatccatcgaaacgttccacatatacacttataatttttttcctttgaaatcaacaaaaacaaattcgtggtaacttgttttcctaattagcaaatttggctcagtagattcagtgattcacagtagtcaccaccgttgtttccttctcaaaagagtatatctatatatttatattaattaatttttacaaaacttatcttttacaccaactggtactatgctcctgcttttcaacaggactaaaagaaatactaacaattagtttgatggggttgaattttatctatccacttttttatgggttgattctcgtgcagaaacactcttttattttgtcttttaggcaatatggttttttcatgtggcggatgaagatgtgcgagaagatgtagacgactatctgattttaatagattttgcagtattagtagagatacgtagaagcagaaagaaaaggaccatcactaatctcaattgcaaatagagcaatgtgattaacattattcatgtggttagcttttataaacggagcaggagatgacgagatgtagctgtaaattcattgataggaataggattaacacccgtagcagtgagaactggattgcctaagatatataagtaaacaaattggccaagtatgtggaaaaggcattagtactacaaagtagagtaatttacaaataggattattatgnnnnnnnnnnnnnnnnnnnnnnnnnnnnnnnnnnnnnnn

SEQ ID NO: 43516 - DNA, 1786 bp, Oryza sativa
acgatgtttcgccgaagttattgatcgagccgactaacgactgcacgcacgagtggacaatgtctttgatcattcatcactgggtcagtttgctcctttttttataaaaaaaaaatcactgggtcagttagttagtcagaccttctttgtttaggcttagacttattggcctagattttttaagtcaacttattgacttatatgatttataagccagtggatttaatgtcctaagtttagtggtggagttatacatctatctcatataagaaaaaaaagcttctctaacctaacttttggcttaatagtattagagtggcttatggctttaaaaaagtcaaataaaaaactgcttgtttgttttggcttagacttttcgacttataaattggcttataagcctaagcaaaagagggcctcaaaacaatcgccgtcgaccaaccaaacaggaaacaagatttgagaaatagtacgagttagtagttcatatgctacggcgcctacaccaggttgtgcacaatgcaccgctaggctaattctgaatgtagacgtgcctgctgagcttggacgacctacacgaaacgcgatccgaagaaacatccattgttcatgggacgcgcgttaatgcattatacctggggctaaaaccaaatggcgatgggaacacctatatatttatcgataaattttctcctaaaaatttgacagatgtaattatagtataatcgtagtgtaattacactgtaatttgtatgtaattacactgtaatttgcatataactacagtgtaacttgtatataagtttcacgtaattttgaatcgttagatctattacaagatttgttttggtgaggaagaaaaaacaatcacagcacacatatatgtgaaagaatttgttcccacaacctccattttaccgaaataacatgttacggagagatttttgaaagttacatacaagttacattatagttacagtgtaattacactacgattgtgtaattacatgcaagttacagtgtaattacactacgattgtactgtaattacatctgtcaaatttttcggggaaatttgtcaacaaatatatagcaaaattgaatggggattcaccccctccatccggccatcccatgagatcggtgcacacacgcgtcggtgacaggcgccgcgcgcaatggggaaatgggaaacgggaggcaggcggcagtgacaaggttgcgccacacgcgcggcggggagcggttgcgtacgtcgattgttgcgtacgcctactcgcgctggcggggttttatggccgcgcgcgtcgggcgaatcgaaggcttcgcgatctcgcaaacacatgaaccgtggcccttgcgcgctcgacgtcatgcacgtaatctgggcagttatacacaccaaccgcccggcgtctggctcgtcgtcacgtcgtcccccgctatcctctccacgcgcgcatatctatctatctatctccgcttttgcgtggcgtggctgcgcgtgacggcgtgaggctgtgagatgcggacttgtggcacgtgcctaggcaagcgcggtgagcctctctgttttcaaacgcccggggcaggttgtaacgctccgcttttcgtgagtcgttaaaaaaaaactaactcggcaaaatcctaattgcgaaaattttcgttctttgtgtagagtctaagttgtgccaaggatctcaatttaatcccgttgttccctctcatcgaaatcagaatcctccacctcgaaaattcctcttccgattcgagtctccaaaatcaa

SEQ ID NO: 43517 - DNA, 2135 bp, Oryza sativa
  unsure (1)..(2135): unsure at all n locations
nnnnnnnnnnnnnnnnnnnnnnnnnnnnnnnnnnnnnnnnnnnnnnnnnnnnnnnnctcagcgcatgcccttaacctgaaaacatgctgatgttcctaggattacaaactgatatagacgtgtgattgtacaggaactgacaagacaagaaggcttgatgctatgaatagagtaatttatgaagttttcccagaaccaaaccgacaacttttgcagaggtatctaccttggatgttttttttttttttttgaaattacacactttgtgtatgtctgaggttttcatttgtgaagaaccagttctcattttttgtagttctcaatcattttattatgaatgtatgagttagctttagattagactgtagtacaataatactccctccgtttcatattataagtcgtttgattttttttcttagtcaaacttcattaagtttgaccaagtttgtagaaaaatgtagtattattttcaatataaaagaaacatattattaaaatatatttaatgttaaatttaatgaaactaatttagtgttgtagatgttgctagttttttctataaacttagtcaaacctaaaaaactttgactaagaaaaaaaacaaacgacttataatgtgaaacggatggagtagcttcatgttccacctatggattccaaaactcactagttttcttttaggactcttaagatgatgcagattgttgaatcacacaaagctgtgaataggatgtctcaatctgctttggcggcttgcatggaccactccttctccgacctcttcttctcggtgaatgtgaaattgatagcgactttagtatggctggggatggttcattccagctgcttcaagctgcagctgctgccaaccatgctcaagcaatcgtcatcattatgctcgaagaatacgatcagatatttgatgtatcctctttttcctttacatgttcctttctacacagtcaagttccatttgaagttatactgcattgactcttgatggattctaatttagcagttacctgtataggacttggaagacggttcctactcttcagatgcatatactgagtccgaagacggtgattttgacaaggaatattccacagacaacgatggccctgaagaggatgactcttatgattctggtgaagataacattgaagaagacatggatgatgatactgagcactcatctggtggcagtgaatgtgacaacaacattaagaccagtgtctctgatgacaaggtacttcaactagtcatcgtttttccaatcttaattacattgaatgacctccttcggtcattctggcaaaaaactagtcatcgttttgatttcaagcattacagatgtgttgtgtctaaaggtccagtaacgagggagcttcccttgtgttgccttttatgatccggcgatgcgtttttttgttgatttcagtggttaactgctgaatttgtgttgtaattgtccttctaaatggttagcatacttggattaacttcttatatactatctccactcctaaatagaagtttttacgagtttgatcatttttccacttttgataacgtaatataacattgatagtagaacatgttagtttataattttaaaccaataataggcttaaatgtttgaccatgctaatggtgaacctgaaatgtatgcaaactagaatatactgaaagccagcacgagactgttatgctgctgcaattgtacaaagaactgcagtagctgctaccccactgtctgctacagttttttatgcttttagatcaccgatatgagcaattcttaggttacctctgaaaaagtatgcccaaagttgaatcagtatttcaagctatatgcccaaagttgaatcagtatttcaagctaacttagaattgaagtgcaaatctttcatagggatgcttgtaactttgttctgacatgaaaagaacgatctgttcacagtagctcaatgatgtgagatgtgaaaatgaacacgaccatcgactacatctccacaactttgtagaagccttgaataagtaactgacgtggttaagtatactgattacccagaattacatctttgtgtctctgacttaatgcaaatgcaatttctacgccacccttacaa

SEQ ID NO: 43518 - DNA, 2364 bp, Oryza sativa
gtatgcgagttgcttgtgtgagctgatgaggaagtctgcgttgaggggcaaagattttgtagggtcattctgcttctattttggggagtctaatttttgtgctcgttgcttcacttcggtgtacatgaactgctgaactcctttcttgcatatggaaaatggggggtgggcatcacgtgcggcattcctagataatgacaatgagcaaagcatgcacaatgctatgagaaaactgcaagccaaacgtgcaaaaaatttcaccagagataaacacgaagaacatgcattacccagggaaaacacgatgcctgatattggaggatgcagaacttgtgctggatgagaacgatttttgagatggcatagcgaagacgaacgcagtcatgctgtcatgcatgctcacaacctcggctgctaaacggcgggcttagtatccagctcttggcaaataagcaagccattgtagtcttcgggagctcagacaagtgcattcttcttagcgattaaccagggttgttaagtattttatgcccatcatggaggccctcatgtaaggaggccgacacaactgcggagtccaggcgacgccctacacttcctcggcgctctcatcgaacacgacacccatctccccttgtgtaaccaaagccgggtagagctttttttagcaacttgctactttccttgcaagggggctagaatagatcgtgtatgtactatatactaagtgcaacttttggaaataaaaaccccttgacattactctagcatggggaattgtctaggagctgaagaaagatcccctgagatagtagtattttgttgagaaaaactccgaattaattaccttgttgaattattgcgacggttcaatttacacctctaaactataaaaccaaaaattctacccactcaactcttcaaatcggacctataaccccctatcccaatccaaaatggatttgatcttatgtggcatcagacgcggcgattaattttttttttaatctacatgacagttggcccacttgacatcgatttttttttattttttttgaacatttttattttttaattttaaaataaacccttcaaaatattattttcaaaatctgaatcttttggccatgccagcccgcttagagtggcaaaacaacactgacatgccacacgcaacaagcgtgacagttttgtaccgtcgtgaccaaataacactgccacgccatctagaccggcatgacaatgttgttttaccacgccagtctggctggcttggctgaaaggttcatatcttataaataagttttgaaagggtttatttttaaaattaaaaagttcaaaaaaaattccttgatagctctatcttctctatttttttcttcacagcccaagagagaaaatgggagggcagggaggtagtgggtcatgggtgtccacggcgaagtcccgcgagtgacgacgctagcgagcagcggcgcggtagcaggagtctaacaccgaggctcgaggaggggcgcctagcggacagagctagagaagggggcgccgtcgtgctcactggccaggaaggcaggtacacaactagatctgaccacgggtcgtcagtgccttctggttgcagatgtgcaggtacatcgttcccgtcattgtgctgccgcacgtgtagctgcatccagcattgccatctagtgagctagctaagctcaaatactcaatcgtgaaggaggaagaagcttattaattagttggctcaccggagaggcagagacgatgttggccgtagctgcaagtgacatggttgcacccgctgcttatatacttgttgccaaggccttctactcctgccttgttggctttgttgccttgctcttgctgcttctgtttcaggacaccaggcggtgtcctccttgccgttttcagatacgaagaagaggaattggctccgcggaaaccaaaagattggttgacatgctagtacattgctactgcttcttgctctttgttgacatgctagtacattgcaaaagatagtgaattgggcgattttgccgcagcggcgcttggactcaacgcatggaagcggcgctggtgaggtttagatcgaaaagttgtcgtcgagttacttcccttccttcatcgctacatctgaggtcgagagagagatagagggagagatatgacatgtgggcccactgttgctttctttattttttcagttggaatgccacgtgtgtactagtttgtgcagaaaacaactcaaaatagtttttagtatttgtccggtttgaagaatcccgtacacaaaatgtctggtttgtagttcgcgggtgtaaatcggaccgatgcaataatttaggggtgtaa

SEQ ID NO: 43519 - DNA, 2545 bp, Oryza sativa
cccattaatgggaactaggcgagcaccatataaaatttctacaaagatagttcaaaggttcttagtcaaaaaaaaaaaagttcagaggttcatcctacagatatttttcagagatcgtttaaatcttcaatatatactgtggtgcaaacttgataagtcactaagtcactttggaccaatttctctttttcaagaataaaagtttgcacaatttgaagggaaaataaaagaggcattgtacaactgccacaagaaatctgcgtgtgcactgtttgatttgttagtaatttacactttttcacatgtacaatcatagttagttgttacaatttgagatggtctcagagcaagtttatcttctcgtgagcaccgttgcttccccaccctaagtttcaatgaccagtaataagatattaatcagagacagaaacacggtcgtcgtcttgagtactatgatcttccgtccaagctgttcttgcatgatgtgttgtgctcaagctccccatggcatcagtcttctccatccttgaccgcatcttggagttcagagaagtccactacaatgttgttctccatggcgatctctttggtcaccttcttcttcagctccatgctgttcaattgccagaaaacctccacaccaactgcaagacccaactttgttagctctccattcttccatctttacaaatacaaatcattgactcgtgaaatgaatggataatatatgctatctagtaccatgggatcaacaatgccggtgccgtcctttgccgcctcggtgaagtcgctgccaaacttgtccgcaaggatggtgcgcgcgaacggcaactccggcaattcgccgcaccaaccggcggcgagcatgaccgacgcggccgcctcacgtatctcatcggtgcactcactggacacaccaaatacaattgtcatgtgaccggaaaagagatagaggacgcgatcaagtctagtgtgaggaaatgaaatgtatgtacccaggcttgtccagctttgcagcatgctcgatgagtcgcttgcaatacatctctatcatttcgaacgcctctaacatgttgtcctcccctatgacttgctctgcctgtgaggagagagcaagacattgctggcattagcacgcctcgccttggagcaatgtggatccctctcttcatcagagaaggtcgtagacacttacccggtggatggcgcgatcgaggtggtcgagggtgagaagctggcgaacatcatcggtggcaatggatttgcgagcgaggtggggccggcgagcggtggcgatgcgcaagacggcgagccccaggagggtcttgagcttgctcgtctgcttggaggtcttccgatggaggaaccccattgttaagttatcggttctcggcggcgttcctgtcctaggctgttggttatatgaactccgaccttatcagttgtatggtcagttcctttgcgtgggggaaaggaaggaggaggagaatgcgagttgcttgtgtgagctgatggaggaagtctgcatgaaggggcaagggttttgtagggccatgttgcttctgttctgggtagtttaacttttgtgtttgttgcttcactttggtgtacatgaactgtcgtactcctttcttgcatatggaaaatattgggtgggggagcaattgagcatctcctagagaatgtcaatgagcaaagcatgcagaatgcaatgagaagacagcgagccaaacgtgcttacgtgcaaagaaatttaccgtatgtaaaacgcaaacaacatgcagaaacaccaaagccagggtaatgtgctgctctgcttcaagcagttacgaaaggaagcacaatttgtgcgtggtgaattttattttaagatggtacagtgaagacgagcaccgcatgcacggctgagatagcaactagttcagtagttttactcgcagataacaaagccattacacatctaggcacttatgcagagtgccatttttcaggtgtagcgcagcagcagcagcagccgtgcatcgatccaaactttgtgcaaatagcgtgcagagttgtgcaattcatcgatcaccccgtaaagactcagttaacccgtctcctttcgcaaaacggtgattacaactcctttgtacaggacaacaaaaaaaaaagggaatatatcacctctgtaatttgtacattctctttcgtttctagcgcaatccattttaattatacacatttgatttcccagaggcagaatatcatatctgtatctcgaaagcagatcctctaatttaactgcacatgcagttgagtcactgacatgactcaactgcacagctgttaagccaggggatccctttccctgtatctccagggatcccgcgcgacgaacctccggtttgccagcaaaaaagcaacggcccccagttctcctgcaccggaattcaacagctgagctgactgaccaatgcgctgcgccgcgccaaaaccaacgaccggaagacaccacctcatcttcgggtgcgcaccgagttgagcctcccctgctcctggttca

SEQ ID NO: 43520 - DNA, 1350 bp, Oryza sativa
aggttcagtttgtcaatgtcggggtttttgccggttttcctttaattaaccgtgctgttgtaaagtttttgggtccggtttcccttataaattgaatcaactctcttcttctatagtgaattgcaggagctccctgcctgtcccctcgaaaaaaaaacacggagcagaagcaccggctgatcaatggccactccactcgatgcaattgcaaggtgaaaaaaaaaaagaaatggttggtagtagttacagttgtgctacattgaccagttaaaactttgtgagattaaagtcgttcgaatcgtcttccatgatattcctcccaaaataaaaggctaccatattcagtgcagaatatttggttgttctcgaccactttgagcatggatcgattcaggctggcgttcatccgacgcagctctagtcagcttgagactcaagttaatccctagtgatacaataccattttatacctccagaaaggaagaagggagagcccctttacagctagaaattttaatcagtgaccggtgactaggcagctgcatggtgtcgaaacatggattcggcaataataaaagggggtagcgcacgagacctaaaagtggatggatgcggagacaaaggatttagacaggttcaggccctctcaatgagaggtaataccctactcctgtttggggatttgaatccgccgggtgtgtattgatctgatgatcaggttatgtcatctgccccctagagggcctcctgcccaccttatataggatggggggcatgattacaagatagaaaccttaaccaatacggtatcggtttcctaaatctactttacaatattatcaaaccaggactttaggccgttccgtaatatacaaggaaacgtaatacccgagtcatgatctattacatattccatagatataagttatcccctatgactagtcggataaccatgccgtatgggtatggggtacccacaatatccacacatggtaatatatattagaggatataagggcccctttgaatcgtaggattgaaaaaacggaggaataggaaaaatataggattctgataagaatgcaagtataaaacagaggattgcaaaacacaggaaaaacacaggaatggccgtttgattggaccacaggaaaaacgcaggattcagatgagagagatagactcaagagaagttttccaagaaattggagtggatgttaaatttcctacgtttttcctctagaatcgtaggaaaaggaaagtttcctacgtttttccttttctcattcctacaaatcaaaggtatgaatagtgtaggatttcaattcctttgtttttcctccatttatc

SEQ ID NO: 43521 - DNA, 1847 bp, Oryza sativa
  unsure (1)..(1847): unsure at all n locations
atagtaaaaaagcaccgagtccacagtttcctcagactataattaaccattaccatcattcaccggagtcaaccaagagagaccctagatctcactctgcttaatcccctctttacttttttcacacttcctttactcattagaacttatgcaagacatctaattacaaaagatgtgcaatccttatgtgcattctcaaaaagatatctgattaaagataagacaatcaacacacatcatagcattttgggaatatgaaaggtgttacagcattaatctacaactccaacttcatgccagtaagacccaaagcaattatgcattaattaacagcattttggttgcttgaaaaagtaccacaaagaaccaatgccacagcgaaacagtgtgttgcatccaacagaaattttaatgaaaaacagagaacaaagacacacaagatagcactaataattggtacaatgagccatttatccttttctcggttttattcgaagtatgctactatagtatgttgctttggtgttcattgaaatccaattatgtgcctacagagcctcagaaaatgagtattcacagtatctcagtccaatcctcttatttgagaaattgttgatagatagtaaattctgcattagttctaatgaaatccatccatgacaaaaagtagttacccatgcaaatggtcaatgttttgcaaccgagcagcatcatggcccctgcattccaccacagccaccttctctcgcttgttctgtcaaatgagcatcgcagtttcatgaggatatttaactcttatgagcaaagatacttcttatagatccaactccaaggaaatatatagcacaaaaatagtaggtgcttgatggtggacaagttagaatttctcaccttaaaatcaattatggaaagctttatcaggcggtaatcttctcctcgactgcactccctctcacaagatatcgcttacatgacagacaagaaaagggaaagaataatgtaagttaaatttttttttctatctagcagatacagatggtgcacaattccacccactttgattctcttatactagatagaacatattatctacctcagaacatattatcttactgtgtatcactcaagcttccattacatgtcgataaggcaccagcagttaatcatgattttttttcataaagcacaaaacaaaccccaatttcctagataataacaggtcgtacaattttatacacattttcttttgaatgacacgctagtaaagggcattgtctaatacgatttagcacgtcttatctcactatgccttcttttcttttgagcaagggaggagacccctcccccgattccattaccagaaatttaagtttaacggaatccacagtttcatccggcaaaaaatgaagagtaaagtgcattggcggtccttaaacttgtatggttgtctcatataggtccctaaactctcaaaatgcatatccaggtcccagaacttgtaaaagtgtatcatctaggtcccaaatcgacacatcccctctaggatcctacgtggcgctgatgtggcatgccacatggatgacgtgccattttctttttttttcttcttttctttttatttttcttcgttttccccntttccttaatttctttcttttttttttcccctttcttcgtgctcgggntcatagagaaaggagaagaaagggaaaaaaagagaagaaaaaaagaaaaaggaaaaatttttaacgggacccatttgtcagtcaaaatgatgccacgtcattccgtgtggcatgccacatcaannnnnnnnnnnnnnnnnnnnnnnnnnnnnnnnnnnnnnn

SEQ ID NO: 43522 - DNA, 1316 bp, Oryza sativa
cgtttctgaccactcaggtcatccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccggtgtcagaggttcgcagacaaagcctttcccaagccgacccagggatacctcatgccacatagaaggatcaaatcctcacataaacataggccattttagttttcacaaatcaaactccaaccacctcgatcggtaattcaacaagcttcgcgttcttgcattaccaggaacccgggttggctccaaccgaccccgccccggcgttccccaactattggcatgcgaggtttccctgaaccgactagttacttagctagggtgtcccattccaccttgtggttgcactttgttatgattgatgagtttcccacaggaatcggtccttatatgcgaatacgggacagcgccacgcaggcaccacctccgcatcgtgagttttcacaattcattttatttttaaacacaccgacaccacatgtcgggttttcaaggcttctcaaacccatttcccaatttttcgacaatcacggtgtatgtgggatatttggtatacgcgctcagagagcacggataccgaggtaccacaagagtggagcgacaaggaatcagggtagtacaacctataggaattagtgcgactactgggtaggtccgtcggtttggcacgcaaaccgaggccaagcaagttaagtgtgtgattctaataatgcaagttgcaaacaaaataataatgacttttcaattataggggcaattgatcaaagggtgacttgccttgctcaaggtcttcacgaagcttcacgaatcttcgagagaacccgcgatcaacgaaaaccgataaccgcaactatacgcaaacaatcgaaaacctaaacaaaagaccaaaagaaatatcctatttagacctattagtagtgccattaaatagatctcaattttacggaattactggaagtggaacggaggcgatcggagctacggatcgagggatatgaattttggaggtctaaatggatttcctggacaaggaaaaggaattattaattcccttggaaaagaaaaggaaggagggatcggatttagacttcctcgggcgacttaggcgcggcccgagggattctcaaggcttggccggccattgggccgagcgcg

SEQ ID NO: 43523 - DNA, 701 bp, Oryza sativa
gtgctgtgtaaacactatagtgtatggaactaaccatagattactcggatataccattagctaatggctaaaacacacaaaaaaactgcgaaggaggaagaaaacatacccataaaagaatgttcgccatccacttttcagcctctgataaatgaaatagatatttgctgcacaagagatggccacctggagagttggcccttcttcagtagggaaaacaagggtaagcactccaagcaatacaaaagttattgctgtctgccaaatcactttactagaaggtgtttgaaatcttccctgaatagccttgactggacgtgactgagtaagttccctatactttttcttgagatccacttttggtttttttctatcagagaaactctgcatgatgattctgtcatgggcagactcaattgcatcaacacttggcttatgccctgcatacttgtttatcagaaaattcctggcagctcgaatttcttcttcagatgcttccctgctgattccaagtcgctgatagggatccttcacatggattctaggaaagatggctgaagaaattaagcggttaaaaagtgaggtgataattacaaaaaagaactaatccaaacaacaaaaccgacaggacaataaaaagtatatgtgatctcaaataaaacatgagaggaacagattgtgagaaaaagtatatgtgatct

SEQ ID NO: 43524 - DNA, 1107 bp, Oryza sativa
  unsure (1)..(1107): unsure at all n locations
tttttcctttttaatttgctaagaacatatatacaaagttttgtttttttacaccttatcagccataaagcaaacgacttaactgtggatcatcatggaacatgctttatataattgattattttatgcactcgataatacatgatctttaattcgatcaacgatttggaatagtaacatacatgatggagttcaaaaaaagtcaatacacatcgaatgaatgtgctaatattttaacttttttacatctttatctaaatcttagaagcaaccatactgcgatattttggccggccctgttttgtaactctccgcttttcgtgagacgttaaaaactaattcggcaaaatcctaattgcgaaaattttcgttctttgtgtgagagtctaagtcgtgccaggatctcaattcaatcccgttgttccctctcatcgaaatcaaaatcctccacctcgtaattcctccttcgactcaaatctccaaatcaaattccgaaattcaatcgcgtcctttgaatcctcggcagatactcgctcccaattccgaaaaatatcaaaccctaccttgagtcttccttgattcctccctgaaacctcgagttcgaatatcgaatttgaatccaaatacaaactccaattctctccaaatcagctttccctgcaaaagtctattttacctccctcgggtgttgtgggccgttttccccccttagctgtcacacccnnnnnnnnnnnnaagagagggcngaattgnnaannncagangaccccnnnaaaatgcagaggaaatcaggagaaaaccctaagaaggtaatgcaaataataatcggaattgacatgtggaatttttcttgagttctacatgtcgaaattcattaacaggatttttagtggaattttcagagccctagaaataattttaaccaattaaaaatcactaaagtgcaattgttaattccagggaaaattcttttcctttttctttttcttttccctccctttttccctcctttttccttttcggatgggccgccggcccattcccctccttcctccccctcctccttgctgggccggccgcaggccgaggcccagcctggcagccgcc

SEQ ID NO: 43525 - DNA, 942 bp, Oryza sativa
actgcatcatttgtgctgcaagcatacacacatatagcatggttattacatctaaaagaaccgcggtgtatttatcatgcactggccaataccagtctacaagcaaagcatcagaaatcttcagaaaaaaaaatgtaacagtaaatgcttgacagagaggattttttccccaaatgcattgaaagaaataactttcagcactacgctcctaaaggatgatgctagtacagttacaggtagctttagactgggattctaaaacaaagaattcactgaacttgactccatcaaatccctaacaatgtactacatagcaaaataaagactgaccaaataaaaatcaaaataagcctggttcctactgtcagtgtaatattgcaggaaatactgatgtattcattggtcaataagttagatcctaacttgaaataacagccagactacagcatacaatgattaaacatatagtggaagatatttttgatagcaatggaaatcctcgcccctcatatatgtacagattagagagtaaagatgttgacaaatatcttgcagacttccctgctcatattagtgcgtggatgtttttaacaataagtatctactgaatgaacagtacaaagtagctaatcagtttctgtgattaggctccatgcacaattttccttatatattcttatagcatgttatggaactctctggagctctggtttgtacaaaaatcaacaatgttcaaacacgaaccggaataccgcttgaattactattaggatactggcatataatgatcaacttacaattgatgaaggcaatcattcaactcttttgcttgtttgcggcattgccataccaccgaaaaagttctacctcgagcacactcagcatattttgagcagtagaaatcacactccttaagggccttctgcttcattttgctccgca

SEQ ID NO: 43526 - DNA, 1003 bp, Oryza sativa
  unsure (1)..(1003): unsure at all n locations
aacccctctcgtgctcccctttgaaccggtgaactccctctcgatcgaatcgctgcgtcgtgctccagtgaaaccccgccgtcggccaccgttggttggagctcctgttcttcttcctcctctctcccggcccgcgtggctgccacgtaggcgccacgtcggcgccacctcgacgcgaccgggtcaaagctgacctcggtcagccgcctccctccgtcccccaccctcgcgcgcggtccacggagagccaacatgctgcgcgtgggcccgccgcacaccgggtccacccgcgggccgcgcgtggaccgcttcccccccgaaccctagcgccaccctcgcatgcgcccatcccaccgtgggccgtatcaccgacaagtgggccccaccgggcccccgcgcggtggaatcggtccaccgggccgtctctctctcccccgcgccccctctgttgggccgcctccccgtggccgcgcccggcccaatggctcggccgagcctccttcaaccctttgggccgcaccaatgccacccgagaaaagtccaaatcacaatcccttcctttttcctttattttcaagggatttaataaatcttttctttgttcataaataaaattctttattccaaaattctatgaatcattttcctttggtcccccacctcggagactgncaataatattcttgagaatattatttctataaattccataaaccatttctcgtcttccagaaattccaattaaacttccaaaattcatatcttcccaaccgctcttgcgattgactccgttcaacttctagtaattccgtaaaattgagatctatttaatggcactattattcaagtctaaatagggtctttttcttggtcttttgtttaggtttttgtttgtttgcgtatagttgcggttaccggattttcgccgatcgcgggttttctcgaagattcctgaagctccgtgaagaccttgagcaagacaagtcaccccttcaaccaattg

SEQ ID NO: 43527 - DNA, 2064 bp, Oryza sativa
aaacacccggggcggggtcggttggagccaaaccgggttcctggtaatgcaagaacgagaagcttgttgaattaccgatcgaggtggttggagttggatttgtgaacgcctaaaatggcctatgtttatgtgaggatttgatccttctatgtggcatgaggtatccctgggtcggcttgggaaaggctttgtcgcgaacctctgacaccggccagtgtctggagtaagttcgtgtcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctatgtggcagatggatgacctgagtggtcagaaacgaatctgtgtgattcgggatgtctgtgggcatcatagactaggcttcccgagtgtaagcggattgttgtgctgccgggcagcaggactctgggagtccgagaaaatgaaaaaggctctgggagccgattaatcaagtggaatggctctgggagccgagaagtaatgatctgacccgggaggtcggtacattactgatcgagctgttgaaaaacatctcttaaagacgaatcgagacgcaagtctcttttcggcccaaacttaaaaagaaataaatcacttagtgatttcaaaatgtcttcaaataaaagatttgcaaaacaaccttgcctctcttccaagcttgcattaaacacctaagttcccgtgacttgctgagtacgaaagtactcacccttgctctatataaatatatatatatagttcctccgtcgtgaagagaagacaaagtgaagtgaagattagggtttcgtcctggttcccagccgtcgcctgtggtgttgggtgttagaccgttggttcccctgctgctgctattgttggtgttcgcctcgtccgtgtcgtcggttgcattctcgggctgtctgagctacaacctaagttaaggtaaataagtcctctatttattttaaggattgcaatgattcatatttgtcaccgtgggtaccagcgctatgtcctgggactggtattgagatcgcggtttcgtaggaagcggttcgcgccgtttttcctacgacacgctcctgtcaggtgccgttgtacggcagtgccggatcggggtgtgacatatttagatcgtctggtaaaattttacacgctatcacatcgaacgtttggacacatgcatgaagtatttaatacagacgaaaaaaataactaattacacagattgcgtgtaaattacgagacaaatcttttatgcgtaattgcgccatgatttgacaatgtgttgctacagtaaacatttactaatgttgggttaattaggcttaataaattcgtctcgcagtttacagacggattatataatttgttttgttattagactacgtttaatacttcaaatgtgtttccgtatatccgatgtgacacgccaaaactttacacccatgtatctaaacacaacctttatcccgtcgatagcgaggcgtctgtgatgacttcgtcaatctctaggatttgccgacccagtcttcgaagatgctcataggggtagggtttgcgtgcgtgtgttcacaggggtgagtgtgcgtgcgttgtgggtgtcttgtgttgtactgcgtaattcttaaaaaaaaatgaaacttttaaaagttttatgtcagcgggtttatttccaaattcataaagaactagtactcaaaatgttttgagatgaattatggggcaatggggcttctgaagaaaatctttattattaggggggttacactaggctgtgtttagttcctttaaaagttaaaagtttgatttgaaattgggacaatgtgactgaaaagttatgtgtatatgacaggttgatgtgatggaaaaagttggaagttgggatccaaagtttgatttaaacacagcctagcaaaagtgcagaactcccccgttttttcggtgccaaataaaaaaaaaaacccaccgt

SEQ ID NO: 43528 - DNA, 877 bp, Oryza sativa
atccccattcaagtctcagtaaatcaagaaaaatgtgtttaatccattaaaaatggttttgttctctgtttcagtagtcttatagcctgtttgcaatgtttgctttgtatgtcgctagattccggttccttcgacgctccggtgtacttcgagatagtcgccgaggttcctccagcagcagagcaaggcaagtcatgcttgtcacttgaacatgttgatcctatattgcaaatgctctattgttttctttcaaatattgcattgttttataatatcactatgggatggatacctattgttacagccatgcttttggatatcatgctcctttgttagcttgggttataacatgattagattttggactaggacttgcttagccatgcttagttcaactagcacacattggggatctcatttaaaacctagactatagttttatttgataatgttggtttaataccaccgctctggtgttggttaattaaaatgaaccacatggtgggctgtgggtgcatggttttgctagtcgcacccatggcagttaaggaccggttcgcgggatgccctggaagaatttaccgtgcttaccacaagccagcgtgggcaacggctgggcttgtagtgtagctttcctctagccgacgcatccaggcaagggtgggcgtgatggagtttggatgggccctgcgacggcttatccgctttccggattcacctaggcacgagagggactggccccgtgccttgcgaggagtgggggtgaaacctgaggtgtggtgtgcttggttagagggggttatgcgaagggtcctgtcacggcctctttccggtatgtcgtggtgacatgtcggcgcacggaaacgtgtcgtggggc

SEQ ID NO: 43529 - DNA, 2106 bp, Oryza sativa
  unsure (1)..(2106): unsure at all n locations
nnnnnnnnnnnnnnnnnnnnnnnnnnnnnnnnnnnnnnnnnnnnnnnnnnnnnnnnnagtcttcagcagctcctaacattataaggaaagnnnnnnnnnnnnnnnnnnnnnnnnnnnnnnnnnnnnnnngtctatccccaagaaagttctcctaaagattcaaaaaaataaaggactgatgctcagtgcaacaaattctttacagggctgtctcacaagtttgaatgtacttgagtgctcataatataatatttagtaaccgagcttatataatgatacacgaataatacatcacacaagatccaacattctgtaaacaaattaactacagcatataccggtaccatcatcagatagtgttaccagttgggagagatgtacatgaactatgaaatctgaatggatgcttaatcaactaatgattcagcttccataccggcaagcactagatcacataacttctcaactaaagtctacaaggttcggccagccaaacggcagcaacctccttaacctcctcgtttgacgactcatttcacacaggattgtgttcccatttcaacaagcaacaccagcggagcgcaatttttcgtcagtacctcacccgttacgcaactatcaggcgattttgcagacctcaagaccccccaaatcaacgaattcggaagcttgaacaggcaaaggatgcgggggctcaccttcctcgaccttcttcttgacgtgattctccctggcctcctgcaggtaccccatggtgcagcgaccaggcgcacgccgtatcggatcgacgccggcgagggcggtggccggcgggggggatcgttcagtcggagttaaaccctaactccctccttggaaggggacgcggacattgacggggaaggtctcgctgtgttttcccctgttcgttggtgggcgagggagaggaagtggcaaatgggctaaacttggtcgccccaaaaaggcccaattcatttggcccaacaggccgtgtaccatcagcctatatgggttttctcccctctcctcttcaccaagcaagttttgctgaactgttgaaaatggccaaagttctcatgaagcagcatagatgagagttgagaccagtagacaggtacagagtcgctgccaggatcaccactgaatcagaaaagatgtttctctgaattgttcaggttagagataggagttttttggagtgaatgctcggcgtagttagacctacacagattaatataactcatatatctgacacgtagccattcatgaattatggtagtataatgattatgtacctcctgatgaaataaggaatgtttcttcgtgtcactgtagtggttttcggttcttcacatgggacctgatgattggagattctggaattgctcgtagcttcaccaaatcgcacgagatccttacagctcttttgtaaggcggataattccaattcgttcaccatcaacgaccaaaccaggacaaaatcaaactagtactactactaatcaagttggtaaggagaccaactgacgatagcatccagccaagctcgacgcttttggcaccaacctacccttgtaaaatgccggatggcatcgccgtaggaggccgcgtgtttccgtactacactcaatgtgtttggtgaaaaaagaaaagcgtttcttgatgcatggttatttgacttaacactaacttaccaaggttaaaagcagatactactgtctgctactaaaatgactgcaggtgcatgtgttttcttacggatcaaggttgcagcagagccaagtcagaggtgtccactgcactagacatcccgccgaattcgatatgatactgaacatcagttgcgtttgaacacgtacgcgcatcggattctgatggttttgcggtagctgacgcctggctggagctagcctgcacgtagtgccgagacgtcctgcctgatcatgtcaaaaacaggtcagaatcaggatagtttccacaagaaacgaacccaaatcccatcggcgacagaatcacggacacaagcacacaactcgagctgattgctcactccacgacgggataagatcataagaagaaactgcaaattaaaccctgtcccgatcg

SEQ ID NO: 43530 - DNA, 1734 bp, Oryza sativa
  unsure (1)..(1734): unsure at all n locations
ggggtgcctgcgtgttctggccaccaccggcccccgccggatccgggtgcaccaccgccggatccgcggcctccaccattgctaccccaacgccgtcgccattccggcngcatcaacccacaacaccacngggcgcaactcacctcaaccgccacngtcgccggtcnccgccgcaagcccatcccgcaagatcgggccggaacggcgcggatctggcggacaccgcngtcgccactccggcgggctccccaggccacccgagcgcgaggagacaaggagcgccccaccgccaccgtccttgcggccgcgcggcttcaccggcgcccgctcgggtgacggcaagncgnaaaagggggtgggggtggggaagaggnacgnccgggtccgcccctcgggagagcgacgcgagagggtttttctacaagcagtcgcttttgctccgtgtcgatcgatctagcaagccggctgacccgcctctgcaaatgcaaagcttccgtgagcagcccggagtgatttgccccgggatcgcgtggtttgtgtcgtgtctttgcatacggcgacatgctatgaatccccgctttacacctgtcagatggaccaaatcaccaaacgtgattggcggtccaactgcagagcagtagcaaagatttgaggaacaacaggcaagacatcggcacggcacctgcagactgcggatgaaggcgttcgccgtagaatttgagctttcgtttactgtaacagggctagttggttgtacttgtaccttacggttgaaagataatgacacctagtagatgatttgccggagaaatattataggacaggaacttaatactcattttcttcgaaaagtcatacggaataaatacatgtgctaaagtgttctcctttaagcaggaacatcagagctttcaattgagtagaacaatgcaggtacacattgccgggtttcaaaccgctgctatttttctcccttgggatcatggcaagcatttttcgtcaacaagactgttagctgcctgtttagcacgcgtcaccaacaaatgtacagagtatgtaaccaagatataatcgaagcaaaccgcctggggtagtgtttttttctctctttttgttcgtaatagcctttataagatgtagaattgtaattttttaactgatccattaatacgaaacatcgcactaactcgtagtggttgcttaaagaaaaaatcatagcaaacaaaacaacggccaattccatccttaccaatttatcttgatgtgttggcacggtaaaaagaccaaaatcggcccaacgtttttccatcgaatggacggagaccaaaacaagcaagcaacttggccttcaatcttcttctccttcgcgctctcgccacgcgccgctgctcgccacagagcaccaatccaagattccagagcgggcggtataagagaggggtaggaggctacacccccgccgcctccacactcaccacccgatcgaacaccgccgtcacagcgcgtcgcggcgggggcgatgggcctcttcggcggcaagagcgcctcttcgaagcagaccgccaagctcaagtccctgatcaagctcgctgccgcgcgcgtcgccgtcgcccgccggccccgcctcgggcgccgctccattgcccgcggcgatgtcgcgcagctcctctccatcggccacctcgaccgcgctctcctccgtgtatgtccatgccatgcttttgccttgcctga

SEQ ID NO: 43531 - DNA, 1102 bp, Oryza sativa
  unsure (1)..(1102): unsure at all n locations
nnnnnnnnnnnnnnnnnnnnnnnnnnnnnnnnnnnnnnnnnnnnnnnnnnnnnnnnnaaaattactgacacggtcactgaacttgagagtcgtatatcaccttgtcaagggagttgaggtagtcgacggccctctccctgttggtgaggaaagtggctcgccatctcgatgttgggcgaacccctgcagtaggagagacacagggcaaaaaacaaggatcagtcgtgcaatcacagcagagcctgcaaacagagctttgacatgcacaatgagtagcgggaactacttgcccaccaagctctgccggaggcctatcttgacatgccttgtcctcgcgaccggcggcttgggccggcagcgtcgcagcgcgccggtggactgataacgaccccttctcgtacttgatcgcctgctcgtacagctctgctcgcccacatcccaacagaaaacacgtcacttacacatgtacgagttataatccctgaacaaaaattacagccgttctggcgtcgcgtcgcgtaccagcaggcgagaggttgtagagcacatgggtgaacttgagggagctgtcgctgacggcgatggtcggggtgacgtgcgggtggtggtggtgcaccggctgcgggtgcggcgacggcgcgcccttcgccgcggcctcgcccttcctcgccggatctcccctgacgaccttcggcccggtctcacgcgtcagcgacgccaacgacgcgctgcatcagacgtcatcgtgacagggatcgttccatcagttaattaccactttatcaggtcaaaataataataataagaacatccaaagaaaatcagcacttgctcagttgcttgctaccactgctaaacttactcctaaataaaagtaagaccatgtctcaatgaactcattgtgtctagttagtccgaatagaatactgtgtcgagcggcttgtgtagaacgatacgaggtttcctctaatttcttgggggaaattcaggcgcaagttacgcgacgggaacagctaccgacgccgccgcgtcaggctgatgaggagattatcgggtatccccgcggcgcatgttggcgccccaaattgcgctcgcgttcgtt

SEQ ID NO: 43532 - DNA, 1244 bp, Oryza sativa
tcataactcagccatttaaagaagacaatgtcagcttcggagttcaggattccttaccagcaagtaagaggggatatgctttccttacagtcattccagtatatagttcaccatttaaaccacttaagtaaaaggtcagttgattttgagtatatattgaaatattggactagtgcaattcattcaaagtaaaaaagtaaggtgaaggtttcattttgttgatagagtgaatttctgttatatgtttcattacagttatgatgttatttcaagacaatattttagcagtaggccagttacttcttcaggcataaagagtgaatctcattgaaggaacaaaatgaacatttcaatttttttcagcagtctcggtaatcaaagttatgaatataccattgctctatagcacctctctctggcaaaatattagcattttgtctcaagacctccttatgacactatattaaacactatgggcacacaatacctatcatgtaaaagttttttatttttgctaaactcaagtttcacaaggtcaattacatcactttactgtggcattagtgagtattcactccattttgttccatacttttgataggtatcatcttcacagactactgagaatgcaggccagttcaagatctgccgatgtggggaaggagacccaaatacaaacacatctgaaactggtgataaatcaccaactagttgtcctaattgccaggtttgtgagatttcttgcacttaaaacttgtgatatgtatttatctaaataacctggtgaacgacttattgtaagctacttgagcaagtgatacacgacttgacacatcactggtttgtagctaaattaccggattgtctatagatacataagcttccatttctatgcatatttgcagcttattcatacttgaaacttcacttttgatattgatatgtatcatttgtgctttggggagcatatgaaaggggggtttgttgaattcttatcgtaaaaccgcataattagttcagagctatgttcagtggaaaaagaagtagacatgattgcttttatgcttcatagtcgcatgcacaagtttccatgaccaattttaggtactcttctgatgcaggttcttaagagtggacatttactgctctcatctaaaggtacgatttgcagtaatatctgtaacggttgcatggattctgtttttagcattaatagatactccctccgtcccataatataaggg

SEQ ID NO: 43533 - DNA, 2538 bp, Oryza sativa
  unsure (1)..(2538): unsure at all n locations
ctcattgcattattatcactggaggtagaatctgacaaggtcttgataggttctgtatttggggcctcttgatatagatatacgctatttctggtcatcataaaattattttaacacctgacaaacacagtaatcattttggtctttgagcactaaatatagaaatcgaattataattgtagaatattcagaaataggaaacccgaacctttgaatgaggatttttttttagaaaatatccgtacctgatcagcattcatacaccccagcaatagcattctggcttggtcataatttaagcacctatgcctacacagtttatggaaaaagaaaaaagaaatacgcggacctgaatgtgaagcggaatgcttatttttttcacatactattagttgtatatgaaagtgaaaaaacaaacactgaggctactactggctgtcagtgtagccatgtcgaagcggatagacttgaatcacatgattaaaagaactacttaagcatattatttttcgttcataataatgtacgtttcagattgttattgaaatatcatgagggttggttacttgatttgataatattcaaaatgaaaaagattaaggtatttataaccatgataactcatcccaaatttctgctttaatttcagaatgcacctcccagaggaaatgaaccgattgttacactaggtggaattgacttgaataactccggaaggtatgcattgagaaattaatgtttgtttaaaggctatagttcctgtaatctgataaacatattcttgagctatgatttcagtgttgtggtcaaagaagacaagaaacttttaacagtgttatttcctgatggccgcgatgggcgaactttcactctcaaggttggtcgcacacctgtttcatttttaatatactgttggcgttcatctgcagtatgtactgctaccattgggtggcagcgattaatgcagcaataaagacgagggaagagagaggggatgatcatctccggcagaccaactgtttggttgagattagatcatgcaattacaaggagttgttccattcatgtttgacacacctgccttttatcgaactgtaatggaatgattttcattgagcaggcagaaactacagaagaactcaatgaatggagaagtgcactagagaatgctctggcacaggcacctgnngnancaagtgatgttggtgcaaaatccaattttcagcactgacatancannacctgctgaagctccagctgaacagtgtaagttaagataactttcatcagttgcccacgatctaaagtactagattcagctagggggttgggaaccctacattctactgaacaggcaaatcctatcgtttccattgcagcggacaataaatctatcattggcagacctgcagagtttgcccttgtagatgctgatggtagtccagctttcctggagaaggccttaaagttcattgaagattatggtgagtgttttttttttcaaattttaatttcatgctatcctggtgaatatcagtaacagtcaaatagaagtatgatatttatctaaaaaacaataactcattgtatgtatatttattaatctgtagtttagtgacgagcagaaacatactctgtttgtaggtgtcaaggtggaaggaatcctacgtcagtctgctgatgttgaagaagtcaaacgaagagttcgggactatgaaaagggtgattctctctctctctccctctctctctctctctctctctaacaagagctgtactctaatcaaataataaaatgtttattcatgactcctgaggatatttatgtcacttgtaagccgttaagcatagataacagatccttgaatttcctatgtcctgttcacatgataaataataccatttaaatcactaatgtgatcttatagggaaaaatgagttctccccagaagaggatgcacatgttattggtgactgcatcaaggtaatctttttttgccaaacgttgactacatagtgacaacatagagttaccacattcttcagtaacatatcttcagttcttctttgctacagtatgttcttcgagagatgccttcatctccagttcctgcaccatgttgcactgcactggttggagcttaccgtaagattgacttcaatttttctttatatattacttcttttttcgccgggccggcgtaagatacgcggccgaagtttattaagattgagaagaggttcaaactagtacaacagatacagctgccatggaggctaagagctgtacaaccgctattgttacaacgatgcacattactttacagcaaaaacaggcactctaagccacaactccggctaaaaacaccatccacattactttatatattacttcaacaatcaatcaatgtagtcttgcatttaactgatgcataagtaaatcttctaaagtcagctcagcgcatgcccttaacctgaaaacatgctgatgttcctaggattacaaactgatatagacgtgtgattgtacaggaactg

SEQ ID NO: 43534 - DNA, 1509 bp, Oryza sativa
  unsure (1)..(1509): unsure at all n locations
nnnnnnnnnnnnnnnnnnnnnnnnnnnnnnnnnnnnnnnnnnnnnnnnnnnnnnnncaagtatccagctatatattatggtattgtgctgttggaagagttccagacatatactttagaagcactgaattatttttccctttgtgattctaccttatctctttgctctcctttttgtctcaataactaactactcctttgatggtggaccaacaatgggaaattgagttttgttagggtaataatgcaaataagtgatattgcttactcttttagcttttacttgtcatcccgcttgtcttcattgcaacaattaaatatatatatcttctgttatgctaatatggtatcaaaagctatagaaggtttttcccattttctcctgccccaacattttcttgaacttcccttccactcccattaggattagtagtggatagaagtgcttgtgaagttaaaataaaagcacacttccataatcattcctggaattttttggttcttccattgcatgattggtgaattttccagttgcttctgtattgtactgtttagagtttgtctcttatctttggttaacatatttaaaaatatcaaatcaagaacagttggaaactttaagagaagatatcaaacagcttttacactgttgttaaattttgagatatttcttttaattcgaaattttcaactaggactcttattgagaagcttgagaacagcaagacagatctccaatctaaaattactaaggaggtacagacttttccctggaatcaatgagagattctgtagcattaaatacttacacatgaggtgatgtgctgtctatttcaggcgaaagaaaattcaatcctacaagcaagtctcgaaagaaggaaagtagaattgcataaacgccgattagcactcgaaaaaaagtaagagctcaaactatgggaaaagtattatatttttttctagaaagagaacgcccaggtagattttatgatttagtctctacatccataagaaatccttaaatctatgtcaagcacaccagaaattttatacatcttaatatctgcctgaaacatgcattctctgttcactgttaaacaagaaaatgtttttgctgtttctgcactcaacaggtggaaaatttgcgagatcagctacagaaggagagaaatttgagggtctcattggagtcagggctgatgaatttgcgaagagggcaggcgtccttcccatcaacaattgacaacaaggttttctttttaaaattttattattgagttaaagtgcaagtgttttttcaccatttgaaaaaaaaattgttctgctaataaaagactaaggctgatcttgaggaagttgctactgctgaagctgatattttgaacttgaaacaaaagggttctgatctccgtggacaactcaacaaccaggtccagatgagctccgcctcattatgtgactcatgcaacaaacgactgctaaatacagacaagctaaccgagtaaggatt

SEQ ID NO: 43535 - DNA, 3256 bp, Oryza sativa
catctcttgtgctgtctccttgtcatccattacaaatcttccaagccttccttccaataattcaatcttggcctcacgaacggcgggacatccctcatgagccaattgcaaagtatcccatatctccttggcctcctctagtcatcaaccttgttgaactcctccggattcaaggcggagagaattgcattggaagcttgagcattgcggtagatgagttgttcttgctccgaagtgagctccatgtcatcatggggtatacaatacctgtacaaacaattttccaaatacttggatgcaaagagattagatgcaacttcatcttgtgcttccaagcggcataatatgtcccatcaaattgaggagcacgcctagaaggcatggagacgaagttgtgagagggaatagtaagtttgctgtaatcaaaaggtatagtagctcccttgggtggtggagttcccttgctgcttgcttcatcttcatttccattttccccgttctttccccctaagtctgacatcgtggatcactcaaagcggtgaagcttgaatcaagagcaccttgctctgataccaattgaatgatcagagatgtagcctagagggggggtgaataggctttcctgaaattttctcaacaatcgtagcggttaaattgacagggcccggaacctcctggtgatgaacaccggaacttccgggcaggatgagtagcctggaacttccggagttcttgagccaggaacttccgggcagcagagataaattaaaacagagatgaaaaacaggtcctagcaagagaagtttaggcacacagaggaacaagatgaagattgcagaatatcagcagattcacacaaagatcatgcacaagagagacaaagacgattttttcccgaagttcggatcacatgaatcctactctctgttgaggtgctccaaagaagccgggtctcgattaaccccttgcctcacttatgcaaagatcccagaagaggtccacaaccttgaactcaacacttttaagtcattttctagaattgagtgaccaccaagatccaactcaaaatttcttctacaaaaaaccacaagtgcaagttgctctacctaagacaacctctgaaaactcagcacaagaatctttactcacttacacttgttacttgcggaggtgaggaaaaccttcacaaacttttccgggacatccacaagatctttagaagctcacgggcgacacctaaccgtctagaagaagatctccaagagtaataggcccaagtgacaacccacaaggtatccaaagtgctcaatcagacttaatcttcaagccatctccaaaacactcctactctctcatctaatctctcaatctcacaagataggctctagatttgagtggaggaaagtaaaggaagcttgggagtggctagaaaaccctagaacaagaatgaacagaagtggaatggccaaagggtgacctggggatgaaatccatatatataacgactaggtgacgtcatctagccgttactcacaagtttgacctgaaaacttgccaggaggttccgggcaaaagtgccaggaacttttgggcagtacttaggaaattttttgcaaataaacggcgcccggaagtttcggccagaacctccgggtagccctctctgtcccgaggagaaaatcatttttcaaaaatgattccaaaaatattttgactcaccgatattattttgactcactttgtataccctagaaccacacttgaaacccctcttaatagtacggtttttttctaaactcaatttcgaaagtgaaaaacctagtctaatcaccttcggtgttttttgcacttaggaacattcaaattggggggtctccttgcattcttagccatcacaactcgctttgggactaaactcctatgaataaacttgataaacatgttagtcctctttaaccaccttgtcattaatcaccaaaacccactagggggtttaagtgcatcttcaatctccccctttttggtgattgatgacaacatggttaaagcacacaaaaagataatagaatttaaattttgaatgatgagagaagtgtgaagctccccctaaagatatgcatataaagaacttgaaatgaaaacattatgcataagatgaaggaaagctcaaaagaaacttcacactgccctcatcaaataagagatgtagatgaaagtgcttgaatgatgagtgatgcaaaaagaaagactagatgacatggcaatcactcaaaaaagatgaaaagaacacaacatcacatcaaaatgcaacatccatatggtctaacttactgacataaaggataataaagcatctaacagacattacatccaaccaaaatagaatacgattacatgtccatatagagagagataatagagaggaaatctgcctggccggaacctccagatcataggacccggaacttccggtcaaatgaccagacaacagtcaaggcagcaaaaaggataaggatttaaatgacccccttcaattcacaatttctccccctttggcatcaaggcaccaaaaaggcgagaaactatgaagagaagaagatgatcactcatctccatcagagggaacaatctctgtatcgccggagagatgagactcatcggactgagcagcggtgtcaccctcatcaacatcagtgggagcatcctcagcagctgcctcggtgtcaccctcatcaccatcatcatcatcatcatcatcatcaacagaatgggaagattcttcattgaagaaggtggatggaccttcaacggcaacgttgctggctgcctcataagcttcaaatggatcaacatagacctcatcctcagaatcatctaacacttctttcccagcctctcttctatcttccttctgacgcctttctatctttttcactttcttggcagtcttagcacacatacagaaaaattgcctgaagtgccttcttgatgggagaagaactcgaggaacttggtggggcactagtagaaggaccagctgaagtagaaggaacagatcgagggaccactggagaaaaggaaggtggagcacgagggcgaaaagaattatggtgcccatctttgatgtagaataccccggtgactgtctcaatcatctttataataaaaggagcatagatgcacccccgctaaggctcaagaatggtgttggggatctcataccaaatcaatttcatcacactgaagggaggctgat

SEQ ID NO: 43536 - DNA, 2745 bp, Oryza sativa
agaggtgtacatctttacccacaagacacatcttcctcacgtgtaaccacgtgccacataccaccacggtatacggacggaagacgtgacatagtttccaacccatcctagccttagacaagagtaccgacccaatcccgcctacggccggaacccccgggacaggcagacggaactgagcccctcgcagcagggcaccaaccctgtgctttttgacatctcgactaccgggccgcagctcgtgtagccttcatttgccttggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatacggccgaggtgctaccatcaaaaccatgcaccccgagcccagcctaaaaccattttaggggattttgaatagagggggcggtgtgaagccaattccacagtaagccaacaattccagagtgtccaggtgatatgaatatttcccaagtctaaagttataaaaccacctaaggttacctaattaaagcgaagcatctacctaaaattatactagggataccatgagtagagtgtccactagttgaggggttttgtttgtctagggtgaacaaggtagtaataacaacaataacaataataatatggtcataacaaaggtaaataggcatggctaaataaaacagtgataacgcgggaatttaaataaagcgataatgcaataatttaaatcaacataattttataaaatgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttgcgaatttcttcatttaattttcaattaaaaatcctatttattgcgtcagccgaaggaacggggcgcgctgtcgcgaccgggaaaattgccttttcccgaacgctagtgtattaatccccgtcccaggaaaagccggggtacaccacacaaacatgatataaaagacacatctttattatatcgacaatatttacattattacaaaggcgcttcaggcctgacaatcaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggcggatgcataattaatgcaagggaggtacaagggaataataatatagggattaagttttgcagtaaacagcatttaaaagtcacttagttgcccaaagccattttgtaaagacgatcctagagctacacagtattattaaacaaggccgtgaaccctcacgaacctgccttaacccaaggcctacgatgatttggaccgaactggcaacccgacttgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatcttcctcacgtgcaaacacgtgccacataccaccacggtatacggaccgaagacgtgacatagttcccaacccatcctagccataaacaagagtaccgacccaatcccacctacggccgggatacccgggacaggcaggcagaactgagcccctagcagcagggcaccaaccctctgccatatgacatctcgactaccgggccgcagctcgtgtagccttcatttgtcctggagaatgtccatcgacacccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaacataagccaaccattccatagtgtccaaatgatatgagaattcccaaagtctaaagttgtaaaaccacctaatgttgtcctattaatcagcgaagcatctacctaaattcatactagtggaaccataaatagagtgtccactagttggggttttgtttattctagggtgaacaaggtaataataacaatagcaataataatgtcataacaaaggtaaataggcatggctaaataaaacagtgataacgcgggaatttaaataaagggcgataatgccaataattttaaatcacacataattttacaaactgggattcaatatgttcaaggatgatgtgacttgccttgctcgctttcccaaacacc

SEQ ID NO: 43537 - DNA, 1523 bp, Oryza sativa
caattcctacgttgagtttaaacgggtggttacgtggcaatatggtcagccagataaataaaaaataatggaaaaaaaattgagctccatatgtcaatcagcaaaatagacccacgtgaccccacctctttctctctctcctcttgccctctcagcacactgctcgagccgacgacagcgctcctcaaagtctagctgccccagacgcgaccacatggtccttccttcacctgcgtggccttctctgccgggactgccgggagtatgtgtcgtaattataaatctgaaaagatgtgcacttttttaatcacgtttcgtaacaaatattaccagttttgctgtttgtcacttgatattttcacctgacttgtcttctttgctttgaatccttctgttttcctccattttcctctatcctttatcctttttctattcctgaataaatcgtggaatccaccgagtactttgaataaatcgtggaatccctaatttgtcatcgagtctgatcttcatcctcggtccaaaaaactggatagaacgtatctcctaacttacaaaaccatgcaaacgaggtccctcgatagtattgatctcgggtttagctgacgtggcgtttatatggatcgtttaactaagtcttcgttccacgtggcattgctgtgacgcttacatgtcaattcaatcttgagaaataatacaacccgtagggcccacatgttagttacacacaaaaaaaaatgatggggcccatgtggctcgcatgccatcctccctacccctcctctcaatctcctctctgtccctacaacgaaaacacaggagcgctcgggcggcggagtgggaagggcgacgggcggattggagtggcgacggccagctgagtggagcgagcgacgggcgtagcggagggcggcggctggagcaggccgccggcggaggaaaggggcaacagagggcaagctctcgcttccccacctgcttccctatcatagctgccgccgaagacaacaacaacgagttcgaggaggaggaggacgcgcacctcaccatcaccatcgcggccctcgccgccacattcgccatcctccgagctgctctctgaccttgacagcgtccttgccgtgggcgacaacgggtgagctcccgcttcccacctgcttccccgccattgtggccgttgaagatgacgaagacgatggcgatgggttcgagaaggaggaagaggaggacacaaacttccattgtggagatcggcgccgacagtggattgctgctgcttcgctcgccgccgccttgcttggccctttcggcttcgcgcgccgtagttgctccggctgcagtcaccccactatgcctgccgccgcccagtggacttcttgcaccaccgctcagcttgcttcccatgggacttccatggtgggagacaaggggataggatacagagggggaagaagtggggcccactgacatgtgggtcccattatttttcaatattaatatttgactgacatgtgggcacgcat

SEQ ID NO: 43538 - DNA, 2291 bp, Oryza sativa
  unsure (1)..(2291): unsure at all n locations
nnnnnnnnnnnnnnnnnnnnnnnnnnnnnnnnnnnnnnnnnnnnnnnnnnnnnnncagtacactgcaaatgtgcgttccgttgaaacgttcaacggagtacgtacaaactacaggtccacaaacctgtacttctcaacctgggattcagaaaaccggttgctaaatacggagtaagtaagatctcaacatcactacagtttctgatgtgacacctgcaaattccaatcttgcttttgttgagctaacatatgttcaatgcaacgccatagttccttcgctgccacacatactctctctttgctttcctcctgttgcctgttggacgagatggcaggatcataggattttgttcatcaataccatatgttttagaaatattattttagtagatcatattattggtagaagttggggctttgttccatctcgtccattttatgcttttttctgttcacttctaaatttttttttagctgtgtacctacggacagaggctgaagatataatccatttccaatatataaaaaatgctataagtttagttcgacttaagaattaagctaaggtcgtaagatctatgttcatcaatcgtgaaaaattcattagtgtctcattaccttattgcaattagcttagtcaacttgttacttgcacggggatctgagccagacatcttcttttttgggctacacatggctacctacaattgcaatcaagatgctgacagctgatacaagatgaagaactatactacacacgaataatgaatccatctccttcgatcccaaaactattctgatggcctgatcaagtccaccgccggtaatcgacccaagttggggattgttaattacactaaacaaccagccttgtgcagctagctgagtatgaggcggcaatacgaggaaggaagtgcgtcgtctgagccgtgaggcagagatgagagatggcagaagggtgtggaaggcaaaggtggtgtggaaacactctttgggtggtcttatataaaaaatggcaccaataagatcatcggtaatccgtaatcaaacgcgaataaacaatagatctaaatttaatcacgacatctaaacacgatatttaaaaaggaggctcaaccgaagtgtatattacatatcaatgttatcaataatcctcaactagctaggccgatgggtgtgcctctatatttaagagtgtgtccagaatagaatccgacactaattttactttgcactatgcatattataagtttactgagacgccactcaataaagattattaattgattgagataatcagtagcacggaaaacacaatagtgattagcacatgattaattaaatattaacaaatataaacgtgaaaattgagatattcgattcttaaaagaaaacaacgtagaaagtgtttgaaaaaccgtaccatttaatagtttgaaaagcgtgtgcccacgataaacgagagaagctcccctcaacagcacaaacaaacgaaacctaaggctgtgtttagtttccttcaaacttccacaaattccgtcacatcaaatgtttggacatatgtatggagcaattaatatggacgaaaaaaaaccatttgcacagtttgcatgtaaagtgcgagatgaatcttttgagctaaattacgccatgatttgacaatgtggtgctacagtaaacatttgctaataacggattaattaggtttaataaattcgtctcgcagtttctaaacagaatctgtaatttgttttattattagtctacgtttaatactttaaatgtgcgtccgtatacatcaaaaaaagatttggaggaggaactaaacacggcctaagtcctactcccttcgtcccatttgagtgaagcctgcccaacttttatcttctgtcttatttgaattttttttgaaaaaattaaaaacataagtcacacataaagtactattcgcgttttatcatctcatagcaacaaaaatactaattataaaaattttcaaataaaacggacgacttaagttgggcatggaaactcatggttgtatttaaaatgggacggagggagtactttataactaactttgtatacatatatttgacaagaactctaatggatggagctagtccggtctagtttttccggactaccttatatataaattattgtttttaatattcgcacgtaatgttggttccacaatattaatacaagtgatatccgatggacgatagtttcttaacatgcatctgcccgttgacagtgggcgcggatagccaacctcatgtggatcc

SEQ ID NO: 43539 - DNA, 1149 bp, Oryza sativa
  unsure (1)..(1149): unsure at all n locations
nnnnnnnnnnnnnnnnnnnnnnnnnnnnnnnnnnnnnnnnnnnnnnnnnnnnnnnnnnactcccacccggaggtttcgcccggtttgtccggatgttccgggtccctggcagctcacaagaccagtcacctcacttgcttgtggagctttaccttctcgcacaaacatcaagcattctttcccatttaccatcacacgcttagacacaggacttctacccgaaaacccgaacccgtgtccatccttgttaggatgagcggtgatggtcttgtaaagggcatcttttgaatggtatgtcttgatgcatccatatttcaccaaagtgcacaacttttcattctctttcttaagagcttgcatagcatcaatattagtagcataagagttcaaatcaatattgtaacacctagcacaccattgctagtagaagggttagaagaattagaaaccacatttggttgagaggtgctattccaaagagtgtcaaattgaacttcaagatctttatgacttttgtctaaattagcaaatttttcttgaagagtttcattaacatccctaaggctagctaaagaaccattagccaaattaagctcattagcaagttgtttatttttagcacattctttagctaagctctcctctaagacaaggtttctttttttctcaagaataagcaattcttcttgcctttcgagtgattgttctttactatccaaagctctcattaacttagccaaatgttgcatagcgggtttgctaaagctcttaagcacatcatctaattcattatcactttcctcatcactagaatcaacatcaagagaagtttgagagggcttttgagtcatcaccttgcggccttgggccatgaagcaagagtagtggtaggagtcgtcgtcgtcatcactcaagttgttgaagagacgctccttgcttgaagaggatgatttgaaggcgacggtagcaacaccaccttctccttcaaccttgtcttttgacttgggcttgggcttgacctcgggatcttcttcatctccgaagtaccacacttccgccatgtgtgcctccgccacatgagcacgctccggcttcttcttgcctcccttagcgttagcttcatttgacttgggacaatcggcaatgaag

SEQ ID NO: 43540 - DNA, 1479 bp, Oryza sativa
attggtcattgctggaagaacatatgactggaattgcccctgatagcttgtcaggaatggctcatttcccacagcaatgtacctgtttaaattagggacaagtataagaaaatgaataaagtaaagtcataaacaaatttagcagaggaagaaagtaagcaacataacagatttcggagaaaagaaagaaaattctcaagcaagtaaaaacagctcgaatagacatccataggaatataggtacaacaaaaaaaaattaagcacataaattaacttcccagcaaatattctgaaataaaggattctctagcctgtaatttaacccatactcaacattagtatttttttttagaaaagcatgcattttatgttgctttccactcggttcacacttcacagtcctaccaggctgaccaccttaaatgaaaacaaaaattatgttccatgatcacaacaatccattctatgtcattggtttacaatataccaccgacaaagcttaattctacaatataccatcaaacaattcgttttcttccttatataccatcaccgttagtcaaacgccgttaagggaaggaaaatgacaattttacccctaggataaaattgagattttgcacaatgccatatcacatcaaatagtcttacatgataaaaagacatgctgtttctatttttcatcaatgagaaaaaatagtggatcatgaccaataaaatccacatgtagcatgatatcctaggtgtaaaatagatattttctctcccttaacggagtttgactaatggttgactagtggcgatgacatataagaaagaaaacaagttgttggatggtatattattgaactaagttttgtcagtggcatattgtaaaattcatgctttgacgatggcatagaatggattatctcatgatcaaatcatttgatcgttgctgggatgacccatttggttactccgattaaaacttcatgaaatagagaaacagtacatattcaatagttcatctattcaatacctacaaaagaaattgtttcaacaaaaatgtagtcatgtaaatgcagccaactgctgtgtgttctgaaattgagcaaacaaatgcaggcatgtccacagaaaacaacaaaaacataaacagtacccaagtccctctctcatccctagcagccgtgccgctcagctatcctcccagcggtgtttaccccctatgcaacccataacaaacatagtagaagattaatcatgccaaatgatcgggttagaacatataagcttgactcagcaactgtccaattcgagagacaagtgacaacaagtgatgcaacggtaagcccttgccagttaccagatatagagagtaagagagtagtaagaaccactttcctgtttatatgtcagataaatatgtttaaaacctttccttgctttaatatttggtatttggaaattatttgcttcctctcaccagctttgcag

SEQ ID NO: 43541 - DNA, 21851 bp, Oryza sativa; identical to SEQ ID NO: 41253
  unsure (1)..(21851): unsure at all n locations

SEQ ID NO: 43542 - DNA, 1711 bp, Oryza sativa
acccggttaaaattttcttgccccgtggggtcccctggccccacccttctgaactcgtccttcttcttacgcataaccgcagcaggcacgaagttctcgcgaaatgctgcagtgaactcttcccaagtgggttctccagcatcctcttcccgagcttccttgtaagtatcccaccaatcaccagcgggtccctccagttggtttactgcgaagatcactttgtcggcttcgcgcacccggataagggtcagtttcttctctatgatacgtagccaatcttctgcctccataggctcgtctgtcgtagtgaacgtgggtggcttggtgctcataaactctccaaagcttgatccttcgtggttgccttgattgtttgcaatggcttgcagaagttgggtttgagtggccataactccggccagggtggttaggtcaggtgtctgggtttcatcattgctggttgacgcccgacgtcggcttgccatctgtgtaggtcgattgagtaagtatcctaatctcctaactggctcttatggttttatctctttaagggaattgtcttgatgtgaactttgttttgcaagcatggtggaataaactcatttacaacacaacagcaataatatcataaataacatcacagagttccacaaatagtacataaatcgtgatgcaatcgactgcacacatacgcagtccaaataaggttcatccaaaagatacattgaactaatcatcaaactactcgtcgatctaggtaagggggggtgtctcgcatgctatccaaaaaccatatgaagcgagatcgaagctgcaaatagtcctccagtctagtcatccaaccatccgcaggatcctggggcaggtagagggtggttgctggcacgggcaaacctgagtccccacggcttggaggtagtggcctctggatctggcttgggcttcttgcccggggatcgggtgctcttgcgggcaatgctgagggtgtgagggcctccgatgaaggtgatgcggggaacaggggtctcatcctctgaaggatcagtgatgtctggctcgatctctggctcggtgtcggtcccctctgtctcggagtcgacctggatcggagtctccatactggaacccagctgtggtgacggggtagggaccagtggggtgtgcacaatctctggtgcaggtggctgtgtcactgtcgtgtccactaggtagggtgctgacttagtagctagcatgccaatctctcccagaagagtgtggaatgcgggtggatatggcgggtgaggaagaagtagcggtcacgccctactgctgtggaagtagaagctcctggggtgctgaccgtggctgctggaagctgctcctccagctggctgacgggctcctgactctctctcagctgctcctcaagtgtattcatcatcccggggcgattgttgtactgataagataccggctggaactggtcgccgtggacctgaagctgggccttcagtgagtctatctcactgccccaagcctggtgcacctcccctagctgaagctgttgcactgtgaggtcagtcacctcggtctccaactctcccacaggcctctgtagtcgtcgatctctaacagagcctcctcgtagaagtcgtctactgcctcagcccatcgtgacagtcgagtcactatcgggttgtagcagcaaggtgtgtcctgaactgtgcag

SEQ ID NO: 43543 - DNA, 1049 bp, Oryza sativa; identical to SEQ ID NO: 41254

SEQ ID NO: 43544 - DNA, 835 bp, Oryza sativa; identical to SEQ ID NO: 41260

SEQ ID NO: 43545 - DNA, 8214 bp, Oryza sativa
taggtgacactatagaatactcaagcttggggcccaataggagcattctgggtaccattgtcagaccagactccgtgctcctagaccggaaaggctggaacaaggacgctacaatacctgacatgttaacagaaccctgggaaccattaccccgtcagtttgatagcgataatgatgcagtctataattggcatgtgatagatgatgaaccactgcccaggaatactcgatcctcatcggaggacacaaggccatcacctacacaaaaaaggaagtcttccaaaccaaaacagagatcgcggaaaaaggccaaggctgattcttcgagtggtaacaatgctgaaaatggtttcaagcgggggaaaggattagcacaatgtgatagatcgcatcaaagtgcaggaagcagcagacggagcaaagggccgagagagtatgacagatttacaaataccctcccacaatatactcagcacattagtaggtggtgactttaggctgttactgatagcatttacagtacagttcgggattgggagatcccacgaggttttgacaggcagaatggcgccttggcagacgtcgaagttcaagcagctttctgtagccatatgtatgatttattatttatttgtttgtctaaggttattcggtcctttgtaacgccgatgaaaccgatatattcagttatattatcatcgtatgaactgcaatttcgccaacttgtctatggcaaagtttcagactattaaaaattatctttggctggaacgtgaattcataattcataacaagacgtcacttcggtgacatccgataaaaataattcataacaagacgccttgaaaggtttaagttttattaaacgaaagaggaacataatttagattgtcgcagctaccaatcacactaaatacatgattggaagttaaataaaatcaagcttatagtcgaatgaaataaaaaggttccaccttcttttcccagtttagaactgaacaagtaaacagctttgtttaccgttaccacaacgacactgcaagcttaatacagctagctaccgtcttttactcgtctttcttctgtgcgaatcctgggggaaaggactccagccttttctattccgctcaaaagaataaggaaatataacgagaattgtatatgaggaatacaggataatcagctatcaagcactttgtgttcaaatatcaagcctcttatacctctgctctattttcctttcgagagctgctcctatgttttttccatagtataacggaaaaaaaaggtcaatcaacaatatgacaggttaaataaacattgaaagtaaaaatgcaaaacaaaagaagctaataaaccgatattgtaaggccacccaacaaacagctgacaggatcaagatggtgtaaactcgtcaaatatattcataccgcaaagacataagtttaccaggttacaagcaggtatgtccattaaaagtgaggacatatgctagcatcatcacttaactaatctaccattcttattcagattgacccttcagctgaaaaaaagtagaaggatttgcaccaatctgctggctaattaaaaaaaaaggaagccagattgaagtggccttatggagagctgataagcttccagtccatattagaagtggagatcctttgtgagaccagtgaaacatctcaatatgactggttcattctgcactaacctgaccattctcgtggggatgtaacattgctacctgcattgagcttatcagccatggcaacagagtctgcaggttgggctgcagttaccactgggagagctacgctctcaactcgatcccgtggataccctaccacactagctgtttcaaacatatttccaaatggctgattatgcacgacttgtggtcccaaatgatgaaatgccatcggaccactcgctggatgctgaggcagaacagcaacaacagtagcagcacagttagaaggattcttgaatgtggcgctgtaggattggccactaccttgaacggcataggatgccacactacagtggttgggcttgcttggttgaggtgggcatgagctcaggccgtgttgctgcaatggttgtggctgctgatgctggatgttaaggtctgtcgatggaagcaaaactgtattgccttggccataaaaagaaggcatggcttcatgatgcttctgctgaggtgaagagtatggcgagtgcacaaccatgtttctcagaagtggctccgttgtagcactggcaggcttctgagaagagtatggaggatacaagacagcgacttgaggagcactttgagcctgaggagatgatgtttgctgttgaactagctgtggtggaacttgctgaatattgtattgctgcggttgcaccacaaggggctgtgttcgccatgcttgtgactcaacctgctgagcaggcagatgtagcctttggtcctggggttgagggtacaattctgtcacctggctagatttctgagataggtcaactgcaaccctggcttcaggattctggatttgtgactgaataacatgtaccgcggattctgatggttcactctctgtgcacttaataggattttggctttgcatataatacacggcagcttgactcggctgctgctgatctggttgtgtgctcaaagagacaggcactagttgctgcaaaatataaccattgctgctttggactggcacagcaggagattgcattgcattaacttgctgaagtggcatgaaagcaacctcatgttttgcaacttgtgtgctgtgatcattttcccttccgaatgttgagaaagcagaggcttcatttgctctagcagggaactcatgcgctatttgaagtttggagaactcgttcggtgtctctgaaatctcatgcttatcctgcagaatctgcacagatttttgaacctgttcgccagaagaaaagatttcagtgtgttacaaaatgatctgaatctcacgagaacagcaagtcgttgaatccattgaattcaatcgtaacaacttgtgaaaaaaattgcactgactccttaagcacgagtgaaaaaagaaacaaattttgaaacgtaaatggcactgttaacaactacaaccacaagctcaagcttcaaatctgaacattgcatcaaaaagttgcaagccatggattaattaattaatttttaaacagctttattactttaccgtgcgagatggatcaatgcgagtaattcgaaaacatcgaacagtttgggtgcaagtaattccgttgaccgtgcaagaacgtgcatggatctagagccagagcacccacctgcctcagattcttctccaggcaccggaagttgaccgtcccctcgctgtggtaatccatgacgtcgctgcgcagctccccgatggacctctcgagcttgtagcagtagagctccagctgcgacaggcggccgccgattccctcgagcgaatgcagcaagccctcggcctgcttcttcatgcactcctccacggccgccatgaccgcctccttggtgtagttctcctgcccaccgtacacgttcacgaacgtcctcaccatcctcttctcctgctgcaaatcctgcccccattcccccccaaacacacacgcacagcatcatcagaaaccccggacaacacagtcgggaaaccggaaaagctttcggggctcctgctacctccgggcggcggcgcgactggtcgaaggagcagcgggcggcggcggggtcggcggggaggccgaacgcgccggagacggaggcggcggcggggcgcgcgggggacgccatggtcggcgcgggcgggaggtagctagggtttttggcctggcgggaggagacgagacggtggaggtggaggaggagggagtcaggaatccgaggcggaggaaggggcgaggaaagtgagaaccgagctgggcgcggggcgcagtgtggctcactggctgtctctgtggagtggaagccaagcaccaaaaagcagagcaggagtagtagttgtagtaaaacagagagagagagagagagagagagagagaggggtaatcagatccggtgaaaaataaaaagtgtaaagtaaagagaagcggaagcagaggagggaagcaaagcggaaggggttggttcgccgggttcgaggcgtttgggaggaataaaaatgggggcggaacggaacgcgtgggttggtggggttgtgtggactcccggggctcccgttgcacgagacgagagagagacccacttggggcgtcgaaatccgcggttgtctccccgtgagatccatgggattcagtggcagacgccactctcctacggtcgcttgttcgcagcctcgctccgcggcctccgcccgtcgacaggtcgagccgggagttcccgcgcggtttggggttgggtttggattgggtcggctgcggtgcggcgtcactatcctcctgaaccatgtgcgcgattagaaaacagcgggtagcgtgcgtgcagcgtccgcgctccgtgtcatgcatcgcgcgggtgtgtaactgtgtatgggcaacgacgtgatgtctacgtaccgagcggtcgtctcccatcggtgtcgagatggttggggaggtgtgttgtggcttgtgggtggcaggtgggacacatccacgactccaccgccgttcactcggtgcacgtttggcacaagcacaacccaaggcgcaggtcgatctcgcaatctgccgagccgatgatggttgcctgccgatcgaggaccgtggccagattctccccgtaggcccatccatccaccgagataagggtaatgacgagagggacgcaatcgtctgtacgagtacaagggaggggaggatagcggcggtgcggcaagtgttgtggggaggcgacaaggaggcaaggacggaaccggataaggccgacccaagtcaagttgcgattatgttgatagtagttgggttttttttacgctctcgccaaacccagtatgctccttccgtttcgtatgattttcttttctaatcaaattttattaagtttgactaaatttatagaaataactaacgatattaaacaccaaattaattttattaaatctagcattgaatatattttaataatatgtttattttgtgtaaaaaatactacaatatttttttataaacttagttcaacataaagaaattcgattaagaaaaaaaatcaaaataacatatataatataaaatgtagggaatacttgataagccgtaggcatcgtgaggtacgttgagtggagtttgtgcgtctacattgtacggagtatacttgcctagtatacaaacaatgcttttttttaagtaaatgtaagttaattggttagaatttttatggtgtaattagactacccgaatttaaatcctagatttatcacgagcgactgcatttgtggctaattattatttcagacactcgttaccagttaggcgaccgtaatgattttgtcaatttcaagatatattggtctagttttctggagatactcgtaggggtcaggtgcgcgtgtgtacgcacgttataagctcctgtgttactaagggaccaaaacattcaaattttttcatcctttagatccaacaccgacatcattgctagcaaacccacggagagtagaaatataataaggattatcccaaaaattaggcaaacaataggggtctaatggtgtagctacacactatacttactttgtaaggggggtttagatctaagggtgtaaagttttggcgtgtcacatcgggtattatatatggtgtcgtatggggtgttctagcactaataaaaaaactaattacagaatacgtccgtaaaccgtgagatgaatttattaaacctaattaatctattattagtaaatgtttagtgtaacaccacattgtcaaatcatagagcaattaggcttaaaaaattcgtctcgcaaattagtcgtaatctatgcaattagtttttttagcctatatttaatactttatgtaggtgttcaaacgttcgatgtgatagggtgaaaatttttggggtgggatataaatagggcctaaataccatgtatgtgttatacatcaatacaagcgctgaattagtggttaggacgggatcgccacatgtcttccacacaattttctgttattttcttccatctagcgcacacttatcatgaatccaatgacttaaaaatcgttagtctcaaattttataacaattccgttaggatgatttccctcacaccatggtcaataacattcgtccgtttcattttggatgtggatttggatcctacgatttaaatgagactggcggagccgaggcctggctaggatgggcaggtgcccgagctcaagccatgcagcaaggcgtagcacctgctgctgattctattgcctattttatgcaccagaccaccagtaattaaacaatagataattgagatgaatattccctccgtcctagaatataaaaagttttagagttagacacgattattaagaaagtagatagaagtgggtggtggagggttgtgattgtatgagtagtgtagatatgtgagaaaagtgaatggtggaggattgtgattggttgggaagagaatgttggtggagacgttgttatattttgagacaaatactaagagttaaaagttatttattttggaacggatggagcactaagtaattaattatcattcttagacatcagcagagccatatgcatgtagacaggtgacactagcagcagccgtgtacagtaatattaatgaacatgcttaaccaaaactagcaaattaccaaagtgccatcatttttttctttgcatgataatacaattaagccctataatcttgtgtactattttttctcaacctaaattagaacatgtcgtttgtcaattttacttgagtctatggtaagtgacatacagatttatacaaatatgtgggtacttttattcgttgttaggcttgctcaggattaagaaaattcatggcactacgccatatcctcacacttttgatggcatatctgtgacgggcttcagcactagtcagtgatgagggttacctttgatgggtcctacgggacgccgtcatcggtgaggcatccttctgcaaccctctgatggcttccacttccagcccgtcacaggtgactagttacctatgacgggttgcatccttatggaccgtcaaaggtgaggttaactcacctcaaacggccctgtcactagagcccgtcataggtgggggaggggggagttgactagggttggactaatgttatatcctctctctcccttatccacactctttctcactcactctccctctcggcttatggcggcggtagaggacccgacggccctcgggcgagccggcggcggtggttcggtggcgtgtggcggcaacggtggtgccccatcctcctcccccttctttctccctctcccccttctcttatttctcgatccggtttttcttgaagtagcaatggcaaggaggtgttgacgatgtgcggcggctcgatgcagcggtgaggagggctcgacggcgtgcgctggcgaggaggaggtgagcggcggtgccgcggcctccatccccgaccgccagtggccaccgcctctgtcccccgaccgtcgggcgccggatccacgtcccccagcctaatggaggacgaatccgtccaccgggcgccatctcctccaaccgccaagcactgccacctccatcccgccgggtgccagatccgtcctccacaaggtcatgggacgcagatccggccaccgagcgtcgtctcgttcatccccgtgctctggccgccgcctccagtcaccgggcgacacatctgccaaccgctaggtgctgccaaccgctaggtgttgtctcctccatccccagtaaccggctgccgcttccaaccaccgcctcctccgagctcctcggcatcaccgtgccattcttcttagtctcaggtcgtcgaggccatcaaggatttttcaagtgttttatatgatttgattttagatattgcaagtgtaaattggaggggtggatgactgattataaaagaaactcttttgtgattgtttttcttggagaggtagatgactgattgcttttcttcttaaaatttcatggatctaaccgatttcagctgggcactatttttgttttttctagg

SEQ ID NO: 43546 - DNA, 9782 bp, Oryza sativa
aggtgagagtttagggccgttatagatgatatgatccggcgtagtgtggatccgccgctcagacaaagttagaggggtacaatactaccatctctgtttcacattataagaaacattataagatattttaggttttaaatatattcatgaacgaaactatgtgtgtgtcgatccatgtatgtgttttatatatgatgttttatatatgcgtctaaattcatatgtatgaaggagccaaaacatgaatggaaggaatgggagataagtttcctatgaacatattcacactaaacaaacaagaacgattcgttgtaatacccgatatagtgaattttcgtagcatttatacttctattacattattatcaattgcaaatcacggtaggtcgtgaagccaagattttgagttgatgggctcatggctttcactagtactagtgtcatatttaaggggactctaactcctagcatttatagctcaaaattcttttgtagctagagcagtgtgtaaggtaggattgtttcattttactaaaagtaattttttaaactctttattctacaagacattagggatttttaaaaggtccaaaaatataagagttagaaccatataaattgagcctaacaacaatgcattcttttggacataaaagcaagttacggaagttgtttactgcctcctccatttcaaatgcaactacctatccaagatgtttttcattccattatctaaaaaaatgcaactacctatgcccttatttttttaagagatcggttaagatagagtggtattgaagaagtagttgtattttaagataaatttaagtaatagaaatagctatattttaagatagagtaaatagcttaaaaaaacacagctaacatttagtttgagtagcagaactattggcctaatgcattaattgatacacacaccacatagctaaaatagatcattaacggatcaaaatgttaaattgtggcattggcattagtggtgctgtggtgggttgacagtagcataataaagctaatgaattgcgcttccatagaaagaacctactatggccctgttgagatcccattctaaaatttttttatcctgttacatctaatgtttgaacacttatattaagtagtaaatataggctaaaaaataactaattacatagattgtgactaatttgcgagacgaatcttttaagcctcattgctacatgattttgataatatgttgctacagtaaacatttgctaatgacgaattaattaggcttaataaattcgtctttcggtttattgacaaattctgtaattagtttttttatagtgtccgaacacccatacgacatcctatataatacatgatgtgacgcgccaaaactttacacacctacatctaaacaccccctatattgttttatcttttatcagctctaacatattagctatctgaccggggtcatcgagctttgtctgcggggtcattagctacaaaatactccctccattccaaaatgtttgacgccattgactttttaaaaaatgtttgaccgttcgtcttattcaaaaaatttaagtaattattaattcttttcctatcatttgatttattgttaaatatagttttatgtatatatatagttttacacatttcacaaaagtttttgaataagacgaatggtcagacatgtttaaaaaagtcaacggtgtcaaatatttagggaagaagggagtactaagtgattcatttggttggttgaatgccaccggggtcatctgacccggtgatattattgtggctctgtccataggtctttctagacggactaaagtaaagtgtcgttgccaactcgttgcttgttaatttgctcttgtatctttgtttagcctatgcgatatttagttggctctcgcgtgttttgaagatatggagatgttgcttaggttttaaccttatcacttgtcttgaattattaggatatactccctttgtcacatttaaccgatgtattacagtcatgcagtgagaccaagacgaagggattctctattattagtaattaaagcccatatcatagaagcccaattgtttgctctggtttcttgcatgtgaaacaaaagagaaaggggcatcccatttttatttgagagaatctattatataccactgagtttgttcgagttcaataatttttcattgacattgtctctttctataatacaccggtgactttattaattgttctacaatatgccattggactgaacattctttttaaaaatacccaaaatacccttagagatatataagattaacaattgatttatctcattagaagtttcaaaaaaatatgaaaacttttatgtggcctccttacacaacatgaaaatttgtacagaagtttcaagtattttttacatttctattttttataaaaaaatataacttatctgttatatgctacataaaatactcgtctattgttttttaatataaatcatctttcatacactacataagatatttttgtgctattatctcttttattagcaaattctctcttatataccacataaaattatttttttttcaaaaaactaaatataccagaaaaaacttaaaacttgtatacaaatttccatgttgtgtaaggaggccacataaaaattttcatatttttgtgaatcttctgatgagataaatcaattattaatcttatactccctccgtcccatgatataagggattttcagtttttacttacaacgtttgatcactcgtcttattcaaattttttctgcaaatataaaaaaacgaaaagttgtgcttaaagtactgtagataataaagtaagtcacaaataaaataattaataattttaaaatgttatgaataagacgagtggtcaaacgttgcaagtaaaaactcaaaatctcttatattatgggacagagggaatatgtctctaagggtattttgggtatttttgaaaagaatgttcagtccaatagcgtattgtataacaattgataaagtcgccaatatattatagaaagagacaatgtcaatagcaaatattgaacttgaaccaactaaatgttatagaatagattctctctttttatttaaccagcagcttacacgtgaactgaatggccaacgcctccttgcatacatgtgaattcattaaatcaatatgtaaccaaatagccatgcgttccacataagactaatgcgttgatttcttttaaacacttcatttttcataggcgtcgatcaaacatggacaacagatgaagtatggtagccctagtaattaaaaccttgtagtatatttattgccccacgcataagcataccactactctgtcatatccaaatagtagcactctgggatataatcgggcaccagaccaatgccttcacgttgtcggtgttattattaaagtaaaactagctgggtggtccgcacaattgcgcggctaacacccaaataaaatcatatatttttttaagtatgatttcacttaaaatttattaaataactatcttattgccttaagactttgaaagaccaaatcttatcatcctcgtgtttctaattatataatttttaaaagtcacaccagttgctacctcttatgtcatctccttctttatttgcttactcgatctactattatttctatccattctttttggaacctttaaaaattggaattttatagtttttagagtttattgtcacattgggttttgtttttataatttctagatgtcccgtcaaatgttgtcattatactgctctacggtccgtccactgctcttctctttgttgttattgagattttaaaaatcgaacataattatcatttgggttcatttttactttctagaagtcccaccaaaccaccagcagctttaccattgtactcctctacaactcgcctgctgcctccctttcttattgtcattgagattttaaaatcgtacatgattatcattgatttttttttactttttagaagttacgaacctttaaaaattggacttggagttttattttttttataatttttagaagtcccatcaaacgatgccattatgcccctttacagcctgtccgccggctactcttattggtattgggaatctaaaaattgaacataactatcggtggaattcattttttattttctagaagtcctgtcaaccgtcggcgggtctgcaactatactgttatacaccccgcacgctgcttctccttttttttgtcattgagattttaaaagtcgaaataattatcaatggggtttatttcttttacttttagaagtcccggcaaccgtcttacttttttgcttcatggcatgcctgacgtccctccttttaatcgtcattaggattctatttggtgttttattaacaatttttatatgtcgtatcaaccgccaccactctactcctttataggcatgttacttcatttatctcgtcatgtgttttagatggtcttttcttttaatagtctttatttttatcacaaattttagttatttataaattgtattcctaattaaaatcttatttttctttttctaattttagaattttttaaattttagttaatactgtattgtgttcttttaatatttttatttttgattttcaattttagttgtttcaaaattgtattcctatttgaactctcttttaatttttttttctaatattggatattaatttattttttattctgaattttaattaatctcgtattgggttcttatatggatttttttttcaatatttgcttatttttatttccgaatttcagctaattttaaaatgtattcctacttgaactcttcttttattttcttttgctaatttcagatttatttttatttctatttttttaattaatctcgtattaggttcttatatggactcttcttttaatattccttatttttatttctgaatttcagctaattttaaattgtatttctacttggactctcctttccttttctaattttgaattttattttatttttattcttaattttgattaatcttttattgggttcttatatggaaacttctctctattttccttatttttaattccgaatttcagctatttttatattatatttctacttggactctcttttccttttctaattttggattttattttatttttattccgaattttgaataatctcgtattgggttcttatatagaaactttcctcaattttccttatttttaattccgaattttagctatttttaaattgtacttctacttcgactctccttttctttttttttcttcttcgactctccttttcttttttttctttttctctgattaatgtggaaatttctagctgaattttaattaatctcgtattgggttcttatatggatttttttaatatttgcttatttttatttccgaatttcagctaattttaaattgtattcctacttgaactcttcttttattttcttttgctaattttggatttatttttatttctatttttattttgaattttaattaatctcgtattaggttcttatatggactcttcttttaatattccttatttttatttccgaatttcagctaattttaaattgtatttctacttggactctcctttccttttctaattttggattttattttatttttattcttaattttgattaatcttttattgggttcttatatggaaacttctctcaattttccttatttttaattccgaatttcagctatttttaaattatatttctacttagactctattttccttttctaattttgaattttattttatttttattctgaattttgaataatctcgtattgggttcttatatagaaactttcctcaattttccttatttttaattccgaattttagctatttttaaattgtacttttacttggactctccttttctttttttctttttctccgattaatgtggaaatttctagcctccacagcgaacgtggtgcctcctttcaaagctgttttaataatataatagatagataaactcataacttatacgcccaaaattgtttggttattatcaactctcgtatgattaaaaaagttgagaccatgaaaaatatatgttgaagttttggggaaaaaatgtcagcaacaacgtaaaagaatattaagaccatgaaagatcgatacattcgaaatttcagagagagagagagagagagagcatcatagttcaatcgcgtattgggccgtgacaagatcagaacgatctccatatatctgctgaaagaataggaaggacatcatagctcaattgcataatgggccacgacaagatcaaaacaatcttcatatatctacgaccttactatatctatcctaaaatatacgtatcaaaatatagtaatttcagatgaaataagacacgtttaaatttatagtattaaaatatatcttgtttgatctaatattattatgttttcgaaggaaggagtagttttattctcaccattatctaggttccgctatgcctatgcatgcatgagtaggcggtcacgagcgacaccatatgcatcacattctgcatacatatagtatgtggcaacagtcgatgtcactttggatttgtcccactcctacgtacattctccactgaccaacttccgccataaagcccgttatctttcgctagttgtatatataatatcttttaaattctattatatatttttggaagttttggtagctacagtttctcttaaaataaattttttttcttaactaatttagttttcttttatattttgagaaaccgtaattgtagaattcagaaaataaaataaaaaaacgaaaactagtttttttttcgtttctcaccggctgaacttataatctaaaacttcatagaccttttttttcgaacggccactcctcagacctcaaactggctctataagaactctcatgcagcatcagtatgattgagatgtgcactttataaacaaagataataaaaactaaaagagagtttggtaatcaacaaagggctgtatataatgggaaattgggaatgcatttccccttccgattccactcagaggcccagtggacaacgagcgactaaccagctttggcaagtgctgccaataacatttgacccctgacgatcatttgagagatatgaatctaatcatcgtaccacttggcccagaaccattgcacaaattaatcaggtcctaattaagtgcatgtaaagtactaagcaaactggcacggaaccattgcacaattggtgcccctgctcaatttagcaatcccacggacggattgaccactaaaaccggccgtttggcagttgggtgttgaggcagttggtttaatttgcctgcgtaggttgttggtgcatcatactccaacccacttggcttaatggtcgccagcgagatatccgacgcctgctgcggcatgcatattgcatatgcagacggtttcagttctcggcggcgcgcgcgcattggtggccacaccagcgacgatgacaatgtgcgatgcgatggccggtggtggcagacaggacttctgtgcttaattcgctcttataattgctttggttaaacgatttcgttggctttacttcgtctatccatgggcatgccgcatgcggcgtgtcccgctgtttctccgtgatccgtatatatacatagttccatctcttgacgtggcgtttggcagaaaggaacgaccctaccgattggaattaattgtaaatctaaacggtttagtatcgataaaaaataatttataatttaaatttttgtatgtgtgtttttaactacttaaaatccaatattaaaaaactacgttaaaaatatctttaaataaaaattaagtttaaaaacttaaaatttagtactccttccctcccaaaatataacaacttttagttatcaggatttatcctaaaatataataacttctccaccaaaattctcttcccaactaatcacaaccctccaccattcacttttatcatctatctccactactcatccaatcacaaccctccaccactcacttctacctgcttttcaaccctaaaatttcgtatattttaagatgggggaatggcgacaaatacttatatagggtaaacgatgaggacgtaagattccgatggtgctttttggttcgatgtttcatacttgtcagccggcactgaagttgattaatttggttttggtattttactctctttattagttgccctgcttttcttcatgcacgcacgtaatcacttcccatattgagcatatatggccgtatgcacttgttcgtcagagatcgatgatgtaaacgtcagtttcagcaggtgctgctttacaccgcgagaaaggtgctgctttagtaatatttattagtttattcgcatttcacagatgacgtggtagtgcaaatattgtctgacacaattatatatgtgcaagctgctggattattctaagtacaaatggagcacatataggagtactacatactttacatggttgtattccaccacatgtctaaagaggttgaagctctagacttatatatggtacggtacggggctatgccttgagcgtaagccaagtttgagaaattagatagggttctgtgataaacttgtgaggggtgttgtggctgcaccttgtgaacaatatatttgagcaatcaatatcatattcaatcatcatgccatcaacgatctcttccggtttcgtaagttttacttttatgtttggttttggtattaacttgtgattgttcgttttgctgtgattttgttcaagttaatccatcaaaaacctttctaatatttcatagatcagatctggaaagttccgttgattgtttcttgctagattcgaatttgcttaagttttaggttttgttcagatttgctaaaattctgggacaactgactttttagggtgttttctcttaaaccatttattagtttgtaaatccctccggtggagttgttccttggtttgtctaatttcgtctgtcaagtttgcaactcgatacaatggttggtttaagagaaatcatgttttttttaccaaagctctgttgttatgtttttaggctaacggtcagaccgcgagagaacctacggtcagaccgaccctagtaggtcgaatagatcgtaggacgtgtgttccattggtttttgaggtcgggttgtgttttgatttataaagattcgattatttgacttccgctgatgtaatctatcattcacccctttctggtaggcttggttacttgtgttcgatcctacaataacttatttagatttaagtcttaaacttcagattcaagtactagattttataatgataatcttttcatgtttaatttcacaagatagtatatgtactctctatttataccgaaaatctcatactcgaaatgtagcatcatatactcctctccaatttcttccaatctccttcgcgaacaccgacgcttgcacgcacacctcgtgaagcctgctgcgaagatctctcccacgtggtgtccatccaccgtgtgccatctcgtatccaacttcatcacctggtattccgaacgtctggacctcaactcctccctgagtctagtcccaatccccaccgttgaccgaagatgacctccaagaatattgactctagtcaccttttcacatggtattccgaccgcacaaga

SEQ ID NO: 43547 - DNA, 8042 bp, Oryza sativa
aaaccctatccttttaaagggtagaaaatcatatctcaaacacatttttcaaacgtgcccataagctttaaacccttatgctcgcaattaattatacatatattgatatatttttatttgaaattgacactatctgatttgaagttggttcgccgtttcttatgtgttaaaagaggcccactctgtaccatgttcatatgtgtcttcctatgatcatacgcaaaaaaaaaaattatgggcccctttgatttagaggaaaaacataaaaattttggaggagttcaattctataggaaaatttcctatgaagccttttgaaacaaaaggttgaatcctattcaattctttgaaattcctatggaatggacaattctatagagattttggaggaaatttaacaagagcttcaacctctttcctttgagtatatctctcttatataattccggtgtttttcatgcggttcaatcaaacagtcattcatgtgttttttctgcattttacaatcctctgttttacacttacatttctatcaaaatcctatgtttttcctattcctacgttttctcaatcttgcaattcaaaggggccctatatttgatagagaaacacacctagtgtggtatgctacatagattcaaatcttagcgaccataattatactcataacgacgacgcgtttacaatatgagagtttgatgatcataattacctgctcgcaacgtcaaataatttggtgatctctccctagccacaccttccatatgaaccactaactgaacccgttctaatataagtcattttattctttgtttactactccctccgtttcacaatgtaagtcattctagcatttcccacattatgttaatgaatctagacatatatatctatctggattcattaatatcaatatgaatgtgggaaatgctagaatgatttacattgtgaaacggagaaagtataatattcgagggtgtatagatcgtaagagaatcgagtgcatatttcaacaacacgggcacaatatcaaacataaactttcattcattccaaaaggttgtgtcattcagctacatgtatatatagaaacactggccccccacacacacacacacatataaataaataaatatatatatatatatatatatatatatatatgtgtgtgtgtgtgtgtgtgtgtgtgtgtgtgtgtgtgtgcactggccccccacacacacacacacatatatatatatatatatatatatatatatatatatatatatatatatatatatatatatatatatatatatatatatatatatatatatatatatgtgtgtgtgtgtgtgtgtgtgtgtgtgtgtgtgtatgtatgtacatacatatacatatatacatacatatatatatatatatatacatatatatatatacatatatatatacatatatatatatatatatacatatatatatatatatacctaataagaaaatacgtaaggtttccggaaattttttttcgtccgtctcttttttttctcttttttcgctattttcaccgtattttccttttttttccgtcttccgcttttttctttccgccgccttttttttctccttttccgttattttttttcgtctcttttttatccccttttttccgttccttttttttttgccctttttctttttctccgttcttttttttactccctacttttttatttttttgccaggccgaaccctagcgccgctgccacatcgatctgccttccatgcgttcccttcttcaattgattacaaaaattgattatccactactttctcatttattttccctatgattttgcaaagtagagggagataacaggttgggctagtactgaaaagacatgaataaatgagattttggcacaaaactaaagagtataatgtatagcgatccaaaaatatttttacccgttgttgaaaagtgcagcgagctatgcgagctgggcctacaactttacttgtgagctaggtcaaaaagaagtaggcaagcagagaggtagcgagctaggctgcgactgaaaagaaatgaagaaatgagctttcagcccaaaacaaagcgtataatgtatgcgatctaaaaatatttttacccgttgcaacgcacgggtatttttctagtatatatatgtgtgtgactcggttgtttacattatctctgcaaaaggaattaacgtacgtatgccaagccagtacactatttggcactttaatttattgacaccaaggagtgaaagagaacgcgaagtcctctctctccctctctctcaagacagtacattcacacatgcacagcgtcatacactcgctgactcacacgcacacaccgacgcacacactgcgccacacacaaagctggagatcgaaacgagcaaaaatacaacgcaaaatgatctatagcgagatggtggagtatatgatgatcgatctctagctcagtgatgctgaggatccggtcctccggggctgagcctcttggaccccgcgggcacgacgccgccgtcgtcgccgtctgccaccacaggtgccaccatctgggccggctgctgcattattggctccgcggccgcagccacgttcacgaccggcgccgccacggcgtcgtcgtccctcccgctccccagcagccgccgtgcaggcgcagccgccgccgcgtcgacgacggacgacgtcgtcatacagaccagcaggacgcacgcggcgatcacggccgcaacaataatgctggcacgcctagccatatgtagttaactttgatcgcgtttacgtgcggtttcgcttgtgcttgacgacgacggctagctactactgcgtacgtcgatcggtcgatcgagacagttgtattatctgtgtatatcttccagtgatgatgatcaagagctagccccctacgagcttatatatagagggaagcttggctcgagtgcgagaattaatagaccctcttgcgttgagttaattagtttcttatggtcgatcttccacgtcgatttgcgctaacacgaaacttgattcgtcttcagaagattctcacaatctcattgatccacaaccgtgtatttctggtttttggaccagaagaccgcttgctttccgttcgagtggttaatgtcgttgtgacgttatttgcataaaccggtctggttcgttggttgcatgtgaggatttcgataatgccctagctagtggctttcccagactgtattactaatttttgtgggtaggtgtacactacagtcctaaaataattgtacacgattctctctcagaagaattcactactattaagccgccatttgaatagttccatggccacttgctccaatgagtggtttgtttggagtttggaccgccacagtttaagaatccttgtgctaaagcctcaggcaattggtgcatacaaaaatgatctgcacaggactaccggttttcctttttttttcttcacaaacataatgccgtttcgacaaagccaagtggaatgttacacaaagaaactcggaccataacttgcattttagaggtttaatcgaggtctactaaccaataacaaaagaaatgagatatactaaggaaatgaacaatggttaaacggctcctgcctatataacctttctacatcatatcaagatggtataacaataagttgtctataatacaattaatgatttagttcttatatacacaaagattgtatacatgatacgagtagtaagccatctattagaccatgttggatattaaccattgttcacgtcaataggtggttccaataggtagccgtaaaagtttgatttaccacctaaactctaatacgagatatttacaaccttaaactttgcaaaccagacacacaaccactgactcaataagaggcagttttgctccgattcgacaaatgatctgtccacatgcatggcaccgatatggcgatccaatcaagatattttcaataaaaaaaataaggagaaccatcttccacctctcgcttgtactctctctttcttatctcactctctctttgcgaggagcctgttgtgttctgtaggtagctcacaggggagaccgtggatggtgatcttgcaatgcttgccacatggacgaatgcagctagccatcgtgctccacgagctcacctcgtccggcagccatctcgacctcattctggatgccatctcgagaacgcacggcatgtgcggcccgcttgtcagcgttattgggagcactgtctcctcgcagaagaccaccaaggccacgctgctcacggcatgtaatctcatatccgccagcgaccgtgcgcttcattttccgagctcggcgtagtggtgttgcggagcttcttctaaaggcatcctcagcaacaagcacatggccgcctagacatcacaccggcgaggcttaacgctagtaacttaaggattactactaattaccccatgcttaattagcacagttgccattccataaaccaagccttgtattccaggagggatttgggatgagccgaggaggaacaggatgacatgtgagggggcgacaagtggaccatagtgccatgtagggttaaaaccaccaattcagtttgaggggctaattcgctcagtttgcatagtgttgtggctgttatgcaacactttcttttacttcaactctaaattcctattgcaatgttatgttttgtcaacataacaccatgtgttgtaaatactaaatttgatcttgagtggaactttcaacttccatagcgttccatttatggttgggatattattgttagaaagagcatcatgcatgggatgaatggaaaaattcaccattttgatgtcactaatatgctataatggtatggaagtaaatgaaaatggtcaataacattttctaagtcagtgcatatagagcatgcaagtacggtcacctgcatgtctacaaagacacagaaaattccttaggtaactcttgagttttcacttcgttccttctacacatctaaaatttgcttcatgtagcatatccttggttttcattttaatcacttctatgcccattttattagttgatcatgagatttttccaaaatgacttataataatgcctcctcttttatacttatgtgctagctattaaaaaaacataagatccacggtggaaaaataaattataaaaaaatcaaatgggtaaaacaatcttaccccaaattctgaaaccaaaatttgaactttcaaaataattcttaaaacaatgatgaaattcataagtttcagcgatgattgaaaaccaagattatttttagttcagtttgaactttgaccaaattgttgtataaaattcatcaaatttgattatagtttcattccaaaaaacaaattttgagaaggggtcaaataatttaccccctttaatttttttaaatgaaaattttcaccttcagaattatatttcttaagtagctagcacataattatgatagaggaccaatatagtattttggaaaatctaggcttaattggattcatgcaattacaaaattgtccggttgaaaaccaaccattcttattcgcattatcggtgtgtgccactgaaatttgtaaagtttgaactgtgacattgaagctgatggtggtggcaagctcgacagggggacactcatcagatgaagcttcagatgaatcggatctagaccaagagcaagacaaagacaacgacacaacgtagatgtggcggcactagaggaggaggagagtgggcatgacccacgttgttacaatggacaatggtagtgagattgacgaggggaggcttgccggtgaaacctcaaatctatacgtgtaatgagtgttacactcctactttggaaagtggatggtggaagttaatggagtttctaatatttttatttggtcatacgttcggccgcaagcaatttcataaagaattttgtcaagataaaatcatctccaattagtattttagtataacatgggaagtcattagaaattatccaccctcaaacgaagagattccaaatgacacgaatttgcgtattatgaacatatgtacaactaatccgaaagtactactagccagtcatccaagcgtataagatgcatcggacgccgcccccacttcgaagtttccgtccacatctgtcacagatcatgctcctcctttttttctctctccacatgtcccgcgcaccacccccatttctctatttccttccttcctgacagcttcctatacacttccgttcttccctcggagagcacggtagtagacaagcagtggcgaggtagcaccgacaccagctctggcagtgtcgatgctcggagcacccgatcaaacgacagtcgggcttgagaaagcctgatctggtgctagcgaggcctaaaggcgtcagatctagcgattccagcactcggggacgctcgatccgatgctggcaacggagctctatatgtttctccttgtttgtactacttaatactactagggataaggaagaagatgaatccagccagcagagtagaggaacaaggcagagaataggtttgttgcagatcattgttctctctttgttgcactttttcgtattggagtgttttattctttcttttgtcggatgttgcaaatagcaagaatttgatgtttcaatcatttttctcaatgttgcatttgcttgaaacacttttcattaagcgatgaaatatttttcattgatcaatgaagcatctaaaatatttttttgttgagacattttttattgaatggtgaagcatctaaaacatatttttacataagttgaaacattttccgggtttcttttccttttgctcggagggttaattcgaagttattctttaggactttgttgcctgaagaaaattatcattatcttatctctatcatttatccattttgagacgtagaggataaggtgattttaaatgtttacttcacacgtagtactgttcatcttatcctcaatgtcttaaaatagatagagatagaggtgagataatgctaatattatccagccaaaaaagtctaaattaactctctatccaaaaggggaaaaaatcaaaataaccctatcccagcattcagctataacaggcttaatcaccttttcttcccaatacacaaatggctaaacccagaattggcaaacaattaatcctcataaaactattctaaattatttcctactagtaccttctagagaaaccccagcatctgcctggcagccacatcgatctgaagtaaaacccacaacgaaaatttccccccaatttcccgatccctaaatccctaatccctaatccctaatcgctccccggtgccccgatccccaatcggttgatcgccgccagagacgcgcagcgtcagagctcgccgctcaccggcgacgggcggcgccggatttcgccgtcagccggcggcgcgcggcgacggtggccaggctccaatcagctcccttaatccgtaaatttgaaaggtaaggtctctcatggctcgttcgccacggccgccgtggtccgatggcctcccgcccgagcttctcggcgtcatcttcgagcagctgagctgcctcgccgaccgcgcctgcttcgcggccgtctgccgcccgtggcgcaccgccgcggccttcgtcgacgccccgcagcgggggctcccgtggctgctcctcccgtcccgcgacgcgccgtccttcttcagcctccactccggcgccacccgccacctcaccctcccggagggcgtccgcggcgcgcgcctgtgcggcgcccacgacggcggctgggtcgccgtcgccgtggacccgtggcgagggttcgcggccgtcaacctcttcaccggcgtgagggttaccctcccggagaagctgaggctcgaggtcccctacgcccacgggtacgggcccgtgaccgtcaccagccaccaccccatgctcgtccgcaccatcgtcttctccgcgccgcccgcctcgccggactgcatcg

SEQ ID NO: 43548 - DNA, 3705 bp, Oryza sativa
ttctggcagcctgggatgtccaggcactggatcgcgagccggcctgagccggacgtgatccaggacatcatctactacagcggcgaggagaagcagggcttccacgtcctcaccaacagggaggaagtcctggtgttcgcgccccgcgccggccgcgaccccaacgcgctgctggagatgacctgcgcatcctaccagatgcgccgccgcgccaaccacctgccggcgtcgttcatcgcgacgcgctacctggtggagtcccgcgggaagctgctcatggtggtgcgccactgcacgggcaacccccgcgtgcggcggcgcacgcgcatgttccgggtcttcgagatgagcctcctccccacgggggcgtactggctggagatccacgagctgtccgggcgggcgctcttcctccggcgaggctgctccagggcggtcgaggtgtcgcagttcaagatgctcaaggaggacaccatctacttcctcgacgacgccaacgtcgacatgtgcgactccatggtgatgaacaacgggagcaggtacaacatgggcatttacagggatggtaagaagatcagagccggctcccggcaattccctcgtggatttaccgcggattgctcgcctccaatctggcttgtcccctgatccatatcgtgcaaaggatcagtgaaatgttgtggtagtccctggctagtggctagtagtaccttctgctctggcttagatttctccgattctgcatgtttgtgctatagaggcagactagtatctatcaaaagaaaatgtaccttgagttcttgatatggtgcaaacaaaacaatactccatcaatgactttcttttttgtgttgtggatgctccatgcgccttcaccaagtttaatttagtttttttacctagtctgattaggtcacccttgaagtatacttgtcaagtttttgcgcaggtttttagatcttttgagccatctccattctaaggtctcctttggaacataggaattttacaagaattttgaagggaatgaactgtttttagatcttttgagccatctccattctaagatcaactttggaacatagtaggaattttacaagaattttgaagggaatgaactgttatcagttattacatcatgtttgccctttctttctttctttccagcagtaatgggagacagtgttcccagtacaacatgctgaacaaattctgtaaagtacatcagttggcactgcagatttataacgggacacatgtatagtcaatcacacttgacaggattattagaggattattgcctgcctgctctgtgctctccttattagaagctacactctggccatatctcacctctccttggacctgtcataacgcatcctgacgattttgaatttgccagaggttatctgaggaattttattgaacatgtgttgtgtatgtctcattttctaagtgatacatagtagcacacggcgaattagtcatatgctcttaatataaaggagtacaaatgtatcgtacaaaatacactcactacatctcttccaaaaaaactttgggcataacctctcttccaaactgcggcactatccggctctttattggcaggttagagctctcgcgccgctctctctctctctttctctctcacacacacactggcacacaaaactggagaaacgagcacacaacgctctctcgctcacacacacgcgctggcacacaaaactggagaaacgagcacacaatgcaatgcaagaatcaagaatgagcgcgtatatatggtgagatatactacatctcagtgatgctgcgggtctggtcctccggggctgagcctctttgacccggagacgtcgacgtcgccgccgtccgccaccaccggtgccaccgtcgtctgcgccggcatcattgcctccaaggccggatcagtcacggcggcgtccctcccgttgcccagccgccgtgccgccgccgccgccgccgcgtcgacgggcggcgccgtcatcccgaccaccagcagcacgcacgccgcgatcacggccacaacgacgccgacacgcctcgccataagtaaatcaagtgctaggcgctacagttagcttaatttcaactgcttaactacgtcgtcaggtgcgtgtgtgcgacgtcgacggcttagctagcgagcgagctactgtgtctgtgtgtaggtacgtaggcgtgtacgtcgatggatgtatgctagcctcgacgacgagctttatataggagatgatatcaggctagtgattgctcagggcgtacgtgcggtcgctcatcatatcgatcggtcgatgtggcgcgcagacggagccgtagattaacaagccctcttgtgtttaagttaatcagttcttgggatcatcgattccacgtcggttcgccacgggaactatgcctcatacgtcttggaagatctcacagattacaagttaaactggctggtaccattataccaaaagaactctggtgctattcttgtatagttttaaacagcttggtcggaaaggcaggttggatgtggggattcgatgacgcactagacgcttaatttgcgcgatcgtataactgtacctatatcggcatcacaattctctgtataaagtatgactaatgtatggactttgttagttatagtggatcttacgtggtagcaaacgaggggttggctagctggtacagtaccacacgcgggatatattagggaggcagttggttgttgaagaggactgtttgattccaaatacatgtttctttcgctattgttgccatctaatttggactaagcagcaggtagtggcctagagagaatcatggctacccgatgcaaatagcaaaagccgatgcattatctgacggagctggaggaagttttttagtccattagcataattaattgccacaaatagaagaaacagggacaagaggacaggggttggtggtacccagtacaaatgtacaatgtttctctcatattccgaaagggcaaggattacccaaatagcttattattcgtcaaacaaatgataatatacatggtacaggaacaaatattgtgtaaagagaatgctcattagttgtaaatacatcagcggtaattcagcattctatcaaccatactaggtgcaaatgaaaagtcttatcggcaagattccgtcaggaggatttccacaatactagggaacagttcaagcttcaaggaggaaattcagcaatctatgttgtgcaaataacctttgcttttgcaactcacctttagctgaggacatgactgccatagtcttgattgaatttttcgtatctatgtacatgaagatgagcagatggccgtgtattccttagtgcaagctcaatgtcttctgtcgttactggaccaacttcaggcaactctgcaacatttccccccaaaataagtcctactgtatcactgacttcgataatgtgagcagcaggatcattttttgtgcagtgaaattatagcatacttttatgtggcattggaggcgccatggaggaatataaattcttcttttgttgctactgtttctttatacgggttcggttttttcagctactgaatgcaaacatacaagtctacagaacttaaactcactgaagttgtaatgagtactaattactaaacaaagaaaattaagtctataagttccctggtaggcacat

SEQ ID NO: 43549 - DNA, 10334 bp, Oryza sativa
ccttccttcaagaaccgacattaaccttctaaggggttgcattgccgcctccttgcacacaaggcgtatatcagagcctgaatatccttcagttttctccacaagaacatcatatgggatattcattgtgccaggaacagatggcaagagctcttcaaacatggcatgtctagcttcttgctctggtaagggaacaagaatctaattgcaagttaaggatggatttccctttttatgtggaaaaatcaagtgtggtcctatatacaaactccagtatcgcaataagaaaagatacaagaatcgagattgaattctttaacagtttttagtacaaacaataacttcagtaagaagcctatgatgtgtcagttacaactacaaatagatttaaggcaagcattggaaataggcaacatttacaactacaaatagatttaaggcaagcattggaaataggctacataaatgttcatcatcaaacattctctttactacataataagagaatcacttattctcaatctgaaattcaaatcagtagttcctcacataagaaaatgatctttggtattgttacttctggttaaacatatttgagatttgaattttttttcatggtcttcaaggtgcgattgttaccatgattttattagaataggtttataaaatctaataagtttatgagatgttggaagtactttaaaacaaatcaaagcatatcatatttatgtttttgaactaagtttttaaagttcatcgatagtcaaggtttcaaaagtttaaccagattttgtccaaaacatcaagcatttgcggacaaaacaagggagtttacctaatagcaaaactggcaattacggagtagtatttaggagcactcgtgaacaaagaaattacaagatggtttgagaaaaaaggatacacgtttctccaaacggcgcaacattgctgcatccagttcccatggcaaatttgtggcggctagaacaaaaacgagatcatctgtcttagttaacccatccatctgcagcaacaaattatcagaattcatgactgcttttatcaccatgtgaatgaaatcacacaagttcaggattattatacatatcaatttatgaaaggtttcatatactaacagaatcctgtatgttgagaaccaccaagggtcttccggctagctccacaagatggtgggctagacgacctgggttcgaagcctcaccccttctagttatttgatattagatccttccctaatattcgcgtcctttttaacagaatcccatatgctgagatatatgatatctaaagagtttgttctttgttaattttcctccatagggttatgttcacaatttagggctgagaaactcatactacttatgaagcagtgaaagtttcagcataatcactttacaaagcctcaagaatgctacctgtattaatagctcagtcttcaatcgccgactggcttcatgttcactacgagcttcaccacgttggctaataatagcatcaatctcatcgagaaaaatggtggatggtgcatgatgccttgcaagctcaaataagactttcactagtttctccgaatcacctgcaccgttgtaactattaggtagggaaaacttactaaaatatcgatagaaatggagcaaggacagaatatcatgtatggtaaggatgtgagttagaagttataagttcgatctagtcaggtacaggttcatccatccgttattaatagcaagaaggaattatatagttccacatatctgttcttccaaattgatgaatgaaaaggatgaggtgattgttccacaaaggttagtgctgttggatatacaatgttccacaaaatgtacaggcggagtgagggtggcagaggagtattaggctagtaggctctggtgcaaatagggagccagtggtcagtgggcagtggccaacaatggctatggaagccctacaccattgggtgccataacatggtatgcaagggtgaaggagaagatttgatggtttcattaagtccaaaagaaatgtggcatatgctaggatccatagaatactgtcatgcacaacagtgattattgatatttttcaagctgctagtacatgaggccaaaagataactgcctgttaggggaatatagaaagaaggaaatgaaaaaaaaaaaaagaattatgaatgtttcagtcctattggtggcgcttaagtgagtttaaggatacagttgagtagtatcaatgaatagttaactgtggacctctttagtgctggagaaacatgtattaactttataaaacttggaagagtaaatactatccaatgtaaatctatagaaatttgctaatacggattgctttaaaaaatatataaagagcagatagaaacacaaaaaaatagtgcatgcatgtatcacatatctacatgattagttggtcatacaagcaatacaacatgacaagaagtagaaactacaacaacaatagcattaaaagggaaacaatgcaaatgcatctcagaacgcaagcaaaagtaatgccataccacgccatttactgacaattgatgaggctgaaatattgaagaaggttgttttgcactcagtagccacagcttttgctagcattgtctgaaacaaaatatatcaaaacagttacatcaagcatacatgatcagcaatttgagttcgtatagcacgacaagcaacatatggaatggaaacggagttggtatgaagggaaacgtatgcaaacaagtacataaacaaatgcaatagactagtggaacgttctgtagcacaaaagacaaaagaagcaagggaaaacataacagaccagccacagcttattgtaggtgctaactatatagttatatgtgtaaaataatttaattatctatgatctttgacagataaatgctgaggtaaatctactatctttaacagacaaatgctgaggtgaatcccagtagagtatttcaaatggcgattgatgttttttttaatacaaggcagcaataatataaaacaaagatacttcaccaaataattcaaccactatagtccatgatgaaatgtaacatattttaggacagggagaacatagattcattgttatgccaaaaaaataatcttacaatatacaagaaaagttccttgctaagcatctaaatagtacaaagataacaatatagtcttagcatatacactatacaactaaaatgcaatgatctttgtaaggtgcaaacctttcctgttcctggtggaccaaaaagcaatatacctttccaaggtgatagcagacctttgaagtacctacagttcaaaaagaaaataattgagaaccaatggtaggtccaaaatactgatttctaacacaagttatagaagccatcagataagctaatttgggagttttttcctgaatctaattagcaaaaaacgatatagaaagcatgcggtgtaacaactagcaaaacgaatatacaggttagataaataattgcctgactggtaaagattctacatctaacaaaaaactttcttcagaagataccaaaaacacacacatggggcattgtaccatcaaactgaaagagttaaagtaaatggtatgcgacatattatcatgaataacagtggttgcttaaatgcaatcttagggagatctgatctgaccttttaaatatgcaaacatgaccatgcagatatgtgaagcatcaccaatcacaaaattcgatgcaagaatgcaacattcttttgagccacgaatgtcaggtatgaaaatattttccagacatgttaaacgacaaagttacttgttcaaaagtgtttagatagttcgtctgcctatgctatacgttgatgaaaggaagttaggaagagacacatcttcttggtattgcaggtcatatcaagaattttgagattctataagcagaaaagagttaggcttaatagattcgtctcgcagtttacaggcggaatctgtaatttgttttgttattagtctacgtttaatacttcaaatgtgtgtccgtatacttcaaaaaaaaatttgaaaaggaactaaacacggcctatgttgtgagcatatatcatatatattatttctgtgagaagacagaaacctacttggggtattttataggcatcacaactgcttctttcagaagacgctttgcattctccaaacctttaatgctttcccatttgacatctggactcccacgaatgatatccctattggcattacaccaagaaggtatggttataagtctgtatacattacagtaccaaatagataagtctggccacatttaccaaaaggcagtgttacctcaacaatgtctcagctaaattgcgcatttctgcagattcaaaagaaggaagtagggatttctgcctgcaaagatcttaagtcagttatcacaaagatacatgtgtaatatacatgataggtgaaagaaaggaatgggctggggagttttattgtgtgactggacaatacaatattacttcagaattatggttgaacaggggaaaatatagctggaaacttcctttgaatatagtaggtactgttaggaataaccagatatctaattgacattaaagcgataagttccagcaattttgttgtactataaactaatagcatcactaaaaatgaaaaaactaatgtttacatttgagatacttatagcaaatactattttccatagtatatgccagacataaaactgcttaaaatgcatgcatgcagacaactatagcaacaaaatcatcataaggttgctatttctaaggtttggacaactgaaatacaatgcatggttttgatcccatattagctaatgcccaaatcaggatcggatcaaccactttggtcacaattaaatttcatcccgccaacgaaggagctaacaattttacaccagacaaaaaccaaataacttcagaggaagttttcacaattcagatagaaaaaatgcagtcaaactggatgtactatactccatagaaagcaacgagtcttacggaggcccagcttcaattgctccattccgcagctccaccttcctctcctggcaccaaaacagagaaggcaaaaaaaatcacaaaatcatccctgaagcagtaacaacttatcatccagagcagaggggggatatagagagagaagggcggacgcaccagccgctcgaactgctcgaagacggccaggtcggcgccgccgttggcgtgcgccgcggaggggcgggtgctgcccgcggagccggatccaagcggcgcgtagccgcgacctccgccgccgtcgccgtcgccgtcttcatctcccccgggctcgcggcggatgccgaggcgcacctcgtagtagacctcgaagtcctgcgcacgcgaaacggacacgatctcagcacgcgcgacagcgacgaagggtgaaaaagggaacaggacagcggggaggagaggagaggaatcgaatcaaacagaaagccaaagggagagagtggtgcggagtcaggtcacctcgaaggtccagcgggtgatggacggctcgtcggcgccggtcatggcgatcggattcgatcgcccgcgcacgcccgcacgcgcgcgcgcacgcgcggcgcgagagctctcctcctccgcgccgcggttgcggtgcggggcaagcggacgagctggcgatgtgaggaggagcggaggcgctgagttggagttggacttgctacaactgctaggaggagaggggggtagtcgctaccggggacaggcgggcgaatctgcgctgattttgcaccgggcggggacctccccacttgaggctgacaccgtgggcagggcgacccgctaccgaccacgtgggcagggcccgcgtgtcagtgatgctacctgcagtggtgcggctatagctgtagctacagtgctactactgttgaagcaagtacagtactactatgataaactcttaatcgcttgctatgtataaacagaacaactaaagatgagattagacttattattatattactaccaatctaaactactaaaataggtaaaatcaacccatccatactagtactatatttttatattttaaaatgaagatagtaaacgactatatgaagaaaagtgagatgccgctcttcatacaagagggaagagggaagatgagagaataagagagtattgcagatttgcattttgcagtaatggattagaagctagtttactagtactagagatttgtaaactttaaaattgatgagtggatggtgtggataaaattagaggttagctataacctccgtagttaaacttgtttaaaatgctcattgtactgtttgaaccaagtgctactagtagtagcactcctgtttaaactttaaagagtacaagtgaatgaatgcacgagtcgttagttccaaggttgacatagcagcttcagaatattccagcgagagagatgttccaggccttcgctgagttgcagggaagaatggtcgttttctgtttaatttaatactccttccgttttttaatagatgacgtcgttgactttttctcacatgtttaactattcatcttattcaaaaattttatgcaaatgtataagatataaatcacactttaggtactatgagtgataaaacactcgtagcaaaataaattataattacgtaaattttttgaatgagacgaatggtcaaacatgtgagaaaaagtcaacggcgtcatctattaaaaaacggaggtagtatttatgggaaaactggaaccatgctattataattttgcaaaatttaagatatgtcatcctgaatcatatgtcattgactcacatgggtcctacgtgttattgagataccgatagcatatctcaaactttacaaaattataatggcatggttccaatttacccgataaagccacgtttgcagcatgcgcagacaggcgttcgcttcgtgaaggctccgctgcgtgctcacaggctcacagccatccacggttccaatcatttgcgagtgcgtgagcccgtgggcgaccccgtagcttattcccgtcaacatcatcaaattcgcaagccaaagaaactgaaatggtccagctaatggctgctttggatgaccggggcatgaagtacgctgtttggaattttgacgagcagcaattaaggtcaaaatcccctcaaataaaaatcaaaccacaaaggccagaaaaaatataagagaacaataccatgttgcacttatgttcgccgaactgatactgaaaaagaaaaaacaaaacaaaggggcacctgcgacagcacatacagtacatctgccaaatcgaaacgcacgtttggaaggcgtatacgcttatatatgcagttgacaagctacaggcatacaagtacggtagtactttgccaacaaagtggcaagacgatgccacaagtcgacgacaaccgcaaccgattttgccaaatcgtcccgtcaggcttcgtcggaacgatctcccatttcccaggtaacagaaactagagggtacaaagtgcagccacacgaacaaagatccaatttcaacaatttaagttttccaacataaagtaataaatatattggaggagcaccaagttctaccacagatactgattagtcaagggtgccctagggtaaagggaaccaaccacatgtatacagacaaataattcaagcggtagtcatttaaactcccttccactgccaatatctccagtttgttcttatcaagcaaatggcatttgattaaggctaaagcatgacgggttattacatcacgagaggcattgggttttatgcaccgctggcatacaggcgagtccactcctttgctgcaaatgccagaccatcgcttatcaggcaaccaataaaatcagagtgtgaggggagacactgttaactggattgctagcttcaatttacctgtttcaacagcttctgcttcattggctttccagtgctttgcaatgttatcagagagaggatcatcagggtttggtgcacttaggagtgcctggatactgaaaaaaaagagtgttgtcacaaggtaagtatagcaaagtgatacccctaacttccaatagttgacaatgctcaagagtttttgttggaaaaacacatcaagggcagtgataaaattactaaatgcaggtaagctaacaaataattcaaattcaacagaaatcatgtcaatcgtaataagacaacagcttagcagacaaggaatttgtgcaggatataaaaagctaatacacatgtgcaggcaacgggggagagacctcaaaagaactgtccgaatctgaagggctgggctccatttgtccttgagaatgtcaaggcatatcctaccaagctacaaaagtaaacctattaatgaataaacaatgtattacgaagtaaactaaataacaaagaggaatgtgactgcaaaccttgtcaatgttggggtggtatattttggtcaggaacctaacctgcatacgcaacaaagaaaaaatggagactgaggtagacaataatgaattatatagctttacacttagggagactgaagtagacaataatccggtatggttgtataacatatgagtaatatttcttcacccttccaatctatgacattgtcaagccaaacagactaaaaaaataactaatcaaggtataatttggctgaacaccaaacgaacaatgtgatgttaagaacacctttaagaacttgaagcaaaaagacggtcaagagaagcaatggcgtgctgatgctcaggacacagctaaaagttcccacaggaccaaaagtatatcttacaaccttggtccttggcacaggatctcattgcaaattacatctcaaataggcagggtttgcattatccctaaaaggaaatcaagcaaatgtaacaaaactattaccaacaagacatcacatataacatataaaaccaacgatggttccagagcgacacgattaaatatgggtaactaaaaattaggctataaagaataaaaatttttttttgccaaagaatggttcaaacaaattaaatgtttcagctactttcctgtatttggttatatgcatgagtccaatgtcaccaaattaatgctccgcttcacaacacaagtcaatgaatgcagaaatgtcctgacttttaatatgagtatataaccacacgcaattctaaatacgacataattagcttgaaggtatacagtccccataatatcatataaaacataaccaaagtttatctatgtcttgttacctttggagcagccataggatattcctcaggtaaaaagagttcaagcttaaaaactccacctgatagaaagaacaatatcaggaagccaaatgataatagaataaaccatctaaagctactaactgttaacacccattatatatccaacccgaattaacgcaaaaagggtttaagaaaggaaatatttaaattatacaccacaacatgaaaagccaacaatatcaatactcataattagtctaatcaaataaatcgaagagatcaatttggttatggaaaatcaagggcaacctttgccgcacaaagcatcaaacaagttaacacataaaagaaaagcacttataagtcacgtatataatccgagtttagaacattattgctaaaagtcactagtgttttagcattactaacttcatactagaaagggaatatgagacacatagaacatgcaagtgcccgccgcccgagaaactaaaactggtaagtgcaaaagaaccagcctaatcaagcaaaagcaggcttacgaaatgcgtgcccgtccatgactgacacataattaacacttctagtaattgggtttatacagaatcacccaattctgcggtatacctagaaacgccctaatcgaccaccctctacaacaaataacatatccatcgggagccgtaacaccctctacaacaaataacgtatccatcgggtgccgtaccttcatagggggactgtgccgggccaaggatcatgacgttgaagtagcgcatgttctcctccgacggagacgcgctgattcccggcgctgcacaaacaaaccaacccaaaaccatcagaacaacacgaacccaaaccacggaaaaacacaacaccatcgccaaaatccgcgatacataaaaaaaaaaaaaaccgcccgcacctggctcgctgaggagtcgctgcgtctcctgcgcagatccaaaccagacgcgaacacacagacagcaaaaacaaaaaatcagcacagaaaggggaaaataaaaaaaaaagaaaagaaaaggggggaa

SEQ ID NO: 43550 - DNA, 5034 bp, Oryza sativa
cttctgctactagtgcggtgcctgagcgttatcccagccgtgcgatgggatcatgaacggccgagattaatccctggggattatttgtgggactttagggcaaagataagcacgccctcagcctcaaaaatatctaaagtataatttgctagtgacaaggatgaaaggtgcagttattactactagagatacagtagggtttttttttttaatacacgacaaacacacatgcgcacacacccaataccaacacttacactttatgaatgtgcccaacggaaccagaaatacatctttgatctcataaaaattatgttgaaagatcacctacttgtacataataatatatgttaatcataaataaaatattgaattataggtagcacattttttagaactaaattttttttctcggggatgagattcgtcggttcattgaataaagtcacttaagaaatatctttagcatctcgccgaagtgggcaaggaagaggcagatggagagaacttactagctagggattgtggatgcatcttctacaccactttaactgtgacgaacattaagtgcaaaccaaaccatctttattgaatcagcaatggttgggtttagaaggagactagcataactatgtctcaagttaggcgagagagaatgagggcgatcataagggtataaaataggaactcaagttgattaggaagatgggtgattagtggggtacagaggtgaggaacatggtatcgtaacagagagaggagtggtgaatcaaagagggagcgataaaggatatataagggttaaggggcataagtagcagaaaaaggcttatccactggatctcttcccggatacccaaaaggaacctccctctcacaaataaagaagacaccattgctcaagaaggagaacaaattacatgaagcacttgtaaactagatgttattacaatattgagagagggagggagaatatctcccaccaaacactaatactctctaaaatcttttacataggtgtgcttctccgtcaatataaattaaaccttttatctctttgtaataaaaaaaaccccaaaatcagcttaaccatatctacttttctcaagctacttcatgtgcttttagcaacaatgtgctatggttagagagcgcgcaacatgctaatcacaaaaattaaaggtatcaagatttctttttaaatatagaagtttatctcatttcttgtggattgaactaattcatgtgaaaaaaaaactataacttcattcgtccccttacaaaatctaattgaactattccatgtgaaatcatgggttcctatggagaccttaatatatgttatatttaaattaaggtgaaaaacttaagaattccttaggacatgtgcaaagtgaggtgataagggaggtgtaattaagaagttttcggtatctctagatctagagccaaacattgtgcagggtgaagctaacatgaaaaatcttggaactaaagcatgtccaaatgttgatcttaattaacaaatacgtaagggcacctcatgtcaactcggaaacaagcacagtgacggtgggtgttgtactttctggttctatttaacataacaccatacttttgaaaaggaggttaaacacaataagaacatttgataacctatgtgactatatgagtgagattaaaaaggttatagcccctcacctcctcttatgttggtaaaaaaatttccatgtcttatattgtatgcggcattgtaaatcaatgtatgagattaatccccgcaaaaaaatgtatgagattaataatattaccagacttttttttatgagggaatagaataagggtgtatttgagaggaggggaaaaggggaaaattgagattatacgtaaaacaaggtgagctattagcatataattagttaagtattaatcattttaaatttaaagaatggattagtaggatatttaaaggaaattttctatagttttttttaaaaaaacacacaccacttaacttaacagttcaaaaggcgtgcgtatgaaaagggataatttttcttcctcttgtgcatgcttctctgaaacacagcttaaaattatatatactccaacccataagaaattacaaataaatccatttcttgccggaagttacattgaaagattataaggaagaatctaataaatgggtccttgccattgctgaagaagctgccggttgaaagcaactatggttgggcctccttgctggctgtggccagaggtggagaatggccgtgcctagaacaaattcaccatcgaagatggaaaaaaaacgtgcgagatgttgctctaccacttttgcagtacgagatcgaggaatacaacttgagtcaaatcaaatcaagtggtagtagctcaaaaggtagctaaacatgaacgctcagcaaagttcgtgaaatttgctaagttaattaattagttcgctacttgtttgggagtacttttcagaaacaatttgcccacttccagctgcattggtcaactactccagaaaagttcatgccttttttcatcaaacttgtggtagatggacaagaatctggcaaagaaaaaaaaagaactactatcatttagtaggagtagtatgattctttgccagaggaaagacctggccttaatcctacgctatctctctcctcctctctctcatctgacgtcaaccattgcgtcatttcggttcaacggcgcacgatctttaatttctccccaatttcctttccttggggaggtagagaatcacacccagaagctcacgcaatccaacctccgcgacagcaacaaatcaggcttaacttggaacaataatccaaggaattagaaagataaggttcttttcgtggctactgatagtctgatactactacatcgagtgcagtatagtagtatactaacccggctatcagcaacacaatctatccaaccactgtttccacgtatgcttttgtttattgggacggcaacatacgtaagtgagtaggatttgataaatcctttgcagtctgtcagatttgattaagcgagagtttgactagtcgattcctggttcaccaaccggctaggtaattttactactggagataaaatgataatgttttgtgtcattggcatcgaaatgaatcgggagcgaatgttcctcctgttccgggtaggaaaaggtcaaggtcagtgcctaattgttcgcctaatcttgcagaacgcatatcaaatattacaaaccttagattaaatttgggaggaatttctgttcgagttcatcttcgaccggtgtattgtcctgtaatgtaattattatagggttgcaatcaaagcatctgggtgcattctagaagttgagatcagtgtcagtccttaatactttgtccgacaaacgacaagtgccagcttttcctcatagagaggcctgatgatgtaggaaagccaactgatagacttgagttgactttacacacacaaaaaggaggaggaatattaatctgatggcgctttatactactattacattaggcgcaaattactgctgctactaaataccacggctttaacgagacagcaacccgtctgcatgattggagtacatgccttgctgcagcctgcatgggtggcgacctaacctggaccgacgcgtcacttcggggcttcaccctgtcggctctcgcggtctcacccgtactactggctacacgaacccaacccacagtgctccgcctgacggtacggtgcgtgcccccattcgctgcacttgcccatgcatatgcttgtctcgcagcgcagctagcagctagctttgctcacgttgtgcacggcgttttttttttctttccatgacctaatcaacgaaacgacgcctcggcttgaagattgatttctggcatgttgtgcacgtttcgccgctgaccttgagccgcttggttgccgagaaaccacagctcgatcgatcgatcgatcgattttgggggaaatggggatggaaatctgtcgatctgataggttccatcactcttggccatagaattatcttttctcgtcgtcgcgctcacggagattgctctcccgtatcttcacgtagcagcggacgcgcgcgcacacggcagaaaatctccatcttgagatttaagaataagatcgataggctcacagtgacactcaattccgatcccttcgttcggaggtttgacccgatatataataattagacagtgtatcattcctgagtatccttccaactttattaccaagtgtttcgagtctgttccacacaagaatcattaaccaatcgccacagaggccgatcgatctatccagctttccagctgctatccgttcgaaaaagcttcagaaaagtcaaacgacaagaagggcaataaaaaaaaaagggtttcagggtcaacacgactgagagtggagttcattggctgtgaatgaaacaaacaatcgggtcactttgtgctgcaaaatcttgaggccacatgaggccacgtttcccagcatttccacatgattttccggtggatatatattgcgccacccccatgctccatctctccccctcctatccatctccacaggattttaagcgactaatttaatttgattatagttaagtttagttaattattgctgatctgaaaaaaaaaagtacacacagagtcgtagagggagaagtaaaagcgagtgggatggccgtctcttccgctatataaagggtcgcttcgcccaaccaaccccctcctcccccgcgcatccatggcgaacctcccctccaccgccgccgccgccgccgcagacgcctccgggttcaagctcttcgggaaggtgatccagcccgacggacagcggggcgtggaagagagcgcggcggcgcaggcgccacctcatccgcatccgcctgcgccgccggtgatggaggcggcggcggcggcggcggggacgtcgcagactctgcaggcggcgggcggtggcggtggcggaggagggggaggagggggagagccg

SEQ ID NO: 43551 - DNA, 2899 bp, Oryza sativa
agttctgctacttcaacaactacaacgtgcggcagccgcgccacctctgccgctcctgccgccgctactggacggccggcggcgcgctccgccgcgtcgcctcggcgtccccgggaaggcgcaggccccgccccagcgccgcccgatcggccgccgccgccgccgcctccgcctccgcggcgtctccccccgccgccgtccccgccgcctccgagggggcggagagcgttgactcgcggtcgtaggcgtgggcgcggcgtggctccggctcgcctcgaggcttcctcctcacatggcgcgggtgacgtcactcctcccccccccggggggcccacgcgtcggagagtctcctctttccactttttggcatttttctggagggtacgggtaggtttctgtttttcttttttggagataccattttaggattcttttggtggccaaatggatgaggccagcaacgaaagagataagaaaaggaaatttggaaatttgggtgctttcaaaattggtaggcagttcaaatgaatgtactactactactagcagcagcagcaggcctcgaggcaatgagatgatgaatcagagtggcagattgagccgtgatttattgaaatcttcgtcttcttgagttcttttggttgcccatgttttggctctgcaccattcacagttaattactccataagtcattcaatagatcatgtgttcatgtggtacctgtgacaatgctgagagttgctgtagtccgcggcgtgcaataaatggaatgtacggggtaggtgtgtgtacttgacctcttgccaatcatctttttgaacaaatgagagtgtaacagatgtcatggagaattcctgacaaattcatgtgttgcgaaaaaagctgttttatggacatatcttaattctatatgcactacagtagtaatagcatgagggggagaggcaggagtattccaggaggaccaggacaaagggaaaacaacaattcatcttccaaataaatccaaataaagggtaaaacatcatagtaaaaactttatagtgataacagttcagctgttcatgatagtgatgatatggtgctagtttttttaatttgttctccatgtcaaacaataaacatacttcaaagtaattgtctcagattccatgtgcagtggttgtgattgtctttaacatgccacttttaaacaagtaggcactggtgcaggtgcgtttttcacacagtacacggagcaatgtgataaaggtcatatatgtactcccctcattccagttaagtacttcaaaagagtctccagttcatgaaaaagaaaagtttccataggattccccaagcttactgaattgtgacttttaaaacagctgtattgacagcctgtgttattcgcattcagaattggtcccgagtcctgaccatatatactgttaaatttaagatcaaccataaaattcggtggtcactgtgctaaaagtttagaggtgtacatgatttttgatgatttacgtgtaatgttggatgaagttgactacatacctatgtacaaactttctattgtgcagctataataaaatttggatcaagattcagatggtatactcgctcctcaatgactgagtgtgcatcttatcttggtaacatccccagatcagattcttataaaaccttggcctgtaaaaaatagtaacaacttgatcaggattagacagacagaaggtacttcacttcaaaaggtgtacaatcatatgcgcacttaaagaaattctgcttcaaaggtacgatatgcgtaaatcttttaaatttattcaacagtcagaatcacatgcatcagttgtaagtacattcatagcaatttaaaaccactgttgacagcaaaagatatgtcatcattctgaattggtgtctactccttcaagtctatggttatgcggcttcaaaggcaccgtgaggacttattactttctcaatggtcacttggacgtaagtacatgcatcggctgcaagcatactcatagctacttaaaaactattgttgacctgacacaggcaactattactactgtgttgaagaaaggataaaagcttgcacctcagtatctccgtgacctatcttcctcagggcaactacctttaattctattcaccagaactatgttcaagattcacgattcccaactgcaggtatagattcttgaattgcctgagcaaatgttgcaatcttgtaggtgaaaaacccaacaagcatgggtatcaattccaggtgcatgaagccataatctggaactaaaatcctgcatcagaccagcaagcacaggtatacatgtaagaaaaccatacgttctactatttgaatattcaaacatcaaaagtttaataaaatttcatctacttactcattccatcggttatacatcatcacaagtgccactggaataagcagtcttggttgggcagcagcactcctgtaagcatgcaagaataaaataagatgcatgtgagcatattttaaaagttgcctagcatttgctgaacatcggtcacattccgttgtaaaatttttaaagaaaagatagaggtgaccaacataattgaagggcattgtataatacatgggaggggaatgttcagatgatgaagttttatcattttagatttctttcaagataaacccctaagcgagatataccaaactaaacgagttctacaagaccttgaattaataaactgcagtgctataaaatattaaaatgagatcacaaagccttagtagctgagccaaactaaaccaattatgagaagaagtctactcaagtgttttatctttttcttttctcaaataccactcaagtgtttatccacaagaccacaaataccaattgaaaaacaacataatgaa

SEQ ID NO: 43552 - DNA, 2137 bp, Oryza sativa
ctttgtttcaactgcaaaacatcccactctgcttagtaaagaccaatagataagctacatatatttgattctcaaggtacatgtcactgattttggacaatggagttcctcaagtgtctgaaagaacgatacccaaacaaacaactagaaagaagagtgatatacctctagatattgctcccttgatttagctgccaatacctcagggtctccttgctgccctcttgactttgattcccttagtatgacatcctaaagggggacaaaagaacatagaccaaaactatgaagtaccattatatgcatgctaaaaaaagagagaaacagttaaaagactatcacatgtagtatatctcaaaaaatacctacatttaccaataaatcagtgacaagattacagtgacttacactgccaccagttgctgccttagctgctcggtcccactttgcttgttcccggcgagtcggaactagcctccatctaggagacgcaacaccgttgacagcctacgtacgaaatccacaaaccatagcttagcaccatctctggtacaccataacaaagggaagatatttgaacaatgagatcacaggctgtcacctcagctccaatggcccgccccctccaggcagcctcaacctgggttttcaagattggcctggttggcgcctgaagctccttgctcagatcaacatccacactgcaatagaaaccacaggtcactaaacagtcgcaacaccaaatgtgagcagagaattcgataggagggtgaggtgaaagagtaacctgtcgaggctcattgcgcggttgatgcttaggaaccctgattccgagtcctcatccacctgctcaaacgatttgctactttagaaacaatagaccagcatccagtgcaggcaaaattctacgctcgatttggaatttcgaaacaaacgatgccacggatgcaactagttcagtcactagatcggagcagataggcacaatcatacgcgcgcgattagagatgagtgaggtctggggcttcgtcgtaccggggtgaggcgggtgatggtggggggcgtgtctgcgccgccgttggcgatgacgcgctccatgtgtgggaggaagtccttgttccagatgaagtcgtcggtgttgcccacggggtcgcggtcctccttccccatccagtacttgcgcggcttgggcgtcgccggcccgccgccgtactccccgggcgccatccccgtcgaccacttctgcggcttcttcttcggcagtatcaccttcaccggcctccgccccgccggctgatccgccgccgcagcagcagccgcctcccccgaggccgccgaggcgcgcggcggccgcacggaggcggcgcggccggcggcgagggcgggcagcgacatggcgcgcgaaaatatctctcgcgcggtggggagcggagagtggagagagtgatccgggaaggatacggacgggtgaacgggagagagacacacctcgtggcgtcgcgagctgcgtctcagtttattatatacgcgaacggttgcgttctgagctccgaatcgcgccgaattggagtttaaattggagcagttttgtatagttgagtttaaatttgaggcggttttgtaaaattgagtcagtggaactctggaactaaaaataataaaaagcgataattgccacttgtcttccctgtagaggggtataccaacgtatacaacaaggaacacaagatattatgaaatgcctttcttttcttctcgcagcgtaaaatactccacagctttcaaatatctcatgttcatagagatccatgaaagagcagaaagcagcacacactaccgtgctatttacacactgcggcaccggcagtaacagctaacaggttacaagtaacaacgctttctattggtaaaaaaaagagacggcttaaacagatattcatgctattccaaaaaatatttccgatggtggtccgtatggacacggtttgtcatgctattccaaaaaaaaaaattacttgccaatggtatggactcctgtcagatcacctcagatttgcatactgggcatgaaatcctcatccgaagccatttgtcaatgcactgtggaagagaaggcagatattcagagaagatgcca

SEQ ID NO: 43553 - DNA, 6071 bp, Oryza sativa
tagtcagaatacatatacatcagcatagtaacagcttcagtaaaagaagcaaaattttaggagagcaccatccagccatccctattgcaagacatatgggtcaagccacgttagtgttaacctaattgtactttcacattatgaagcactaagaatgtaataccaagtgcatagcatatgatgatatgaatattttataccaaaaggcaggagtaagctcgcaactatgacaaatttattgcctggtggcgaaaatgtcatcagaaaagcattgttataaaaaagctaagtacttactcatcagattctgacataaattcctctccgaagtttccaaatgcttcttcgagtgaatccagtattgccatgcgctgcatatttttcaaaaagaaaaaatgtttgctgtaacacaagtgttccaatgtattgacccatcagaagaaaaaaggagttgcttcaatatcgtataaggggcattaaataaagtgttttgcttctataataaacctatctggattgataagatgaatgccaaaaacacataggagcacttttggtgttaatgcctgtgcataatggaaaaacacaagggaatgataacatggcggaatgctaatcaactaggtaaaaaaagccccttgatactccaacatagccatatcatagattagagagtaatgaccaaccgtttctagatccatgttttcatctctgaagcatcctctagtcaattgggagataagcatctgagaataagcaaatgtgagtgcacaagtgaaggttgaagaaataaatttataaggattcacacattctgttgctctctgtcagggcggttgaagcttctttgcgaaccccttctgcttggaattggagtcagaacattgatactgtgaactggtgagtgccggccaaatgaatacaagtgtgccattgaacggtccctttggctctgagaagaacaatattacacctcttaataaagaaatgattggatgaagcttcagataaataatggaagtaattaagacatgggatgccatagcccaataggccaccataagcacaagatagaaatacaagtaaagaatataagattacgaacaacagttgataatcaagtgtttttggtcttatgttttatcaagaacaacagtggataattaagtgcttttggtcttaagttttgctatctgaatttgttttacacaccattgctacgttttttatgcttgcagacagatatgattgtcatgcctttttatctcaatgtttaattagcaagaagtaattggcacttgcagctaatttacttgcaaggcgccaagtttctcaatgaaaataagcgtggtagctgtagttttcaataatgtcagacatggttatcacttattaggatcaacataatagtcataactgaaaccatggcattattcataaagatgaaaacaaaattgttgcaggccataggtgattttcacaacggatgcatcaagccacaatgacaacttacagagctagattggccctctctgacagcatttctagcgtgttccacatcttcctcttgcaatgtccaggctagtgttgtatcaacctgccagattccaggaataagcgagtttttaaaaatgagaagaaaaattcaacattcacaagatggccaactgaagattgggtggggaggttaaaccactcgtgaccaggcaattggcatattctcaaagtaataagtccgtcatttcttaagttagtactgaataatcagaagaaaccacaatcatcacgtagagacaacaaaaccaactactcctataacaaacaaatgatttaaattggcaccaggatagcaagattgagaagtaaccatgagtaacaacctcttctaagttttgcgagcctggctgctccttgtttaactgctcctgaagcctgcgtgcaaactcctcatcggattcaatttgtctggttcttaactgattctcatcaagaagtgggtagttgagccccttgatcctcgatagccatgtggagctaccatcttccatggaaacatcaccagctccagtaacttcattagtggctacagagcttggttcatgcattggaacctcatcttctctcttgccattgtcccgcgaatgcgacagtttgtcgacagcaggatcagcgggcctcgcaccaagaatccccttccacttgtcatccggcgtgccggaaccactgtgaagcagcccgtgctgtccatgtccctcctgcaaccccttgctgtctgattcatcctgaggcgcggagattgatccgccatttcccccatctccaggcttgctttcgcctcccgctcccaatgtacagccacgggagccgatcaaaggatcaacaggcgccgacaccgctctctccagcatctccccctcgccgaccttctccttgcccttcttcacttcctggctcggcggcggatgcggatgcggatgccgatgcagcagcctcgccatcctctcccgctcgaggaagctctccgactcggttcttggatccgcctcgcaggcagcgcgcttccgatcgggcgagtgcacgcgcgcctcgtcctcttcctcggactcggagtcggacgagaccagatcaaccacctccattccctgcaaacaaacaaacaaaaaagagaaaacattcaagcacagccatgacgaggggaacatgccagtgagatcagcagcatcatccaatccaataatcattttatttattattcgaggtacttaaaaccgaagtaaaatgagggatttgaattgacacgtacacccgcgacctcctctttcctcccctcctccccgcttttccctcgctcgcccgtgcacaccccacccctcgcgctgccgcgtcgccggccgccgacccgcccctgctcgccgcggcccaggtcgccgaccgcctctgctttattgcgccgtcggggtacgtgtcgctccttcgcgtctcgctcgcggaggaatctggggatgggggcggcgtgagagaggggttcctctccggtggaagccggggggagacgtggcagagagggaggaggaaaaatagaagggagcaacagaagcgttagaggcagggccaagggaggcccagaaaaccggggacaaagaggaagaagggtattacggactattcacttcgagatttcgtacttagaaataaaagagaaaatggaaatacgtgaataatggtagggcctacaattttcatacaacatagtactccctgtgtaaacaaaaggccaactgataaggatgaaacatattgcatttttttaacaaaggagcgtggagacatgtgaatggaaaaaaaacgcaaatagtttgtcggaaagaaaattttgattttaattcctcatttctctagcaagaaaaggagagaaggtaatattattttgccaatctaggcaaaatttagtaggctaccataactgatggagaaataatcatcggaagagggtgtcgtgttttaaagggactagagatcataaagagagaaaatgttcttgaacttgagatgaatgagtttggctcgaaaaaataatgaagaaggattatatataggtgagggaggaaggacagacatgcaaaaattgtactaatattatttccttctaataattagattatctcacctttgccttttggaggttttgttttctcgaaatagctattgtgcgcctcatttgtggcaacagtggcgattagcctccttgatggatgaggatggtgattcttcttctccttctctagtgatagcaataggcggtgatgaatctaacaagctaaaatttttatgttggagttaaaagaaacatagattaggcgtttggaggaacgactaaggtagcatgccaccggtaatgttgttgaatccgtcgggaaaaatggtgggacaaggcaaggcaacaaattcaaaggtataccatggtggtgagacaagaacaatgatattatagagataaacggtgcaaaagaaaacaggaagaaagaaaaggcacaagaaaagatgtggtcaagtgttgacgaattgtgttgcactagagcaacaacaaaacaatggtaagaagaatcgccacaatggtgggggtaggtggagtggtggctagggtttgagaagaagggaaggggatcgattttatatggattgtggggttagaagagtcaccgcaatagctaggagagggagtggcggctagggtttgttgggaaaaggaaggcatgattaaaggggatcaattttatatggattatggtgaagatgttttcacataattaaaatttaaaatatttaaacttattcaatttaaacttacggatgtccgtaaatttaaaaaattaaatgcatatatgattatagtattttcataatcttataaacttattttaatataaaacaaagtaatacctcaaggatcataaatcacaaattcgagtcttatccccaataggaattaggattttgtgaatggataaggggatagttatccatccaaatgtaatataacttagtcctatgaatctagacatatatctcatgcagtcttagttactactccctccgtactcgtaaaaaaagtcgttttggacaatgtttaaatcaaaccttgggaatataaatcgtgaataactctcaagttgttaagtttgaaaatgaaaaattatatgaatagatttgtcttgaaaaatacttttataaaagtatacatatatcacgtttcaataaatattgttatagaaacaacaagtcaaaattgtgttttggagacagtgtcgctgtccaaaacgatttcctttacgagtacagagggagtatattttagaatagagtgaataatgcactaaattaataatgttagtttcttggacttggttattgtttaatactcagtttcaactttcaacacaccgttcaaaattggcttcctaccaacatggatttttaacactttggccctttatgaaaaattatttcacaaatagaaccacggataaacttgttcaaggaattatcctttttctaggcactagtgaccttggtgtcgaggtccaatgtctcagcaccaatgatagcgtcgataggcctggccctaagaagggtcgagctgtgccatcgcactgagccctcgaagtcaaggggcacaaccccatatatatatgctatggatataggagcccataggccataagaacttagatttagaaagcccaggaaagaaagatatataacttgtttgataggaatgtttttttatgcattacatttgttagaaacatcattatattatcagagttatattaaagggcccatctatcgagcttcgctccgggctactaaattgataggaccgggcctgagagccgacatcttcgctccgtagcaacaaagatatagagggatcgtcgccaaagagattggtgtcgaggacccatttaatttttcaaaaagggttcaaaggtaaatatttattcttacaactatgtccttggtgcaaagtacctatgtttgaccatttctagacttcctacgattttgtttacaaataggttctcagtgctaatcattctagtgccaaactccttcatattagcaacttagctatcatggtagacgaggggtgttggcgccagtataattagtgttgagatattaaacattgacaccgagaaaaatagtttatttccaaactgattttttaaagatctgtttatacaagataagttttcaaaaagagttagtaacatgtaaaaaattatatcgtgccgatgcttcgtgactcaacttttgcttgtaaatacggtttcagaaattcagacgggtcatgaacagatatcggacccattttttttcttacttttccatccatccttagaaaaaccaatctgtcccgaaaaaaaaaaaacctacttctaaattgttatattttctaagatggagagagtatgcaaaacacatgggatattaatgctgaacgcagtttattggttacccgcaaattgttaatttcagttatgggttagaacttagaatcaacctga

SEQ ID NO: 43554 - DNA, 2841 bp, Oryza sativa
tgtccatatctaacattttcgttacagacctcaaacagccttcaaagcagtacgtatgtcctttaactattttacatcctctagaattaaacagaagctcatgagagcttgactgtccaaaaaaaagtgtaggtaaaatagcggtcaacactaaacaacaaagtgcaagaaaaagtgctcttgccgggaacacgcaacactagttacacagcatcttttgtgatgcgaactactctagctgattctctccaccaaagagcagctcgcaccgtcagctccatgagcttgactcctactctcctataatcctaatctggtgagtggtgactcctctcctataatcctaggaataatctggaagaacagaaactaatgataatcctaggagtaatctgctctcctataatcctaggagtaatctggaagaacagaagaacagaaacaacgataatcctaggaataatctggaagaacagaaaccaatgattaaacggcagtaggagtacataacactacaagcaactctgacaatcagcagatataatgcataactgcagagttaatcaaaatgacatgcatcctttctcttggatggaactatgaggaaactcaaaatgacaagtttcaatttgatagaacaaaacagattcatgcaacaatcagattttacgatgctcataccagagtttaatatttttttagttattgaactaagtaatgatgaaacttggcttctctttttgcaaaactggaacaatcatactgaaaccagatctcttagtaccatgggtaaaagaacaatggtggtcacctattcaaatacaactaattgatgtgtcgttactacaatatttgccaaaggtagtgaacggtgactggtgactggtgagatatgctatatgataattaatctgagcttgtaagtaatgcacatactgctctagttcaggtcttcaggaatcaggataaacctaacctctaatgccctaactcactcaacaaaggcacaaaacctgttattatgtttatagttcagttataagataaactaacaaaaataattctagaggatgtaaaaaagagcaaataacaaacatcaatgcatattaaatatagctaaaaaagttgaaaatatgaatagccatagaagctaacaagacagataacaatgcagtaccaaactacaaacgcctaaagcaaagccacaatacaccgcaagacacaccaacatatattatacacatataatcaaagttgagaagcacaagtattgttcaagatgatctttaaccagtgaactatctcacagtgcaagtcgagagcataccattagtaattttaattccttacctcagacaattaagcacaaatcctattatgaactgatatgaccgaaatgaaagcaaaacccagaaacaaaaacctagcacaaaagtatagagatgtatggccatctgatcagggctagcccaaaagaaaattcctagcacaaaatacttgaacattaacgagtcacaagtcaaaaatccagaaccataaacatacatagtaagagatcattagagcagatgaatatctaataagaaaacccacttgccggttgccacaaattccaaattggcaaagctaaagcatgaattcaattcgactgtataatagaaaatttatcagatcataagtgcagatgagagatcatattagaatgagtagaagatccctcttgccaatatcaaaatacagccaactagaaaggcgtacagacatcaacatacacataacccagtctgatttagaatggtgaggttgaggcctgcattttatgatgaggtatactccctaatattatagtgtgtatatacggccaagtaattgaagcatgatatgaagaaagctaattgacagttgaatttcaaacttagtaaacctcccaatctgaggagatatcaaccaggcattgccaaatttaagcacgctggaatatctgagacagcttaatataaaggaacagtacccatataggaatcgcatgaaaaatccactacaggcctaatatgaccaccagtccaccacaatataaatctgagaccaaacaaatctttacctaaactcttgttcttaaattatcataggtaagcaggggtgctgaggaacgggagcgcggcgagagacatgagcatctccgtggcaccatcaggatgcttcccgtgctttgcctttgcaagctgaagctgcacgtccacgaaagcctgcatccgcttcagctccagatccttgaggaacttgatcctctgcctctccatctcctccgcgtgcctctgcttagcgaattccatgcgctcgtacatctcggcaaatgtttcgactgccctcgctagctccccgaaccctccgccgccgccgcctcccctcttcctcttgctgctgctgacgccaccaccacctgcacctgcagctgcaacgccaccggaacgagacgacacggaccgcgacgccgactgctgcgagccgtcgtcttcatcgtcctcatagttgttgttcgggttgttgtagccgtcctctgaatcagattccgccgcggccgctgcagccatcttattgaagaggaggcccgcggacgggaggttcgacgcctggcggtagtttggcaaggggagggccacggccggcgtcggtgacggcggcgagggggagcgggagggcgattccaggcgcctccgcatcatggggagcccgcggggcggggacggcttcttggcgctaccgccaccgccggcggcggcggcggcggagagggtagggccgacgagcatgtcgaggtccctgtagaagtaccaggacgag

SEQ ID NO: 43555 - DNA, 5320 bp, Oryza sativa
ggcggacggacgggggcaggtggggttagccggatagatcggtgtgagcggtgagccggtgcggcggtggggaataaaaggaggggggagaggcaggcgggcgagcggcgaggcggcccgtgggccgtgaccgaggcggaggggggcacgtggagacgctggggcggaggcattgggcggccgccgttggatcgaccccccggctcgctcgtgttgaccgtggggggcaacgagccggcggtgggaaaggggtagggggggagttggttgtcgacttgtcgtggacgtcgcgtcggggacggagtccgaattaaaatctcgctcggttgggccggcgcggcgcggcgcgggatgcgtgcgtgcgtgcggcgcggacggacggatcggtggacgacgacgcaccaccgccgggggggggggggggaccgggtgccgtgcgggaggaggactcgtgtcgtggtggcgtggcagaggcggacacggctagccgccgggcggggcggcgcgtgcgtcgcgcctcgtttgggtcgccgtggcggaaagagagaagcgtatgcacagtggagacgcgatgacgtcggccaagtgggtgacaacgagtgctttgtgtttgggtggattttttttttttttgggcgaggtgttttgggtggattttgttggttctcccggttgagacgaagtcatcaagatcctaaaacccagttcagtcgggaacaggaggatttcatgtgaattttgtaaaatttcgtagaaaaaaagtttcaaggggaaaatttcatagaaaatgatttgattcgcatagaggaacataaaaaattttcgcttttcagatatggcctcaaatatattgcgatcctcgtaacatatctctacattcctggcaactttggtatggagcacaggcgataagcagataagcttggatcatcaaaccgtgggtactgtactgagcagtacattcagatcaataataaagtcagaaaacacaggtactctgctcaatttggttgcatctcaaggaagatctcaaatgtcaacttttaccgagtaccccggccaaaactttcagagaaacaaatgatagatccgaggacacgcaacggtcctgatgaagtatgacagcaaaactagtcctgcgattcaaggcatgttcttctataagcggagacacattctttttgtacattcatgaaggttcgcggttatacagccgcaatataagaagtcaatatgtgtaccctcgccggtttgcaaaatccacaggctaatttttacaggttttacaggagaaacttatcggcctctgcaggcaaggagtgagctggttcgtcagcttgacttcagctgacggcatattcgcagtcgagcaagcgggtaaggatctcctgacagctcggccgatcttggggctctgcccaacaatctgcatcaaacaaaagcaaacactttgctaagctataactgaagccgatgcatgttggtgcgacatgactctgaacactggaataccccaattgaaacatctgtcatataaaagcaccattacctgcaattaacttgccaagaggtccttcaggaatctcgagccgtgaaccttcgtttgcaacagtatataccacctacagtggaccaaattcatgaagttcaggcaacaatgccatgtcaaaggaactgtgttggccatatataagtacatcaacaaactggaaacatgatgcatgcaattttttaactgatcatgtcgctagagagaaagattcatcataaacttcagggaatataacttttatcagctatcattcatgatgcaactgttttgatacaaagtggatgggtgcttacttgaactggggagatcccatcccaaggacgactcaatgtgcatagctcccacatgatcacaccaaggctgaaaatatcacatttctctgtaaagggttcgttccttataagctcaggggccatccattctggggtgccagcagaggagttgtcagtcataggactatcagtcatcactcgggaaaggccgaaatcacatatcttgacggtccaatgcttattcaccaggcaatttgcacttttcaggtccctgtgaactatcttcatgcggtgtatgcacatcaaaccccttttaagtaaacaaaacaatttgtcagatgagaatgaatgctaaaggagggctatgagatgatgtccgcacgacaagagaattatatcagaatcttctgaaagtttatatgtaataccagctaataggaatatatagtagtaatagttattgtacaatgagaaagatttaacctgcagatatcacggacaattttcaacctcctacgccaactgagcttctttttctgaccactcatatggatgagatagtacagcgatcccatttccatatattctgttaccattgacaagtgtggtggtaccatgcatgccccaagaaacaatataactacagatatggaatttgctttagaaactcgtgatttatggcatttgcatgatatctagtgcagagctgctgagtattgtagtttgacttaatcaaagtgagtccttaccatttggatgccgcagccggctgaaaggaaattgtgaagttctcaaagttagtgtgcatattatgattaaaaagaaggctgccaataatacagaagcaagcatagtacaggtacctcaggatatatatctcattgcaaaaatcctccatgttttcagttgtcagatcctgctctagaaatactttgatagcaacatcagtgccattccatataccacggaaaacctctccaaagaatcctgatgaagtaatttgacaaggtgacaaaaatgttaaaacatgacaggcaaacaagaaaggaaaattttcataagaaagctttcccaaaataaaagcacacattgaagtatgaaacaacatatcaaatggttcaggcataacatgtttagcatcatccccattaatattcctacattcgtattcataatgcttatcaataccatggatgagtaagctccattaaatggtctaaagaatgatagaatcaaaagttggtgacatcatgatcctcagaaagtaaatcgctgttcaactttgcagttgcggtatccaatatataatttttttgtgttagtaaattttgactgaaccaaacatattcaataaagtgtggatatggaaacaaataacaatagcaagtcatatcttatgggagattgaatttattggatcatttttcaacaccaagtttgatggatctaattcttacaggaagttggtaatagctaaggagaaaataactacccatgttgtgtttagtttttgttcattttgaaaacatgctagaaagagaaagcagcatagcaaaagtagcaacaagatgaagagtcaagaacacaagcatagcaggtaggctgacagtttacaatagacttcggtaactttggctgaggaagttcaagtaacttgcctattccaacccttgtgccaattgttagctcagagaaatctatgttccactcttcaaagggcaataaaggtttattgagaaatggggaactctgcaaaaccttgttccacgccaataccatcttttctttacttacaaaatcacaaggattgattgtttcagaaatttgcgccctatattcatgaggagaagaaggcaatgacatagctttctgagtggaaccatttcggttccttgggccattgttggtagcaacaactcctccagatgtatcatcctaaattgaaatgaaattatgagcaaaataagtcatatttccaactcccaaggaataaagaaccaatatagataagattaaacaatggaatttgcaggaacatacattatttgggcaatcacttgcattgttttggtcctccccaacatacgagggtgaaccttcattaacatggtccctttggaggcgattttgctttagtgtttcattcatagcccgaaccgccctgtcaaagatttaagattgaaacaatgaattcctgatactcattgaggatatctagcaaaatacagacaaatgcttaaggatatctagaatcaaaatacaactaaaagaaaattatcaatatattttggttgaaagcaccaagcgcagctatacaatacaactttgaaaacaatatgccatctcaaatatcgtcaggatagttcaaaataagaattacctcacaatgtcatctccaatctcaggcgtgatgctaatgcttcttccccgtattcttcgagttttagatgttgatgcaccacctagaccatctgatctgcaagtgtgttcttggcttgtcaaatgaataagaaggttcacaaaaagggtaaaagaaactgagttgaaacatgttcaagacaaatgtttgacccatgaaaagggtaagtaagtgttaagtatcaatagcaactcacacgctaagtcattgaaaaatgttattccctgtggtcacaaacatgttgttttggacatgtatgaagtcaatttcaaaactgaatataaatatatttttaaatgttaagattggatgtatgtacatatgcatagatttgtcatgaaaaacattttcataatgttatagttttatcaagtttacaattatattataacaattagtggccaaggttgtactttatacactcttatcaatgtccaaaatatcagttacacatccaagaatttattcctgttacatgtttatcccagaatgctgggcagaaagctaacgtatgacgtgaatggacatcagatatgtaacaaaatctgctctcaatggtttgccactatgaagaataacccaaaaattaagtagatttcgatcaaaattatgtggaagacttacatttgtaacattgaaatatataaaattgcacctagctaaaagaaaaacaaaagggatatgacagtaaactgaagacagcagtggagaatttatgcacttttaacaatattgtttcacagaaaagaattgaggaaaacatgcaaacttcagaaaaataaaaagatcagttgtcaaaccttgatgtaactccactttctgcatattcctgaaatgaatgttgctcgccacctagtatagatcttgcccttgtcttcattaatggatgctcagggctacaccagaaaacaaaaggagaaacatagagcgtgagaatagcagcaacacatgaaacaggtaggaaggcaatgaaacaaaagaaagacatgttacgttactgctcactactagccgaaacacaggaaagaaacaaactacaatcgtgaaagtaaccacaactacaatgtaataattctg

SEQ ID NO: 43556 - DNA, 8571 bp, Oryza sativa
tatcagaccattgcggtgcaatctattatatcagttatgtgctacctcaatttcccctcggaaaatgttcttgacctcaacataacattgcgcaatgaacgcccagatagatttgatgaagcttcaattctgcactgagattgagatgggaaattttcatcttgctcaaattaaaaactctagattgttctatcaaactaatgttaaaattggaagtcagcaagaaaagaaataaataaaatacaggacctgtctgattttttaattctactactttccacagttgtactacttgaaatatccataagtgattttgttctgttcaatttctgtatatgtttgatgttgacacttaaatcatggcaacaaaaaattctcagagtcaaatgttctatacatttccctttatttcactgatgtaaagattgacctatgtagccagtaaactatcaataaggttccaatcaaccacctaaaacaagtgagggccatatatcaacatatcttacaaacatttttttcctaaatgaaacaaatgcacatatgctagaagaatacttgatgttatagcactagaggaatatttgatgttatagttttattacacgactttgtatttagaagcacttctaccagcccaataatgcacgcaaatgacaatgatcactattcagtatagtggaaaattgccttgaaaaaaatatggatctgttgtttttccaataattaagatagcagttcagccatggttgacttgttttctttctaaagtattctgctagacattcaacatggaaactaaaatgttactatggaccctcgcaaaaaaaaatgttactatggaccatcaccaattacattcattattttctccaatgatcgaatcattaactatcaacatagtcaacaatggataaattacaatattggaaaaggtcgagaagaaccgaatcagagaactaagaggagaaatttgacatatactcatacccttcagcttcaactttatctgataatccatacagaggactgttgggctcaagaggggaatcacatgagtcattttcggctgaatcactctcgccagcagcagagatatgcgatataaagatagccttggctgagaacgggattaattgccctggaaatcgcataagatcaactagcagttccatagagttcagtgaaacaaccacggacatgtgtttgtaggaatccacaaatccaactccaccatcatcaggtagaccctatgaaagacatgaatgcttgatttacgataaagaacatggaatatgcagaagaatgtaaaggaagtcaacataccactacaagtttactctcaagaccaacagcatctgcaagaaccttaaacaggatagctcggggtcggcatgatccatgctttatctgccctagaagttgtgaccctttgtttccaaagaaatgattatcttcagttggagatcttgcaggacttacatcaggatctaggctcttgaagcagtcaaaaacctgttccagaataacttgcaagttttaagacaaataaattcagcacatctgtaggcaccaaaagtgcccaaagatgttaaaataatattgaccattgatgattcataaggtgagctcatagtgggaaattgcacatgtgggaaatagaaaactatatccactttataatttctgaaaaacttaccaagccagctattttctttatcaccaaagctggactagagtttaatcctttcacaagtgcgccactaagctgtttcaacatgaaaagcttcttatctctctcaacgtccacaataattatgtcagccttaagtccatctgcttcaagagtttgaaggtcatccaatgatggtattgttgggaaattttccttcagctttttatcctgtatgaatgcatcacaggacagagaacttcataacaacaaaaatgagaatatcaaagctcacaaagaaatgaaacaaagcaacacttcactaaaactctgaatttaatgattaagagaagaagataaccattctaaaacataacatgcatattcttttttctttccttgatccctagtctatatgaacttgcttcctcattgaagttaaggcatttgaaagatttttccttgaaacataaatttgttctgtttcctgatttggcaatgataaatcggtgtacaatgctaagctaccaaaaaatgttaaccaagatctacccaacatagcaagaaaggaaactatgtagaatagaccatctttgaaactgttaacttaaacaaaaccacaaaaacacctggaggcccagaacaataaaatatgcaaatcaagcccaatgttaacaatttagctggagaactaaacatcttttacagaaaatgcatggcttacatgaagtaacaaacatctaactaaaatgccctatgacatgccacaggtaatctagggtggttattttcctaaaatatgtccccaaggaacaaaagagaattgttcagagaaagttccttaccggaattattgagtagaaaccattagggatgaaccctgaataagtccctgttgaccacagtaattgagaagccttccatgatgaggatcgcaaattgcttcgaggttctttatcagaaaatacactttgttttctagataaggaaacagattctatctttgccaaaaagtctggtggccaccaactcggttcacatgaattcacttcggatttccccgaactagttggtgtatcgtccatttttcagataatggaattactcatttccaagacgtgagagtccccttatgcatgtttccaaatgttatatgataaaaacttcgtatttaacaccaccactgatcaaactagtctgtatctgtcaaacaaaacagatgttaatataaaatatcagaaaattatgaaccactagaataaacttctcctagtgagtccatctaaagagttctcttgtctatttcatcctcgttaaagtaccaccaaactaatcagcggctccaaaacaaaaaaaaacagtttcaatgtatttataactctgcttccttaatcaagttccagcagtaaattttgtcgcctattaaattaatgaagcaacagagaacattgttttcttaataataaaaatgaattaactcctggtaggccgtttaccaatacagtaaaacaagcaaagttcagaaagaaaaaaacaactttttaattttctcaaaatcaactgagcatttgatagtaacatctaactgaaaaaagtgggagcatgtgaactgcatgaggtctttgtttctcccaggagaaagggcaacttttgtcattggctcagttgtcaacttgatggtctacaatgatgcattagaaactaaacagaagtggatcacatacgcgctttatcagctgatgtgcatccttaaggcaataagagtcccaaacgtatcaacatgaaaaattgtgattccgcttcaaccttatcgcaatgttccaggataacatgcaaatatgttgcaaaaacatcaagttgttagcaagcatggccaacaattccacccacccactgttatcccagtaaatgtggccattgtgcctgctgtcggccaaaacttgcagtcaattattccaagggatcattaacagggccttatccatgaattgagcaccttagtaaaaccaccagtcaaaaataaaagtagaacgcataaaacaactacagtagctcagctccttggcacacagtaacgaagtacggtcaataattccgtaaattacgacgcaattgtgtaactaactatagcccggcaccctcgctgcagcggctgtttctgcccccaaaaacgagcagaatcaggatggacgcgtcacgcgcctcgcatcctatcccacggtgccacgagacaaggacgccgagagatcttttgcgcggtgtgaagcacaagggccgaagtcaccgaaccagcaaacaaatcagcgacagaatggacgcatttgcgctaattcaaaacggagcaccccccacggaattggattcagattgctcacagcagagctcactacgcacaagctagatcagaggcgcacgcaacgaatccaagcaggtcgcggaggtgtggcttaccgacacggaagagcggtcgggacggatctccactccactcacgctccgctccacgacaatccagcagatgggatgaccgaccggagcacgggctggcgaagattccgaggcgtcctgctccgcttccggcggggaggaggcgtgcgctctgcgctgcggcttcggattcggagaggagcgcgggccggtcacgtcgcccaggcagccccccgcaggctaggccgcctcgatcgctcgcagtcgcagcgcgcgatttggcggtaggtgggttggtaggtgcggtggcggaggcggaggcagaggattcaagggaccggggagggtgaggccacgtgcgacaccccacgacgaacccgtcgctcgcggcgtcgccacttgaccagggttaggccggcgcgcggcgtgctcagccgtcagcggcggtggcgcgcggtcagtcgccgagtcagccgagacgcggacaggggagtgggaggaggaggacgacgacgaggagggaagtggttgagagttcgagactccggagagaaacttaacgagagcgcggcgagagaaggaggcggggcgggtcagtgagaggagagaggagaagaatgctggctgcgacggaaggaaggaaggaaggaaggaaggacggacggctcctccagctgttgggggaggcgtcggtacgcactggggcaggctactgtggcttgcgacccgcgggccagtgactcggtgagcactgcagactacagggaggacgaaccggccggccggaggttgggtgttgtatgaaatgaacctgcgtaggcagcttgtttgtgtaggtttaattgcaagtacggaatttttaagtgggtttgtatttgtgagattacttttaaagagcacacatgcatacttatatttgagaaaggggagtagttaatattaagttacattagtttttattgcattattttttatcttttgtgacagcgagaacgtgaaatttcacgagattagtatagggagaaagatgtatttggggaataggattactggctatgttttgctaataatagctatagtatttgaccgttgtgtgttttaatagtgcaagagagtttacgacaagaactttttaatgataaaatcacaaaagtcgtaatacatttgtctttgattatcaacttgagttggcatccaataccacgtcatgaatatcaacaagatttgcgtgtctcgtcgaaacgacagatatggaatcatcgtaacactcagtttactttgtttaatattttttcatctaatattgcgtcatgaatattgaagagatatgtaaggcatatctttgttgtatctcacatcaggataatagataatagatgtgcagagctgtgcacactttcaaaatacttcattataattgttgacgccttacaatggattcacctagctaacaacaatcatgaaccacacatggttatctgaatcaccgtatgtttgtaacctgtcaatccactatgacactttatgtttctagtttatataatcacatgtttatctttagattgtttttaaaatagtggggacagttgaggaaacgttgtagtaacttgtttgtgatactattgttgcagatgccttttaagggacaagttcttatagacgatcgatttggagcatagtttattttcattatagtgttttcttttatatgagatatgagatagctttctattttggtttgtttatagactatgttatgcattagcaaagaaggaaaaacatgtttacgggggtctagatgcctgattatgagataggataagaagattgtacgtttgagaatccctacggtaatcgggtaaataactctataggttttgtattctctatgaaatcattggtttatttgttgttaataaaaccaagaaggcaaccaatataaagttcgtatcataaacaccaaaatggtgtaaggtgatctgatacacatatctcttggtatccaaatgtaatgttagatatatgtatgatatttcgtatacttaaatttacttttcattttaaggcaaaatttgctatatgacactcaaagttggtggcatttgctatgagacacccaaagaacgtgtattagctgctgtacactgcaaaaatgtggtaattagttgctagacacccacctcattatatattgtttccggtagaaatagagagagaaacattggttaaagacaagtttgcccatgggcacacttgtcaatctcacatatcatctctttctattttcctcttcttcctcatgccgctctcttgccgttactcatgcccctcggtgaagacgacgaccgccgtcagcgccgatgagccacgatcgccctctactttctgcattcctcaatcttcgcttgatgccatctccgttccatctaattttgtcccatcccatgcagcggttgaacgggaacgcggatcatgccctcgctgccctggagcgcgctctgagcatcgccgccgcgacagcatcgccgttcccgtcgatcgggtgaagctaaggccgagccaccgtaccatcttcatcacgacgacctcctcttcggaagccccaaagaaacctagccaatggtgcagcgagcttggagatcggcatcatcttctccaactccggccggcgagctccatattcaattccacccgctccagtgagccaccattcaatccatcgcacatagaagctccctaggacgtccataacaccatccgtgtgcatacatggcagctcttcgagtagatcgagccgttgtcgtcaacacggagtttttcctcgccgtcgagccattccaaccgaagccgctgctgtccaagcctcgacgatcccttccaataactttggtgagcctcctggacaagcgcggcaacggggcggcagagggggtagatgctaggcgggacggcggtcggtagagcggcagcagtgtcccatcggtgacgtccttcatcgccgattccgagggccgccgcgagagactgcgagggagcgcgacgaggaggcctgggagcacgggccggagcgagcacagcagggcggagcagcgctcgcggtaggtggcccgagagcgacgccgctgaagaagagaagagaagaaaagagaggagaagaaagaaaagagaagagaagcaggaagaagaatagtgtccaggggcatttcggtactttcaacgctctttctctctccgtttccaccggaaataatataataacgaggcgggtgtccagcagctaattaccacatttttgcattgtttaggagctaatacatgttttttgggtgtctcacagtaaatgccacaaactttgagtgtcatgtagcaaattttgccttattttaaacactctttccagtttaataatttcacgttgttttcaagggtggatgtagagtatattaggggggtgcctaggaacccgatcaagaaaactttttagctatacctatgcacttcctcgatacaaacttagacacccgcatcaacttaaattcgatataaagtagagtaaattaagcaagtggcaccaccctccattccgttctagctccgccctggttgttttggacaataacgtagtcttccaatatgattttctattataatatatagtaaatatatttttaattttattaaagcagattttaggactaatctatatattccttctgtaaaaaaaaacaagagggcaaacctgactatgaatctggatatttggacagatggagtatgttctagcgcactataattgaataggcaggtcagatcaaatccatctttagaaaagcaggagtgcaaaggaataaaaaagagcagagatgaaaagagttttgccatgcttcatccattggatcctcatcatccaagatatttgtcggtgcggtgatgagcatttgcctacgtgttcaccagcttgaccaatggcaaggggtttgaccgaatgcacggtgcctatcatgtcaactggtcgatcgacatagcagccgtacgacctgcttgtctttagccctcgtccaaccatcattttttttccccacatttgcacagtgggagtacgaatcaaactgtgcgcatcattgacaagcgagtcaatttgttaggtcagccaggtgcacggtgtcaatcgtcagtacgtctgtacgtgtgccagtgtacgtgctcgcgctttgtgttgtgcagtgcttgtgcctcgacccacttttgccatcgagtacacgctctcgcggcgcccggcgccattcacggccggagcgcgtgagcagagcgaggggccggaagcgtatagcaagcgccatgtttccaaagccgtcgtcgtgccgagccccgtaccgctatggcgcgggcgcatgtgcgttgctgtcaactttgcggtgccgcgggcgcgcgcgcgtgacggcctgtgcggcccgggggggggggggggggga

SEQ ID NO: 43557 - DNA, 14336 bp, Oryza sativa
acacctctcgtgccttttcctctctctctcactctccctgtcgtgccggcggatcggcgagcggtggtgggctccgtgagctatcgacctatcgtcgcgcgcgcggcgcggtggggtggcgtgcggtgcggggccggaggagcgggagaggtcgcgatcgcgatcgcgccggggtggagctgtcggtgctagttgtaaagtccgtggcttggcttgctgcgcgcgcctgcggctgcagctgcgggcgagggtcacgtgcctcgtgcggttacgtacctttgctttcctttgggcgaaggtggggaacgtgggagggatggggacgccgctgccggccgcggatcgtgccgtgtgattcatgagaaaattgcaatattagtacggtaaacattggggttttgctgttttgacactttaagtggatgacaaataagtctatttatgtctatgaaatatgggtctaatatctttatagtaaaaattaatgtttgcagtgtcataattgcaaatccctggtgattcaacaggctgccccggccctcaaggctagaacaatattctgcttttcgccggttcggcccggccaggaccaaaatatgttttttagggtacgtagctggtaatcaagtggtgttctagctctccgtgctgtttgattgtctttttgaatggataactttttttaatacaaacgagaggagtcggtttgtatccggtgaaataaactgccccgttataaagcgagctaaaatacgttacaaacacaattgatggttttatttcacggcgcatgggcaacataagaaagaacttaagcagatcacattgtcagtcatcacgcatgtgcttccgtaggaaatcaaggtaggttcgtgaacgaccggtcgtacatacgtttgctccactaataattgatgacacttcttaattactagctactagctaggatttgggcaatattatgtttgatttgcatgaacaaggaatcgtcctgtgcatgatgaggattgccaactgcgcgtggaaaagaacctcgtctgatcttaattaaggaatcatgcgaaaggccttgccatgtttgtagttcaggcaggcaagcagccggcagctaatgcatctatatgatctcatggcgctgaggccgcgaatggctgagcaatggcaccaatcatcaatatatcatgcaatggaatatatgcgcaagtcccctcgtgactccgcgtgacgagacaccatgttttacctggcattcagcctgttggtcgtcggccgggatgttaaggcaccgtacagctacttggtttagttgcactgccactgccttgtcacttgcgttttaaaagaaaagatcaatgcattgtcattgttgctgatcatctccctggatttaacttaagtactcctagttgcaccgtgcaagtgttccgaaacaaagaagagtagtttgcaccttgtttgcagagacaattcggattgaatgttagtatggatcgaagcttcgccggcaccacgcgcacttggatgaatttgcatgttcactgctcaccggccgcagcttgctgttggcctgttgctgatgcagtgatgtacatgtcccattggcacatacggagtactccagtccaactagctttggccagcgtaggtgaaaagttaccgaatcttatctgtttagttcacgctaaaattgaaagtttgattgaaattgaaacgatgtgacggaaaagttggaagtttgtgtgtgtaggaaaattttgatgtgatgaaaaagttaaaagtttgaagaaaaaattaggaactaaactagatatgcttctagttttaccgttccagccactcctggataaacctggctgccacagcaacgaaataacatgtgcttggagatcaaccggttgacggagcaaactagctattcccagatcaaacatgattactggatcttaaatataggcatgtttaggctgcatccatgggtcgacacgtgtgctgtactggtgtgtaatgccccggttgatccatgatccctggctcccttcatgggctcatggccttgtccgatccccacccatgtacaaacacacacaagctgctgccaaccgggacctcccggaaagctggcaccaacaaagcgttcccgttgtgttgcgcccgcgcgcggcccacacacgcgcacacgcgctacgcgtgaccggcgctagcgtccaccacccagcctgccgcctgccggccataggcggagatgcctgggcacacggccggcccgccatggcctacgtgacgtgacaaactggacaacccgtctcgtacgccctcgtctgcagggtacaggctacagcccgccgccgtcgaattgcggaacggcgtgtgccccgtgcggccgggtttcggcacagctctgcaagcccgcacgtacgcggcacgcgcgatcgatggtttgtctacccctacctaccacgagtagagctactatgcggccttggaagtttgccttgtgccgttgtgctggtgtcccggactcccggttggccggttgataggcatgttggggagttcacggttcagtgtctcggagactcggataatgttctatgcgtgggcatgatcattaaacgggctctgtccgtgactgggggacatccggcccagtacggtccagtagcggagctctcggtgaaacgctgaaagagagagcccacggtcagatagtttatgtaagtgcaagagcgaagaatagttactggagtatctccgttacaaaataaatttatttttcgtctatctcacacataccaatacaaaagaaaaaaactaaaatactattgttttatcaaagcttaatataactttcttactttaactactcccaatacaattattacctacttttacaaacttcaatgcaatgattactctaaaaatgaacttattttggtacaaatagaatgagctaaaaatacttaatatgaggcaaaggaaataacatccttgtacgtgtacaacctacatacacatccatggcccatgtacattggttgtacattggattagggccgttgtagtatgttttttttttttaaaacaagtttatttaattatcatttattttattgtgactaggttctttaagcatggtttatatttttagatgtttgcagcaagaattaaatatgacaaatggttaactgtatgccaaaaatcagtgatgttttatattaaaaaacgaaggcagcatatgaattaattgtggtggtgttggagcgtgtacctacaaagtaagtggggtgtttgcaaactgagggcctgtttagatcctccaaaatagcaaaagttttgccgttttggaccactttttggcaaaatgatctaaacactagtagcaaaaagtaggcaagttgacatttgtaatttgggagtccatagcagcaaatttagcaaaaaaaaaaaaagcatcgggcccgtgcatgagagagacagcagcaattaatggcaaaactttaccatgtatctaaacaccaacttataaaattcaatgctaaatcttttgctaccaaaacttttaccaaaaaaaatttgccgcagcaaattgatctaaacatgccctaatttgataaactgaacaatgaacctgataaaatatgcagtaatagactgtcttgtgatgtgtgatgtttgctgtctgcctctttgggctggcactgaagattggcttttgttgatgcctgaagatggaagctggattttgggtatgttttcaaactgtattactgcaatgtattggcaagctggaatccccagccgatcctactagtctagttagatttctgtttagttcccgtttgttgtttctgtataaaaacctttttgttttcttcagtttcatgcaaagccgggtaatgaaaattgcatgttctctaaaaaaaagtagaagtaataatagaagtaaatgtgcgcttgattgaacaaacatgcatgggatgttggtttttaggaatcaaatgtttgattctgacattaaggttcatcatgaatattagtagaagtttagaatatagggtatctgggcatgtactccctgttgccttaactttagcttgagagttgagactggctcggttatacttaagtaccagctaacgtatcactaaattaaggccgagtttagttccaaaatttttcttcaaacttctaactttttcatcacatcaaaacttttctacatacacaaacttacaactttttcatcacatcgtttcaattttaaacaaacttctaattttggcgttaaaaacacaccctaagtggcatctctgccctggctctttttttagtttttccattttagcttagggccatctttctttctgtagctctctatagatgcaggaacccacgctagatccaatctgagcaacactgaagaaattaaaggtgctcccatataaacacctgagtcaactcaagatgccgtgaccatgcgcatgcagtgacgcaacaggacttgatctactcaggccaagtacagtgcacatccctcctcgtatgaccttatcattattatacagtaatgaaacaagtctactttacatttgtctaaatcttcagatcaggtggaatataatctccgccgtgtttagttccaaaatatttcttcaaacttccaacttttctatcacatcaaaactttcctacaaacataaacttctaacttttctatcacatcgttccaatttcaaccaaactttcaattttagcgtgaactaacactagtacggaaaggctttttgcatacgggcaaaaagcatctttgcatgcggttggggcaaccgcatgtgggagaaggtctgtaaaaatcacccttttcgcatgcggccggcccatccgcatgcaaaaatcccattttcgcatgcggttgcttatacgggccgcatgcgaaaataaattcagcaaacaaaaaaaaataaaaattcaaaaaatcctgaaccctagaccgccgccgcacggtgccggattcgtcgcccccgccgcccgccggcgtcattggcaccggatccgtcgcccacgccgcctgccgtcgttgccggcaccggatccatcgctcacaccgcccgctatcgtcgccggcaccggatccgtctcccccgccgcccgccgtcgtcgctggctccggatccgtcgcccccgccgcctgccgtcatcaccggcaccggatcggccacccccgccgcccttggcgccggatccgcgcggggcggcgccgcccgaggtcgccgtcgctgcagcagtgaggaggggatggcggtggcgccgctgcccgaggtcgtcgtcgccgcgggggtgggcgccgccgtcggatccgcgttggaggagggcgggggagtcgccagcgacgacggagggaggtagaggcggcagatccacgcgggcggccgctcccgcccgccgtcgccgcgtgccgccctcggccgccgcctcgcgccgtgccgccctaggccgccgccccccgcgtgcctccttgccgccgccgcgtgccgccgcctcgcgacatgtcgccctcggccgccgcccccgcgtgcctcctcggtgttgctgaccccgccgcgaccttgctgtgtgtgagggggagagagagagagggagttgaggagaaataatggtggagtgaagataaggttggagataaggctgctgaaattttgaagtggtggagagggcgaggaggcaaatcagacttttagataaaaataaacattaaatctaattttgtggtattaaatgaattcatgtgaaaaagttgtcaaaaacaaagttgtagagatcattgagatctaccaattttcttttggtcatttctccatctaagtttgattgagctatataaaatttgaaatttaaaatataagaaattcaaataatattttgaagcaataaatgatttcaaatggaaaagttgtgaataacaaagttgtataaattatcaagatctataacttgttttggtcatttttctatatgactttgtttgaacagtttgaatttgaatttcaaattataacaacttcaaacagcattttcaaatactaatcgatttcaactgaaaaaatcatcaataacaaagttgtataaatcatcaagatctataacttttatattggtcattttttcatccgacaaagtgatttgttcacaaaatgtacatatctcttatatagtttataaaactataagagagatatatattttgtaaacaatcttacaaatatctttatcggatgaagaaatgactaaaatagaagttatatatcttgatgagttatacaactttgttgttgatgactttttcagttgaaatcaattactgcttcaaaatattatttgaagttttgaaattcaaaattttaattgataaaataaagtcaaaagaaaaaaatggccaaaataatagcagtaagaacacaataacatggtagagcatgatcttagaaacatttagaaaaaaaatcatctaatttggagttcatataagtgagatacactagttttaaatttttcaaattttttatttttgcatacgcctccttaagtggatttttctatacgggcgcttaagtgagctcatttttgcatgcggccgtcttaagaggcccgtatgggaaaatcgatttttccatacgggccacttaagaggccgcatgcaaaaataacctacgattttttgtagacgccactagttatggtccgtttgtaaaaatcaaagggtctcgtacggaaaaatcacttttgtagtagtgtaaacacagccctcgattgatactagtattatttgaactttgcggagtactgtcacatgatttcaaatgacgacgtatggatgtttattatttacatgtacatgagttatcttcaaattgtatatacgtcaagcaagtactactactagtaaggttacaaggcaaaaatcaccctgaataatacgttccaccattattgaggttagagttaatcaggggaaatgcagagaataactatctttatacagttttggtagtataagctttacctttaatcaccaaaactggttgttaatttccagcttcaaaataaatgaagtctaggtgcactagcttgcatggcaaggcgatgagccgatgaccagcgtgaggcagtgaccacacggagaagcgcatttccgggtcacgggtgtggcaggggaatccactaataagagtttaaaaaaccatgcggttattatgtattgcaacattctcagtttttaaaaccactatataactcacggtaaccacaagtcacatatttatcgcggtaaccatcaaacatgatgtgacgagaaccccatctagaagatttggtaaacctgacactgacacaccgtgccactagcccactactatccatctcaaggacgtattctacgagctttgtttgttcttcgctccgtttatactccagtgtaaactcgatcttaatttcatttcgcttaatgacttcactttgtcctcggatgatttgcgtccgtccgtttgttcacgctctactacacgtacagacgtgcaagtcagcaaacctgaaggctaagcaatcgcgcaactgcgtggttactatacgcacctgtgaggctgtgaccgttcacgtgaggcgatccctttcgaccggccggttacgtaaaaagaccggagaatctcgcgtaaacggttatccatttctcacgggaatctttcggccctggccttcctgtccagtgcgacccgttgtgcgatcttttatctgtgttatattaagtcgtttgatttttcttagttaaacttttttatatttatttaaatttatagaaaatataatcgaatttttaacataaaaataaacatattatcataatatatttaatgctaaatttaataaaactaatttaatattttatatattgttaaattttttgatatactttatcaaatttatcaaagtttaattaggaaaaggagtcaaataacttataatattaaacagagagagtataaaatatcatacgttattaggtttgtttatatttatattttgtaagtatagagggagcggtagtagctgccagcctgccaccgcgacgagattgggtttcggtcgtcgtaccgtgtccgtgtcgctcgaccggagacgcttgaccccgcgggcgcgcgcgaccccagtcccgacccgcatcgcacatacatgtggccacaggcggagcctccggcccaacccctcctccaagtctgaccgtgcgccgcgcgtgtcgtacgtacataagcgggggcctccgctagctagctagccggagggatcagcacgtctcccagtcgcctccagcaacaagctccgtctcattcattcgccagtggcaagcttatcgccggccggccggccacccaccctcgcgcgatcaatcgatcggtacggtcaagctagctaagacgagctatggccatgctcgggaggaagagagggggatcgtcgtcggccaagctgccaccccacgccgaggacccgcgtgcggctcctccgccgccgcaggccggcctcaccgccaccgacggtgggcaggaggtggccatgtcgcaattcgtcgcgcagctaggcatgtgcgaagcctccgctcgagtagcgaaagcattttgtaagttgtaaccaatggatggatggttgaggaatttgatttttttttcttctttttttgggtgcgtcttggcatggcagacgaggcggcgcggaagaggctggacagcatgaaccagaggctcaggtggctggagcagcagatggagacgctggaggcggaggtcgggaaagccagctccgccgactgatgatcacctagtacatctttgtagcaacacccttttttctttagtcttacagatatgtagttcgatgatgatgatgatgatctgatcgccttttctagcttaatctctcttttgttcgatgcgttggagcagcgcctttttgcctggaacctctgccacgttttaggggtgagtatttgatcctgggtctaacgtgtttgcctacgattcattctgacatggaaaagtatggccgttagttcatcacttcatctcgtcgctttcattttctgtggaaatagcctaccgttccaaccacgcatgctggacttctgacttctaatgttctacagtacctgggaccaaaaccatacactctgtattaaattaaccagtactaatccccactgtctgcaatcactagtacatatttgtacgcaaatagaacgaattgtgccgaacattccacatctaaaagtgaatactctctgtcccaaaatcttaaaatataagagattttaggtgaatgtgatgtcccttatattttaggacggagtaagtatttcatctgtttagattcattgtattagaatatatcacgtccacttaaaatctcttatattttgggacgaaagaagtaattcttagtacttctattaattcagatgtaataatattcttaaatcattcaggagaggcactgttcacacaatcaccgaagtttgcctgtatggtcctttgacgtcttacagcaagcttgtgcaatttcatggtccgacagtccgacacctttatacgcgagataacatggccgtgtttaaattcaaactttcaatttttctatcacagcaaatgtttagacatgcatgcatggagcattaaatgtggaaaaaaaactaattatacagtttacatgtaaatcgtgagacgaatcttttgaacctaattacgccatgatttaacaatatgatgctacagtaaatatttactaataatagattaattaggcttaataaattcgacttaaaaaaatttgatacacgagctaaacacagccataacagaaagacagaaataagcgagccaatctattcatacaggtacggagtaaatgtccagccaaaagtaaaaaaggtatcatcacttcatcaagaacttatgtacaacagactgccttctgctttcacttaaaaagcaaaagttttacaacacaatttccttctcggagctaaatccatttggtaaaatggtacatttcccgcacaagaacaggatatgaatagtaccttgatatccagagtaaaaaggaaagaaatgaaagaagaaaaatgccgggaacaaccacaacggcatgcatccacaaccacaaccagatggcaatatgaggacatcaaactatgttgctattcacaagctagcttggtaccaaagctgctgaggctgatagcaaaggcttgaaacgctgagagtggctgccggtaatccatcgtgaagatattgtcatcgaccttaccaaactgcaacagaactgtttcctcatccttcgagctagcaggatcattgggatcagcagcagcaactagttggaaattcttgacagatgcaactgtcacccgcccatggaagttcaagcaccagcactgcaagtgctcatgccagcggggagctttgtttcttagaactgtgttccctgtgggttttctgaacttcgtctttagacagttttcccatgtctcttgagttgaagggcactcaagtgcacaatacattctcctaggacctctggatttgagcaggttgtatttataggaaacctgtccaacttcatagtttcctgctgacacttggggacttatccttctacttccaaaacgccgactggatcgactacttgatgctttagcgccatcatatggtggcttgctatcatatattttgaagtttgtcccccaaaaatcagatctaaacagaagcacaataataccaatgaataaaaattaagacaacaaaaatccaatacaagcacgaaaacacaacagatacccaaccagtccaaattatctgcacaccataaggggaatcaaatcaaataaggccataacctaatctaggacagtgaaataatgtctcaaaggaactgccgtgagacttacacagcaatcaattgcaaggaaataaatgaaatacttttgagcacaaataaaggaacaagagaagttataaaaactgaagagcctgaaaactccccaaagagtaaaggctaagacaaaatagaagcattcggcagttttaagtgcaatttatgaggatgcaaagtacttcggcagtcaattgcaaggattatgattcatgttgactgttactgttgcaaaccacaaaatcaaggaatggaggaggcatgtgtgacaccctaccctggtttgagtaagtccacacatgagggtgtgaattagtcccaccttgtggccttgtttggcaaggctaaaatcccaggggatgggccgggtctttcccaaacaaggcctacttttgcaggcttaccaggtccaaggtatcaatccctcaaaacagaaaaagtccaaggtatcaaccaaacccttgaacacgaacacaaaggatgaaagtgcaagtgtgttggtgtgagtgtgtactctatccaaaatggggttagaatttagattatagacttaaaaccagttcagaccttggggcatcacagcatgccaccatgttaaggggttcaatcttacaacataaggatatactccctcctttttatatatatacgacgttagttaattcaatattgaactaacaagcgtcatatataaaaaacgagggagtaccatttgaactataaaacagtccaatacctcattgaaaaacaagatagtaaagaaacagatactatttagaactcagaaggcttatattgtcttatggtatgggtacccaattttttttaaaaaaaaaacatctgcagatcagctaaatacatatttttagtgcattagcatgttccctaattgtaaatatattactgcaaccaatttgttagcactaagcaggatgaataacagaatatgcaagaatgattaagagtgaactatgcagccatgtagaacctcacctcagtttccccatgtatgcattgcttccttgtgaaaggtcatcagcatcaagggatacgatgtactcggtatggggaccacgtctaaaccttctagcagccatgaggaacttccctttatccacagttgctatcatatacaaaaagtatatattaatcatcaagcacatttgatggtgaaaaagtccatatggcattgcagttggtacaaaaaccagaaggaaaaatatacggtgtaactgacagaacccccatcctttttctttttcttttttttaaaaaaaacacatatccgcacatgttagatgttacacttgaacagctgagtgtaagcctgtaaggagagaaaaatgttgcttctagatacataatttgagtgctgttggatctgattgtcaaaataaaagaaatttgaaaacacttgactaagcaggccatcaaatgtaatggaacaagtagacttccagtcaccctaatcactatttgcaggacacgaagactttggtataattcagctaaacccttcaacaattatgtccaaactagccaatccaaataaataaacagtgttaagtatattcgggcccatatattctaggcccattggcccatgaggacataacatagtacataatcccgaaggggcatctcttatcaatttcttatcagttgtttcacaaaaaataggcaggtacaaaacaatattagttcctaattcaagtaaaatgctgtaggttctaatccattaggtgctccaatcctccaccttatcctcccaccatcccataccaattatgccaaaagatccaaatgcaaaatatcacatggtcctagaatgcaaacatactgtgcatttctgctggtttgacagataatttgaatctatagaaaaaaaatgaaagccaggaagcaaatgtgcatgggactgcccatgccaaaagttgataggtcaacatcaagccatcaactaggagaaacaagcgatgcatctccaattaaagccacaacgaatttgagttaaatctaaaagcattcaacttgactactgctaggcatcaagtgtcaaccacagacaagtaacaaattccaagaaaaacagaacccgcacagcaatcataaaacagcatgtcacatgccttacattgagatggcaaatcaaattgattatctagatgcacataatcaaattgatgcctgcacatatgcagcacaaaataaatgagagtcaaggaagttctcatatcacatcacgtacagtcatacacttaccatttgtcaaaccaaggtagaggtagaacgtagagttcttcttattccgcttaatgaaacattgcattgggaactcccttggccctggctgcttgacaaaaggtgtaagaactccgattaatttgcatacaaatactgtgtatcaaaactacgacactcctctgcaagactgcaactaaaatcctacgtagacgaatcacccaaaacaaaactatgctactcatctcatggggaatttcagccactaaactcccacttataagtgaaatcaccctctgtgtgataggatagtaaatagctaaacacatatggccccgttcgaatctgattattggatgaagattaagtgcgcatgtaaaacgagactcattagcgcatggttaatgatgttttaattattaaaaattaaaaaatggatttatttgattttttatagcaacttctatatagaaagtttttgcatgaaatacaatctttagcagtttgaaaagcgtgctaacggaaatcgaggaaaaatctggatgttgttggagcttagaacgggactaagtaaagctagactatatacatgctggaatatggtcctaacatcaaatctgtagccaaaagcatgaaaattcaaactgctggtgataagattttccaactattcattcatagcggacgaccctcctcgggtttgtttttccttccaagcctccagtgtgctatactgctatctaccaacgatgtggtgattttgccaaagccataaaaagaacaagtgcgatataaatcatccattgtactaactaaatctagttgctcccgagcctagttttaagttaaatccacaaactcttataaaaaaaaatactagtatcaaaatcgattgaaagttaacttactccaaaaacaaatagctaggactagacataaacaaattaactaatcccacgaaacatcgcgaataaaaaaggtaaatttgtaaacctcaaaaattaaataatcctctaaaaatagcatgagcaagtgatctcagcatcctatggccagaactgagggaacctaaagacgcaggctccaaatttagcaatcaaaagcatagaggactctctaaa

SEQ ID NO: 43558 - DNA, 1856 bp, Oryza sativa
cctcgtgcacctcgccgccctccggcggcggcggcggcggcgtctcccgaggcatctcgtcgcgtcgcgtcccccaccacaccacccccaccaccaccagtgtaccgcctctccactaggtcgcggggctctttcttttggtttttgtactggaaaaccgcgtccgcgatggagaggaaaatggaatggagtacttgtctggaaaagtggatctagcagacaagcactgtgactacacccccaagtgtgtagataaattccttctttttctcaagcatcatggttataaaaatgtccttttcagctagcacaaatactccttattacacgtagagagcatttattgaaatagattttattatactaaaaaactactaagatttttatcttcggagtacaccttccatacacactctatcgccgcacatacacacgcacacgtgtaaatatattatgatgcgcgtctaaataggattacacgtgtcatgtccctttttaaatatatgatgttgatgatttaaccattcgtattattaaaaattatattttatttattttctcatgaattgctttattattgcaagaacataagcgctaaaattaataagacaaataattatacggcatatttaaaagttaataatgtcatatatttaaaattagaaaagtactacttttcaccttttgggatttgatcccgagaaaaaaaatgtatgaatacattcgacaggtagagtttgaatttttagaatatatgttcataatataagatttatcaactcttgttcattttcctttttttaaagaatgaatacatgattaaattttgcagacatagtactagttaacatttctatgttccagcataatgttgctcacataaaaaaagtagacttaatgcaatatgtgttgtggaatattgtatacaggtttgtaaatacatgtcatcgaagtgctatttatatgtaaactttgatcaattgtctttttttcaataaatttactaataatatttaaaaggatatcgtagtaacaaggcgtgttacatcttaaacataaacatgaaactttcattagtcgtagtacgtataatcatagtttgtgtatgatggttattttcaacagatatttgcaagtgcacatctccatccattgtggttgcatgattgtatctatgttctttatgaaatgcgcacgataccctccgtaattattgtaaattacttatataaacaaataggtcacataaacatattataaaggaaaaaaattgcagcatatagcccccttgcaggatttgccgcgtcaattttcttccgaagaaaaaaaaagtaaatatatgctacaaatactaaatgttttgaactcgggaatatatcctacgcataaaagctttccgtgcacaccaacaaatgaatgttacacaaaattctataaaaaaaaagacacatacttcaaatagcattacagctatatgtgaaattttatgttcaaattcattatattttagcctaaaaaagacaaaattctgacatataattatctttaaactgttagatttttcatttgtttatggctaaaatataatgaatttgaatatgagactttggggatacgtgtaatactattacgagtaaatatccaattttttttagaatttttcgtgacatttgctagttggtgtgcacgaatgtgtacgagaaacttgtgtacataggatatgttacatttgaactttgacgctcaaatttttaggatgaattctatgcaatttacaacgatacacttgctcaatctttataagcacgcttcccaaactgttaaatagcgtatagaagtttatttaaaaagatttt

SEQ ID NO: 43559 - DNA, 8477 bp, Oryza sativa
atcttcttcagtgaacgagcagcctaagcccaaatttgtcttcggcttggctcggccacaccttggtgagtacccttggaggcccaacaacgcatagattgtcggcccggcccggcccgtacgcggcaaatatattcgctgcactagacactacacaaagtgggctccaccggggggagtcgccacgacggcaccgggcaccggcggaggaggagataacgcggaggcctcgcggcgcaaactccccaggtactcgcgctccttcctccccgcaacccaccagctcgagcctcgccggcgctccgaccagcactcgccgtgcgtttctcttgcggttgggaaggggtttaccccgctcggagttgctccgccggcggagaatgtggtagccacgccgcggccgaaacctcgtggtgtgtgtgtgtgtgtgatggcggcgccgccgccgagcgcgacggtggggctgattcccaacctggcggggcgcggggtcttgctccccgcctcggcgcctgattcgagcgcgtgccacgggttcgtggttccgacgaggaggaggaggagggtctccgtggcgccgtttggttggggtttggcgaggagaggccgggtttctgacgcgagagcggatggttttggtgctatgtgcgcggtggctggcggcgaggctggtcccggttcgtccgagttgcggcacgtcgagaaggagctgacgtttagcccgactttcaccgactatgtgaagatcatggagtcggtgaagttggacaggagcaagagtttagagagcacagaatcggatggaaggagctcgaggaggaggtttacaggcgatggcgatgcaccggttgttcggcgaggggacgagaggtcaggtgatggaaggagtacatcttttgataggcaaaagggatctcagaggaacagaggggatgtgaatgagaggagcatggcgaataatgatattcagaacaatagtattaggttagtagagaaaaaaaagccaggtgatgttgaaaagcgtcggggaagacagggaaaggtagatgaatatgtacagagaagaattgttcgaggtgagattagtgaagatgaaggtaatgttgataaaaatgagcgcaagcagtttacattgcagttgaagatgaaagatactagaggtagtatggttgctcatcaatcagagagaaacatgcatgttcagtcaaatgcacggaagggtttgcaaagacagtcgacttcgatggtaagccatatttctagcccttcaaacagcagaattatattggagaacaccaagtctttggtaaaaaggggaaaggagaactttagtagcccagcaagaagcatatatgagaacaatttcaaatatcccagagaaagaaaatttaccaactatgatgtcaatgctgatgataaatttcaaagataccagcaaacaacagaaaattcagggagaggtgttgtagtgggaaggtttggagagggtgatattgattataacaaggctactgtaagcaaaagatatggcaataggcaggcaacgtctgggcatgatggtcatccaacggtcagcttgaagcgtggaaaacctgaagcaattcgaatgcagagaggggaaaatgtccaaacagggaagtttattaggagagatgcgaaagctatagacttggacgatagagctgctttcaagacttttgaggtattcactgatgtcagaaacaggccacgggttcttcaaatggaactggaagatagaattcagaaattggctagtcggtaagtctttgtatgattggttttacagcctgtattgaatttgttgagttgtcttggttttgctgttgtataaattcatcataatagcctcttctaatttgaaaaaaaaaaaactcatgacggtattctgtcccatcaaaactacttgacactgcctctgctgcaggttgtttgatgggcattaagtattttttacaagagggagttgcctatatgtagcccttagcatgagtgttacttcgtttgaaaatctcagggcgttctagattctatttgaacactcatgtattcaccaattttaccatcgttgttcacatccaatagaagaggacactgaccacctctttttaattgatcacattaaactacatgatgtacttccagtgacatgaatttcgttttgatagataatgagtaataacactgggcttctatcaagactgctgctcaaatatattgtatcaatacttgcttatttacaggctcctgaaagtgagatgttacaagaacaggcatatgaaaactgttgtccgataattcccactctaaaattatgtgtgaacttttttttttgtgatcatgttatctagatgctacttgcttggagaattctttcatgcatgtaagacaatattacatgaatgggacttctagattgaacttagaaaatactttcattcgttgatgagcatcttgctttcctatacattttttgttgcttcctagacaagtcattgagcctatggagtcttcgctgtcttagttaattctttatggttatttattttgtgaaggctgaatgctacagatgtaaatactccagagtggaaattctccaaaatgattcatgatgcaaaaatcaaattctctgaccactctatcctaagggtcgttcaaatactgggtcgatatggaaactggaaacgggtcttgcaagttgttgaatggcttcaatcccgtgaaagattcaagtcctacaagagcaggtaatgaaacagttacccatttatatgttaatatattattgtgaatcttaaagctgcagtgttagtttatatatgtatatttcattttttaccgctgttatagacttatattgttgtttatgtagcagagtataatgtgtactaagttgtctgtgatgaaataagtttgcttcttcatttgttcatcttgtagtttctttttttgtttctcttgggtaacccgtaagtccttaagaatcacattaaatgatttacaatgcttatcatatttaatgcgtatgatgttcatgagagaacatatttgttttgtaggtatatttatacaacagtgcttgatgttcttgggaaggcaaaaagaccttttgaggcattgaatgtattttacaccatgctggtataactagcgctcatctgtcttatgtttggatgtacctaatctttccatttaaatgatgtccttatatttcatctgcaggatcaattgtcttcttatcctgacatggctgcttatcattgtattgctgtgactcttggccaatcttgtcttgtaaaagagctatttgatgtgattgaccgcatgcgttctcctcctaagaagtttaagctaagtcctattcagaattgggatcctaggttggaaccagacctcattgtgtacaatgcggtgagtgacacttttagcaaatgttctatgtaagtgagtgcaccaatgacaatgagacatgattgtttaatattgttggtaatttagtattcagtagaatgtaactgactctactgctatgtaggttctgaatgcctgtgtgcaacaaaagcaatgggaaggagcattctgggttctgcaacagttgaaagagaagaacatccgccctacaaatacaacatatggtcttgtaatggaggtacggtaatcttgattacatattctctctgtcctcccctaaaccaactgtgctggtcatgcagaaatgcgactgcaaatcttttatgattttatggaattaacacgtaatttgcggccgtgttctgcgtgcatgggactatacatatgactcatgacagtttcagagaccatttctgcatcgatgtttctcttacctggattctgacaagcatattatatctatctacagcagatagaatgttttgctcatatgttggtcttagggaaaactgttgcttaacttggttccatacgatttccgtagtattgattgtattttttttttcatatgtttggcacaattctttatgcagcgtaatccattttttgttataattttgtggtactgtaggtaatgcttgtttgtggcaagtacaacttggtgtacgagttcttcaataaggtggagaaaacgtcaataccgggcactttgaactataaaggtaattaagaaggtttgaaaacagttgaaggcaaattttatattatatctcatatctcttgctgcttgcagttctcattaatgctctttggagagaagggaagattgatgaagcagtcatggctgtcaagggtatggaaagtcgtggaatagttggttctgccagtctttattatgaccttgctaggtgcctttgcagtggaggccggtgcaaagaggcacttctccaggtttgcacttgcaaaaatatagttatatcttgtacatgacacacttgctgtagctgttgttgcaactgaaaatacattttgccacctatagtcatcttgaaaagtaaacgtagatctataattctatattggacttagaacctcagctgcaaactgattcttcatttttttaataaccgatagcagttattctgctggttttaacaatttatcggcattttactgtcattagttgctttcgtgaccataacttttactctaatcccgatttctcactagatagaacatacataatcacaattgcgaaaagcatattcttgttgaattaggcactgtgtgttggtatatgagactatatgcatatatatttttgatagatgaaccaataggctggaatttagttcccacagtataattatcggtgtgagcttcaaatccaattaacttactttttgtaaaacaagctgaaaaaactttatcaaacagccaggcataagaactcagcttgaacttgtctatctgtaagcgccatcacctgtctatgcttgtctcatgcctctagatgctttgttttatctcttaacctttttctgatggcaactgtaatgcaggtcgagaagatttgcaaggttgcaaacaaaccactggttgttacctacacaggactgatccaaacctgtatagacaatggaagcatggaaaatgctaaatacatatttgacgaaatgtgcaaatactgctcacctaataacataacatgcaacatcatgctgaagtcatacactgaacatggaatgtttgaggatgcaaaagatctattggagaatattctcagtggcaggataaggagtaaagtggaatcgagtcaaaaggcaattgcagacaaggttactttcaatattttcatggaggcctgtgctgaagcaaagaggtggaatgattttgagtatgcatttcgcaaaatgttatctagtggctaccactttgacgaacgaaggcaccttcgtatggtgcttgatgcatataggaacgggaaggtgcttatctcatattcctaactctttaactatccatgaatctccgtaaatgtagcttataaggatagaatattcattgtgcataatctttcatatctgaagttgaagatgtttggttcataacataggtcatgttattgcaatgaatggaggatgtttgattatgctgtttttcccccatatgtatgtgatcataagattgcatggtgactgatcttagtagttctgaaatctatacatgtgggccttttagcttatatttctatgccctcagagagaacaaacctcactagatttaaaaggaaatttcaactacaagcacagcataatagtactagccccagtttggcaacaatttgagccaattccttcagtattttatggcttactgtcaatatgaactatgcttagagttcagattttatggacaatgatagaatgcaagatatatgatcattttcccattaaactgcttcgttaattatttggtgtagctattcttagccttactgcctttcactattcaggagcagttattggaagatgtatgggactacatgtgccaatatggccgagttccgcctgcccccatgataatggaaagattttgcctgaaactgagacaaggggacacagtggcggcgatgtcctgcatcaatacctttcaggagagcaagatacgcaatgtttcatccatgtcctggttcaatctgctgaaccgtaatggggatcgcttgaaggaggatattattatcaagctacttcatgaactcaacaaccttgtaagctcaagtggtcactctgattctttgtatcaaaatattataagtagctgtacagaattcctttctgtttccacctctgtagaaaaggcgtcttctgatcagcagatgcttccctgtacgtcatagctactatatattaatatgccattatctaaaagaaaatcagagtttggtcattggtcatttggttcgtgctccaaaaagtttgatcatcaaatccatcggtttgctcactgcatcatactattctacgaggataagtgatcgtatgcatgtagcttggtgggctagttatttgttgggattgcatatcggcagaagtaactaactctgaattggtcgtcatcctgagatgcatggcacttcgcctcgttttaaacatcacctactccgctactcactacccgtgtttctcatgttgatatcaattttctcatgtcagtatgtcagctgcttggttaggttctctttggttgttccgacaaaactttgatactttcagctggtataccaaagaacacatggagaagagctacaggtgtgaaaatttctgggtcaattacacacatagatgtcctcgcataatgaatttacgcatgcagccgattgggaactctcgagcctgacgagtagtccaacaccaggcacttgtttgctcgcacgttcggacaggtctgaatccatcctcttgtctggactctgaagcctccatcttgcgacagtcgcctgattggcgctaccaaccgcgcgagataaggttagctcaactttggagaagaaaacgttgcatctgatcgtcgtgtcagtctccatgagcagtgtctctgtacccctcttgttcttttgataaagaaagaaatttttgaagcttcgtggatatttctattttccgtcaggctagacatatgttaagattaactataagatttcggtaagaatttcaaataaaacactctaattttgttagatgtttgaaatttttcctggagaatatatacaggtgatcagacagcaggaggaggatggcgcgcacgacgaaggcggctgcgcgacgtgggcgcggcgacggcgtcgtctccccaacagaagaggaagttattattaagctggcaaagtggcaactgatgaataaaacagaaaagaaaaaaaaagaaaagaggaaaactaacagacggacagctaggcccgggcatcaaataaaatcgtcggaaaaaatcaccaggaataaaaaaattccccttcctttgcgcgtcccacctgtccccttcgtgggccccaccaccgcacgtctccaccttcccccacctcgccgccggccaccgcctccgcctccgcctccgccgccgccgcctccacatcccattccccgtgccctcttccccaacccccctcgcgccggggggcctctgcgtgaaggaagagggcgctgcgacgccgaccgcgcgccggtaatgagctacccatccaccaaatgcgatctgttcgttcgtctttagatgaatcgatcgaggcttagagccttagacccggttttgctggccacttcttcgttatggaagagagattgttttatttttgtttatcgttttcgagtgcaagcatttggcgccgctaagaccccctgattgcaattggtcactaaacaaatgtcaatgtgaggaggaggagggtattaaccctattttaattccatgtgtgatgatgagcacgaaagggattttttaaaatgcgacgaatccgtcgccggcgaagctgaggcccctcgacagcgaccttctcgggcttcttcttcttccgcgcgtgtccccatccaattctttaatccggaatttcgtactcccggcgtggaattgtcctacagttgtcccgtggaattccgtccccgctttttatttctttaagcaacaatgcaatcttggtgatgggagagattgcaccgtgatttttctttgtaattttcgatgtttttttattttataatcgatttcaatgtgttgttgcgtttctttgatttcgccaactactacttgttcctccaagaacggacgaacgctgtttgggctccatttcctctctgctcatctcctcctccgttgccccaaccaccgggtgagcagagcagccttctcttctcttcttctctcgatcgaatcctccttttcggtttcttgattcgaatcgcgtgcggtgtaagctagataggcagtggtggccaatcaggcagagagaaaaagtagctaaagctgtctccttccttgctttggggcgatgcaag

SEQ ID NO: 43560 - DNA, 2689 bp, Oryza sativa
tgtcacctgcatgcaggagaggaggaggagcaggaggaggaggagggggtagtgaggtcgccgccgcggaggaagaggcgcaatggctgttgctgctgctgctgctcgcgcctgatcagaccatgcactccaggctgctcaagaggctcgcgaagaggatcatgtgacgtggagcgagccgcaatgtggaagatggtggacgcgctgctgcgttgctccgcgctcgtcgcgctggttcttcatttcgtcgtcaatggctgctcggcggtcaacactgaaggttagcggcggcggcggcggtggcgtctcgccggtgttgtgggctgcgttcattattaggtctgtgggtgattgattgggagctcttcttggttgcttgtggttgcagggtcggcgctgctcaagtttcagtcgagggtggaggaggatccgcatggcgccatggcaggttggagcgagcgggatggcgatccttgcagttggaacggcgtccgctgcgtggatggcagggtggtgattctgtgagttcattgcccttccttttttattcttctgaatgtgcagtgattctgattggaaatgcagtttacccattcgatcaaggatcattgttgcaaaatgtagcaggttttctctctttgatgatcctccgtttgactaaaaccattctgttgaagagttgcgttgatttattgttaaaatggacgttccttccccactacttttctcctctgatctatgtgcggtttgacttgagaatacatgttagaaaatgcagcaatgcttcagttgaatttctggcaacacaagcatctatcaactttatagcccagagaagttagatgtgcaatgattgacttgttgtatttggtaacagagcctccttggctcctttggactgtgggatttctccggattcttgtgaaaatcctttagattcgtgcaaaatggtcctgcgttctaaaggaggccttggtgcaatcagctcctcttccagccaaacagtcaatacaaagcatcatacacaatattaattccgtcccattttgatttgaattcttatttctttgatacatatacagtattcagaatgtccataaaatgtgctgtagaaattaattttccctttagaagcctgtatggaagtttaaaacataatgttgatatcattatttggtttatttaaatggtttcttgactcagccaatgtgaacaagtggccagatggtacattcaattctgtgacagggagatgttgactaataaagtgagattatcgactaaaacaatttagttgattcttttaaattgtaattatattggaggcccaagatagaggctaagcattggtgtagcttgatacttcagcagaaggtcaagtataatcaccatcggctgaacgttgtgatctgcctaggtaagagtgctgtagtagggtccatatgttcatataaaacatcccttatgtgtcagcggctcatatctagagagcttttcttaggcagcacattaagaaagccaaactaatgctgtttggcatgcttcacgcttatatactattcaataggaaaactgacatttccattcgtagttctagatccctaacatattagtctagcaaataaaaggtttgttcaatactctacatgtacttcaaccaagcacaatagcagccctttttctttcctgattacaaggtaggcagacacacacggacattgccactcacaccacacgcagaaatgcactattgtgtgcgctttgaactctttcgatgtcaagatttgctatcaaatgcctcaggacgtgtgacaggttgagtttcatacaccaatcatctcattcagaagtttaagttactaggaaaagagacatcattttctgctcatagagctttggagtagtcccttcagtgctacttaatattgatatttttacatgaaaacaccttaaggtgattctccgactcactaggttaataattttttcttctcaagatgatctattacagaaaaactcatgttcagattcttgtgtttcactatataagattcatttataattgccgcagtgtttctacatattttgagtggataatggttgctttatcatcttaagaattgtacttactatgaactctctttctgtaggaatctaaaggatctctcactaagaggtaccttgggtccagaactaggaagtcttagtcatctgagggctctgtaagttatcttgactttgctttaaagaatatacattggacatcttttgaattggatttctttaagatctagtaacgagaaattactatagataaatatattaattctttatcggttgatgcttgactagcttattcagtttgtcttccaggaaccaggtgtctaaataagtcaattaccgtcagtaaggacatctgaagcatatgtatccaattaaatgaatattggtttcaataggccataatcaaatggtgtagttcatatcaactaaactccgtgctaaataaaaatgagactaaaatgccacatgaatacattgtgcatttgtgtgagtaactgaggagtttacacagtagcataagatcttggctaatcttttgatggggcatccattacttgaattactagagctaatgagttgtaacactgtaatcttactcctgaatgtgatttgagtgttttctaca

SEQ ID NO: 43561 - DNA, 738 bp, Oryza sativa; identical to SEQ ID NO: 41264

SEQ ID NO: 43562 - DNA, 1198 bp, Oryza sativa
gcatttggtcaaattttaaccggccttgaaaattttaccaaattaatggattcttgcttccaattatttaatttaactaatccatgttatcctttagaaataaatgattaaaaattaggtatatctgaagaaaagtaaaacaacagtagaaagcatatgatagaaaatgctctgaagttcatatttgaccataataaacaaaataacaggatgattatgcacatttttatccagacagatcagagaagaaataaaatattacctgtcacaaatgccttctgcagctgtccactgagcccagtcttccatggacctattgtcgccactgatttgttgcggcatagcaaaaacatgcatgctatgccgataaacagcagagcgattgatgaaatcacaatggcatacaaccatctcttagatctttgtggaggaccactggacatgggtggactacttggaggacttagtggtggaggcaccttgatttccttaaatgctgaaaatgatccagttccagtagaaggaacagaagcaacagctggaacaggagcatttgctgaagctgcagcaagattggtatcctccaatagtctgcgccggctaagttgtacagttggatttcttgcagcaaattgtgaagaaagatgagctggtcgaaagatgaaggtatgttatgtactagctaatgtatacagggttctatgaacaaacttgaaaaagataagagcaggttaaattaccagaaagattgttattgtcttttgtgttctcttctgatgaagaatcagactcgaatctacaatggttcacattcacaactgttaccatcaacacgcactgataatttgttttataaaaataaaaaactggtattgaccagaatgtatatcaatctaattcttcttacccattctcagatctttgatacacatcgcccctctcatcatagacgtcaaaatcaatttcctgatcaaaattcctgtaggaattttggatgagaggccattgaaagttattgttggaaagcaacctgcagagcagtagaaaatatatcatggctatattacttgatgttggtcaaattttggcaaagttaatcagtcagacgacctacaagtgcttaattgattgcatttctgctatctcctgcggaacttcaccagtcaaattgttattgcttaaatccagtatttccagc

SEQ ID NO: 43563 - DNA, 956 bp, Oryza sativa
ctcatctagcagcaagaacaaaaaaaagcaggggaagtgtagataaaagactagctaccactaccacataaaaatcagagaagaggaaggtgggagcggaagcaatggaactacctgcggtgaagtagggagaagacggcgtcggtggtgaccggtcggcgtggaaatccgtctgcggcgcgtcggagacctgcggagtagggagacggtgggcgacggtggcgggagagatcggcgtcggcggcgacctatcgacgggagggtttccaacggcggggatcggtggcagcgctggtggtgaggggagggaaaggagcggaagggaaggagcggcagcggggctgaggggccggtggtggcgcgagtagtgggagggaagacgcggcggcagagcgaggaggcgacgcagggaggagggcgaaggacgcggcgtgggggaaggaggagtgggcgtggggaggagatcgatcgagggaagagcaatcgcgtgatggggaggagattgacgccgttggatatgccatcggatggttgagattacgcgtgtctgtcatatatgtttgttgtatcaggaatcaagaccaccactacgactttttaagtagtagagattcatactctttacatacaacacaaagtgagtttttaccgccttctgtactaatttctttctggtattcatacaatgatatgttaattgtttcacgcaatatgcacattctagagcatgatctatatcctagactctatgcagaaacccagggaaactttcaactcaatcattgaaatgattaataggtaatgtcatccatcccattgtcattatggttgattctattgctactatgtgcatcaagcttcattagttgtagtttggaactgcaggcatgattccataaaaacgtccgcggggaattcaaggaaaaactgactgtgaggacgaactttctggtagg

SEQ ID NO: 43564 - DNA, 1216 bp, Oryza sativa
aaatgaaattaaacacttgttttagactggcaccgacggtaagattgggtggtatctgggaaaggctagtaccgtccccggtcaattaaagaccgagccatgaagttaagcatgaaacgaccccatacaatcacacttctcgcatggggatagacctagcggagtaaatagctgagcgaaggcagtatccatgcatagtggtttcttgatgcgtaaggcaagggctctacagtggtgttgccattggtaggactaccatgtgttaatttaaacataattataacttaatgcatgtgtgtgagtcttcccttcccggatacgccagaactcctctcactactagaaactgtgtacgcctagagtgcatgaggatgaaaagttcatggagcgggtactgtcaatgtgaggttatcgaaaagctttgccgtgatacgtctcatgtgttgggacgaggctcatgtgttgggcagtcgcggagtgtgggtaaagtgtacatccactgcagtgtgagtaaaacgaatctattcgaatagccgtgctcgcggttattgagcaccgggacatgtattatacttggctagactctaaattcttaacttgtgtgggaagggttattgcatgatgaattttatgctgttggagccacttcctgagaagggggaaggtggacgttctcagaaaactatgacgactcaatggcgggaagctatccttgggatcacaatggatgatggacagaaccgtcgttgtttaaatataaacactggtactaaaatttgatcagtcaatgctaggtcttaggcttgtgaaaagaattacaaaacttgctttgcgcaaaagaaccatagccatcctttgaaatacccctatcatgtgcattgttgatgtggtggcttgctgagtacggttggtactcacccttgcaaatataaacttaatcagaggccggagatgaagcttcggaggatccctatgcctattaccaggagggtgatgaagacgatgacgctcaataggtcttagttacggtcattgcctatggcaatggcatgccgctgccttaattccgctgccttatctatttctgcttttgggatgtattccggaccgctcggtccgatgatttaagactacgcctgccggcttatgttgtaataatttgcactagactctcgtgtatgtgcgtttggtatctcggctataaactcgtgtgtac

SEQ ID NO: 43565 - DNA, 4041 bp, Oryza sativa
cgttccctcttccgttggggccattgcaggtagtgacatgatcggagttgtcgatgtagaaaaagaagaacatgacgtagaggatatacctgctcgtgcaggttcttaagtggacgaagttccggagacctgctcgttctcagtacctgtgcacgcaggaacttagaaccggggattgatagaagctgtgtaggaacagagaagaggggggattctaccataggaggagaaccagtggaagctgatcagaagaggggatcttctgtctatcccagaggataagattgaacacctgagaggaacgttacgagattgatagcgcattattctctagtccgttactagagtaacgtgaccattcatacctgtcggttacacctttcctcatagggtctagcccatttaattctaacaatctccacaaaatttcagagctcataggaaacattgtcatttttgcacctatttgttataccagtgtttcggtggagactgttaagttgaattttcacctagaaaagaagctatatttgaccacaaccgaacaatgggcccacgggaattatcaatcctgtactgtcagtctttactcaattacttaactgatactgggctgtcgttagcacctaatttgtttggagcatataagtcgtactaggcttttgcataagtatctagagatcacccaaatctcatggactgtgactagctgtcggagcgtgagctcttcgattaggggtccgtgaggcccccctttgctagttcggccgggggcagcgggtgagattcgaggattcagtggaatgtgtgatgtggagggaatcggacccctcaaggaagacgaaacaaaagggatttatacagtttcgggccgctgtgaagcgtaataccctacttctgtgcttggttgatcttgtgagaaattataagatctccttgttggagtagaaggtgttgatcatgaggagcagaagctgctctagagtctaaaatggctcatcccagagaaagggattcctcctctccctaactaggcctggacctccttttatatctcaagggattaccacatgggcccatctagcctattaagggaggataatcacataaaatgcatgtcttgttgctttccttgtaagtctcttgcatgccttgctatgacatggagtccaccgaatcttaaccagctaacagaagggacgcacctgtcattcaacatttaatgagttaggacttttggatcctcactgcgccgggaaacgggaaccctaccctaaccgggttaggcaagccgtctccggctgtgatgagaggctaagacctctcatcatcatggctgatgggacagggcaggacgcacgccgcctgacacacgcggtagtgctcctggcactctgggtcccatcggtcaatcaaccggtcacaggccggttgagtgcactgcacgctgcattaaatacggcgtggcacagctggtcaggtcgccataaatgcaggtaggtgggcgtgtggagttggccacctaacccaccacatgtggtgtggtgacccacggagggtttcgggggagcccgacccatagtcacgggagggagcggccgccgccctacctcgggcccgatacaccctcgggggagggggggaggggccatgtgacgcctggggcagcctcctccctctagtctcggtcaggacggtcccgacccccaagcgaggagggggcagccgccgccctacctcaggcccgatcccccctcggggcagggccacgtggcgcctggggtagcctcctccctctagtctcaggtggaacgggtgttggtatttcttaacgatattcctagaaatataattcccaacaatggcgcaaaaatactcctggtatattatggttacagagttcatccgcaagcgcacggatataccgttgtagcatttcacccgagagtattacaaggatatcgtatttatttaatcctatgagaagatcatggtagagagaacttaactaataatttatatgttacttgtaataatcatagtctaagcaggggttaagataatccaagagtagagtgacacacaagcagtaagctactcattctcatactaaattatctaagctaagtggaaataaaagagaaagagaatctactcctatacttctagtttacatagtatatatacattctagttatctgatatactagctaatattctctatccgatgccctcctggtacttcgtgaagccacccctaactgtcgagtttcttacgacagcccgtcatgaccatacaaccggggctaaatacagaggaataccttccccaggaaattaacttagaactatatacacgcgcggaggaatatccgtactgagctgtcaccatcagcggcccacctctcatccgcagcatataaccccaaataatgatctaagcaccacgcctaaactaccatatactactctaattgatatcatcgtcatgacatagagtaattgcataagcaaacattatacccgcaccaaagcatctcccagataagctagcagtatattcaatataacatgaacataatataaattggcatccatatactcgaaaagtattttaataccataaatgtataaagaagagtattctaaatctagataggtgaaagcagcaagctgcttgaaagaagaatgagccacgtcctctgaaattgcaagcaccatcggatgagactggtaaaacaaaaggaccgttggatcaatatatgagaatataatccattgggtcaatctggaggcttctagacaaaaggtcaaaaatactccatctttgagaactcacatgtctagggtatttaaaacaccacgtccggctaattgattaactgatcaaataaagaaaaaaatattgaatgtagcctcacccttaattttcaaggtaaaatatttttttatcaaggtaaaaaatattgtagtccttccagtccttcaaggtaaaaaatattttcagtcatgtgaggttaatattttttcaagggtaatagtccttccagttatgtgagcgcatccacaatgtagtctaaaagtggttcataagcaatacaatatttatttcagacacctagcaacattgtggaactagtccatagcaaagaaataataaaagctacccataagcatataggctgcccatagagaataaaatatattatttgtctctacctcttctttcctcctaatactatttgctatctatatacattgtgaatgttacaatagttaaagttcatataagtgggtcccatctatatggactacttttgctatatagattgttgttgctctaaggctacaataccccatcaattttaccttgatcaataaaaaaatatttaatttattcatttactttgttaggtacatcaatcacaacctttcatttttaatttaccttttttcttaaatgtagtccatctcaagaaatatgaaaataggtaatattatcttcgcttttaaatatatgacgccattgaattttttatatgtgtttgataatttggattattcaattaattttgcaaacataaaaaataactcactcttaaaaaacttagataataaatcaaaccgactcaatttattttacaatagaggcagtagtatactcaccaaactgactattgattgcatgcccactactatagacatgttatgccataagttagagttgcgcgaagcgcaactgagtggctagtaaagtacaaagcttacaaaggagaagagaagagctactagagccatacccgaactctcctgaaggcttccggactccgatttctactctattcctattccactagcttaagaatactaaactaacttgaggtgtgtaagtgaagtgagaaggtgagctccttaaataggcaggtaatgacggttatggtggctggaaaggtcggtaataccctccaaccgccatagggaggaaatccacaccgtccatcgccaaccctgcatctagcggctacacggcgggttcggccg

SEQ ID NO: 43566 - DNA, 3679 bp, Oryza sativa
tgtaaaaggttagtgaaccaaatcctaggggaatattattattctaacagtatatgcattgcaagtataactagttcttctctattttggtaatattgacggtcaaaactgatcgctaacgacaatcaacaacaggtccgacccctaagcaaagagggggcagccgccactccaccccaggccggaccctccttggggaagtgccacgtgggtttgggggcggcctcctccctctaaacatgataccgccgggcccatatcacagacgcagtcagacttatataggtgtgttccttctaaaatgttatgtaggccaacatgtctactttatggtaaacattaaggtatgcaccaacttgccatatagatgaggagagaagtacatcaaagaaatgagcctctcctcctagctacccaatagcttatttcaacatcctaattcacgccatctctaaccatatacgataggttactactattgtgtaactcaaaagggtcttaaacccatctcactcgatgcactgcctatcacattttgcgatagtccctcaatgaactgatctgctagatttttagcaatctggacatatggctgcgttcgaatctccaacaaaagttggatgaaaactttgatattcatatcatgcttttcaaaatattaaatggtgtgtttcatgcgaaaacattctatgtggaagttgctctaaaatatcatataaatctattttctaagtttgtaataattaaaacttaattaatcgtacgttaataccacattgttatgcgtaaaacacttcatcttcatttacatgagtttcaaacacatagtctaattctatcactccgaagtattttaggattctcatagacttcaatcttctttttatatgtctgtatgactttatgttgtcctttaaactgttcaccttaataatcgtcatttgattatcacggttcataagtcactggtttttcaaccacggttaatccatcggaggcccatgaagtactcgatctcaatagtggcagtgctacgtcaaattattttgatttaatgactgaccctcaatcgttcgcaagttgttatacgttgcacacgtgtataccgtgagcgcaacttatccattttttttgtttaaccacattttaattttctctctttaattaggtatctaattgttcttgacgacatcagcatggagcagtggaatgccatagaatcgatatttgagaacaatggtagaggcagcagggtaatcgtgacgacggccatcctctcggtcgccaacagttgcacggcctacaagtccggagccaacggcggatgctgcatccgtcgccatggctgcgtctacaagatgcagactctcggagaagcgcacgccaaggagctcgccctcggcggcggcagcgatcagcgaccgccggagctggagcacggctcggcgacgcttatggcgaagtgcgacggcctcccgctcgccctcgtcagcgtcgccaaccacctgcggtgcctgggcaatctcacggggcggcactgcgccgacctgtgccacctcctcggctccctcctgctcgacgagcgcaacgtcccgaggctcgccgggacggcgccgccgccgacagcttcgcgaggctccgccgggttctgatggacagctacgcgggcctccctgactacgccgccaggacctgcctgctgtacctggccgtcttccccaacgacggccgccgcctcaagaggagcgtgctcgtccggcggtggctggccgaagggtacgcgcgcggcggcgaggacgtgcttggcaacagcaccgacgtggacgtcgccgacggccacttcaggtcgttcgtcgaccagagcatcatcgtcgcccaccctgccgacgacgacgacgacgacgaccaccgcacgaggaggtgcaggactcacggcatcgtgcacgagttcgtcctgcacaagtccatcgccgagagcttcatcttctcctcccgtgctcctccgaggcgcaagagagtccgccacctctccatccaagcggcggcgggaacaccacgacggcggcgctgagcacgacggacctgtcttgcgtccgctcgctgaccgtcttcggagatggcggcgacgccgtctccaacctccgaaagtgcaagctcctcagagtccttgacctcgagcagtgcaccactgctctgagcgacgatcacctcgctgacatctgcaagctctggaacctaagatacctaagcatagggatgagcagcaatgtcaccatgctgccagacaatatccgaaggctgaaactcttggagacgatccatctcagcaagaccaaggtgacaatgctgccactacaagtcgtcggcctgccatgcctagctcacctggtcggaaagttcaagcttctcctcccagatcaacgtgggaagaagacggtggtgatcagcaacgagctcgagaagctcgcgaagaagagcaacctccagacgctcgccggcttcgtcgccgacgagagccagcaagcgtttccgcagctgatgaggcacatgaggaagctgatcaaggtcaagatatggtgcgagttcggaggagaagaatccgacagtgtctcgacgacggcgacggatcacctcgccgacgctatcaggagctacatcgaggcacccaaggttgaagagaccgacgcacgctcgctgtcaatcgacatggagcaatgctcgaagcagctgatcaggtcatgtcatggagagagtaagctcctgcactccctgaagcctccatgccgcagctacctcacctcgctgaagcttcatggcgacctgttccggctgcacgggctcatctccatgctcaagaacctctacgagctctgcctctcgtcgacgacgacgaccctgaccagggatctcgtatcagccatcggcggattgcctcttcttcttcgcctcaagctggtggcgaatcacatcgagcatttcgccataggagccggggagttcagaagcttgcaacacctgctcctcgtggtgcatcgtcagaatcccatcctgctgccaaagatcgaggagggagcactgcctcagctcgtctctctcgagctgctctgcaagcatctgcgcggcctctccgggatccagatcagacacctccagcgtctcaaggaggtcgcactcgattctcgagtgagcgagggcacgaagcgagagtgggaggcagaggccaggaggcatccgaacaggcccagcatcttgctcctgaagaacagttacagtactgtcctgcctgacgacactgacagattggatgatcagatggacggggagcttgctcgggagaaatctgcacctgatgatgatgctggcaaccaggagcagattgcggaggtggaatcagaaagcagtgcatttcaattggcgaattccactatgaataattcagtcgctggaaaggaatcaacagctgatgatgctgatgaagaaggattgggaagcactaatgcagtgcccatggagcagataaattctactggctccatcaatgagaccgaggtctccaatagagggaaattcacaatgtcatattttgaggactgctgtccctaccatgaggtaataaactataaatttggcacatattatgtgaattcaactgcatttgagatattatttaattaaggtt

SEQ ID NO: 43567 - DNA, 2191 bp, Oryza sativa; identical to SEQ ID NO: 41268
  unsure (1)..(2191): unsure at all n locations

SEQ ID NO: 43568 - DNA, 4974 bp, Oryza sativa; identical to SEQ ID NO: 41269

SEQ ID NO: 43569 - DNA, 3000 bp, Oryza sativa; identical to SEQ ID NO: 41270

SEQ ID NO: 43570 - DNA, 2261 bp, Oryza sativa
  unsure (1)..(2261): unsure at all n locations
ccggtcagatcggcaaaaggcaccggtcagaccggccagatgcgccggtccgaccgatattaggtcggcggtcagaccggcctgaggcgccagtcagaccgtcgttgggtcggcggtcagaccggccgtatgtctaccgccagaccggctagagggcctggtcagaccggccgactatgataagctggtctcggcttcggatttgttgcttgaggactccccaacttcatctccagaaggtattggcacatcatgagaccccactttgatggtaatcaccttaacacgctttccttccctcttttcttccttaacccgatttttaccataaaaccggccattgtttggtgaagacaaacgctcatgaattggcctccttggtcctccccacccttggttgaattgcattggaggcatatgattgaacattggcggtgttgtcccccatggcatgtagtaaggataaggataacccggcggcggcattgggtaaggcccccatgacatgtcaagtgaatgatgatatggaggtgattgcgaccgtcttgatgagtgaccaaatcgctccctaggaggtaatcttggtcttttccctttattgcgagctctctcaccaccttgcttctcatacttctccaaaagcatatcgaaggtcaccttagtcttcttaggagctttagaagttgagacttcgctcctattctctttccacacaccaaagactggattctttggcaccatcatctttggcctagttcaccaatgatcactcattttcccttagtagattcggcttgctccggccgaatcaacaccttcttatcattgaaattaattgtattcaccagaaaaggatcatgattaagcttcatcttggaaccatcggtgaacttcaatcgtccttcatctatggccgattgaacctatcatcgaaacacattgcaatcattagtagaatgagagtgagaatcatgccatttacaataagcacgatgttggtatttaatacggtcacagataaaatccgcaagcgcacggatataccaatgtagcacttcccctacggagtattccaagggtatcgaatccaagggaacgtgtgggggcaaattttcttccaggttatcccaggatcccacgcaaaagataggttgggatagagaaggattactagtgagaaggagaaacagtatctagggaaagcttaactttaatcctaatgcaatactttaaggcactggcacccgctgttcccagatgtcactctactacgtatccagacagggaggacttaagtgatctcgagggctgtcaccacctctacacccacctaaaacgtactgtgggatacacagcaattacgggataacaattacctaaacaccacgtctaagcaattaatatttacttcagtgtttataactcaccaaagcaatcactatattttagttgattatagtgaacaataatcacgtatgctatttaggaattaaccaagagataattctcacaagataaatctaaattactcaagaagaatattatattaaattcagagtaataaatagaataaaagaaataggagaaaattaccgacaactccggaattcttctgactccttttactctactctcttcctattctagtatacaatatagtacaatagagcctcttataatttatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggctgca

SEQ ID NO: 43571 - DNA, 4365 bp, Oryza sativa; identical to SEQ ID NO: 41271
  unsure (1)..(4365): unsure at all n locations

SEQ ID NO: 43572 - DNA, 3082 bp, Oryza sativa
cccaactgacatgtgggctctcagtcaaattagtataaatgccaccgtctaggattgataaacttgtaatgcttgtattgtagaacttggtacaactgtaccctatctttaaactgtgataatatctctctgcttgtagagatttgtggttgaaggattgaactgtaagcctgtgatgggtaaacggatatgcccgcgagcacatggcgcccgcgggcgatgggcatagacaatgttccttccacgtcatgtagtaacgggcatgcccgcgggcacgagcatgggtagtcactacccgtgcccgtcgtgcctgccatccctaaatgcaatgataatgaaggggtggatcggacgctcaatgttcaaacttgagagcccagaaaataatttatattgcggcgaagcccagaagcttgtctatttttgaaaatgaataagtccacttgccgtccctcatctttatgtcgagtttaattaacatcccaaaactgcaataccataaatcttcacctccccccaaaaaaaaaataaaactttacaaaaccgttcaagtgaggtcccttggcagtatggatatttgttttggatgacgtggcatcttagtcatcggaaaaaaaagttaaaaagaacatatggggccggcccacatgtaagtgccatatcaccttcctttgccttctttccctctcttttcaccaacgggtagcacgcagtgggaatgggcttcagctccatgctgttatccatgcttgcctctgtcacgacgaactcccaacggaaatcggcttcggctccatgatgttggagctcatcagcgcggattccatcggctccgacaccggcacaaccatcgtgcgcaacttcttcggcatggcggctctacgtctcgctaatttttagagaaaaggtcagagacctggcttttacttgaaagccacatcggcggtgtcttttaacagctggggatgccagcgaaccatacaagagcaaaacaagactagtaagcttaaccacagcaaggagcttaggagcagaccaaaagctgaacaaacacttgacaacaacctctaaagccaacacaccaacagctaacgctaaccaactaacccacacctaatctcggatgccgtaggcctgtcatcacctttatttcttctgtcatagcttctagcttgatctcatcgttaggtttgaagagcctcctccactgcaaaagattagagataatttgaaagggcaaagttagtgtcacgcccagaaatttactagtaatttccgaactagtttgttgtcacgctcagaaattcactagtaatttccgaacttatttgtgcataaaatcctcgtccaggaatcagccgaggtacacaaactgacaatttaatatacagaatcatcaataatagtgttacatactttcaaaagaaaagaaaactgcaacggaattacggtctagcgaagctccggctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaacagcatttagcaaaacattaagaggagtaaaacagtggagtaattaatcagaaattttaatcaacactgaacagcacacccatgctgcacaggcccaaccatcctgaacaaccatacccggctgcacagatctatctccaaaccaggaatgtaccattccaaactaggagctaaattaattaccatcaattaccacattattattaatgagtagtgtgggactaatcacgaaagacattgttcgacccgcccataaccgcgggcacggctattcgaatagttttactctggccagaggtgtactactgtacccacaagacacatctccacaatatgtcaccatatcatcatgtgcccatgctgaacatgtcaccatttgtgtagttgtgacaagacccctcgcataacttaacccaaagcagtgcaccgttcctggattgtagtcaccccctcaaaaaccagaggcatggactccccagcgacccccgtgggcttatctccgccacttctcagtctggtgctccgcaatgagccttgttatacaaagtgtccagctgttgcccattctggcttgtggttggcacggttaatgtttcacaaccgaaactcgtgaaccggtccttaattgtcatgagcacgaccatcaaaaccatgtgctcacaacacaccattatcaagttttagttggcacattaattaattaaccaatcacgattgatcatcgtgagctatcattaaatatccatcattaagtaatagtgaaacattagttatcccaattgtgtgctaatgtttctaagcatggctaagtaattatgtctaacatctagctgaacaaatatataaagctcaactagtcaaattataataacccaaggtatcaaggaatagagtaatcaatgcaaacagaccataacaaaggaataagttcacaccacccgattgtaacactagaaatatgggccttcaaaaactttttaataaattgcatcatgccgattttatttgcctattttattggaatttggtttcaaagtttaccgatcgcgaataaggaataattaattaggaataaacactaaaattaaattggcaaaataactaattaaaataaagattaggtgagtttggaaataaataaaatattatcgcgaccatattggtaacaattgaatttaggtgcgatggaataagaattaaccctaattaaattcgaataaattaaatataaaaataaaaataaaatatgggtagtgataatctaagttagagcaacacaaatattgtgtaaacttgatttgtgcaaaaattagaaatattaggacaagatttgaataggaaaaacaaccaaattggaaaaataggaaaagtcactgttcattgccccataggtgttcgcttgaggtcactagccctaaccccccccc

SEQ ID NO: 43573 - DNA, 6210 bp, Oryza sativa; identical to SEQ ID NO: 41274

SEQ ID NO: 43574 - DNA, 2406 bp, Oryza sativa; identical to SEQ ID NO: 41275

SEQ ID NO: 43575 - DNA, 4239 bp, Oryza sativa; identical to SEQ ID NO: 41276

SEQ ID NO: 43576 - DNA, 900 bp, Oryza sativa; identical to SEQ ID NO: 41277

SEQ ID NO: 43577 - DNA, 1500 bp, Oryza sativa
atttttcatatttgtaaaaaatttgaataaaataaatggccaaacatatatacaaaatcaacattgtcagacattaaaacaagaggcagcagttaaattgcaccatttttatcactgtttcgttttagttatattttaaattttgtttatgtacaaatacgattgagtttagtctaattcttttttgaccgaacaagggaggcccttacgactattttttattaagtaaaaaaaagttcttgtaacaactgagaaaatgaaaagaaaataaattacaacttactgctataagttaacatgccattgtggtagtttagtctaaaaaattataacaagggtatgaagcatgtactttcatttacatttagtaattaaaaatacaaacaactttgtagttgttctactagtagtagaaataatgtactagtagtttagtcgcctaaaaaaaataacaagggtatgaaacatatactttcatttacatttaataattaaaaatacaaacaactttgtagttcttctactagtagtagaaataatgtaaacactttacctttattttttcatgcaatagaccatatctatttatattaacaactcaattgctgttagtagaatgaggtgggtataataattgtttagattaccagtataattcatggctcgatcgaatcgtatctactaatagagggcactataaaagtaatttaaaatattattggcattgtcgagtaaattaaattcatatgtatagttactaacttaattactatatgaaggataaaaaaggggaaatttgagaaaatagtttgtaaattcatgaaaaaaatactagagatagatgtagacatgaattaccttttatcttgcaaatgcgtccggatagtttcaaggagtcgatcaacctcccaaacatccgaagactgatgctgatgttgtggccgcagctgtgacagcatgtcggtgaggatcttcgtcatgtcaggcttccggggcgtccgcacgaaagcccggcagtcgaacggcgcatccaaccgccggccatgcagacgatagaattctgtggccagcgtcgtcttgccaacacctccggatccaacaatggaagccaccttgagcttcggctcgccgtcggccagccaccggacgagcttttgcatcgaaatatccctaccaacgagctggccgtgcacagcagcgtcgtccatcccgaacgtcagcgacagaaaccggcggcgttcgttgccggcggagtcctcgcgatcgtcgtcgtcgacttcttctctcggcctcgagctcgaggtgcgcctgccaagatggtagctctcctggcggcgaatggcctccttcacgcgggcgctgaacagggtgacctcgtcggcgatccaccgccgccggttaagctcccctcgaagccgggcgatcatgctgctgatcatcttcttggcaccagcagtgctactgccatcgccgccgccgcggtggtggaggagctgggtc

SEQ ID NO: 43578 - DNA, 2049 bp, Oryza sativa
ttgacaggtgggcctggcgactttttaatatttcctgtacttagtgttttggccatattgattccatgcaggctgtatgctgcctatgatttctacatagcatgtgagataagtggttactcattcctatttcttgtcccgtgttttataaacctttcgaaattgttacaatatctcccaccagccttatccacgcggtatgggtataacataaagtcaagaaaaaatttctcttttttaaaaaaactgtagcactggctaccaaaactcagccaaatttatgaattttctttctattctttcaaaattctaatttgaaatttaaattctcaaaaaaaagataaaacacaaaaaaattgctgaaagaagtgaaaattcaaaagtggtatttcgcaacctgctagctatgtgctgacaagttagcaatcattctttcatcgctttagcaaagacgatcatccattggcctgtaatgtgacgataatatatactccctccgtcccataatataagggattttttgaccactcgtcttattcaatttttttttgaaattattatttattttatttgtgacttactttattatctacagtactttaagcacaaatttttgttttttatatttgcaaaaaaaaattgaataagacgagtggtcaaacgttacaaagcaaaaactcaaaatccattgtattatgggacggagggagtagcagctagtggatgctaacaaggaaagtagcaagatgcggatacccttgataaaactggtataatagaatactacaaaggttgatgtaacctgcgaacctgcttttaattgcaggcaatgagtcagtcaagcactatgaaaggtcttcttaaaaaaaaaaccactatatggaaggatgcctgtgaagattatggatacatgatacccacattatctatatatgtatccaactgctaatagaaggtgtgctatatttgtacataacttggttgctagggtttccttgccggttaaggcaggaccgtacacttcgattgggtttatctcttgtaatactaaagggaacttaggccgaatccgactgggtttcatacttgtaacctctgcccctaacctatataaggagagccagtaacaccctcgaaggacaacatacaacataagtcaccacaacaagatcgtcagatcaatacaacacccgacggattcaatccctcaacaggagtagggtattacttctcattaaaaggatctgaacctgtctaaacctttgactccacatccatccacttttggacttcgtaccactatgcaggatcaggtcatttctgacagccctaaaccctcacctctgacgggttcaaccttggtcaaagataagtggtcactgatgacgttgagtcacctgtgacgggtaaaggcccgtcagaggtaagagtcacctctaatggtccccaactaaaacccatcacagatgagggtcacctctgactggtcccaacaaaaacctatcatagatgagagtcacctctgatgggtatatattttaacatgtcactgaccgtaattacgatccatcactggtgtgaaaaatgggaaaaaaaagtaataccgtcctcctaggttaccatcacattcatttggacggtcatagatcgcatctggcattcacaaataaaataaatcatcaaaattcctcttgttcccatggcattcatcccaacaaaaccacatgaatgtcaatcaccagaatcaccacatgaattggaatcatcgatcatagtagcaagaatgtgaacaacatgaacaacacaagacaaagtatttgggtgaaagaggactggcaggcaatggatctgaacgcctccacctgccatcatgttcgttgtgcttgtccctgagacaacgcagattggagcttgggcgcggaggagacaacaaaacaatgggcgacacatgtggatggaggtggcggcgacccgagctcgatggtgaaggagacgaaaacacggcagtcggtgcatgtggatggaagccgcggcgaccggacccccatg

SEQ ID NO: 43579 - DNA, 3279 bp, Oryza sativa
  unsure (1)..(3279): unsure at all n locations
acttagcacgtgcgaagtagctagctactgttttggagtggcaaacaaagcaaaagttcgatttaaaaaaacaaagcaaaaacaaagcaaaagttggtgcagaatatatgcctttgttttcttctgaaattattctgatgatttattcctgatggggaacccacctaaaaattatccgtgctctgtggatttttcaacctcacagaatgtcgccagtctgattgctgagtatatatagtttcaaaacttgcgtactagctagataaatttacctattctagaatgctctcttttatacgctttcttctgtttaatcttggatgaactttggattgacttgctttaacccacattcaggtctcaatatataatatgaaaccgggtaatcctaatgggcgggtgatcgctctctcccctccccagcgancacccgcccctccccttactactttacctccccttcttctcttactactacaccataaaaatttgaattaaaattcaaatttgaaacgggtatgtaaactttttacttataaaatttgggtctatagactaatatttgaattcaaattcaaatttgaaacggcaaattcaaatttgaaacgggtatgtaaacttttgacctataaactttgggtctataaactaatatttgaatttaaattcaaatttgaaacgggtatgtaaactttttacttataaactttaggtctataaactattatttgaattcaaattcaaatttgaaatgggtctataaactttaggtctataaactttagatgtatagaaatactatatataaaaatatttgagttcaaatttaaatttgaatcggatatataaacttttgacttataaactttaggtctataaactttaggtgtataaactttagatgtatagaaatactatatatacaaaatatttgtattcaaattcaaatttgaatcggatatataaacttttgacttataaactttgggtctctaaactttatatgtgtaaacttgatgtgtataaactttaggtgcataaatttattaaaataggaaagtaatacggtgtcaaaaaaagaaaaccaggtggagggagggagggagggggaggggggggagtgaattgatcgctgcccccatcgccaggtgagcgatcgcccatttgccatttcgtatgaaaccgaccatgtatcaccgattctatccttttaattttatgagcgatgacgatgctgatgatttatgtcttatatagttaggaagtacaaattttgtaagtataacttatagcgccatctatttatcaatttaccaatttttttcttatttatcaatcactgtttaaacagtagatcaatatgcaaccattcacatttatacatgatttcttgtggtgaagcaaacgatgttctaacctactctagtgcaaattcttactagcatgaaacataaaatatgacttacgtaaacataataatgcatctggattaaccctgaaaataaaaacaaagtaaagtaaaatatgcatttcatttgtgttgaagttgcagtaattttattttgtgcatgtttgggccaagcaggcttgtgcaagtttaggcgatttattgtccaggtgtaggtgactgacagataagaaaatatcaagcgaatgataaataactaaacggataatttcttcatccaatacatgttgaattgtcatcattttttagtgtctcgtgtattatcgtgtgggaagagagctggcctgaaagtaaaaagagccctactcatcttgcataatagtgcatacatagcaccatttcgaagtagggtacgtccatcaaggccaggaagatattgtatatcatttttttttaaaaaaatgtacttaattaaagatggattttttaattccgtttgaatttttatttctattttttaaaagtatgagatcaaaccacaagtacaatcaaaagtcaaaaccatgcatgtatatctttagctgtactgaaatgccagaaattcggtgattttttttcagaatatatgcattatattgttctaaaacttcccaaaataatattctgccctgattttagaaacacctcccaagtcacacaacaaccctagctagtgtgtggcatctgaagactgaaaatagtttttgttttgcactagaaccagagataatgccggttaattttcgtccttattggctgaggccagcgagtgtctgttgaaaatctactactagctagtgtgaaaaaaacaattcgggttcaccaaggtttcaggagaaaaaatgattttccttaccaatgatgacacggaaatttaattaaatcacccgtaaaatccatgcgaatagaccatatatacacgtggtgctaagtttaattatggaacctccatagtcatatcatatcatactctccctccattccaaaataatcatcatattacataggtacatcaaaactttaaaaaaaataataattttctcatactatatttactccaacaataaacccgatgcatacaccatccctatattttttagctaataacaaatcaagatattgtatcttagttataaatactggtgtgtatggatggatgcatcaatatccatttactccaatacataaataacgaatagatttaacgaataaacacaaatatgatgatcatttagtaataacctcaaaaaagttatataatgatcattttgaaacggagggagtatacagcagttcacaaagggaaccacttgtgtgtgtgtggtatatgagtgtagggtgtgttggtgtactcaattacgctctaatccataccccgcagagggcgccaaatttaaaagaaaacgtcatagctaaaaagccaataccccttcagccacaaattggttccactaatataacactactggaaacagatttttgcaaataggtaaaatagatttttctaagcggccatctatcccgcttgcacttaaaaacctgcgaaaaatacatgacatttgtaggcggcgatcaacaccacctacaagaaatcattttcacatacgacatctcaattttcataggcgcaacaaccacccgcctacgaaaatattcttcgcaaacaacaaaaaaaaaacaatccgcccaccacccccatctgccaccggcgtcgctttttgctgtggcggacaccaccaccatcgcccctctgctggatctgggagggagggaggaggggagccgcaccgctgcctccggttagatctgggagggagggagggaggggggaa

SEQ ID NO: 43580 - DNA, 1889 bp, Oryza sativa
agtgccctctctcctccgtcaaatctaggagggagggagggagggaggggaggggccacgccgcctcctccgctactgtctgtggccgtcacccgggaggagccacgccggcacctgctgggaggaaggagtgaagggggagagggggatggagggggaggtctaaggaggagtgaggccttttttgcagccggatgtctttacattccacctgcaaaaattaattttcacatgcgtggtcttaagacgcccgcatataaaaataacccttattttgtaggcataccttttaaaaccatgtatgtgaaaatcgattttcgcagacaggactagttctattcaacctttagctatttttgtaaatggtgatttttgtagtccgtctggaaaaataaaatcatgatgttgggaaaaatagtttttctagtggtgtgattttggtttcacctgtgtggtaaatgcatgattaacatcttctagtcccacaagtcaaaaacccatgcagtgcacgagctagctactcctgaaccattgatctcatttgatcaagtgtttagatctatttatactaccacgctagttagcagtagcagaaacatggaggaacattactttttaaaaaaaggtgcggaggtgtcatgcccagaaattcgctaactcgaatttcaagtagaatgtgtattaaaatccctgtccaggaccagccagagtacacaaatgacaatttaataaacagatccacgtcttacaaaaacaataaaataaatcttacaaacgcaacggaaaaaacaaataaattagacttaatcttcacgaccaaaagcatagcttcctccataaaccacaagcaatcctcgacgttcggaacaagctcaatcctcgaagaactcaccatctaaaccaatctctgcctcggggggggggataaagcaagactatgtaccaatcaccgtactcaacaagtcataccagcaggaaggtatgatgcaagatattctcaaaggaatggctcattggatatttgcaataaaagcagcatttataaatcatattttaaataagtaaaacaatatatataattaagtagtattaaatcatcactgtcgaacgctaaagccacattgtgacaggcccaaccaaatcacctgaactacaccagttttacaagtcatattattatagtgagactaatcacggtgagctagttgaccgcctaataaccgcgggcacggctattcgaatagttttccacaagactcattccacacatgttaccatgcctcgaagtactgccacgatactgcaaagggggaaatcatgacaaaacccttcatataaccctccctaatcgaacatacccacctcaggtttcaccccctccttgtgccaagtcgtgcagtcccctctcatgcctaggtaaatccggaaacaacaaagattaatatccaggcccgaactacaccattgcctctacccttgccatggtatgtcagctaggttaagttatactctagatttagcctaaagcccatgctggttatcatcatataattaaggactaaattataatgaatcccattgtgaactagttgatctaagcatggctaagcattcctaaacatatcatctagtcaattataacccaagttatcaatagcataagatattcaacaggccgagtatgataggcatccatcccacacgacattctaaaacaatgcaatttaatagaaagcaggggattttataaaataggctcaacatgatcaatcctgtatgtatgacttgccttgctcttgtgctgatgaaacctcggcaaccacttcgaaataaactggatcaccgaaactgacagaatctaaacgacaaacaaagcatacaagaaatac

SEQ ID NO: 43581 - DNA, 1185 bp, Oryza sativa
  unsure (1)..(1185): unsure at all n locations
gctcagattatttagttatgaatttcacaatataagctgggttattacaaataaccgaaaacccttaatcatttattacgtattattgcccaaagataaatagatcaatggaaatatatctccggtaagcaagcctcacgaattagcgactccacaagccaatactttgtgacccgggaccatccaaacggtcaaccgaaccggcgaatggaaccagcggctcaaaacgactataaactaaagaacgactgaacgaactaatactttgacaacactacacgcgaacgaacggttagcggcttaacgaacggctgtggcaaaggcggcaactaagcactattagcggcaacgactcggtacagcaaacgataggccggtaggtatgggcagcgagaaaaccacaacgacgacgcgggaccgcggcaacggcacggctaggtggtggcggctcggctcggctcaggggcggcagcgacggtgcacaacggctcggcgcgtggcagggggggggggccccaaaaaaggncgacggcggcgcggttgggcggctgcggctcagcagtgactagggcaacggcgcgcatggcagtggctacacacgacacggcgacacacgaaaaagcttaaccctaaaacgagaagaaaacctcaccggagaacggaacccggagagggatgatgacggcggcggcggcggttccggcggcaacacacgtgatcgacggcgacgctagatgagaaacaactgaatagattaaatagatgaattgatgtttgcggcggaaaacacatcaataaagagggagaatggagtaccggcgacgcaacgacgacgtttaaggaaaggaaaggaaacggtaccggaaacgaaattggacttggctcgtcatgcaaaacgaaaccacggacgaagagaggagtgaatcaggcatgattcacgaccaaaggcaaggagaaaatttattattaattcaaatcttgataatttaaattaacaacatcaattctgttgctctgaatattccgctttaagtcctgttaatgattttggagcaaagagaattcgaaaaaaatctccctaacatttccgattattaaatacattgttaattagggttttctcctagttatccaaagtaatttctatagtcaatttattggtgaattagaatctacggaaaaggg

SEQ ID NO: 43582 - DNA, 18062 bp, Oryza sativa
  unsure (1)..(18062): unsure at all n locations
agggtgcccaagtggtaaaagactggatgtagtggagacgagcggacaacaagacgctagcgacgcactagagctactaggatggaggagggaccacctgacgtcgggtcattagttagaaggtggggacaacgggcgcatgataatggtgcaagtggctggagatggggaagaataacgggagggggcaccttgccaccactcagcttcgagaggagaaatgataggggtagtaggctgatacggtgagccttgctagcactgttggcaacttccacactggcgaggcaggaatgcagcgttggggtagtggttaggagatggagagttggagacacattggtatctcgacgatgcaagccgctagagacgggaaaggttgccacgcctcagcttcgggcgaaagaagggatagggggaaggaggtcggtatggtggcccttgttggcattgttggtgccttccacgctggtgaggcagagaggtacattgatggcggtgacaagggcagtggggtgaggaataagagaagtgacatgtagggcttagagggtgttgcaagattcttaaagccatcctagtattttaaaactcgagtgatattttttcgcattttcagctaactgacaaatcgcaagcctcacctaatgcatttttctttttcatgatcctccaagatgcaaatcaatcccacttgttcttatttttactcaaatatgctaataaatttgtaatgctacgaaaccacactcggaagatttgcctcttgccctttttttttttgccgggtcggccaacgaccaatttcattaagattggaaagaaaaacaaggagaatgttacaacgacattacaatgtcgcgctagtccgggagagatcccagacccagcgtgaacaagcaaaggggaaagagggaaggtagggcagaaccctgacaatacacaacacgattactctccaaaatgggagaagatcccagctaccctccacaccgcaatttcttcttttatatcctcggctagttgcttcggaatctttgacacatgctgaaaaattctagcattttgttccttccaaataagctagcaaattaacataaaggcgttgtcgaagtccaccctgtagctcgtcctaaaacggcgccgcgttgcaagccaccagtcagcaagcatgctgtcactgtccgccgggattgcaaagtttgcattgcaccatcttatgaactttcgccatacttcctcttgccctcttcccccgctgctgcatgtcaccaatagagatgaaaatagagcggatacatgcggatagcattcatatcacatcggttttcgtacttttagccggatatgaaaacaaatacgaatagctgggatatagacataaatatgaatgatctcgaatacaaataaggattgaataagaccagacacaatacataaacaaatatgtctcggaacacgaaatccacctaaacttctaaaatgtgtatccgtcggaaagtctaataccatatttgtattcaactattcatgtgggaaaaacatttgtatttgtatgattgtatccgtatctgtaccatcctaatgtattcaattttctcgataggctccgttttcatccctggccaccagcggtcatccaggatcatgcacgcgtttaccccccgcaacgcagccaaactcaacggcgacgcaacaagccacaacgctcaacgcatgccttgcgagaccggcaaagccatttccatgtcgaaccagtggaattcacggcggcaggcgcgcgcgagcatcgcatgcccaagctaaatctgagggaaggaaaattagcatgttgcttatatttggccgcagcaatggcgcgccatcgcgcgcatgccccgttttttgcgtgcgtgtggtttccaactttggctcgcccctccgggcgcaaacaccacaacacctcgcgcccatgcgaggacgcagccatccatccatccacccagcccccacactccttcggcgcgcgcgtccgtcctcgatcgcgcgcgcgtcgacgagctaagccggcccgggaaacccaaggcccctctcccttcctcaagcgcgccggcgggcctcgccggcgcgcgacattgagctcaacccccccgtcgtagtcgcacgtcgagcgccaccaccaccgccagcgcgtcgcatcgtacgtcctccacgcgcggcgccgtgctaggcaacctcctctgctgatcgcccgcctcctcatgagcgtgtgacctgctgtcgaatggtgcggcggcacctgctgcgcggacacagcctggacaggttcctgccgatcaggagcctcatcatgtcgtccagctcttccttctcgtcgtcgtctccgtcgccgccgccgccgtcgtcgtcgtcgtcacggggaagcagcagcggcaggtggtgcggcgtcagcgtggccgaggaggacgaggacgatgccgccgtctccgcgacgacgaccccgccactgccgccgctgcagaagcgggtgctgtcgaggagccacgggtccaaggccaagccgctgggcggctccgtcgaccacctgccgccggtggtgccgccatcgtcgaagaacgtccgtgacagtggaccgccttcaggtgatcaaccatatgcaaaatcacaattgctcaaatcttcttggatcaaccgcttagtttcgccattgatttgatcgatcgttcgatctctgttgcagagattgatctggtgaaggagaagttcgccaagctgctgctcggcgaggacatgtccggcaccggcaaaggtgtctcctccgctcttgctctctccaacgccatcacaaatctcgcaggtcagtatcacaccactcatcacatgctatctactacaaatctcttgtgttcttgcctgtcatgatgtttttttttcccgttcttcaccgtggcaaaatctgcagcttcggtattcggggagcagcgccggctcgagcccatgtctgccgaccggagagctcgatggaacaaggagatcgactggctgctgtcggtcaccgaccacatcgtcgagttcgtcccttcgcaacaggcgtccacggatggaaccagcatggaggtaggccatccacaagatcgttgcaacctcattactatttcatcgtgcaattcgcttcattttcgtccttgttgtcaaccaggtgatgggtacccagcagcgcagagatcttctcatcaatatcccggcattgcgaaaactcgacgccatgctccttgtaagcataatagcatatacaaatgtccaaattgatcttttccccattagttttctgaaccagcattactttgcggtggtccttttgccggtggagcaggagtatcttgacaatttcaaagatgaacaagaattctggtacgtaaaaaaagacgcagatgagggtgaaaagggcgatgcgccaagacagggcgacaagtggtggatccctacagttcgagtccctcccgagggtctgccagatgcgtcgaaaaaatggattctgcaccagaaagaccttgtagggcaggtgctgaaggcagccatggctatcaatgctgatgttcttacagagatggagatcccgggagagtacattgaaactctgcctaaggtgacttataataccattaatatttgtaaaaactcctttccatactttacgcatatcttttctcgaagtgagttcattttctgcttgatgctgagttgaacaaacttttcctggattttggaatgtagtacggtgttttcctgaaaaacattatgaggctaatctaaccgagactacttctcttgcagaatggaaggtctagtcttggagactcgatatacaaaattataactgatgatcatttcgatcccaatgagctcttaagttctgtagacttgtcgacagagcacaagatcgtcgatctcaaagaccgaattgaggcctccgttgtaatttggcagaggaaaatttccaataagctttcctggggccccggtgttagcttggagaagcgagagcagtttgaagagcgggcgcaaactgtcctactcatcctcaagcaccagttccctggggttcctcagtcatcacttgacatcagcaagatacaatacaacaaggtcaaaaaaaaaaaaccatagctgcatgtttagttacttttttcggatttgctacagtacttatactcatgccacctgcatttgctacttcttttcttcaggatgttgggtatgccatcttggagagctactccaggactcttgagagcttagcctttgcagttttatctcggatcgaggatgttcttcacgctgatgccattgctagagacccaaagcgcacgaaatcaaggagaaggcccagtctagttgacatccccgagatcattgacaatgcactggaggaagaggagactgtgaacagcatagatgccaattcacaagtgaccaacaactctattcactggcaagagcaagaacacgaggacaaaggcgcgaggctgaggaaagtccaccgcatggtcacaaagaaacttttgcacattgagaaagttgataatttggggggtgggttgaaaagcttttctcataggtagctgtagcctgaaaaaatggtcagacagctgcatgcttggttgtgctaccggggggagcacctgtaaatagctcaaacttcagagaggctggatgggttgtattggcgatttggcggtgtaatctgctcatctcagttgagatgaaatcagtatgcatatttcacggcctcattttggttggaaaatttttgcatgaatagatcagaaattcaaaatgtgaaaccgctagtatctgaataacagaatgcacactagcatattttccttcggaatacaaaagcagacgtgcgcgcaccaacagtaacacaaagatatgcaagctacagttgctgtaaactatgcggagtataagtaattggcaagatggcccaggcattaagcctagatttatcaccatatttaccttgtaaatgaaataaccgcacagcctccttattgccatcttcgcacgctgatactaccttcttttttaatagatgacgccgttgactttttctcacatgtttaaccattcatcttattcaaaaaatttacgtaattatactttattttgttatgagttgttttatcactcatagtactttaagtgtgatttatatcttatatatttgcataaaatttttgaataagacgaatggtcaaatgtgtgagaaaaagtcaacagcgtcatctattaaaagagtattaagctgtgcagaggcagtatatgcctgttcagagaacgggcattgctgttgcgatccgatcagtttctaccataaaattctctcttcttgaccaataatccagtttactctagaagtcactgtctaagtgtcaacggaaagatcaaacctttttctggagatataaactgaagattataacttaacatgagcactgaacattactacttgattcaacagtggatacagattcaaacattatcataaagtcctcacaactaggcagctcatcgacaattttattcgcacaagtattttgcagacaaatttaaacaagattgacacgataggtccaagtgatcgctgccgttcctaagagctgaagctcttacagtgccttgaggatctcctcagcaccagagattgtgaattggccaccttcctcaatgtttgcaacagtaaccttgaggttgtcagcaaggagagcaaaccgtctcgaacgaataccaagccctttctccgaaaggtcaagctcaagaccaagtgccttggtgtatgttcccaaaccatcggcaaggaatttcacatgcttattctcagggtatgactttgcccacgccttcatgacaaaggggtcgttaactgcaaaattatatcatagatccacagataagtcatattctgccacagctgccttgattcggtactatatacagtcagaaagtggatagtgtttctactttgtacaccagtcagtatatctaccctacacaactttaccgagaacacgggaaaatcacaatatctgaaatagaataaaattttcctttgtccttaccatgtttagttcaaataattgactgaagatttctgacaaaagctaaatttgggaatatgaacatggagaaacaaatgacagaaacataccactgacaagcaagatgtcgtctacacccttggctttgagctgctcagcctgatttatgaatcctggcacatgctgattgctatagccatcgaaaaataataataaaagacattatgtcagttcatcaggttttcagaagtgaaaagaagacaataacagggcgagtaacaaagtaatatgacaacttaaacctctgtgatggcaaaatagaacagcgggttcttataaaagggacagcaaaatgagataattggcagctagatatattaaaactgcggtgccaagtgccaacagaggatgatggcaaagggaaggataaaacatttcaagctcacaaatttatcgaaaccaaatagtacaagtaaaaaccaacagcatcagtctaatctaaagaatgaagacaaaagttagccagttaggagcacttggatatgagcactttgctctcgataaaatgtgtactctgtatttgtcagtcatgtgactcgtgtctccattttttctattcgaaatgtttgttttagttcagttagctgcatccaggtttacagattttctgtgggagattaatcaacaagaaaaggctatcagcttacgaaattctgagcgaatctccacggagtaactatagccaaaatctcccttttatatcctgccacccatcttggcttaactgcttctagcatagatgcccaaaaattataacattttctctcgcgtgctcagaagctggggaacaacacatggagtaaaccagaacagtggatcgaagtctactttttagtcatgcaactagcaatatataaacccacatcaagatttttaaccctaactctgacacccaaggaagtgggagtgacttcagagctcgtcaaatcaatcccataaattgtgagtatctgtataataaagcagtaatcttggatttggtccggacatcagctagtacacatttcagttttgcagtaaaatttctcgatctgataaaaagaagtcccattttttaaggaatttttttttcagggaaatataacgtctccaagaaagaggggggagaggaaatcgaaaaaaggaggaagagacctgcaggtcggggtgaaggcaccggggacgccgaagaggacgaccttcttgccggcggcgaggccgtggacggagacctgctgcagcttgtcctccccgtcgaaccaccccagctggccgtcggggagggtgtcgcccacggcaaccggggccatgtcgctctcccggatgattcttgtgttgcctgcctggatgtgtggaggagaggaggaacagaggaaggagagaaggtaatcgacagggaagggagatgagtgatgatgaggagaggaatgcgaataaataaggggcccttccctccccactgattgtgatatgctttggggtttggttggttgttgggagcttcgagtgtgccgccgagtgtgaacccaaaaatttgggcggatatacgagtggtactgtactactgtgtagactttcaagtccctatcaaggtttggacactaattataaatattaaatatagattattaataaagctcattctataatcctaaactaattcgctagacgaatctataaaacctaattaatcgatgattagcctatatgatgctacagtaaacatacgctaattatagattaagtgggcttaaaaaatttgttacgtgaattagcttttatttatgtaattagttttataaggctgagtttgagaaaggggagatagagaagactgggaagatacgcaaaacgaggtgagccattagcgcatgattaattgagtattaactattttaaattttaaaaatggactaatatgatttttttaaagcaactttcctatagaatttttttaaaaaacgcaccatttaatagtttgggaagcgtgcgcgcggaaaacggaacaaactatctcccaatctcacggtggcgaacgcagcctaagtagtctatgtttaatacttcaaattcatccgatataagagtcacttgatccaaacaccaccttacactgatctcggtagattgaacggatcgtgaagttcagcgggtatactggagtttcttattattagtagaaaataaattgtgagagtacgcgattcccggatttgtcaggatatgcgcaccagaactgaatatgagaagaagaagaatcatttaccaaaacctggtacgttcgctcttgttgacactgcccgtgaggccgtttcaagttttcaacggatcgcggacttggtggatcatacgtgttcgtgcaaggaatgatcgtgccgcagtggggctcgaggaaattaaacttgtactgatgctgttttacctgacaagaaaatgaaaacaccgcagtggggctagaggaaattaaactttgtactggtgctgttttacctgacaagaaatgaaaacaccgcagtggggctagaggaaattaggctcccatcggatggcctaataagccaaagaaaaaaccaaattttaaatttttaaatttaattttttaacctactttttttttcagcattggcttttaagtcacaaagaacacatatataaatataaaaagttttatatacaaatttatttttatttctaataagccgtctggtgctgttttacttgaaagaaaaaagtacgtcgacagcaggattcgaacctgcgcaggcaaagcccaacagatttcgagtctgtctccttaaccactcggacatatcgactacttgatagtggatggaggtgacaatttatttatactctactacttagtatcaaacaattttccaacgcctactagctaacattacgtgccttggccacatcatctgcgttgctgtcctgtttgtatgcttctattggccgtaaaaatatgaagtacaaatgagaatgcaatacggctgtattttgtgaagcatataaccctagcttttcggggacggtgcgtgacattcaaaatctaaccctctattcatggaaaatgtcgttttaatcagtttcaagcccaattttcaaaaggaaaaaaaaagacccctttgaaaaaaagattaataagaaaacccaggaatgggaaggtaggtatataatgtcatgtccatcgagtttctacacgaattaaaaatataagaattttttttaaaaaaattgtagttggtatacacatatgagaaacacaaaaaagaattagagtcatgcatgggaggaagaacagatcgtagtagcattataaattattagtaaaaaatgtattgtttagagaacgcgtagtacgtaaaacgtcacgtgtgtacgtaacggaagacaatggtaattttgtatggttattaaaaaacggtgaagtttttccgaatgtgtgaatattagttgagcttatagaagttgcacatcttctatgtaattgagaaaaacccgattatgttgcaaaaagactaaaaaatacatgtaatcttggacaaaaccaaaagaaagagatcacttgctgctagcaacaattcaattaataaatgtggtaatattaaacaatccttgctctgtagtaaatctacaaacggctgaagaagtactatactattctacgagacatgctaaggtgcttgggaatgatgacatccgttgatcggatgcaatccaacgatatggatctatatatatgtctagaaaagcacaacaaataaaatgcgcagggtaattatcaaaaaaaaaaagagagtatattttctagataatggaatagaacattccgacctttgcttaaaagagcttcaattattacaactaggaaagaagcccgcgcatctatggatctatatatgtctagaaaagcacaaaaataaaatgcgcagggtaattgtcaaaaaaaaagagagagtatattttctagataatggaatagaacattccgacctttgcttaaaagagcttcaattattacaactaggaaagaagcccgcgcagatcattttgtttattgtttatgtcaaaagcgtttcctagattcaaacaaaaatcactgtgtcccagttatatataaatttgcctaatatcgccactacttattattattattttattttattatggagacttattatcgttcttttgaaaccaaagtgattatgaccctgtttagatggaactaaaacttttaagtccctatcacatcggatgtttgaacactaattataaatattaaacttagactattaataaaactcatccataatcttggactaatttgcgagacgaatctattgagcctaattaatccatgattagcctatgtgatgctacagtaaacattttttaattatggattaaattaggcttaaaaaaattgtctcgtaaattaactttcatttatgtaattagttttgtaattagtctatatttaatactctaaattagtgtctaaatacagagactaaagttaagtccctggatccaaacaccacctatttaatagatgaaactgtatttgtaacatcaaaataagaacaatacatcgttaatcgactaaaaaaattatctccactactaacctaactgttcatgtcgatctgacttatttctaaatctatgtataaatattccaataatattttatcaaaaaaatatattataacaatatcgcttctatgagttaataggataataatgttaaaatttgatatgaatgcccatctaacggatgaagccgaacataactaccaaggctttctttctcgataccttgaaacatgggtcacatatcgacataatcgtgcccatcaagaccatcgtggataacagttttaacggctaattcactattagtaccctcataaaggattgcatcgttaattaagtacccatggtggcttaactcatccaaatgtatgcctttgctatatcatggtagtatagcaagctttattatctatgcttggcacccttttgagaatggaaaaagagaagacggaggtgattacaataatcctttttaaagattgagttgttttgtggtatatagtagacacaatttgtttatagtgtaaatcaatattactcaaatttcaataatacatatacaatattcttatttgaaagtgagtgaggttatcatgttagtagagtatatgacatacatccatcaactatgcccgacacatcggaattcctcaagtataaaaaatatatattatgggtgttacttgattgtttatttgttgccaaaactatatgacaaacaaaaaacctacatatatgaccatagttctcatgatggattaaggggttgtagtatagccatatcactcgctagaagtatttttaataaagtttatcatgtctatgtatcatgtgtgcttctcacttttcaaataccaatcaaatagttctgaaaaattcaaaaaaaatatttgagaatcgtaatatctcacatattaaaattagataagatctacttgaaaaaaatataactaaattctgttgttttcatttttcatttttacatatgtagattcaaattatttgtcaggtgatattgtacaccataattatttgaaaaattattatgatattaattattatgtgccattatgtatttatcagttagcactaactactataggtcaataatagttcatttaattaaaggaatacatcagaattattaaaattgatatatatatttaatagatgaacacttacagaccattgaattcatattacatctttgatctagtttaactgcgtatgttggttgggtaatattttttatatcatggaaaatcatagtttagagaccattgattttctctgatcatagtgtgtatgtatatttttagctatatatttatatttttacatgtgtatatgtgttactttgctttttcttacatgggagattttggtttttttttggggggggggtggattgttttttcagtagacctaatttaatggtataaaataacgggtttactaatttaaagtttgtagagtaatatattttagctctatatcatagaaaatgcaaagggtgatggtatggctcacactattttttaatttataataaaacatcaatatatagatttaaattattgatttaattgtcaagaatataaagaactaaattgatcataaaaccaacttatagttttcaaaagttaaaacatgcatggagccctccacgaagatgacactgacctaatttaaagttcgtagagtaatatattttatctctatatcatagaaaatgcaaagggtgaaggcatatatatatggctcacactattttataatttgataataaaacatcaatatatagatttaaattattgatttaattgtcaagaatataaagaactaaactgaccaaaagttaatacatgcatggagccctccacgaagatgacactgaccgtgataaccatgaaagtctacattcaatcgaagatataaatcaaatgttgtttagattttattatgctgtagatatctcaacaacctaaaaataagaagagcagataatgcatatacgtgcttgtgccgtgagctgatggtgattatcttggctgatcgtttgggctggtgcttttataattaatcttggcagtgattttttttcaatcatagttatcaatatctttggtttttatttcgttcgtacatacgtatagcttttgcctttttttcccggatgaattgtacgcaacgattttctcttgtatgtgaataggattttttttttcccggatgaattgtacgcaacgattttctcttgtatgtgaataggatttttttttaaccagatgaattgtacgcaacgattttctcttgtatgtgaataggattttttttttttgagaattacacagtacaacacagacactcacaacgcacgcgcactcacccctatgaacgcacgcacgcaaaccctactcctatgagcatcttcgaagactgggccggcaaatcctggagagattgatgaagtcaccgtaggcgtctcgctgtcgacgggtacgtcgcctaccactaaaagcacaacgccgttaaatcctggaaaattcgctcccacggggagtcgaacccaggacctcaggtgctactgaagctcttgtaaccactaggctatgtgaataggatattgggagcgagagattattttttatagatttaataatttgaacgggatattaggagggagagattattttttatagatataataatttaattgtctaaaataatggtctcttagctttaagtgaaaatcgagaattaaatgttttattttaactaagaatttatattattttatttaatttattatagcgctacttagcaacgtagaagcgtttgtagagtgacacatggtgacgtgagagcgtttgtaggaaatttaatggaaaagtataacaaaataaatgataattacatatttctttagtaaataaacatatgttcaaacgccaataatattatggaggtatattaggtaaagcaaaataataaaagaaggggaataaaaaaggaaaaaagtggggtatgttacgttcttactcatatgtacgtacttgcaggcggtgagggaggcatacgtatgagggtctatttttaatctaatctaatggtgtaaaattatggacccaccaatttaaatgaaaattaagggccagatgtttctaatatattaaaacgccacatggcgacttaggagtgtttatagaattgctacgtgacggcttaggagcgtttgtaggaagtttaatggacttttactatataatagatagatagatagatagatagatagatagatagatagatagatagatagatgtagcactctaaaacgagcgaagttcaaataaaattaagaacaccaaactaagaagaaaaataacccatataggataagaaatacacatttattaaagtttatttgtaaatctcaatttattatccttaaaaaaaattacatactcgtagtctcgagagatgagttagagatgggatgtacagtacattgggaggtgccagcactgtaaaatatctcactactctattcagtctatacccatcctgcctaagcacatacttccacaggcgcgtgagatggcgggagcatgcactgcggcggtggagcttccagcgggcgccacgaaccgccgacgatcaccaggtagaagcggctctccggcacggtggcgccgaagaggcggaacccgcggcgcttgaaggcccagatctgcacggcgtcgtgctccctcaggccggttccggcgatgaagtccatgtagccggtccccttgatgatggtgccatggctgctgtcccagagcaccagccgcagctccttcatggcgccgctcaggtgcagcaccgtcaccggcaccccgccgtggtccttcccctgcgccttcttcctcggctccttctccctccccttctgctgctgctgctgctcaccgtcggcgacgtcgacgctgcctttctccgttcgtcgcttcttcttcttcggcaccggctttgggcgaggaggagcctgatcctctccctccacgttcgtctccggcgtcgttccctgcggcttctgcagctccccgtcggcggcggcggtggcggcgatgacgacgctgcctttctccgtgcgtcgcttcttcttgggcctcggcctcgggcgaggaacccccttctcctcgtcgttctccaccaggttggcctccttggcctcgtcgacggtgagcatcgggaggaggcggcgctccacgccgaagatcgggaggcggaaccggttctggtgcgggtcgaggtcggtcctggtcaccgtcttcctcgcgatgaacaccaccggctggtcgtacgtcatccccagccgctcgagcagtatcttgcggatccacgccggctccgcggacggcaccgccgccgcctggtcgtcggcctccttcctccgcgcggccgcggcggcggcgagcgggacggcgcgtatgggccgggcgtcgatgggcgccacgtacgggaccagagcgcccgtcgccgcagccgccgccgcgcgcgcccgcttggcctcccgtcgtcgttcccgccgtttcgcagcggcagcggcagcggcattgcgcccgtcgacgtcgcacgacggcgccaccgcggcgagaggccgcttcatgccggcggagtagcccgcagcagccggcggcatattgcggggcagagagatcacgctgtttcgtcaacaccgaagtatcgcgatcgattttaatttgctcgtattcttcgatcgaattctccctcgggaactcaatatggaagggggtttggatggcgcatatgccctggatttataggcgcgaatgcgtatgcgcctcgagacctgatcggagtccagggcgatcgctgcgaacgcagggcaaactcatcgtgtccgacacggaatggaatgcaacgcaaccgactggataatcattttcgcttttattttgtcatagtatcgtcgtaagcagtcagggcgcagcccgattggcatacggcataccgactggtgagtgggtaacgcagcctgttagaatgagccggcgtggggaaggaggctttccataattttggtaacggatttttgcatttggacgcctgattggagttggagatggccagatggtggggttccggtttccgtgggttgaaagaaggaaagggcccactcgtatcgttggagttggcccgtttggttcagattactcctgggcccaagcacaaatggccattctgtatagtatctgaattcccgtaaaaaaatattgtatctgaatttgtgtttttatatctcaatgtataagttgagtttgaacctagtatttcgtagagtggtatatgtattatatgaatattatcatttttttaaaaaaaatggtaactattttatatggtgtataagtttgagttggaacttaatattttgtagagcggtatatgtatattatatgaatattatcaatttattaaaaaaaattggtaactatttatatggtttttaaaggaggttgctagtgggcgggtgatcgcttccctctcctcctagcgatcacccatccctccctcctaatacttatctttcatctctcttttttacttttttattacatcataaatttaaaaaaaatagtaaaagaaaattaggaaaaaaatctaatactctcattcatgtgcatagactttataccgtaaactttgcatgcataaactttgtgtatagaaatattttatatataaaatatttgaatccgaatttgaatttgaattggatacataaacttttaacttataaacattcggtgtacaaactttaggtggataaactttagatgggtaaactttaggtgtataaacttactaaaatagaaaaatataaaatatttgaattcgaatttgaatttgaatcgggtatataaacttttgacttataaacattcgctttacaaactttaggtggataaactttatatgtgtaaactttaggtgtataaacttactaaaataggaaaatatcaaatatttgaattcgaatttgaatttgaatcgggtacataaacttttgacttataaacattcgttgtaaaaactttaaatggataaactttagatgtgtaaactttaggtgtataaattttaggtgtataaacttactaaaagaggaaaatataaaatatttgaattcgaatttgaatttgaatcgggtatataaacttttaacttataaacattcgctttacaaattttagatggataaactttagatgtgtaaactttatgtgtataaacttactaaaagagaaaaagaaaaaaaaaacgatcgccgacagcaatcgatcgcccgttagcctttccacgtcaggtgagcttgcttgctttccgaaaatgctgagctctgaccataccttgcaatgcattaattttatactagtaggattttagttcaaatcccttaaaattaccacgaatttctccgttccaaaggaggctttacatagggaaatttcggtactacagctggtataggaagccaagccacgaacattctcagtgaatacatgatacattagcacgcaacacgatatttgcattgacaggaattcagagatcagaacagagcaaggtgcaacgcagctgaggagaatgaaatattgaaaaggaacttgcgagttaggaccaagcacaccattgtgtgtacaatctatggttttgatttaacctttgttcatgtatatcaaagagagtatctgctttgctcttcaacagttccaatggaggggaacattcacatctgtgaggtgatatgtatgtatataacggacagaaacgagaaaaaaaatgaaatgtacatggctatatctagctggatgaatatggggaaaaaatgaacatatagaaaagaatgcaacagagagaaaaactttcttttgtcaggcttctcacttttcaactgttactagtatgacattatttggaccagatcttggcagagcagcttctcatgatcctggacgctaccaagttcaggaaggcatcattcacactaggatggcaaacaaaaagaggagcagcaggacagttatgttattggcacaacagcatccagattcctctgcagcagccagccaattgggtagttgacttgaggaggttccagttcgaaattccagaccataacacgagtgcaattatccccaaggccttccatttgactctcgtcctcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 43583 - DNA, 9385 bp, Oryza sativa
tgaaatgactagatagcctcatagccatttcccttgcttgtcgcgttcggaaactggttgcaatttttgccacctcctgttcttgtaggatagtaatggcaaaacacaaccacacacagtaatcaaacatgtaactactagaagcttctctgctggatacgcacaattcttgcaagttttgtaggggtagctttggtgagattgcttgcactgatcgctcagcccatttgtgtaatcagggtagatagatccaagagaattaatttctggctggatacttagctgagcaaaaagatgatgggcctgcctctcacatactccctccgtttcacagtataagtcattctagcattttccatattcatattgattttaatgaatttagacatatatatctatctagattcgttaatatcaatatgaatgtggaaaatgctagaatgatttacattgtgaaacggaggaagtatcattcacgtgtttttttttcttttttggagagagaaacatattcacatgtttgcttcagtagttctgtgtagtactcttgccagttgccacctcctcatttcaggctgctcacatggtgtggcctctgcattatgcagctgtgcgtagccaataaaggcagcaacgtacgctgacaatgcttacgtttcgtgtctcttgatgttgccaaacattaggccaaagtccttttttatgatttttttttccaaaattttgtgaagcgagaatcttgttgacctgatggttttttgttgttcaaggatgtcctcaattctttttatttttctgttgcagaatgcaatggtcttccaagtcttcgcgatcctgtcgcggtcgatcgatcaaccgagctccatgtcggagccaccgtcgtacaccagcgtggcgctcgccggcgtcggcaccggggcgctgcagacgctgatcctgtcccccgtcgagctcgtcaagatcaggctgcagctggaggcggccgggcagaagcaccgccggcccggcgaccaccacgggcccgtggacatggcgcgcgacatcctgcggaaggagggcgtccgcggcatataccgcggcctcgcggtgaccgcgctccgggacgcgccggcgcacggcgtgtacttctggacgtacgagtacgcgcgggagcggctgcacccggggtgccgcggccacggcggggagcaggagagcctcgccaccatgctcgtattcggcggcctcgccggcgtcgccagctgggtctgctgctacccgctcgacgtggtgaagtcgcggatgcaggcgcagggctacccgccgaggtaccgtggcatcgccgactgctttcggcggagcgtcagggaggaagggctccccgtgctgtggcgcggcctcggcaccgacgtcgcgcgggcgttcgtcgtcaacggcgccatcttctctgcctacgagctggcactccggttcttggctagcagcagcaacgaccagaggctggtcatggaggagaactgaatcaccgagacggcgagactgcaggggttgtacatagactagtattcattggcagcatttccgaggctcgtagcgtcgcaagaagatgagattttcagagaaagcatcgttgctgcagagttcgtgtagattggcattataggtttgccaaatgatgatgatgatcaatccccaattgtctagggaaaactttttctggtgtactgctattacagatataataacattgtttgagacagtaaagactaaaattaatcttcttgtcttgctgggattccatgtttactctgttgtttttcctaaaaaaaaaagtttactctgttgtgtagtttttttttctcagttcagacaaataaacaaatacccttttgctaattcacatttctaaacccttagaaatatgcttcttttttatcctctgtggatctccaaaagctcaaagatgcacattattttcagtttcccgtttgatttttttacttctacaggaaaaggaggagaatcccaatacaaaacaatggtcttgtgactttgtgaggtgttttcaatcaagacaagaaaaaggttgctttcagcagctacctcaatgaacaagaggaaggcaaaaggtagactcttttcttgggagcactcgtggatatgaaattaccatttatgtgtaatctttttctgcttacgattggcgaaattgcaggctatcttactccacccaaccaggtctagatcctgattccaaaaggaatccagttggtttgatttgatttgaggtcccagatccctggagaaagctaagccaagtgagaaagatacagccgtgctaactgattgctttgccaattgtcatggaattttgtccttgtccatatcttcaacatggattcacctatttctgaagattcgcagaatcagacaagatcatattctatatcatattctcaagacttaggactccatcgaggcatatttgcaaaagaaaaaataatttgtaaataaaaattttatatacgtgttcttaatgatctaaaagcaaaagctgaaaaataaactacgatgaaaaaactccaaaatcaactccatatttaaggttgaaaattcaaattttgacttataagcataagcataagccaaaagatgaggttgttagatcatataatctttgtgaaatctcatatccttgtatgatgtcacaaataagtggtgtatcgaacatcagcatagtctgtaaagcacactccatatgagataatcttgggaagacattatgtaattacctccatccctttttatacaacgtcagttactaggatcgaacaacaataactaagccaacccttgcgtgcgcgcgggggagggggggaggttgaatggttgtaatacccaaaaccaaaacttttagtaatcgacggatgtcggtctgaccgaagtaggtctgccgttctaacagcgtgatctgaccggagttgatctcccggtctgaccgtcctgaagcgtcgttgccttctgtcgcggtcgccggtctgaccgaagcgatgccaccggtctgaccgtcggtgtcctgctggttggaccaccgcacccgaacaaacacaaattgaagatacctcaaagtagattgaaactttattatttctctctgtgtttacaaagtgcaacaacactcctcacaaaaatctcgactacccattgtgtgtatgtgggatgtggagtcgaatttggagggagtccaaatttggtacaattgagtttgtaaagttctttttcttgcacgagaaggtttcctaggggagtaggacttcttgtaaaaggttggttcttagctttagactgcttacctcgggtataaatagaaagggagggtgtggcatcccgttatcgatattgagagagttaagtttagagaaaagttagggtttcgagatcgtatgtcatatgaaatctttaccaaccacgtgcatggatctttagcctaagcatcctgcatgatatcttgatcgtccggccatcatcttctcccaagttgactcccgatccggcgtcaagactcacatacacatgcatcaatcaagaaaccatatctgagcacatgttctcaccaatttgactcattgttagcacacaaaagtattacatacgccataatatccacctagaaatcataaacatgatttatccataggtatccaaataagcaatccgaaaacgaaaccgacacatcgtcggctggtcagaacggctatcacaacccggtctgaccagacctaatatgtcagcaataatccctgttcatcacctgaaaaactaatatctctaaaaccaccttgccaataatctacaaaaatcaaaactaataatctcatatgccaattgttcgtcacaaaatagcaatcaaacacactttgattttacaagttagttaaaaataagctaaccacgttaaaaaaacaccaaagggcgaaagggcctgtagcctagtagttacaaaagtctcagtagcaccttgggtcctgggttcgactccctatgggagcgaatttttccaggatttaacggatttgttctctagcgatgttttagaatgtagacaaacactacaagggacagtcttgaaaagaaaatccagtgtgatagtaaaagggttgaaaacgagaaaaaaaaaaccgtagacaacatagtgcatacagcgtggcccaaatagctattctgggtccctatcttgctctaactgggctaccagaggtccacacagcccatgtggagaatacatttccaaagttcaaaataagcaaattattttttctaggggcttggctagtaccgagaattaacacaaagttttccaggttagtagtaggaaaaatctatcagaataaaatatgaatgcacatagctggatagcatgtaacacatggcaaaaatgtgtgcttccaatgctatatgcaacgtcatatatagggacaaaactagaactatttgaagggaataatttcaaggaaaaatatggtgaacttaccgcatcgcaaggtcaaatactcaatcaatatacacgacacatgtacatttgcaagtaacactgtatatatagatggactcttgaatcgtactcgagcattctgaatggattgtttctggatgaaagcccacggattatctacttaactaggtgatttcttgtgtgttgttgcgggaattactaagtagtcttttatatgttttcttttgtcgacaattgagctatgagtaaaaagaatattagttattaacaacaaataaaaccgatttatgaaaccatgtttgaagagaaatacatttcatagactttgtatgagattgcagatgaaatattaaattgctagctgaaatttgcatcaagcagagataaggaaaaaaaatgaagaaagtctgagtttattagtaataatcaataaataaactaaatgatataccattctttgatggataaatatatattaagtattataagaatgataaatagatatgctgaaatattgtaaaaataatgtgaggggtgatgcatattgatttgtaaaattcattaaattttagatgatgttgcatgcttgcatgagttttggtatgtaattattgctagtagatgatgaggtgatatgtttgcatgttaagttttagacttagtgggtacatgatgaggtggcatgtttgcatgttgagttttaacttcagtaggttacaactgttgggggaaggattgtgaccctttcgtcagcgcccccctccccccgggtcctgaggaggctagggtctccactcccagggccgccaccgatgccttgcggagtcccgcaaggcgggctcttgatggagccctgcgaagttggcaagcccgtagagggcagttggctccggaggcctcggaaccaactgaagggctccgagggtctcgaagcccagtcaagggacccagagaccccggagtcggagcctaggatggcctccagaagtgggcatgggcattgctcaccctccaaccaccactgacgtcacggcacggaaggcgatgtgaaggccaatgctagctattacgtggagctcgctattacccgggtaaaagctagcatcatgatggcaccataccgccttcttaatgggcgcagccggcgtgcgttcgggtggatttgacccccaacctgttggctggcccacccgtcagccaactcgggatagctaggatgatagggacaattttgtaacttcctttatatgctatcgggtataaatatgtaaatgctaccctcagaagagctcagaagagggggattgaaccatacacagaaacacttgcttagcattcgtgagttgtgttccaacacaactgtatagaatgtatatattatgtggaggactaagtatattataagttgtgaacataacaatagaacaaccgatataatagacgcaatagatttttttagaaatagtgtttttaagaagagtagagtaagaaatctcgagcaataatcggtggataatctaaaaagaggggccaatatgatgagttagcatgcattacgggcacatgacatgatctagatccatgcagggcaatcttgcacacccaacaagtgttgattataggcctcaatcacaatcacaatcacaatcacattatattgatgtgcctcaatcgactattgggcacatctagacaagctgtaatatggattttaagttcctggttagcttaaagaaccgtactgtgtacacatgaactgagctcatctaatttgatttcttgtgctgaaacttatccatttatgttctaagtcctattcttgacacgaccactcacgtttacagttgattttctttccgtcgtagatatcgaaagcgagacatttgtatacaccgatccagtgttcgaagatgcttatagaaatatgatatgcatatgcttattcataagggtgagtgcgacgcttaagctcacgtgtttaggaaggaaaaaaagctcatcatgggacgctaaatcgtcggagctctgccgaagttcgccacggctagggaaggatgtcgcggtgcacaaatcgtgtagctgacctgacggtcatgattttgtaaggtttgcgctgatttttaagtgaaatacctagtaccatttagcaaattcataattttagtataattcctgatccacggtacgaatcgactttttgggcacatccagacaagctgtaatatatgaattttaagttcctgcctagcttaaagtacagaactgtaaaagctgtacctttatctcgcgttttgtaagccaggatgctggttgagtaatatatttctctcccccccctaaaaaaaaagaacagtactgtacacatgaactgagctcatctaatttgatttcctgtgctggaacttatccatttatgttcaaagtcctattcttaacacgatgactcatgtttacagttgattttctttccgtcgtagatatcgaaagtgagacatttgtatatacagatccagtgtaaaaaatgctcatataaatatgatatgcatatgcttattcataaaggatgagtgtgacgcttaagctcacgtgtttaggaaggaaaaaaaagttactgtacactgtcctcttgttcttggccgggattgccggataaactctaggcgatcgacacagaatgggaccgcggcaacaatatttggagcacacgctgcccaccaacacgccaccacacacacacgcgcacgtacagtcgtccaccactaccccgcgtgatctgacgatgtgagatgcccctttcgtccatccatctctcgttcttcaacgactgaaacgaaacgacgggcggctgatcgcgagcacccctgtcacagcgctcgacgcagccgccgccggtcgcgaaaacgcgacagtgcgcgggaccccgcaccggaaatggaattttttttcacgaacacgtaaagaattacacgttaatatattaaaaaaatataataacaccacgcaatcagccagaccggcttatgctaagggaagagagaaaagcaaaataaaaaactaaagcttagaaaaaactacggtggctaaaataaaactccaaatagcgggaaggagctgagccacgttacactcctaacaagtccctagaaatggcaacgccagctaacaaacacatacgacccttcgagtaaatggactccagaaccactaagacagaagagagctcagagtcgaaaactctagcgttccgctccttccccccacacacattcacacgtacagtcgtccaccacggcaacaacctaaaaacggcagggcacgatcgaggaaaaacgtacgatccgggaagcagaaaaagggtctctcttcgggggctcgcttttcccatcatttcaggtttgcgatggcgcaatccacatcaacatccaaccaaaccaaacctgtgcgttggcgcacgggcagggcacaccgaacgggccgacatgtgtgggcgtgtgggtcacacgggaccaatgcgcgcggcggctacgttaccacggccccggcgctcgcgcgcgcgcggtggctgcaagccggccggccactagagtagagagagcccctgcatggctggatctgtacagatctcaggctcgacaaaggggtggaatctttccgtgccggccggaatctgagtgttaatgggtgtgttaggacaaagcccctgttgctgcagcatcattattggtaccactgtccttgttgtgttacagtatgtacgagtactatttcggtggatatacacatgtagtggactagtatggcttctccatattcattactactcctatacatgctctgattggtcaaacgaactcgctcagcactcttgcacatatcttaagtgtgtccttgtaacgcaagaagggatggacactaaatttgttcaaaatgcacccagttgttgccatgtggccagggtgaaaaacggtcggaaacgatcagaatcggtagcatttcttcggaaacgattctcaatcggccggtaattaaccatatttatcatttaaactattcagtgttaatattaatacgatgcagaaagaaattagaaaaaaaacaaaatttaaaaatagcaaaaaaaaaaacagtacggtcggaaacgatatcccttatacggaaacggtgggcggccgattaggaatttccgtgaccgttttcatccctacttgtgggtaatcgtggatggcaaaacttttgaatctactatccttttactccatactaaatctaaatgtgtttccacatagtttatccgagtaaattccataactctgttcccagcagatcatgagtggatgtacatgcaacaagtcagagaataaaagctgcattattaattctagaagccgcaaaagggcaaagcagggttgaaaattccccagaacaacatacatgtgtaaagctgccaaatactactattccatatactaacctgaagcacccctacacacatgcattgatgcatatgatgcatcgacggatcgatctctgcaggttgcggtccggcccacaccgtgccgtcgcgcgcatatacatgtgtcacgtcagggtgcatcatgtggcacggaatggaagcagctacacaagtatacctcggtcctaatcctaataatggagatcgttttccagggcctaaaaaacaacaaccaaagcgaaaggaaaaggaattataattaaagtcgacggaacccccccaatatgtggcctcatgattatctggatatgccaaatgccgagcaaaagtagtgtaggaatgacgacgaagaagagcatcccgttggcccccgtcggctctccccttcgcacacacgacacgacatgacatggatccatcgatcggccagatgtaggagt

SEQ ID NO: 43584 - DNA, 11373 bp, Oryza sativa
  unsure (1)..(11373): unsure at all n locations
cgatcgatcattctgcgggcactgatccccatcaacgtcggcaaaacaccatgatgtgattaagtgatgatgagctcattgtgccggctagtttagctacagagataatttgaaaaaggaggtccaattaattacccccttaaatatataaaagcctattaagttgggtattggtttagccccttaggctttgttgtttgaagtaaataaccctaagcgtttttgtgagctgtccttttgcttgcagggcatgctgactcaacgttttttttttcaccatgtcaacacactagtcaaaccagtacatggagtaataaaataaaccagtactccatgtacgtacatagagtaataaaattgttcatatatatttttcttgttctgttagtggtgaaaacatcatggtagaatcatcatgtgcacatgccaacatggtagtaggaccattaatgagttcgtgagccacataggaaaaaaccatccaataatttatactccctccatccacaaaagttacatttattacttttatcacaagaccaagaagaaattaaatcatcttgaatgttacaaaaccaaagagtgaaagcaatcaatgagaatacatgagacttcttggattctaatcaaatatttaatttatctcttcatttaagtcttaaatgtataaagactacaaatagaaacaatttatttggaaaaactcaaatgtgaaataggtgtaacttttgtggatggaaggagtatgattcaggggttatgtggaccaattagcatgttcaaaggctcaatacctaatagttcaaaattttaggcggactctcgagtatttttttcttcaaaatgttgttaatgagattatgcttgatatatttcactattacacttatgcctatatctgaacacaatacctaaaaatatcttattttttatggtattagaagtaatggttaaccactatttcttctcagtaaaagtacaaggttttaaggttgtgaaccactaggtagtatactaatatacttttttccctaaaaacaaatcggctttcctaagatgccaattggtctaagctttatatctatcctatcactctcttgcttaaattaacttccttccttaactcagatctaaatggcttcctttggatcgacatgaacttaggcgtaagtcaaagcacgggcatggaaaagggattatatggcgtgctgggctggataaaagaagcgactacgcctacaatgagaatagcgggactcccactagccgacagagaattcccagccaaaatgaaattggacttctagcaatagcagaaatatcagtagaacctttcctactggagaataactagaagtttctgggtcgagcaattgagggaacgagtaagatatgtttgtcagtctacttgaaactcgatctttcgggaattagttcacttgccattcaatctcttttccaagttcatgtcttagaaggagtacacaatctccttttctatccttgtgagaagcggaacactgcctccctctcaacgatgtcactagatagggacacacatttctgccaggcgtttgttctcattcctggccaaccgtgccatgaagagtcgagcaagagcaatcgcagctttatctctgcctttaatgctcccattttagttatccataattttgttacggcgacgtgacaatgtattccttgaatatgttacttactaaccttacttttatgaatcatgcttactgcaaaactaatgatccaaaataaccctaggagctgcagggaaactattttgattcctcgagaagatgtccttttgttgtttgcatgtcactcaaatggttatgaaatttttttgagaagatgtattaacatgtgatatatcaccccacaaacatgcaagttcaaattcaacttctacgtctcgcaacgaaaaaaacaaatttgactgtgaatatacattgattagcttagtttattttgaccaagaaaattacattagcataataatacgtgtgtaacacatattatatttccccccttttaacccgatacctacatgcatcaaattcgatacgtgagtatcagactcgatacctgagtatcaaagctgatacctatagatgtcagatctagtatctgcgtatgagaactgatacctatagatatcagatccggtacctgagtatcaaacctgatatctatagatatctgacatggtactcatatgtattactacctagtatttgggtatcatgtgtgatacaatctgatacctgagtactatcacgtatgatacagacatgtacttatatggtacctggtacttgcgaggcatatataaatcagacatcgtaggagcccaacgtgcactagtcaatcttagtaccagacataatagtgtatcatcaaagattatcaagactaaaatagtctttttatttttcacagcctcgctccatggctcgggaggcatatatatttccttgctaagacattcggccatgcctgcccaagctcaattaatttaccacaactcaaagtgtccaactaagtagctctctcgagacctgtcattgagacccaattaatatgcacatgcttagatcggtcaagttggtacatttgtactagtgggaacacggaacatcgcacgtttggcgtggagcggcatatgcgacttgggttcggaaatggtagctgggagcgacggagcgctagacgcgggggagacgatgtcagcacttatctctttgaaacggaaccccgttgtccagacattctctaaataaacacgctgtaaatctcgtcaattatttcataagaagaaccgagtgattaaccgaacaaggtcttaaacctcccggcttcacgctgtcgcgataatactttacctagcacagtcacgcacgcgcgcgcacccccggcgcggcgagttccgtttcgcctcttcgctcctctcccggccactgttcatgcgtgtcagcgtttgtcccgcaacgctcggggaccgccacttccccccgtcgcgcgccaacttgccgcgcccgcgcgcggaacggaaccacgtacgctcgatcgaatgctcgatacccccgcaagctaagctttccgatctctcccaaaaccaatcgtttctggccaaagagattccgccactccagatgtacgcagcgcatgtgactgcatgccgcgcgactgcgacgaccgagctagtaccggcggcggcgaaggcgatgttcaggtggtagtgaccaggtcagcttatcgctttggcacgcaaatggcaatcgctggcctatccacgaattactgacagtagtgaccatgagtatgacatgcagcagcagtagtagttcgctcgattcggttgatatatatgcagctcgctgtcacttcagaatcgacggacttgtcgaccaatcgatctctcacgcaaatgtgcgtgcgtccgttcgtagtcgcgagctacaagccatttgggcgtcagtagtgccgatctcaatcgggtagataaagttagcggagccatcgattcgcttattcacagaataagtgaaagcgaatatgcgaaacacatatttataaatgagaaataatttataaataaaacttttatatacgtgttcttaacaatataaaagtaaaggctaaaaaaataaacttttatgagaaaaaaactcaaaatcagttttaaatttaagattaaaaatttaaaatttaactgaaaaatataaacataaacgaaaagatgaagaccgatctgagagccgggggttctttgctgaaaaggcatagcaggtggcgaatggatagatacataggtagtaaatcatgcagcatacgtgctcgattggtgtacagtggcaacggcgtgtgtgtagttcgcccacgacggttcaaaggctggcttgatattttttccgggtgtagttggattggtaggacaaattagttgcactctggttttctgatcttccgtggaacagaacagagcaattgtttttggtgctacttactcatggtttacaatatcgaggatagccgcttggttatcgccataacagttgatatcagaggacaccatatttaaaaacattttgatattttgaacaggttaaaaaagtttcatactagaatttatttttttggtaaacattattcaaaattcatcgattttagttgataggtagttatcatggttgttgacaaaatcatggagtaacaatttcctgtgcttacgttgttagaaactgttagtgatgtaccctagaggattgtatcacatactatgtttacatatttatccgacattgttccttgaaatagataactccttattggttaatgaatatgtgattctttcatgagactctttatgttgtttgttactatttctaaaggatccctgatcaaatatcatatgtggaacaaatatgtttatatgatcagcacatgtattaattgatgatcatgtctcatggatcatggtatagtgataccaaattaataatgtggatacatgttggtaaacatgttgttggatagacccaacatgagacactgcaagagccatatgtgttgtgtcatcagtgatctcattgagtgttggtgttgaatccttagacctgagattattatggttctcaacatgtgtagtagcttacttagggactgctaaatactactccgtaattgggtagttataaaagtagttttcaggtatgttatgaaacatgtagtgagatatgaataatcaagatgagatttgccccttctatggagagatatctctgggtccctcgatgttgtagattatagaagtgcatggccatgccaagggtgattgaggagtcaatcacaagttatataatctatcaacaggttcgagtgaagattgagctattagaggatggcacatatctagccttgagcttaatcgatatcatgaggcaaaggggttcatacaagtatacactagaggttcagccgatatgatatttatgtatgcccggtgggtcaatacgttctgctaggagccgctgttgacgcgtggactgaaaaagagttttcgggttacagccgagtatacatgaacctatagggtcgcacgcttaatgggccgaaataaggggattggatggagatctaatatgagcttacttcggatagggatctgaataggagtcctacgggacttggaggcccgagtgatggatcatatatattcgtgaggggtgtgaccggcggaggcattacatcacgtgagaaaccctagccgtcacttccctccccgagcaaaaccctagccgcgcgcgggcactagcaaatctgcgcgtggcgttccgtccctgtacgtgtggataccggtagaggcgccgctggtttgcggtgctgatcagcgtgggagtacggcgaggagaacgcacgaggaggagaaggtcgagccggtgcgatcgactacttctacatcgacgcgcgctacttcgcgagagttccttcgacttctcagcgtcttcttccactgcgcagtgcgtcgagtggtaacgatttatgatctaatacttgcatggttcctggtttacgcgatagaaaattttgatttatgtctatcatagcctacgcgtatcccaacaggcataagtaattgaacttttgtgggattttttctttgtaaacatacttgtcttatatgtataggttattttttcccatgttgcttaattaattgcctggttttccaataacattacggttgtgttcgacactttattttcctatttgtccaacctctacccccttatttttcttgcgcacatttactgaactgctaaatgacactctttttttgcaaaagagtttctatagcaacttattttaaaaagtcatattatatctattttttaattttattttaactaacactcaattaatcatgcactaacagatcaccctgttttgtgtgcagggaagtggagctcctaacctccacctccaaacacagtttaggagtatctagctacattgttctcgaaagagttcctctttgtttatctatttggtgttgcgtcctccaactatgtcacttctttaccgattacctatatttcctcatccaccaaccaccctattttgggtgtctctcccctccgtcgccgttgctcctgcttcatatcccctgatggcattcccctatccactgtaaccactagatagttatgaaaattcttttaataattaatacatatagaaacctaataataaatgcaactgcaaataagactctacttttcataatcaaatgtgatgttttttccttttatttgtagataaaatttgatagttcaggtttgtgtagaacatttaacacacttatcgatttatctacagtaattattttttatgtttttttattaattatttatactgaatacaagaaacatccttgatggcttaaaatagtttcccaactttttatactacttgcactattattgctcgctagagaaaagtgctccggcataaaatgcgctctgtgttggagaatgtataagatcttgatgatgctccagatgtgaaccaagtgcaactaggggctgtttggtttccagggacttattctaagtccctgtcacatcggatgtttggacactaatttgtagtattaaacatacactaattacaaaatacattctataagcttggactaattcgcgagacgaatcttttgagtctaattacgccatgattttgacaatgtgatgctacagtaaacttttgataattatggattaattaggcttaaaaaattcgtctcacggattagctctcatttatgaaattagttttttttattagtccatgtttaatattttaaattagcatccaaacatccgatatgacatgggctaaaatgttttagccccatgtaaacactcctaggtcgctgttgacgatcagacgggactaaaaagcagaaaagcaaccttcactaaaaacaacttccaagaaaagcccatgttagccctcatctatccttttgggttctgctttgcacttatggtacttgacctcaggtcacatcatatattatgcatctaaatttggttgcaatttatgggcatgcatatatattgcaagcatgtcgtgtctactgaacctcgtgattgattgaataagacgtttagatttataagactataatacgttatatctatctaaaatcctttatattttaaaatggagggagtggtatagaataataaccagatttggcacatcacctaaaccacgtgatataaggttatataatgatagctggagtttaaaatttatctaagactacaagggtatcttatcaacattttcatctcaacaaacttatttttcatttattctttttaccggagtacttatctatgtaacaaccatctctgacctcaatcttaagctctttgaaaaaaaaaaatcaaatattgttatatttttggatgaaggagtacgggtattcacctcctctctctccatttacaaatattgtgcactatttgacttctactttttttttactttgaccatcaatatatttttgactggttagactaccattagttttaactattaatacatactatagagtgtatgtatgtcttctttattttcacttttttaaatagttatatatatgtatgaaagacagcgtagatgattatatcttcatacatccatttactgacaagtatctaaacatgctgaaacaaatataacaaacatagcaaaaataagcaatcacgttcatacttgggattaccattttgtttgttaaaaaaaatcaaatttgatcttgcatatatattttatcgagtgatatgtgacacaacaacaatctacgttatgtaatgtttttagaatttattagaacctttttggccatactcaattaaccacgtcacatacaactctattcaatcttttcaattacttcatcgtattatataatcttcgcaggcaggagggagatccgcctgcatcacaacgactgcgacaatcgcaacggcccgcctgcgaaaatgcaaaaaaacgaacaaaaaaaatcgccgcacgcggctcaccgccgccgtcctcccccggccggatctgagaggggaggggagctgccgccatcgtcatcgtcgccgccgccatgctccatgccgtcatcgccccgcgcgtcgtcttcaccgccgccccgcgctttcgtcgccgccgccgctcccgccggcctcccccctccctcctccggccaaatctacgagggagggagggaggggagacgccgccggccgccccgcgccggcggtggaggaggagttggagaggtcaagctggcggagggtggcgtcctggaggtagaagcgagggtgggtggggcagaggacgaggtagacgatgagcgcgatgatgccgacgaggatggcgaggacgacgaggatgccccgcgccgtcgcccccgccggcctcccccctccctcttccggccagatctgggagggagatgggaggggagccgccgcngtcgccccccaccggcctccccctccctcctccggccagatctgagagggaagggggaggggagccgccgccgccgccgctccacgccattgccgccaccgccggcctcccccttccctcctccggccagatctaggaggaaggggggaggggaaccgctgccgccgcccggacttcggccgcacctccttgccgctgctgccctccgccgtcaccgcccgccgccgccgccggaagccgccgccggggagagtagaagtaaggggaggggaggggaggggaggggagaggccggtgaggaagggaggagaggtgtggagcgactcggaggtgtgaggacttagaaaaaaattagggcccgcaaatctatttatattaaagtctatttttgcatgtggatcacttaagcggcgcctgcgaaaatgattttcacaggcgccgcttaagtggtccgcctgcgaaaaaaatctattttggcaagcgggcatcaaatttcaccccgatttatatttttgtaggcggtcattttgctctaagggtcatgtctgcctgcgaaaataaataaggtcctcacgttgggaaaatgctttttctagtagtgatattgccctgaattatttaatgtatatctccaaatatatgttttatagaaaaaaaatattctcatgcattgcatagaccacttgttgtaagctattttaagtttgtatattaaaatatttaaccaatccctataattaaatagattatctactataataatttagtcgtcaaatatctgtttcaaacttgcctgatcaatttatgaattacggattatcatgggcacattttctaaacttataaatagtatatatatgatttaaaaaatcttcatcggcatttattagaattttcaaatcaatttgtaatatttaattcagtcgtttgtgccctcaaataattaattatcataaactcagtatcataaatcatcaatcatctataaagaacaggcccttgcgtccatcgcataattgcaagtatatatacttcaaagttgccattttgaaagcatatgcaaattctagtaaacatccaacacaaattcaatctacattcacatgtcgttggcaaccctcggaggctcgtgtatatgaagcatatattcccagctgaaaaatcaagccaataagcaccgtgcatgtacatatatatgcagacagcaatacatggaatggaattaataatatgcatggtgtcctcctctgagcacaagagcgcaatgatgcagggacggaaccctacgtagctacgtgtgccgagtacacgccaagtgcgcgcgcggctgggtgcagtggcagctagcactacgcagggcgctcggcgatcctgcggcgccgcccgtgccccataagcacaccaccttgttgccatcgacggacagaatctctcttgcatcttgcttgttagaaagtgggaaatgatggagatgagatggaatcgtggcttcagaaaagctaaggagcaagggcttccaggctgatcgatcgatcgatctctattactccctccatttctcgttacaagatgttttaactttggtcaaagttaaactgctttaaattaacgaagtgtatataaaaaaatagtaatatattttcgatccaagataagtttattataaaaatatatttaattattaatttaataaaactgatttgtaatgtaaatattattatatttttctatatatttagttaaatttgaagcagtttgactttgaccaaagtcaaacacatcttataacttaaaacggagggagtagctgataccattggcgcgacagctcaaggctgggccggtgcaagaatatgccttgtctggaatatatgttttcatgagtctcagatgagagacagcgcagacatgcaactggggttagggcataaggtctcggagcccccttttggtgttggacaagatgagaaatgcatctccttcctctgactagctatgctatgagagtgagagggtactttgattgcatgtaggatcgatcgacatcataaaaccaggggttgaacggtatcactgcatatatgctctagtggcctgatttgtggtggtggagtggtcccttgggatcaatacatattggtacagaatgatgacgatataattgaaagcaccatgcatatatgtatgaaaatatcggcattaagaacctgtttggtatagtttcaactctatatatatcctgtagagagacttcatcgtccaaacagtttcagctcctagctgatactgaaatggtgtatgtgggattcatctagaaaggtgatatatatactgaaacatgcattagataatgtttggtattgttgacttaccatatggatttccattggtacccactgaaagtacacattagttaacgcaaaattgagagtaagaaggctataatgtgaaaacaatagaacagaaaatctaccagagcatagattattgcaaatgttgtttgttacaattgacacttacaaaataacatgacaacaattgccaaaatgaaaaaaaaaggaaatgaaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 43585 - DNA, 9749 bp, Oryza sativa
  unsure (1)..(9749): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnngttacttttttgaaaaaaaaaaaagagagagcacgattaagtcgtttttaacctttagcaatctgaattacattcaaaatagcttaaaccaataatagagttcagatggaaaaaacttgggatattgatttgtttataaattttgagtgcgagcgccccttgtgtgagagatcaattttatttatttctttctttttttgtaaattgagtttctggcgacaaactaagaaactaccttgttgcgataacatatcattttccggacatgttttaagttaaaccttacaaaccttgagcataaatatctttttaaatgcttatgttggatgtatgaaaatcgtatgtttaaaatcgccttgaaaataactttaataatactatacttgtattgctttttatttttctttttggcagaaattagtggtcagccgcattttaaagaacatgtctatgttcaaaattcttgtcacccgcagggaggagcacgtttttttgcatgcgacctttgctttgcttcattgacctgctttctaacccgtcatgcccaaatgcagaaaagaaaccgtcccagcaaagtcagagggttacttgataagcacagttttctcgaaatccaggaagaatcaacattctttcatcataatagaatgcttcgtttcctattaggcccaaaaaccaagtgcacccaataattcttcaatgactaaagcggcattattttttcatgaaagcaataagatatctttccataattgcaagtatcatcaaatttgtcattacgagctttaggattcagttgttggtctgtgtaatcactaatcacctcaaagagataagaaaatgggaggagcaagcaagcacaacaagaaaggcagcaggcattatgccgtgtccttattactctattatagagatatatagtactgggtgctaatgccatccaattcactaacctcttgttttctcctaatggtgtccacgattttttcgttggccatctttttctcggggccatctatatggctcatcataggggaaaagctgaagtcctaaccaatagtcccaaaatgcagctgctggaaaagtaatgcatggagatagaaatggtcaagcactcagtatgaataaaatgtattgaaatgataagctaaagaacaaatccgctattcatctaagctatcatgttatgaagttatttgctcgtatctgttgactattgctagatacagttccaagtctagatttgccggtccacttcttagtcctatcttactcagaaaattgaatccaaaacattcctcggtttaaatcttcaccagggtatctgatccaacaaacacaaagcttctcagaaactttaaacaaagtagaacatatatatttttttaaagtgctctcaggaccgattgcatcgtagataaatattcaatgaaaacctcatattaaagagatatatagggtaaaatttaactggtattgtggtactaactgaataaacactataactataattaatactaaggttatgttatgaatatgtaattttcatacaacagtgttttagatttcaagataatcttgggctgaactgggagtttgatcaaatgctgaaacattatagctcatatgctaagctattcatttctcaggtggtgattcatgatgcaggttactatggaatatcattaggaagggggcaaacgattcctaacatttattcaaggtatatcaccagcctgttgaatatatagcttacagtctaagcaacagcctacaatagttttgtacgttcagttcaacaccataagaacagatgggtacataagtataacatgatgtctccatgcattcgtaacaattagagcagtggataggaacaacactggttgatctaatatgtaaaatcccattgattttgagtcacgatctggtagttgtcatgaactactcaacagatcagaaaaggacctgtggccagtaatcatcacatagaaaagcctccaccatgtctgcataccattatcagaaaagggatgcccattctagcatttttcttcattttttcttgattccgaatataaaacgagttcgcaaggctgaattgtatacatccaatttggtccttggcatgaactacaataagttctctttagagaaggcaaagaagtttaatggtgtttccaatgtttagtacttgattacatagaacttacaaagcaacacatttgaactacaatggtgactcaagactgcagaagtggttatcacttatcagaagttcaggactgggtcactgacagtatcaatcttgccccacagtcaacaaaattgattaaaattttcagaccataagtggagcgtatcatggatgtgcaaaaagacatcctggaaaaagcatagaccggaacacaatttcttcgtaatattttttttagtgtttatgctggtgaagaaactcacagggccttatattggataactcatgtgaaaccataagataattaagtgtttaactgagggttcatagtgcaagcaattgaactttgcttagtcaatttaattttcatcaatgcaattggctacatattaaatcaaatttctgcattaatagttgacatgaaggggaaaaagtagcaactcaaacacctacttgccttgtgataaccttgaaaacttccagtggttaggcagaagaagattaaattcattacagctaagtggagttacttggacagttgggctgcactaaataggatgcccatacttcatcagctggagggggtggctgaacccagtgcccaggtattcggctgcaggcaggtgagacaattgcattgttaaataagagaatgctacatagaattcgtttcacatggtaaagcactacaatcgagagcacaatgtactaaatcctatcatcagagcacttcaataaaataacatgaatgctaccataagttattagtagatggcttgaaagaaccacaggacattcagcactataatgctatcccagtactgaaattacaagaaagcgttccagagtactatacaagtagcccaacaaacttcgaatgtatccaacaaccatcattctgtttactaaaagagattgcactttcctatggcataaacctcatatataacccaaatcaatagaacattatatattctcatgagttctttttttctcatcttggtattagttcttcagagaatcagcaaaatatatttccattgttttttgttgtatggcaaagatgcttgttgagcgaatttagtttgcatattatatttagcagagtgaaagtcataccttcctccagctctaataaaggaatcccacatcctgcggacctgcaatcaaaggtggaatacatacatgatggctgagtgaatctattgagtaattcccaatcaaaaaacatattgagtaattgcacatttgcattgatatgagaccatcgataggatcatcctaaaacattcacttggtagaaatcacattaactgattaacacataaagcattcgcaaaactcccagatgagccaattatggtattcaatggaagtgtgaaacccgccatgccatatctatgactctgatagattgatatgtaaagcctagttcagaattttggctgtgatagactgatagtgcaaagcctagttcaaatttacactgtattattcttatacactccacaaaaccttaatggtagcatgaagttgaaaagccagcataagttacctcaatgagtgttcccatgtcgtagctgcttccatgataataatggtagaactcaaaaggcagactggaaacagaatcataatgcccatgccctttgctgtcatctttatgaagttcatgctctgttttttggcttgcatgatgatttctgccgcttattcctggatctctctggttttgttccagtgttggtgcacttttggcttgatcagaatggggtttttttttatcttaacactgcacagcccttctcgacccttgcgcggccagaatagcatccttggcagcatcagctgtagcagcactagcagcttggcgctcctcttcctcaactgcagaccctaacacgctcaagatattcatcatcttcttctggcagcaaatgacctgaaatatattacatggtaactcatgcatcagttaccatgtgtttaggttgatcaactgtactaaaacaggggaaaaaaataactattaacaaggaaaaggcaaagtttgcaggtgattttaggccctgtttgattcagcttaggattattataatctagcttattaggagtaagctgaaacaaacaagtagataattatagcagattattataatctataagccagattattataatctgataagctgctctagaggagcttttttcagattattgagtggctaaagacccactacccctacatacttgagaaaaattactcacctatgccatcaaccgaacagatagctgagggcattatagactttagcctttcaaacccaataatccatgccttcaataatccagacaaacaaacaactcacagcttattctatgccagcttattataatccagcttatagtaatctggcttaataatctagattataataatcataagctgaaacaaacagggccttagtgtgttcgcgcgagcctaccataattttatagcaaatatttttgtgaagttttcagacaccacccatttggacaacagattggcaagaaatgcattagatatgacagagaagaatgggaatgccaaaatttggcaatcatttaaacaagggacaaattcttgaagcattacaatgtgattgacccattacagtaagattgacccccatgtattaaccatttcccacattttgcacctctttagatatgactataggtttgacggactcatatattgaaataaataaaaagaaggaaattcttaaaaataatgggtagatgaatatatcctgccttgtttcttcattttttgaactctcatagagcgaagtttctttttagtttctcgaccattagggcaagctcaagctgaaaatagaagatttgtattgagaaaattagttttctagaaaacaagactattgtatttgccgctcttgaatttacaatttctacagagaatattaatagtttggaatctaaatataacatactgaaataaccactcaagaattcacaaactgattgcacaataattctgaatgaaagaaaacaggtaggtaggtggtgtaattgaagatgttgggttgcagcatatcaaacacaaatatacaagactttaagaaattttagaagcaagcttatagagtttcctaaattcgtagaaaatcagataaggtcaaagataaaaaatggtgtaacttaatgcttactacaacttaacaaaattcataactcaaggtatcacaatgtatagtaattcagcagtgtatgaaaatgaattaatgaaacatagcgctcacaatttccacgcagatgtccacagacaagcaggatttccacaccacaatgtaagcattaactttacctcagattctagacgctttctttcctcatttgcttttttcttggcaatctgcttcatgttttccacctgatttcacagtatcaatgaattgatcatctgtggagcaacagtgtatcttacccaaaacaaccccactaacaaaatgacaaattcaaaaatgagaaagaaccttgcgctgcgccatgtccttggctatttgcctagccctccattcatcagcttcctgatcaattctgtcataatctgcatgctcctgtgaaacatcaagacaattgatgtcattatggtcagttgtcactttgatttgatcacaatataaacagaaaaacgtattgatgagcgcaccttctggaaaagctctgcaacatgctttctttttctctttctccatcgcttatttctcttggatttctgcagcttctgagctaacctaatcattgcatacctctcttcccaaggacccccttggttcacagcaggataaataggtgcaagaaggttctgaatctgagaacaaagataattagcagcatctgtggccagagactcatgagtgtcttgactaatcttcatagctctagcaagctcaacgaaatgccggggcctatctgcagaagaaccatcaggctctgatgacaattttgctgaagacgagtcaggtccttgcgtgctagcatcgaccgagtttctagcctgcgcaatttcctcgagctcatttatcctgccaattcaattccattttcagtccacaaaaaaaaaaggtctaataaattagcaataaaggaaatgccttcggttttgagacaaagttgcatgattatcgctagctttaggcggttcaggaactcacactgcagtggctaattcgatggtttcctgcagcctccccacatgctcccgcacattgtcccgctgccaaaaggatgtagcggccggcggctggaaaggcggctgccactgccatggctgatgctgctgctgctgcggcggcggcggcgggggtgcgaccccgaaagcacccggtggtcggaacatggcgggcagcttccctcaaaatcccctcccttaggtcagttcaccacgctgcagttgaggcgaggaacgggcggaatcaggctcaggggaaatcgagtcttaccagggggagaccgggggaggacgaagaaggtgacccctgcgacggaaggcggcggccctcgcctccgccgccgatcgcctcgacggtgggctcggttgcggcgggcgtttcgcggcgctccgccggagcggagggagaggggaggaggaggaggaagccgcgggctcgctcggtggagtccaggaaacgaaacgcacggcccagtggcccacgtacgtttcgcctcctccccttggtgggccgcaagaagaaggcccgtgccgcgaggacgcgtgccgccgggtgagagatatttttctttctgcgtctcgctcgcgtcccgaggcgtgtgcatgcgtgccacgtatcctctccgagccagtggcgcgctgccacgtcgcgctaggttgtcatcgtccaaagcacagaaaaaaatatttatcttttatagcttggttttgaagcacatgaactaatgaaggactggcggttactagagcgttcttcttctttctcaattctgcatctgaggctttgggcattttatccagcgatgagtctcgtcaccgcgtgctccggcgagagaggacgtgtggcaaacgagagagatgaaagaaaaaatccactttatgtttgtgtttagtttacactgatatttgaaagtttggaaatatgattgaaattggaatgatgtgctgaaaagttgtgtatgaaagatttgatggatggaaagttaaaaatttaggaaaaaactttgaaactaaacagggctttcgatgcgaccaccgaagacacctgagagagcgcgtactcgctcccggagtcccgacccgacgtgccgggtggcggcttcacccgcagctgaagtccgcggcctctgtctctgtgcaacccaacggcagttaacccgtgcgcccagcgcatggagcgcgcgacattgggatcaggtgcattctcaactacagctgctcctaagagcacccacaatggtaaagtaaggtgctatctataaaacatgtacatctcagcaatagactagattaatagtaaaccacttcaatggtatgtctacatgggtatctatagctctctaatctattgcctcgtttttctctatagactatctccaggttagtagatagctttcctctccctcttcatttaatctcttccaagtaggaaaatatgctgacatggatttcttgtagagagcctataaataactattgcgggtgccctaacgcgacattgggatcgggctctcgttaggagcttacacaagatcttgttcattcaatttttcaatggaaggtctaaattaatgctacagtaacattgttataataattttgtgctgttttgttataataattaatggatagccataatatgactgtctaagttgcagtccaggctaagaactgtacaggaaccggtgtagatttttgcggcgagatgcgttgcacggggacaccgggcggggcggtaagtagtacagcaagttgggggatgccaatgattcaaaacagtttgatcatatctcaagcggaggtgcgttggatcatatcggtgcatctgcatggggcatgggtatgggcatggccatgttcaggtcgccccggccggtaaaatccggggattggtgattccaccgcaggagaggaaggttaataatatagcacactgttagctccaatttatctatagtcaatctaatagctaatttatacaatagttgcttactatgctattagtatacggtcccacctatcatacatatattgtgtcttagagtccatgctacagctagctacaaatctgtagctcgctgctcttctttctcatcttttatctcattaaaataatccctccatactcgtaaaggaagtcgtttaggacagcgacacagtctccaaaacacaactttgacttcttatttctataaaaaaatatttattgaaaagtgatatatgtatacttttatgaaagtatttttcaagacaaatctatatatatataatttttatattttcaaactcaataacttgagagttattcatgatttatattaccaaggtttgacttaaacattatcctagacgacttcctttatgagtatggagggagtataaattcaaacatagatatatccagatttacaataggcctaatttgtctagtaccatcacaaaaatcacggagttgaaaaatactatagtatgtgtcattgacatgtgggttcggccccatatgtcattctcacatacgatggtattttctaaatttttcctttactttacaataatatgatgtatcgaattcagtatcctctctgtttcaaaataaattctctaactcacaatataagaatccagggcatctcctggagctagagctcaaccaaacagtttcagttctactataaatgtgaatggagctaggtggagctctctcaccaaaatgaactagagaggtggagctgggtttaggcagctccacaactccactccagacccaactcctggagctaaatttaggagttggagcctaccaaacaggccctaagagcaagtttaatagtatagcctactactgactccaaatcatctatagccaatgtagtaaccaattcataccatagttgcttactatactattaatatatggtcccacctgtcatacacatattacgtcttggagtccgtgctacagctggctataaatttatagcccgctgctcttctcttttactttatctctttaaaatatgtttatagctggcttgtagtctactattgtatcggctctgggaatatcccaacatccatgtgagagacagaaaacaggggaaggaaccatcacgcaattacagagaaacttgtggccccatacgcaaaacctccccccggtttggacagcgccacagtgcgccacctctccccgtgaaatagcccacgtatgcgccccgcgtggtcgccc

SEQ ID NO: 43586 - DNA, 18747 bp, Oryza sativa
  unsure (1)..(18747): unsure at all n locations
aacgccgcggcggggaggggatggaggggaagcacgtggtgatgtcggcggtggggatcgggataggcgtcggggtggggctggggctggcgtccgcgccgtgggcaggcggcggcgggcagggggcgagggtcggggttacggtggagagggtggagcaggagctccgccgcctcgtcgtcgacggcgccgacagcagggtcaccttcgacgggttcccctactacctcaggtgattaacatcaacaacgtcttttttttcctcccgttcatcgagctatgcaactgttccgtcaccttgcatcgtcagatttttttttttaggattttttcccctttgttctgtcctgtataggggatatgtttttccctccgttcttatgatcttatcatgcacaaataattctgagtctgtgatatgcaagcaacagatttacagatgaactgtgtagtttggcaaattagaaaaagagagagagagagagagagaaatgttttgaaaggtttcaacaatcttttggctcggagatcacaaaatgaacgctctgattgaagacagtggcactgctatatttctgtagattagcttgttcataattttgcgtgggaggcgaagagagacaaccctgcttttctgaaatgttcctctttgtgattgaaaaatggcagccttgaaaggtagtgctggtagaattggttaaagaaaaaaaatgaggggacgatagaacacatacagaacaacatcgatgagacgtcaaacgtctgtttgttcactttcaagatcaaaatattagctggaattcaattttaatgatcacccagcaggacaaggaagatgctagatgaacgatagatttctagctctgttctcttttttaatgtacacgttcatttccttttccaccctccatgtcatcatcctttgtttctctttttccccaaactatgatttgcagcgagcaaacgcgtgtattgctgacaagcgcggcgtatgttcacttgaagcaagcagacatctcacaatacaccaggaatcttgcaccagctagccgtgcgattctattgtcaggccctgcaggtaaatcatattccattgcacaggttaaggagttgctgaatcactcttcttctggccctgactaagttaaggctaattaagttcctatcttgaagaactttaccagcaaatgcttgccaaagcgcttgcccactattttgaagcaaaattgctgttgctagatcctacagattttctcataaaggtgagtttggctggcacagatttcctttcatgtacatttttaagtatgtttgtgatacagacttttcttcctcacagatccatagcaaatatggtggtggtagcagcacagactcggtaagaactcaacacgctttgtcgtatttgttgtaaggtcaccattcttctgatttccgaaccttggagaatataaatgtgtgtgtcctgttttgcttattcttgacattgtagtgcttttttttccctacattgttgcgaaatttagaatttttatcaactgcccaagtagtggccagtttaaattaactattaacttgtgagcactttctccttatcagtctttcaaaagatccatatctgagacgacccttgaaaaggtgtctggattacttggatctctttcgattctaccacaaaaggagaaacccaaaggtgacatgatcgacttcacaataagaaatgttcaactgttccttattctgaagtagggcagaataattatgtttgcttgtcagtagtctgcttcagttcttgcatggaatttttgcaactctgctcagtcattagcagacgacatgaacttttctggtttcatttctattagaacaaactagatggaacatgtattttcatgtgaaattcacacttttgcacaccacagttgagatcttgaatacaaccatgttgctgtcattctcagttatctgaaacaaaaatgtctagcgattcccactgtatatgctgttatttatatggatgaaaggcatcggtattcaaacagagtttcagaaaactacaattcctgctgaactgagagaatgaataagtacacttactgccagcaaagcgcaaaacaactgttcttgacttcacataatttagcctcaatttggtctgaaattctgatgctgtgaacgaatgtaatagtgcttaccttaaaaaaaattgaatttgcttgcatttgcagaatgtagagcataacttaattgtatttcgttctacctcagaagttttgcagctgaatgaccatagagaataactgaattatgtatttcattctacctcaggaagttttgcagctgtatatttgttatcttagtttggtttattttttatcacaggaactattcgtagacaaagcagcatgacggacatgaaattaaggtactggaaaattgtgcttctgtgaacctgttacagaaactgcaaatcattggctgctgttgatatgctttctttatgtattttgcaggagctctgaaagtacgagcagcttcccgaagcttaaaaggaatgcctcaacttcatctgatatgagtagtctggcatcacaaggccctccaaataatccaggtcatattaaaatctcttgcacacaaaatttgtcctgaggcttctggtattttgcacctatatctgtttctcatgagtcatgttgtatttggttaaacactgcagcttctctcagacgtgctagcagctggacttttgatgagaagattttggtgcaagcagtatacaaggtactgcattcagtatctaagaagaacccaattgttctctacataagagatgttgagaagtttcttcacaagtccaaaaaaatgtatgtcatgtttgaaaaactactgaataaacttgaagggccagtgctagtccttggctcaagaattgtggatatggactttgatgaagagttggatgaaagactaactgctttatttccatacaacatcgaaatcaagccaccagaaaatgagaaccaccttgtgagctggaactcccaattagaagaagatatgaagatgattcagttccaggataaccggaaccatattacggaagtccttgccgaaaacgaccttgagtgtgatgatttaggctcgatatgcctatctgatactatggttctaggtaggtacattgaggagattgtggtttcagcagtttcttatcacctgatgaataagaaagatccggagtaccgaaacggaaaattacttctatctgcaaagaggtacttagcatttttgtatagttgtctgttggtttcttcatctcttctccgctttatgactctctcatgacacagcttgtcccatgcactggaaatttttcaagagaacaagatgtatgataaggatagcatgaagttggaagcaaagcgtgatgcttcaaaggtttgttttatttctactgcttttggattaacttcatacgcttcaggaaattccgaatattctgttgatttgtagttattcatgtttttttttaacgaaccgttattcatgtattatgcctcacatacaggtggctgacaggggaattgctccatttgctgcaaaatcagaaacaaaacctgcaactttgctaccaccagtacctcctacagctgctgctgcccctcctgttgagagcaaagcagaaccagagaaattcgagaagaaggataatccatctccagctgcaaaagcacctgtaagagcattaattaaaagtctaaaagcacacgtgcaccagcaaaactattacagaaccgttggttattatggaagtgtcgttctgttgaatgctgtgcagagtaaagcgtagttccttgaaatcaattattgaaaggtttttttatgactttgatatatcatacgtagttcttaaaaaatatcttgtgtcgttttatgttactttcacaagccccatgaatctaattttgataatgtgtaattgcatccttttcgtgtattcaggaaatgccgccagacaatgagtttgaaaagcgcatcagacctgaagtgatacctgctaatgaaatcggtgtcacatttgatgatatcggtgcattaagtgatatcaaagaatcccttcaagaacttgtcatgctccctctcagaagaccagatctcttcaaagggggtcttcttaaaccttgcagaggtatattactttttggtcctcctggaactggcaagacgatgctagccaaggctattgcaaatgaagctcaagcgagtttcataaatgtttcaatgtcgactatcacatcgaaatggtttggtgaagatgaaaagaatgttagagcattgttcacattagctgccaaagtatcaccgacgatcatttttgtcgatgaggtcgacagcatgcttggtcagcggaacagagctggagagcacgaggcaatgagaaagataaaaaatgagttcatgacacactgggatggcctcttgtcaagaccagatcaaaaaattcttgtccttgctgcgaccaaccgaccctttgatcttgatgaagctatcattcgaaggtttgagcgcaggtttgcatctcttccttgctagatgctagttctctcatctgtatctaaacttttttttagcccctttcgattgttccaagttccatgcctgagtgtattgccttgcttctttaggatcatggtcggcctgccatcattggaaagtcgggaattgattttgaggagccttctgtcgaaggagaaagttgatggcgggctagactataaggaactagccaccatgactgaaggatatagtggcagtgatctaaaggtcagtatcataagacatgaatctatgtcaacccaaagaactctttggttaactcagtagtctgctgtgtgacagaacctgtgcacaacagcagcgtatcgtccagtgagggaactgatccaaaaggaaagaaagaaggaactggtaatctagtcactgcgatacttaagcattcactggagacaattttgtgaaattttatactaaaagtaaaatatatatgcctaatatcttcaggagaagaagcgggaacaaggaggcaatgcttcagatgcttcgaagatgaaagagaaggacgagacgatcatactaaggccactaaacatgaaagatttgaaagaagcaaaaaaccaggtgaatcttttgttacagttgaatttagaattctgaaacatgcacagaacgtaattcttgctaatataaaactgaaaaactgttagcattatacttgcttgttaacaatttgtggaaactttgaaatgcaggtggcggcaagctttgctgctgaaggaacaataatgggtgagctgaagcaatggaatgagttgtacggtgaaggaggctccagaaagaaacaacagttgacatactttctctgaactatctaaatatccagagtgtatgaacataatttgaaaactagaatagacggaaaacaccatgtgaaaatagtccagtgttttaagttccaccagttaagaatgtttgggaccaaaggagcctggttatgaaaccggtttttttttgttgtaaaacttgatagagaacttccatacacagggattatgtttgncctgcctcggtttgttgtgcttcagaataatgaatccggagcggacgtttgttttcttttgtctctttttttattccaatccctgtgctctttttgcatactcctccgtgccaaaatacccaaaaataagaaagtatggcatgacaaagtgtggctggcaccagccaaacatgccattacgccacgagttccagcgatgccggctagctgcactgctgcagcaagaatctaagcgcatcgcacgaaccatgacgcggaagaatcatcttttgagagcgaaagtgtagcttgttatattagccagattgagagtttaatgcaatcaaatggcttatgaggaagcaaaaaagcaaaggtagaccggtagtgctgcccatgatgagaccatggttactcaacacattggcatgtgagaaagctgtggcagctcatagattagcctggaagaagagcaaaagtgaacatcagaagcccaagtgttacctttgctttcaaggatcaaggactcaaggagtcgaagggaccaagtttggttccttataagcctttacaaagcagcatcagatgatgtttcaatattaaaacttcattatggatagaaaatgatgctgcattccccaaatgactcgtcgagtgacgcaacaccacaaatttttccaagtcctaaagccaaagtttggaatagcttcaaaatttcggtatatgtccaagattatgtgcatcttcaaactgaaaaaataaatgtgcacatcgcaggctgaatctttaatagcgcaatcataacaagatttttcaccaacgtcaacaacaaaaatgacgggtagatgacatctagtctcaacattggttcataaatatcaccaaattccaaaatgcagcaatcttagtaacaaaacaatatcgcataaacaatatgcatgcgacatcttacagatcaaaaatcaaacagcgatggagcaaagcatgcgctgcagctgcatactgtcgtagcgcaagctactcagctactcccatcaagatcagacaacaaaagagccatacacaacacaaggcaataggtgacagcagtgcatctcaagaaccacaacccaaccactactatcacctgccacgaggcactgcatcacctcttcctagtgcttcttgtctttcaaggggccccttggtactttactcaggaccttagcatcgagcacagcatactgtttcttaatctcaacccaccccttctcaccatatgagtcaatctgatcttcatacttctcatacagaattgggactgtgtgcagcaccacaaacactgtttggcataagaagcaaaagatctaacattagtcaaatctatagtttgaagaggtaataaagaataattctgtccaaagtagcccaaaccacttaccaatataaaccaaggtcaagaagttgcagcagcttccaagaacagaaagcaaccaaaggccagcaatcacctaaaagtgtggtatagatcataaatattcagtttgctatgggaacaataattatacaaacacaaaagcatcacagacatacaataaggaacttcttgatgtcccggccaagagcaatctgacgaagattggcaaaggccctgttgatctcataacgtgtagatagagcaatgttgacaaccaaatcttctggaataatcacctctgggatccgcgggggagacctgaaagaaagggcacagtttagagaccttttatgtaattatctacctgtggaacatgattatgctttgccaaaacttgaacaagttgtgatagagatgaaaaacaatcttacttgttaataaatgatgaggcattagaccagagaaagagaagacccaaagagaatatgagcccatggcaaacgaaagtcaggaggtggtagccaagcaattcaaaaaggatccagatcgcagtggcaccgcctagtacaccggcagagatgttcctgttcctccataggaacacatcagcggctgcaaatagagaactgaaatcaatatggcaggatgaacaatggataatcaggctatataacatgagcacataatggaaatttcacctcaaccacaaaatatgaccacccctatggagagagcaaaggtgtttgttttgaaggcaggacagcagaagactaacaatcccagacaaatatagcaataatcaacagcatatgtggcttatagtaatcctttgtagctattgataaggattcaccagaatgaggtacatcctcattcaatatgattgtgttagctacggcttaactgtgtgacgaggcggagtacactattgctaatcactaaccttcaaacacatactgtttacaaacagttcaattcttgctcattgtcactctaaagggaccagtactagcacaccagcagacaataatgtgacagaccaaccaaggaaatcatgaattcaattattccattactttttacatgtcaatcaaaaccccgcttcacatggatcctgacacatacaagcatatctttttctctttgccacaatcgcttatgattcatcaaagctaaacatgtccactacttactcaaaaagatacggataaaatgaaatcacatagatcagattgtatacgagtatacgagacgcacgcaacctgcattgccgaaatttgaattaactagcacagcgaggatcacattagttgttccgatttgtcaaagatatctaaactcatccccaaatacccacagatctgaatagatggtcacacatagcaaaaggctaaaaccctactcccattggccaagtgctaatctaccagatctagcccgaaacccaacactcccaatcaatccagatccagcccatccccacccgctctaacaaattcaaaccaaatcagctttgaaacagagagagagagagatcatcagcagagagagagcagccatacgtttgcctccaccgaggaccttgtggatgggctcctcgcgcccgaagaggcggaacaccttggccttggcctcggccgcggcagcagcagccgaatcaacaaacgactccgttgcgacctcggccggggccggcggcgccgagggcttcggctgcttgcgctcgtcagcgtcggagtcggacgacgacccgtccccaccgatgtggagcttgtcggcgatcttctccatcagcgtctcgccgccgccctccgccgccgcgcgcggctgctcctccgccatcgccgcttcgctgctcgatgcgggggggaaagtggaggaggagggagttgaaatgggggagatctgagttgaggagacgtggaacggtgtggaaggggatgggggttttatagtgggggtgggggtttagggcagatgggggaatcgtggacgttggatttggattggacggtggaaagcgatgggggtggacggtggggggcgctttttgcggaggagtggaccacaatacgcatgtcctactggctacgcagggttggaatggggaaatgcttggggtactcgagtgtgtttggaaggagggaaaaaaagataaacacatgattaattaattattaattattttaaattaaaaaatgatttgatttgattttttaagtgatttttcttttttttaaaaaaaagagcaacatttagtactttaggaagcttgagcgtagagattttcctccaaatcagctgacgccgagcggagctgatttgggtttttttttcaggtactcccttctgtcaaatttatttgaggttgattatccgagttcaattttctcgacgtcgactatttttctctatagtgagtataacactatccatccccaaaagaatgtatttttagcaattaacatggacaatagaacctagataatgaatattatccaaattcatagctaaaatagtattttctatctacttgtttgaacctagatacctaattatatcttgtttgaacctagacactattcatagtaaaaaaaacattcttttagggcggagggagtacctttttaaactatgctatcaattatagtagaatgctagtatattgttacaatgttttttcctttttttttaaaaaaaagaacttgtttgaggttataaagttggttaagatcatgttagtgacgatttgggttttccacatgctcccttatctcaaatttgtttaacgttgaaagacattttctcaaaatcaaatatattttctctatattgagtacaactagctccgtctcaaaaaaaaaagctatgaacttgaatgttactcctaaatgagtacttcctccgtcccatatttttagtttcttccatttgtaccaaaataagttcatttttaaagctatcattgcatcaaagtttgtgaaagtacaaaattgatgtattggaagaagataaagtaaggaatacttgtattgagatttgatagtatggatattcttgtctttctggttttgtttggtatgtgtgggttgtgtcaaaagtaaacttattttgggacgaagatagtatcattttggctatgaatttggatagctttttagctataaacctggacatcactattgaggactctagattcacaataaaaagacaatcttttagatatggaggagtatttatttaaactttgctatcgattatagtagaatactagattgtcacaatgaacttctctctttagaacaaaaaaacttgtttgaggttataccatcaaaattgttcagtgacaaaagataatcctgttttaccctaatagttctcggggcgtgaaaattgcattaaaaaacaacagccaccattatggctacaccaatatgagtctaaggttgggttcttatcagctaagagcaggtacaatagcaggctacaagccagctataaacatattttaaaaagataaaaaagagagagaagagcagcggactacaaatttgtagccagctgtagtatggacttcaagatataatgtgtgtatgacaggtgggaccaggtattaatggtatagtaagcaactattgtatgaattggttattacattagctataaatgatttggagctagtagtaggctatactgttaaacttgctctaatgagctgatctactttctcatttatagtgagtacatttctcgaactgttaaacgatatgttttaaaaaaaatatagatatttcctacaaatcaaatgaatataatctgtgaagtttatgatagttaatatttaaataatcattcgctaatcatgtgttttgatttccgtgcactaactagctaagccaacccacactatcggatgcagcattattaatctaactcaaataaacttgccaaactcgatataatataagtggtgtgctaaggagtatgagacgatcattgtttgcagtctactacagtagtgcatgattgtgcgaatatgaccgtgttatgtcaattctcacatcctcgtgctatatgatagcctatttccacaaacaattatattgcaccgtgaatagccatctccactatagtgtcggatgctcctttccacctttctctctctcgctgtgtaatgacaggttatatcaatcttgatctgtgaaacttaatcctgacccgttattttgggtgtataaagtgataaagaaggaaatataattataatgatagtagatggatttatgggtgcgtgctaattaattgaccctataaactgttgggggtaacattatgggtgcatctagcaaagaaaggaggaccgggaggagagtagcgggtgatgtcaaaaagggccccggaatcaacgtggcgggcactaccctaccgctgcggcggacggccagcttttctgctggaccgggccccacgatctgcttgaattcggaatctctgcgtcatttttgatttgtagagtatccggcctactagtatcccaaaatggccgacgtggcatgggcccaccacacgggtacgtacggtgtgtccaaatgtctctgcgtccgcgtggagaatccggacatttttgtgcacacaacttcaaacttatggcctgtttatttcgctaaatgtaattagatatttaaccgaatgtcggaaaggtttttcatacgaatagaaaaactaattttataactctggaaaccacaagataaatcttttagtctaattaatctgtcgttagcatatgtgggttactgtagcacttatggctaatcatggaataattaggctcaaaagattcgtctcgcgatttctctactaattgtgcaattagtttttttaatttatatttaatgctccatgcatatgtctagagattcgatgtgctgtttttttagaaaaaaaaattggggaactaaaccaggccttatccccccctcgatcggtgcattgtgtgatccgattatccgaccaaatgtacagacctatcccctctatcctataaaaaacccaatcctaccaacgaacctagacacatgttcattgctagggttggctttttttttgacagagtagtagtagattgtgacgcactttaatgagttaaatcttttgaaactcgtcgaactacagattcaaattgaagctgatcattttagttttgtttccgccacttctccccggagctactattagatggtgtttgaatctcctgaagatgaatatgaagataaagtgtttcatgcaaaacgaggtggtaattacgtgtgattaattgagttttaattattacaaacttgaaatttgtattaatctgatactttagaacaacttttatatagaaagttttcgcacaaaatgcaccgtttagcagtttgaaaagcatgtcacttttatctaaaagtttatccaacttttgttggagaaaagaatagggccgtagcccatggtgtaccacttccgtttttaaatatatatcgtcgctaatttttatgatgatatttgactatttatcttattaagaaaattataaaaatgctatttgtttttattgtgacttgtgtcgaagtttgatgtcgcgattccggtatttgcatggtatggggatcgttggtactagggtatacgcgagactgaggtaaaagagatagagacgaggatttttatacaggttcgggcccctgaattgtcagctaatagccctacatcctgttggccgaagccggtattgatcttattcaccataatcataccagtacaatatttggggtagcctatctaactgttgtcgacatggcggtctgaaggtctgactcgtagtcgacaacagggtagtcttcctcctcgaatctgtgcccggcgagatcagagatagcgctttcgtttctcttgacagtatccggagacaccgtaggggactagccgtgcttatccctgaagccgatatccggcgtcttgtcttggcgtatgttggcttgtattggctttgtggtgtctatgttgcccgtgtctgttgattgtggtgtcgattgaggtggttgtgtcccctctcctcctagggggcattgtatttatacccataggtatcccctgtccaagtagaattagggaaaccaatatggatacaatctgagtagtacttgtcgtttccatgtagaactctgattgtcttcccttatccggaactccttctatattcgcaggttgtttccgtataggatatggtatgtggtgggtcctgccgagatttagtcaactactattaggtatatggtatccataaccctgacaacttgtattattataaaaaaaactccagccttaacttatattttttttacatatttacaatatatttttgaataagacgaatgatcgaacgttatgtgaaaaatgacatcgtatataaaaaatgaggtagtactattttaaccaaaaaagaaactcccgtcatttcatattataatacactttgatcaaattttttaagttcgatcaagtttatataaaagtaatgatattttcaaaacaaaacaaacatatcaaaatatattcaatgctatgtttaataaaattaacttggtgttgtaaatattgctgttttttaaagaacaattgatctaacttaaagaaacctaaaaaaaaatcaaagtgttatataatatgaaatagagggagaagtactattcatgtggaaaaggaataatcgcattgcaaagaggatgtcgcgtcaatgactcaatgtctatggccttaatactgacgaagcaaaataaggctggtgttacaggttgaatcgctagcaaagggctccttaaggtctcatcccttgcgctatgagttacgaattataagctgttactaaatttaaattttaaaagttaatttttattttttcaatgttgtttttatttaattttaagtcgctcagaatatatatataaaagtttgcctataatatgtaactattgtataaataagttattagattgactgcagataaattgaagccaaatactattaattaaacttgctctgagagagacgtagtccagctagctaaggctgccttttcagctagcgagcgtacctagcttgcttcttgtcacgagaagaaggaacaattgtcttgaatgctacgctgggattatagggtttagggtatagggtttagggtttattcatatttccgtgtcgagaaatcatgaacaaactagcgcgagtgcagactgcagcaagagtagagcatctcgcaaattcggtttgcgtcctgcctttgagttgagaaaaacaaaatgggggctattctgttcaaattaaagcgaaatagataaggaaactgttggtctttgagctcacacgatcacgcacattcacaaccgcaaggcccacgcaagtagcgactttgggccgcgtcttgcctaaccgaccccagcccacgtggacgggccatgatccaaaaggcctggattagacaccagagagctaaactatctcgagctacttgcctactactcttctcatcttcgaacctaataccagtgactatacattctcaagcgtgttttggttgatagtgaaaagagaggaagaagaagatacgtaaaccattaacgtataatcaattaaatataaattattttaaacttaaaaaatgaattaacaaaatacattatttaaccgttcgaaaagtatatatgtacgtgaaaaaacaaggtaaattttctctatttgagcttcactctagcgcagggcaacgttgcatattgccaaaatgccaattaagtcaactaacagtaatattgttgcaacaacagaaacaaagaaaaaaaaagaaaagaaagatactagctactctatttatcccaaaacataagaacctacttcatctatcccaaaaaaacaaaaatctaaaactggaagtggcatatgattcgtagtattaggatatgccatatcctgtactccctccgtcccataatataatggattttgagtttttgcttgtactgtttgatcactcgtcttattcaaaaaatttgtgcaaatataaaaaatgaaaagttacacttaaagtactttggataataaagtaagtcacaaaaaagtatataataattccaaaatttttttaataagacgagtgtccaaaaagtgcaaacaaaaactcaaaatctcttatattatgggacggagggagtattagattggtattttatatgacggatggagtatattggatatgacatgtcatagtactactactgtgaatctggacagtgatatatcttagtaccataaaactgaacagtctctgtttaaattcgtacaactagatttttatattttggtgagaatgaagtactcctaggagaaatgtggaagtgcccccctcacaaatggacggtagtgtctcagattaaaaggactgacatagtaggagtccagaccggtggcgaggccaaattatacgtccaaatttgcattgcacattgcaactactggctctcgctcaaactccaatgttcagcatccattctccaaatgattgacgactgatcaagcctcccaagtcccaactgtgtctcacatctgtagaagtgatactgtatctcaagagtcatcattttcgtgtcaggcttggatgattccatcatggccttccatctccaaagaaacgagtaaatatcattgcgatggtaatactgcagcgttctcttttgtgtcactgtcatcgtttgccaatgactgcatgcttctggttggacgcaatcattcctggtatcatggtttatggaaatgatgggcatggaaatttcagcatatatataagctccctccataaataaataaatataaaactaatgacatattataatacaacgaatctgtatatactcctgaacggagggagtagagtgtagtgtttggttttggtttactggtctctaaccattgtctctggctagaccaagccaaagagatatcgttcgggtgatactctcgtatggtcatatcccaaaataagttagggatcttttgtataacgtaaggttgagaaaacataggagtagggaaaataaactcaaaaaattgacaaaaaaagaaaattaaaaaaaaatgattagttggataaaccatgtgaaaaaaggaggatatataatttacgtaaggttgaaccacatgttatgttttatctgaaactctcatggattgatgtattccataggattttccatttattcaatagtgtccaatctccttcgttccaaatggctaggaaaaaaaaacactataggttcaaaatcccaaaagatcctttattatcgcttactgcaaaagaaaccttaggtagctctatcatgtttgatctaaagatagttttcttaacacggctagcaagatgttgccatcagaaaacatatgcatgactcaaacaacatgatatataatcatcactctaagcaaatataagctatgttccgcgcacccacccgataaaatgttcacgatgcaccttcttccaaatcctctctagctagttatgctaaatcccttcaactttcttggccaaaccccttctgaaataactaagtttagggcccctttgaattggaggattgttataggaattttggaggatttaatttcctaaggaatttttcctatgaaacccttgattcataggaaagtataggaaattttccttaagattgtattcctatagctcaatttcataggaaaataagcaagaggttcaacctcttggaaactatcatttgctttgtttatttcctatggtgctatcaaagggaccctctttatatttcctgtgtttttcattcatgtaggattagtaaaacataccacttcaattcctatattttttctattcctgtgtttttcctatcctgtgtttgaaaggggcccttagttatgcctttattagacataaaacattacagtgttaggctaaccaaacaaggccatttatccttctcaactatcaagtgaccaagatagaaacagaaaatggatacattgcttttctatcaagatgcctgttgtattttgaccagagagatgtacacacaaattaggaagaaaacatgaagtggtccaaaacgaactataggtgtactgtaagcatgcatttgatgaggagggggtacaaaattctaattcaaaacgactctttcaaatacagaggattgctacggtgagaaaggccagcaaaattccaaaaggatcgaaaccgaaaaaccaaaccagtttagctttttagtggacacttgggacactcgtcccaaatgtttcagttactccctcccatatcgtttgaccccgactcgcccatcaccgtcgagtcggcgatgaacggacaggatggcgcgagccgagcacctcactacctcactgacccgctctctcttctctcatctatataggctgagtttgaaaaagggaagatagagaagattgggaagatacgcaaaacgagatgagtaattaatatatgattagttgagtattaattattttaaatttcaaaaatagattaatatgattttttaaaacaacttttctatagaaaatttttacaaagaaacacacccgtttattagttcgggaagagcgcacgttgaaaacggaacaaactatctcacgatctcaccgtttagtccttgatgcaccaccttctccgacctctctctttccaccctcaaaaggctccccaaaagagtccttttctcagtgctgaggcagtaggaggtaggagtaggagctagaaacgagtgaagctcactgcggctagctgctgtcttgtgttgtgttgtgttgtgtggcatggagacgttcaccttcctcaagttcttgcgcggcggcgcggttgccggcaacaagggcggcgccgtggcggccaccaccatagccgcgtcggcgtgcgaggacggcggaggtgggggtgggggtggaggtggaggaggggaggtggatgacgacgcgtcgttctttgacctggagttcgcggtgcccggcgaccagagtgccgcgtcggacgccgcggaggcgagggtcgagttcctcttctctgtcgcgggggatgtcgcgtccggcggctaggtggtgaccgtgnacaacncggtgncggtggcgccgggtggcgagtncgaaaaggcgaaggtggtggagctggtctcgaaggcggcggcaccgccggcgtcgttcctccggccggcgactaagttccgcgtgctgctgctgaagctcaggaagccgaaggtccctgtcccggcggaatgtaacggcggcggcggctccccggcgccgaagacgaaccgtttcttgatcaagttccgagtggacgacgcgcccttcgtctcgctcttcacgcgcgacaacagctctcgcacctccgacgccggcgccggcgccggcgcagccaggccggctgtgcaggcgctgcagactcccgaggcggcggccatcaccgccgaggaacggcggttcgcgaaggagatgctgctcaagtacctgaacaagatcaaaccgctttacgtcaaggtctcccgccgctacggcgagcgcctccgcttcgccagcgccagcgagggcgaggagacggacctggagcccgacccctcgcggtcaccttccccttccccctccccggcgcccacccagcctcctaccgcggcggcggcggcgg

SEQ ID NO: 43587 - DNA, 1975 bp, Oryza sativa
ccccccccccccaccctccctcaaaaaacatccatggtctttctgtcaagtccgtcgcggcacgaggcacaggcggccaccgcggcgcagctcggactttaactgtagtctatgtaataaaaactaatttgcgagacaaattttttaagcctaattaatttataattagagatgtctactttagcatcacataggctaattaggctaattatggattaattaggctcaatagatttgtctcataaattagtctaagattatggattaatttttatccaccgtttatgtttaatatttataattaatgtccaaactagatctaaacaggtctcagcctcggcgtgccgtgccgtcgcgtctgccggtgctcgcgcccgcggggtctctcccgtctctcgcctcggtcgccgcgaaaggcgacagcgccgaggccaccccacccacgaacgtacgcgcgtggatagcgtcggtgccatctcgtcacggcgggcgcgaggcgacgacgccgcgggcggcggtgcgtgacgggtggccggcctctgcccggccggtggcatgggtgcttcggtgcgcgcgcacgtacgcttgcgggttggcgcgacgcgtagctgggcatattgctactactacgactcactagcgtactggagtacactactaccgcccgtgtaaatacagccactgcactgcagcatgggagtgtatgcacacactgtatacgcacatacgtacaacacgggcggtacgtgacagaagctacactacgtaccagcctactacgacgtggcgtcgacacgccccggagttactgcggcctgcgtcggcattgattcgggaagtggatctacggcgccggctgttagagcatgtacaatagtatacttattaaccagctgcaaatatattttaataagataaaagataagagagaaaagcagcggactatagatctgtagccagctgcagcacggactctaagacctaatgtgcgtataacaggtaggactatatattaataatatagtaagcaaatattgtgtaaatttgacggagcgtggagctcctcaccgggagaccgcgcaggcccccctttgccggttcggccgggggcgctaagtgaggttcttcgccctcgatcgatcacaagacacgggcgatgtagacaggttcgggccgctgagaagcgtaataccctactcctgtgttctggtggatatgtgtgtgaaggagttacaaagagccggagagccagagagttcaggctccagaacccctctagcctccttttttctttttttttctctccccttttggtgggcaaggtcctccttttatatctcaaagggataccacatgcaccacttctacctacttttcttttgggtggggacctaccctatcttgaccaaaacttggctcgcgccttcgcctggaagctaaatcacagcttgtccttgagtgaggcccagcgccatcactcgcctgacacaggggataaccctgtcattccttcattaatgggtggagatttgcaatggccgctgtccgaatgaccctccgatgggatgggtcatacctacctccactccgccggaagcagatgcaacgtgggagcacggttgtctgccgatgacgtgaccggcgtcagaccagtcacaagaccgtcattcttgttcaccgcatgttagtataacatgccgcacgtctacccttcttcatacaatgactttcttgccatggttgcgatgaagcctggaatgaatctggccgggactgacataccaactccaggagttagcacaccggctctggctagggacgagtgcctggaggctctcatcattccgacgggacggggcgaggcgtgtgtcaggccgcatgttgccacctaacccgtgatctgaccggtttttgaccggtcacacactgtgacctgtcacggaccgaacgagtgtgctgggctgcattaaatgcg

SEQ ID NO: 43588 - DNA, 7608 bp, Oryza sativa
ccccccccccccccgagggggtcaggccacgtgggtgactgcagctgccccaaacctctagtcaagatacccccggtcccatgtcaccgacaaaattagctatagatgaattagaacctagtgagctatactattaaacttgctcttaagcctttttggacgtaccatacgtcttcaccctccctcggaagcttgcacattcgttgccgtgggccatgtccgtcagcctgacgcaggcatccactcgctcattaaccgcattgactttcttagatctctagtagatgagtgaagcatagactaatcactgcactttagataatgtcagaatagcataaacgtgaaccgtatccaccgatccacgagtcggggaatccaatgccgcgagcaacgcaagcgctagccttcctagtccgtgtccaccgatgatggagtggttatctgtttcaccgctcgtccgatccgagccgaagttaaagctgctgcagcaccggccagttgagcatttaccacagcacgtccaccgcaattcattccgtcgccatggccgtgggctccgtgcatcctccatccaccagtctcgctcagagacgcgtgatttattccatccctcttgcattgcaccaatcaagcgcctaataaacactgttagtagacaagcgccgcgtcggtcccagcgggagaatattattagcgggcgatgcatacggccaaggtaggcacacagatgagacgagcacggtacgtacgtgagggagacccgacggcctggtggtggctcgccgccgcggctggaccagctgatagcgcgcgtgcctgctggtgccaaggccggaggcgcgtacgtacccgcctgaatcatttgctactacaggcgaataggcgatcgaccggtagtcgtcgtgtgtgcccctcttggcatgtgatgtgttcgccgcgtcgagctccttggttggcatgcatggcgcgcgcgcgcgcgatgggtggttacggcacggtgtgtgtgtgtgtgcgcgcgtgcagtacgcgcgcgccgcggggagggaccgagggagggagggagggacgcgtacgaaggctaaagccaagacggcaacgacgacacgacgacgcgttggaaagcatgccgggaatgccgtgacgggatggtttgattataactagctgggtggcccgagtaattacgcggctagcacccatataaaattatatatatttttaatatgattttacttaaaatttattaaatagttctctcgttgtcttaagattttaaaataccaaaccttattatcctcgtggttctaattttgtagtttttaaaagacacatcagttgctacccttgcttctgttatattattttctattagctttctcgatctaccattctccttataaccttcatctaaaaacttatattttttagagtttattgtcctgttgggattcttttttataatttttagaagtctcgtcaaacgctgctattatactcctctacaaccgtccactgtatcttctctttattgttattgttattttaaaaatcgaacataattattgtttagcttcatttttttactttctagaagttccgccaaaatgttagcgactttgtctatctactcctctacagctcgctcgctgccgcctttctttaatgtcattgagattttaaaatcaaacatcattatcgttggggattttttttactttttagaagcctgaacttttaaaaattgaaccttatagtttttagagttttattgtcttgttgggttttatgttttttataatttttagaaatcccgtcaaacgctgccactttactcctctagaagacccaccaaccatcagcggtctaccattatactcctatacgacccgcccgctgcgtctcatttttaccgtaattgagattttaaaaatcaaatatgattatcattagagtttatttttttactttctagaagtccccgccaaccgccttgacagatagcttcacgacctacccgtcgtccttccttttaatcgtcattagaattctatttggtcatttattaatagttttttagatgtctcatcaaccgccacctctctgctcctttataggcctgttatttaattaatctcgtcatgtgttttagatggtcttttctttcatttgtcttattttttatcaccgattttagttatttataaattgtattcctagttgaaatctttttttttctaatttcagaatttattttatttattattatgttcttttgatattcttattttttattttttatttaattgtttcaaaattgtattcctactttaactctctttttaatttgcctaatttcggattttattttatttttattccgaattttaattaatctattattgggttcttatatgtactctcatttcaatatttcttatatttaattctgaatttaagttaattttaaattgtatttctacttgagctcttattttcttttattttttctaatttcgatttttttatttttttattgtgaattttaattaatttggtattggattcttgtatggactcttctttcaatattccttatttctaattccgaatttcagctatttataaattttattcctactcgaaatcttcttttttcctttttataattttgaaatttatttattattattccgaattttaattaatcacgtattgggttataaaaaatattcgataaattgtatttatttttatcccaaattttagttatttataaattgtattcctaattgaaattttatttttctttttctaatttcagaatttttttgaaaaaaaaaagttaatactgtattgtgttcttttattgtttttattttttattttcaatttcagttgtttcaaaattgtattcctacttgaactctcttttagtttttctaattttagatattattttattttttattctaaattttaattaatctcgtattgggttcttatatggattcttctttcaatattgcttatttttaatttcgaattttatctaattttaaattgtatttctacttgaactcttcttttattttcttttgctaatttcagatttatttatttttattctgaattttaattaatctcgtatttggttcttatatggactcttcttttaatatttcttatttttaatttcgaatttcagctatttttaaattgtattcctacttggactctcatttccttttctaattttagattttattttatttttattttgaattttgattaatctcgtattgggtttttatatggaaacttctttcaatattgcttatttttaattccaaatttcagctatttttaaattgtatttctacttggactctccttccttttctagttttagattttattttattattattctgaattttaattaaccacgtattgggttcctacatgaactcctctttccatattgcttatttttaattccgaattttagctatttttagattgtacttctacttgtactctctttttcttttttttcttgtaggaatttctagtctccacggcgaacgtggtgcctatttttaaggctattttaataatataatagatagattacttgattggcgtggcgctgatgacaaggaggcgggaggaaatcaaatcatatctctcctcgctgtcaacgtaccatgcgggtcagatcagctcacagagtcatcgtttatgagaattgagggcttgcaaaactgccactggtggcaaaactgcggtcacatactgaacggcatgagagttactgccactgtttggtggccgcttcatgagagagcttgatcgatcatgataagctattttcagggatggaatgctcctggtggctactaaatgtatactaatataaggtgggggctcggctctgattgatgatttgatggtgactctgccgccttgctccaaactgctaatgatttcagagaaacaaaaagggtcccaggatgctggatttgtctctaagaggttataaaattctcagcctttatctcttactacttactccgtatcaaaatataagcatttttagctataaataactgtatgtttagatttataactaaaaattgttatattttggaacgaggtagtagtagctgctcaatagtcaagagtctccttcctgtttcagaatacagtatccggtacagattttaattgttgctcctgaaggtgcaatatcatgctactattagtaacgctgtgctcaggcgtcagaggagattacaacagtaggaaacacagtagtaatattaggccattaaaaatgtacagtcccccctatgggacccataactttcattcacattaagttctgatgtgctatcacctaaacctcctcctagttaacgagcactgtgcctgctctgccctgcagctttgtaatgctactgtactagcgtacagtacgtgtgtgctcggacgacatgtgctaactggcaggaacagagaacagatgaacttgctctatcagatgatgggattctgatttgcatgcatgtgcattgtttactttgatctgggaatgatcagccgagttgcactgagattgacaaagatacatggacgcagtacacacctcaacgagttagagtaaccttaaggacagatggcatatggagtggctatggctgtgtttagtttgtgtgctgatttttttttatatacgaacacatatttgaagtattaaatgtagactaataataaaataaattacagattctgcttgtaaactgcgagacgaatcttttaaacctaattaatttatcattagcaaatgtttactgtagcaccacattgtcaaatcatggcgcaattaggctcaaaagattcatctcgcaatttacaatcggactgtgcaattggttttttcctccacatttgatgctccatacatgtgtctaaacatttaatgtgacggaaaagttagaagttcgaagaaaaaaagttagaatctaaacacggcctataccgatcttggactgttgtacataattgttttagccattaagatcagatcaagaaatgagcaagtttaatagtatagcccactactagctccaaatcatatatagccaatgtaatagctaattcatacaatagttgcttactatactattaatatctggtctcacctgtcatacacacattacgtcttgtagtctgtgctgcagctggctacagatctgtagtccgctgctcttctctctctttattttatctctttaaaatatgtttatagctagcttatagccaactcttactctctctgtttaccaaacacatgggaagagtatagaccttgcttttatcacttactccgatccttctattttagaaaaaaaaacaacttttatacacaaatttgatcatgacctaagtctagatataaaagttgttttttttctaccccagagagtaagaaacatcaatattcttttgtgatttaataggtacaaatatcttatctctctataaagagacacatatacattatggctaacattatacgatgcacttatatatcccaccttaccactagcaccggcaagtactataccacatgcctctttcaatccactcttcctccaaccctactacttaaattgatccttcattttgccttttcttgcttgtttgcgttggatgtgcccattgcctcctaaccactctaaatacgatgtcctcgatcacacctacatccatggtcctcctctagcttgtggctagctatatgcaaacattgtcatattgctgtcaacgctgctctcgacccggcatatataaaacatttcggctatttagtgtcatggagttgctaagtatgtgattttacaagtactattatagcatcttagtccacatcatctttgtgattttgtaattcgttgccattcatcttacaacctctctaataattgatataactttctttaagcaaatgccgaaatgaattcattatctaaaaaaaattgcttcatgtagccatttcaaccgtcatgcacgtatatatgtgtgggataaatcatagttaaggtaagattgtttggtatcttggtttagggcatcatcaatgtatatggcaaaagtggtctatatagataggatccacataaataaactttacctatagcaatcctcacaatgtatatggatacaatgtgacattaggagaagagagagaagtagagatagataatattatttatgttatatgggtagtccatatgcatatagataccttttgctattttctttatatggactagttgcacaatgttactagatggctgaatggaatagtttatttcctatggactacttttgtagtacattgtggatgcccttatatcccacaagaatacaatatttatgtgtgctagcttacttgtgctgccaatcttgactttaatttagatcacttgccaaatatcatacctaaagctaacttggataacaaaaggcatgagaaactaagggtgtgtttgaggagaaggggattgaggagattgggaagatacgcagaacgaggtgagccattaactcatgattaattgagtattaactattttaaatttcaaaaatggattaatatgattttttaaaacaactttcatatagaattttttttgcaaaaaacacaccgtttagtagtttgggaagcgtgcgcgcggaaaacgatgtgcattcttactccctatcacccaaacgaacacatcctaagtatatatagacaacattaatgggtgagtttgaggaataggggattgagaagattgagaagatacgcaaaacgaggtgagtcattagcatgtgattaattgagtattaactattttaaattgtaaaaatggattaatatgattttttaaagcaactttcctatagaatttttttttgaaaaaacacaccgtttaatagtttgggaagcgtgcgcgcggaaaacgatatgctatctcacttattgtccatgtaacgaacacaccctaaaaatagacttgactcaaaatcctgaaggccgaatctgtgaggaagaatgcccagcacacaccgatatgtaaaaaccttttctcatcaggcggattttgtgcttatatgcgtgagaggcggaggagacttcaaaagtctatgtggaggagacaagtattgtgcatgcgcgggtaaaccggggaccggagcgtacgtgagtacttgcaccaggtactaaggagccatgcaagatgcaacagtagtactcctacagtagcagtagtactggcgtcacacgtgaggtctctcgccggtttcagcgactgcacatggatggcgcgggaatctctctggtcagctcagctcagcttgctgctctgctcttacactacacgcaagtgagcacaggtacagcgtcgcggcatgcgtctcacggattcaccaccattgcaacgcgacgccgtcatgcacacaacgatactctccgtccaaaaaaaaatcaacctagggtatatttagttcacgtcaaaattagaagtttagttaaaattggaacgatgtgatggaaaa

SEQ ID NO: 43589 - DNA, 1923 bp, Oryza sativa
ggtgtcaaacatttagggaagaagggagtagtatttttttgggttcagatcttgccacctaccttgggggagcttcacgtactcgatcacttcggattcctgtttggcgttggcatcaatccacttccagaacagtaagtaattaactaacctttcttcgctttgtacgttggtgtgctcgatcgtatcacgtgcaggctcaagttgagcaatttagcaagtactccacttcagatgaagacaacagtgctacgactaccatgaacaagcaaagctccttactcttctctattctgaactcttctaatcaatcaatttactataccgatacgagtagtatatggtaactgttgggtgactcgatctgtcagatatcttgatacgtttttacaggaagatgttaattacactgcctgcccagcttctcctccatctggtaagtggtagcgacattttcgagtggatcgatcagatccggtgaaagttcagtgcacacgcacgtactacgccgtgaatgggcagcagtgactcgtcccggatcggagtcggggagccatgtgcgaggcaccctttttcgaaggccgctgctgccattctgcacgcagcggcagaggctgtctcgcccggcgccctgttctcggctagctgcttgctcgcactgaccgatctctgcaggagacatgttctgtccggtgtccggaaacgccatggatctagctcggacagcgcgccgtacgtgggcgcttcacggggcaccaacagtggcaatcttgatagccggaaaagctctgaaaaatcttatccatggagctgaggttgcaatcaacagagcttggtggagaggaagagaagatcactgtacctggacaacgaagctatagccatccatccatgcatgcacgagtgcatgatatgatgctgtagagcagagcacgaggaagacgatacagggaatgaatcaaattttatatccgggtgtatatatatctagcagggggaaagattcagcagtagatcttgtcgctaaatctcttgcgatccacgctaactgacgcgttaacaaagggaagtgggcaatttgaattggaggggcgctcccggtttcaaaatctgacggggtcccgtctgtcttctgctaacattggtgaccgcattgcaacagatttgctcctgtatcagagggataggtgtctgtccacgttttgttctttcggctcgcagtacatgcatgtgtgcagttaaatactgctatatggtaagttgttcattggtaaacaatgtagtggacgtgttgaagttcaccccacacgactagtttcgaaagaaggataagatatataataaccacagggaagcacacgaagaacaattatctttatcaactctctgttcttcgttcataatcttgaggcagcatgcggcttgcagggatgaataaacatagcaagactgcaagagtgagtcaccccatctaagcagcggggagaaggtgaatagttcatgggccttgaagttaccaggccggtgcccatggcaaaagcatgggcctgcatttaggcccagtctagaaagcagagcacacgatttcactgcggagtaagttcaccggaagtccctcaacttaacagcgagatttttttgaggtctctcaaccacaaaaccaaaaatgtttgaccctaaactcattcaaaccgttcacaggaggtcccttggcagtatacgcgggtggcttcgctcacctggcatcctatgcagcaaaaaaaaattaaaaaaaattcctggggcccatatgtcacttgcactttatttttttcttctcttttatctcctcttctctttcttctcctctctctttgcccgcggagggtggcgatgggcgagcctgccactggagtaggtggaggggccgcgtcagtgctctcc

SEQ ID NO: 43590 - DNA, 1587 bp, Oryza sativa
ccacccacctatactgccaagggacctcctgctgaacggtttgaatgagtttaggggcgaacatttctggttttgtggttgagggacctaaaaaatctcgctgttaagttgagggacctccggtgaacttattcctttcactgctgcactgcaccggcctacccctccaggctctaccccaccccacacatctaagcatagaggaataagttcacattgtatctcatcttaatgtgacgtttgaatgacatccttaaactgcaatataaaaacattgaaccccatcttttgaaacaagattaaataatatcctaagatagtatagatgactattttggccaacatggcaacctagtaaaaaaaacatatgagatccatatgtacgcaagtaggtggacttccacctctcccacatatcccctctcttcctcctgagctgaccagataggaagaggggcacgaccagtgagcgcgtctgcgggagacgataacggcggttggaggtcgatgacgagggaggtgtcagtggtctgtggcggcggagcacggctgctgacgacggtggtgtcccctttcgaccccgtacatcaatgacgcgcagccggaagtggcaggtggccgggacttcaactccaccagctgggaggagacgtgctcctcgtcactaacgtacgaacacgatgtgttggctctacaactcgataatcaggggcggatccagcgtgggtgctggggggactcgagtcccctctaccccactggatcaaccattgatagaagggaatataaaagggaaagaatagtgaaaaaatgaagagtagggaggactaaagaagaaagagataaatccttaaatcttgttctggatccgcccctatcgataatactatattgccacccctactgtcgtcctagactcaaggtttgctcacgcaaccaattacattggcatatttagcttgtgagttaggtggctcgttatactcctttcttcccaaattgaccatcatatatgtttatgcaccaaaaccaaaaataatttaaatcacatcaattaagacaacatgcacacattctactataatgcatacatcgattaaaacaccatgccaatcacaccttagcatgcacacattctcccatgctgtatcaattgtattctgatgaatctgtgtccatgtggttatatgacgatcgatttgagaaattttgaatttcattatatgatgatcaatttgggaaggagggaatatctataacgagataaaatcttgtcttagcacgttaacaattttaaaaggaataagttcactttgggtccctctatttgtcgcctagtccgattttcgtcccttaaccgcaaaactgggtatgacccgtcccccaacttacgaaaaccgggtaaacgtggtccctcggctgttttgaagacggttttggcttacgttgcgcctacgtggcttgtttgtcttggtcttcgtcccacgtggcattgacgtggtgtttacatggcaattatatctcggaaaaataataaaaagcgtggcctcacatgtcagctgcacaaacaaaaatagtttttaaaat

SEQ ID NO: 43591 - DNA, 2604 bp, Oryza sativa
  unsure (1)..(2604): unsure at all n locations
cccacatgtcagcctcactcatctcttcttccctttcccctctccctctctctctccttcccaggcaggggacggagcgggtgggtggcggagcaggcgagctccggcgacggcggcggctgacggcgggagcgctaggcgggcagatgaatagggcggcagcgcgaagccgaaggggcgccagcctcgtcgtcatcttcttccggtgcacagcgatgcgaagccggtggggcggggcggggtagggcagcggggacgacatgatgcccggcttgttcgggttccatgatcatcggaggtccttcgatgggctcgccgcgcccttctcggagttcttgggtactgcgaggacggcgaggatgccaccatgtcacgtcctgatttttcgctttctgttctgctcgcctatttgcgaaaattcacatttggtttattcgtctaaaatagcttaatgaaaatttcgttaaatcaaaagggttttaatgtgattaattaattaatacgttgtttgctttgtggttcttaattggagttagttggatttaattcgtatttcggaagtggagctcaatccctaattcaaattccatccaaatccaatattctaattcaaatcctaaatcctttccaaaaattccaaatactttataattggaattttccagagaagtccctgttttttttccctttttcctttctctctttctctattctgccctttttcagtttagcccttattcttctctctttttcctttttccccaccttctacctccagctctctctctccttcttgagccgcaggcccggggagaccaagccccgagcccacgtgccgcctcggcccggcctcctcctcctctctgcatcgccggcccaagccgccgccgaccgagcccgcgccggccgcgccacaagcccaatcggccgccgctaaaccccgcaagaaccggcgccgcccttccataaatcgaagccgtgcgtcgccctaaccctagctactccctcctctataaatagcgctggtcgccgccctctttttcccctccttcgtccaaagccgccgccgccatctccaccgtgagcagccgccatcgccgctgctgttctgtgccgccgccgggagccgcgccgtcgtcgccgccatctccttcccgtgccgccgccgctggtaaagccccgaggctgagccctctctccctttcgcgccgccgtttctctctccacctcaactccggcgtccgcctctcgtcgccgtgcgccatctccacgccgtcccggagctcggtgctgcgccaccgcgttggcctcgacctcctctgcctccgccgctgtttgccgcagccgccgtgcgccgtcgccgacgaacgccgccgacgccgccgcgctggagccgccatggcgccatggccagagcacgccatgccgtgtgatggagcagctgtccttgtccttttctctatgccactgacagtgggcccacatatattttcctatccaaaattaattcaatttccgaaattaaatatccagagaatattctcggaatattcctttttcttttaccctcggattttccctgaattcaaacttccggaggccataacttttccgtttgaactccgattcgatccattcttcttcctaaattcttctaaaatcgagctctaccttctggtttaattggttatttcatttgatgttatttagttagtttttctttgtgtttatttgttttcgtgtgcaatcgtgtagacgttggagcggaagagcagtttgcttcagaagacgctgtgcaaggacaatactgggaacaaggcaagtgcactctttgaatatattgaacccatttgtgaaatgttttgttttgaatacatgcattgttttgtttataaactatcgatgggtagcgtgacctaattgttaatattatcctacctttgataattattgattgcccataataccttgtcaccctagtctttgtgagttgaacattgggctcaactcatggtagagtagttatgcttagcccgctcaaggttgttttacaagcaaaatataattttgattaatcatatatttataatcatttttatatgaattgtgtggctgtgtgctatcttttcggtagtatgtgttgcaccgtgtaaaacaacagtgacggagcgtggggctcctcaccgggagaccgcacaggcccccctttgccggttcggccgggggccctgggtgagattctaagctcctggtctgagtgtggaaggttcgcgagagtgaaacacacaagacacgggcgatgtatacaggttcgggccgctgagaagcgtaataccctactcctgtgtttaggtggatctgtgtatgaagaagctacaaaagagctggagaaccagagagctcttactttctccctctctgatctttctggatccgaaaatcccccccttctaagtgggcaaggtgctccttttatacctcaaggggataccacatgcaccatctctctcttttttgtggggacttatcctatcttttcataaacagacggagacttgtatggatggccgtcgaatgaccttttgatgggacacnccataccta

SEQ ID NO: 43592 - DNA, 11584 bp, Oryza sativa
ttgatgtgacactctggacgaggaggcgccctccgttgcgtgggcagcacgccggccattacgccggcgctcgatactgatgcgggcatccggccccccacgcagatcttcctgggtcggaggcgctgacgaaggagtggcggctgaatggcgagcaacagccgccgctcgccgcgccctccgccttgacgacacggagccggtggtagcagtgccagaggtcttggtggcggaggaccgcccaccagcacctaggcgctgccgtgccgtcatgaccaagttggccacgtcgtccagccaacgttgggctggagactccgggtcagggacaatgggcgggtgacgtaggagcgcgcccgcagcttggagtgcgccctggggcgtgctgccgtcgccgtagacgaggaggcgacgctccccatctcgccgcccttccctatcacccgtggatgtcgaagtcgcggatccttcgaccctctcgagcgcctcctcccgcctaggactttggcgtggagggggcggtggagtacgagctcgacggcgtgggttctgctccccgtcgtcaccgctaacactcggagagaggttgtgcgcctttgcttgttcggccattgggctgaacaggaaaagcttggcgcacacgaaagaatgcgagagcttagaaaaacacacgcaaagccccctacctggcgcgccagatgacggagcgtggggctcctcaccgggagaccgcacaggcccccctttgccggttcggccgggggccctgggtgagattctaagctcctggtctgagtgtggaaggttcgcgagagtggaaacacacaagacacgggcgatgtatacaggttcgggccgctgagaagcgtaataccctacttctgtgtttaggtggatctgtgtatgaagaagctacaaaagagctggagaaccagagagctcttactttctccctctctgatctttctggatccgaaaatcccccccttctaagtgggcaaggtcctccttttatacctcaaggggataccacatgcaccatctctctcttttttgtggggacttatcctatcttttcataaacagacggagacttgtatggttgtcgtccgaatgaccttctgatgggacagcccatacctacctccacttccgccggaagcaggcgcgacgtgggaaaatggctgtctgctgacgacatgaccagtgtcagaccggtcacaaatcggtcattcttgtccaccacgcgtcagtctataaatctgcatgttcgcccttcttcattcaatatcttgcttgtaatggttaggatgaagcctggcatatatctgaccggaaccaacgtgccatctccaggagctaacacgccggctccggctagggacgagtgcttggaggctctcatcctgacgggatggggcgaggcgtgcgtcagaccgcctgtcgccacctaacccacgatctgatcggtctgtgactggtcactgaccggataaacgagcgcgctgcactgcgttacatgcggcgtgacgcgctcgtccaaatcgcaataaatgtggttaggtgagccccgctatgctcacctaccccatatacgcggcgcaaaacccacaaggggtcggggcgcctcggccctcggggccgagacgggagcggtccaacccctcggggagacaaagagaagggcggtcgtatcaccctcgggcccgacccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggtgtgacgccacttcctaaggcctggtgacatggtggggccggtctaaaaatcgggacaatccggttcatttttcctggagatatggtgatggcgctttggttggcgagcgtaattaacgcgcgcacgagatgttccatctcgactgcccagccgcatgtccacctcatgcaccgcaaacgggcgaatgggattagtggaagcgtgggcgcgagaaacgagggggcaagatagtgggcgcgagaaacgaggagccgggcagcgttggcaagggtataaagtcgccgaggaagagatttgcttccttcctctcgccattattccccttgtcttcgccgcttgcgccctaactccttgtttcctgtgccctaccttcgccacacgcgctcactcttaaacatctcttcctccggcgtcatggcacggggctccgctttgcttgatggtagcgtgctgccgccttcccgcatcgtgagcgagaggcaggccgggctgccgcgccgcttcatgccggaatctgccaccggccgggagatagttacgctgggcgagggacgcccagcgccatgctacccggggcggtccgtcttcttcctcccttttgcaatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttgctgttccggtggttcttcaccgtacagtcggtgtcgccgccgtcggtggttggtggctgctacttccaaccgcgggggccggtgttgaaccgctacattccctgcgtcctccgcaagaagtgggatgactggaagagcgactggttctacacccccctcgccgacgaagcgcgcctccgacttccgagccagcccccggcgcaggcctccagctggcgggcgccggtagatctgggagatggctatgacgccgtcctcgaccgcctggcgggcctgcgatccctggggctcacaggggccatggtgtacggcgactatcttcgtcgccggatcgcgccactccagcggcgcacccggggtgcctgggagtacaccgggtccgaggactgtatgaggactcaccagggagtcagatgggactgggctcctgaggacttcaagatagtggtccaacgggtgctgaatctcagctccgtggaggcatccctcattcctcaaggagtcctccccctctgcagcgatccagaccgcgccttcatcctgaccattatgcaggcggtcggggcgtcggaggagcgggctcctcgaggccacgatggcgcgggcgggagccgcaggggggaacaatctaccccgggagggggtcgtgcttctgggccccgcgacaggggcccggggagcggccgccctgccgacgcccgggggaagaggaagcaggaaggaacccctcccccatctcctccccgagggggcggggcggcacgtgccagcagcaggcgcccggaggggccacgccgacgtcgcagcccgagggggagcggaagaagaaacggccccgcaagatgggggggacagaaccatctcggggaaaccttatttcccctccaaggtggtcgtttaaccgacctcctcgcaggttcgtcccacgcccatcgtggccgtattcattccctcaacgcgagttttcactcatccatcttgtttgtcttctggtctttcttctgtttcagcgagatcccgtcgcgtccctcccgccatcccaagtccggccagtctgcgaccacagaggctcggaggcgggaatctgaccggcgagaagccgcggatcgcctacgggaagccgaggaggccgcccaggtggccgtccgagctcgccaagctgaagaagccactcgggaggaggccagacttcgccaggccgaggagacgacatcctccgaggcgacccgtgaaactgaccggcaagaggccgcggatcgccttcgagaagccgaggaagctgctcaggtggtcgtccgagctggccaagctgaagaagccgctcgggaggaggccagacttcgccaggccgaggcgacgacgacttccgaagcagctcgcgacgaggccgcgggcgcatcgctcgggcccactccctcgtgcgacgctcaggacaaaccaggtccgggggacatccccgagtccggcacgtccatcggcgggccaagccgcgcggcatcctcttcgaggcggctcttccccacgccttccgttgctccactgagcgcagaacctcttctgcaggccttggccgtcgctaacaccacggtgttggacgggttaagtgcccagatggaggccttgcaagcagagcgggtggagctcgacgccgcatgggcacgtgtcgaagaggggcgccgctcggtggaggccatggtggaggtgggccgcaaggcacaccgccggcacgtctcagagctcgaagttcgtcagaaggtgctgggggagatcgccaaggaggtggaggaggagcggggggctgccctcatcgccaccaccatgatgaacgaggcgcaggacaccctccgccttcaatacgggagctgggaggcggagttagggaaaaagctcgacgccgcccggggggtccttgacgctgccgctgcccgagaacggcgggcggcggagaccgaggtggcatcccggcggcgcgaagaagcccttgaggcccgtgccatggcgctagaagagcgtgcctgcgccgtggagagggacctggcggatcgcgaggccgtcgttgctattcgggaggtcacactggcggtgcacgaagccgcctgtgccgaagaagagtccgcgctccgcctccgcgaggacgcgctcaccgagcgggagcgagctctcgaggaggccgaggccgcgtcgcaacggctggtggacagcctgtccctccgcgaggctgcgcaagaggaacaagcgcgccgtaatctggaaggtgcccgcgccgagagggccgcgctgaaccagcgggccgctgagctcgaggcgcgggaggagctggacgcgagggcgcgcagctgcggggcggccgcgggcgaaagcgacttaaccgcccgcctcgcagctgccgaacacaccatcgccgatttgcagggcgcgctagactcgtccgccggggaggttgaggccctccgcttggcaggcgaggtagggcccggcatgcttcgggacgccgtctcccgtctagaccgcgccggccggcaggcgggcctctggggcgggcggactgcgaagtacgccgccaaccaggggggcctcgcccagcgcctctcggagatagccgggactctccaacggctccccgaggagctcgagaggacgattaagtcatcctcgagggatctcgcccgaggagcggtggagctcgtactggcgagttaccaagccagggatcccgacttctccccatggacggcgctggacgagttccctcccgggaccgaggatggcgcgcgcacgcaggtccgggacgccgccgaccatattgtccacagcttcgagggttcggcccctcggctcgcgtttgccctcaacttcgacgaggaggacgatgacggcggagtgggcgacagtggcgacgaggctggcgacccgggtgcatcggagtgagcccccaggcccccgccaatctttaaatagtttcttcttttcttcttccgaggccttcgggcccccttcttgtatagactaatttaatctgcaatcaaataaagagaaaattttttgtgtcaattctatttgttgtgtgtatgagacgaggatgtctgtgccgcggtccttttgtgtcttggcttgaacaagggctcgtgcccaggtcctagtcctcaaatggctcgggtcggggctagtgcctggggagatccacatgtcgagactggccaggccgggagcgtggtgaccgagggttatgggtgacccgattgtgggtttttgccgattcccccccggagttcaccacgccccggggcacggctcggttctgggccccgtttggcgattttagccgacccgagcccccgagggcaggattgaacacgagtgacctacttcaagtcaagatccttcaaaaggaaacaacagcacagatacaacctttaggaaatcgaaaatgcttttattgaaatacagatataagagaaataagaatatgcatatgtggtagcccccggccaaccttgcacgcccgaggggggtgcggggttggcccgagcccgaaacctgacacccgatccccttttaggggtagaagcgacgaaggtgttcgatgttccacgggttaggcaactctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccaccttcgctcttccaagtagtcgaggtcatctctgcgaagctgatcttgatcagcctcgcagtacatggtggcccgaggggacctcagggtgagctcggatgggagaaccgcttccgcgccgtagacgaggaagaaaggcgtttccccggttgctcggcttggcgtggttcggttcgcccagagcaccgctggcaactcctcgatccacgaatcgccgtgcttcttgaggatgttgaaggtcttggttttaaggcctctgaggatttccgcattggcgcgctctacttggccgttgcttctggggtgggcaggtgaggcgaagcagagcttgatgcccatgtcttcgcagtaatcgccgaaaagttcactagtgaattgggtgccgttatccgtaataatacggttaggcactccaaaccgggctgtgatgcccttaatgaatttaagtgcggagtgcttatcgatcttgacgaccggataagcctcgggccacttagtgaacctgtcgatcgcgacatacagatactcaaacccgcccggggcccgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgtcgaaaggctttgccaaccaaggtgcgcgaggcggagtgggatccgcattcgccttcatggatatcagcaagaagctcgacgccttgttcccgaggaatgcatttcaggaggattccgttagccgcgcgccgatagagggtcccttctaccagcacatagcgtttggagatgcgttggacgcgttcactcccttcgcggtcctcgggtagagtcttatctgtgaggtatgcttggatctcagcgatccaagcaatcaatctaagggagctgggagcgctcccctcgggtcccgaggcctggactccgacgggcttcgggggcctgtcaggcgcgtccgtctcccctaaggggtcgggtcgcgccgacggctgggcaagcctttcttcaaaggcgcccggtggggtctgggctcgcgaggaagcgagccgtgagagttcgtcggcaaccgtgttatcccgtctgggcacgtgccgaagctctatcccgtcaaaatggcgctccatacgccgtacttggcgcacgtaagcgtccatctgcgggtcagagcaccggtactccttacagacctggttaacgaccagctgggagtcgcctaacaccaggaggcggcggatccccagtccagcagccaccctgagtcccgcaaggagtccctcgtactctgccatattattggtcgcccgaaagtcaaggcgaactaaatatctgaggacgtctccgctcggcgaggtcaacgtgacccccgcaccggcgccctgaagagacagggagccgtcgaactgcatcacccagtgggcggtgtgaggcatctgtgaggggcccgagctgacctcggggactgagacgggctcgggagctggggtccactctgccacaaaatcggcgagggcctggctcttgatagcgtgacgtggttcaaagtgcaaatcaaactcagaaagttcgattgcccatttcaccacccgtccagtaccctctcgattatgcaggatttggccgagggggtaagacgtaaccaccgtgacccgatgcgcctggaaataatggcgcagtttcctcgaagccatcagaatagcgtaaagcatcttctgggcccgagggtatcgggtcttggcgtcccggagggcctcactaacaaagtagacgggccgctgcacctttcggtggggccgatcctcttcgctaggggccacatccctggggtgctctttgtccaagcggcctcgcggggtgcactcgtcttctgtgccgacgacctcggggccggaggacgacaggggcggccttcccacagtggcctcgaggccgtcctgggggtcgggggctcttggcgtcgtcggacaagcgggcaaagggccaactccggtcgtcaggggccttaggccaccgttcggctcgggggcctcttctccctgctctctcccgggtcgagtcggcacagggttagcctcggggtcagagggcgataggtgcggccttcccgcagtggccctcgggccatcctgggggtcgggggcacctggcaccgtctgacaagcgggcagagggcctgctccggtcgtcgggggccttgggccaccgttcggctcgggggcctctcctccctgctctctcctgggccaagccagcacagggtgggggtgcgcggaatgaggattgtcctcatcgcgctccacaaccaacgccgcactaaccacttgcggggtcgccgctaagtagagtagcaagggttcatttggctccggggcgaccagaactgggggagagctgagatacgccttcaactgagtgagggcacgttcagcttcctccgtccaagtaaacggcccggagcgtttgaggagcttaaataagggtagcgccttctctcccagcctcgatatgaaccgacttagggcggccatgcaaccggtgacgcattgcacatccctacgcttgttgggggggcgcatccgctctatagttcgtatcttctcaaggttggcctcgatgcttcgggcagagaccaaaaacccgagaagcttgcccgcaggtacaccgaacacgcacttatcggggttcagttttatgcgggcggagcggagactctcaaaagtttccgctagatccgagagtaaggtctcttggttgcgcgtctttacaaccaagtcatcgacataagcctcaacattacgtcctatttggctacccaaagaaattcgagtagtgcgttgaaaagtaggacctgcattctttaacccgaagggcattgtcgtataacaataagttcctatgggggtaatgaatgcagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagcttgccgttcgccttgggaacgaccaccgggttcaccagccactccggatggatgacctcgcggatgaatccggcttccagaagtcgcgccacctcctcgcggatgaaggcttgacgttccggggcctgccgccgtactttctgccggaccggccttgcgcccgaccgcacggcgagacggtgctcaatcacctccctggggaccccgggcatatccgtcggtctccatgcgaagacgtcagcgtttgcccgcaggaaagagacgcgcgtcttcctatttgtcgtccagaagaccaccgatccgtgtggtcttggacgggccgtcgcccagggcaacctccttgaccgggacctcgtcgcatgtgactatccgctgcctcggggcagcgggggcggaggtgccaagcctctcgtcgcctccctcgggcttggacgcggcggtgaggtggtccgcgcgctgctccatacaagcaagcgcgactttgaggtcgccatggacagagttggggccaccggggcccggcatcttcatctggaggtaggcgtagtggactgccgccatgaacttcaccaacgcgggcctccctaggaccgcgttgtagggcagactgaggtcccccacatcaaagttcacccgctccgtgcggaagttggcggatccaccgaaggtgaccgggaggtcgatatgacctagcggccaagtgtgacccggcgtcacaccgataatcggctgggacggccggagcaccatccctggggccttgatagcgtcaaaggctgcgggggaaaggatgttgagggctgctcccccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgacagtggcaatggtggccccaggctcttggaagcctaggtcatcatcgccgtcatcgatgtcctcggcgggggccttctgcttggcctcacttcgccgattgccggaaggaaccgccggggacttgccctcttggcgctcctgcctcctctcctcctcccacttcctcgtccgctcagccaaacttttgactgcgcggcagtccgcgaggtcgtgaagggaggtgttgtggacgatgcaccacttgccggttgggcgctccctactgggagcgccggcctccttctttttgtcgctcgcaggcctcccctttcgggtggcccgcgaagcgccctcgacggcgaggacatgaccctcgtcgtcggaatgggctgacctcttcttcctcctcctgtcacgccgccctgtccgagcagcggatccgggggcggccgaagctgccacaccggaaccggaggggttccaggtccatgcctcttccttacgagccactcggtccgcgagctgaaaaagctccgcggtagtctggggctctttggaggcgatcttttcgagcatgcggttgtgccgcacaccccccctgaacgcgtagatcaccgcgtgtgcagggatgcatagtatggtgttgcggacttgacagaaccgctgaatgtatgagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcctcttcagggccatgggaaaaaaatttgccatgaccctgttttcaccccctgcagcctagatcccggtcgtgtagacgtggagaaactccgcggggttgacgctcccgtca

SEQ ID NO: 43593 - DNA, 11594 bp, Oryza sativa
  unsure (1)..(11594): unsure at all n locations
gctcgcccaaccgcaataaatgtggttaggtgagccccgctatgctcacctaccccatatacgcggcgcaaaacccacaaggggtcggggcgcctcggccctcggggccgagacgggagcggtccaacccctcggggagataaagagaagggcggtcgtatcaccctcgggcccgacccccccccccgagggggttaggccacgtgggtgatcgtgtctgcctcaagtctctaagtcatgatactcccggtcccatgtcaccgacaaacaggcggataaaacctttttgaccggggtgatgggtggttctgtgtgaacctggttaggtggtaatgtatctgtgtgatcgttgccgggtacggtctctgtgtgagcctactgttgagctgtgtgctattgtagtttggcaagttgtcttggtcaattaaggacttcacttcataagtcatggatctgagcctaacgtgcaaccacatgttctcatgggaagaacctggcccagtaggattccgagtcttggcactgtcggcccaggtggctagatgataggagtttaggttcgccatggggactttcttgtctgtgtgagggaaaggtgtctcatgggggaaggcagtgttgggacgaagtttctaaaaagccttgttacagactccttggccacacacaacctgaagtgtgacacttgcgcatggccgttaaaaggacgatgtatcttgtgggtcaagctgcacaacctttgcagagtgttaattaatctattcgaatagtcgcgtccgcggtcatggacatgctcggtgatatctcatgaggggtagttgtgaaaactgggaatgaactgtgtgcaggttaatgaatatagctatgtggtcctgtgtggacgaatcctgtgtgaatggatagttggtaatactgttatttacaactattgttttaaacctgtttataaattgtttataactgcaaattgttgtgttatgcaaaatagccattttctttgttgtcagcttgcatatgcatatttctgtgtgcttgctgagtattccatgtactcaccttgcaatttcccccaattccagaagaaaggttcccgctgtttcctgaggagtttgttgctgaagacgaggaataggtcgtgagtcctagttgactgcctgtggcaagttgaatggagctactacgcatttatcttatttccgctgctactttaatattttccttaggcccttcgtggcagaataaatgtaaactttagccataaggtttatcacagtcattattaatattaaatattaggtttcctttgtgatattggctgtgatattatctttgtgtctgtgtgtgctagcttgatcctggactagcacttatacacaggaggtcctattttgggtcctcacacgccgtcagccgctccacccgcgatgcccagcagaacggcgccgaccctcctcgctcggtcgccgagcgccggctccctcctcgcaccggccaccgacgtcctggatggtcacatacgggttggagccctgcctcctttcccggtcgccgagtgcgccttcctcctcgcctggccgccaccgccgacgtcctcgatggtcacatccgggtcggagccctccctcctcgcccggtcgatgagcgccgcctccctcctcgcccggtcgacgagtgccgcctccctcctcgtccggcgacgagcgctgcctccctccttgcccggccgccgcgcgccgncttcctgctcgcccggccgcctcgagcggcccctcctctcgcccggccgccgcgcgccgcctccctcctctcctggccaccgcaagctacccgtcctcgcctggccgtcgcgtgcctctctgcccaccgccccccgctgcgccgccgctcaccgttctgtaagggagagagaggggggatagagagtagaggaaaaaaaattgaaaatatacctctttttcattggttttgtacaaatacgctcatttagaaaatatttacagaaatataccattgtcgtgaaatgaaagcgcgaaatcgtgcgttactgcacgatgtcgcgcgaggtgtgcgcgaaaccgctcggtctcgcaccgcgacttcgcttacctaacccgcgtactctcgctatcaataaattaattagtgtaattagcaattaattaattacaattactcctttaactaacatcattagtaattaattaatcgttaatcacccgttaatcgtccactgatcatgagtcatatcaggccatctcgcaaggtgatgaagcgagaccgccggtctcgcgacctgctgttgcgataccgtggcggatgcggcggaatcgcgccatgattctgcgagaccgtgacgaagtgtcccgttgtcgtcattttcgcttaacggcttagcgatatattagcgatatatcgtttcgatttcgctctttcaatcagcgacgacgatatatttgtgctaaaaattttacatctcgaatatttataaaataaataaataaataatatactttcaaatttaattcgagagtagagggggctgacatgtgggaccacatatgccccaccttttcttattatttttgtgtagctgacttgtgggtcccacattttttattatttcctgagatccaattgccacgtaagcgccacgtcaatgccacgtgggacgaggaccaagacaaagggagccacgtaggcgccacgtcatccaaaaccgggcacaatactgctgagagacctcttttgcacggttttgtaagttgagggacccgtcatacctggttttgcgaccgagggatgaaaatcggactggacgacaaatagagggaccaaatgtgaacttattccattttaaaaaacgagccaagcgtgctagtcacaactttttatttccagcctagtcaccatctaagctaccgggccggagcccatggcacaaaactaggcacgtgtttaagcctagcccagaaagcatagcacattagcacacgagcatagtcatactagtactagcaggtacgagacgcggaagaaaattacacaagactgagggtccctacagtcctccgaaagacctcgtccctctacatatgacacctgtccactacgaatctcaaagtaggcagcctctgtcttcttcctatctccccaatctcctgtgttctgccgttcttcctcaacacgaccaagtagagcttacgcacgaccaacgcacgcggtggcggccgccggtgtcgagcggcaacactcacccagccaattgacaattcgatggtgactaatggtgaacacttagattttgctcgttgctttcaatctccattactgctaagtgctaattattaatggtgattgaatttatccgagcatttgatgattcttttggacagtgaaccttggaaaatcacatcgttgtctgctttctcatcaagaggcttggtgtacatcaactcccgaatacatattgtggagcggaccaacggagttcacacgctacagcaaacatgatgcaagccgactggcagcggcagttgagcacgatgtcatcgtcgcactctcccgacagtcatccatgagcccgaagccactcgccgtcgcgcccgctttggtcgggttcgagggatgcctcaccgagcggaggaagaagaatggggattagaggggagagaggttgtctctttgagattcgtaatggacacttgtcacgtaaggggacgaagtcctttagatgagtgtaggacttcagtcctatgtaattttcttccacgagacgctccaactgtccaagcagaagtcgtcttctcgcgagaaaaacactgaaaaactgatgacgcgagtacactcgtcgagcggttagcgacggagccctgcagcgtcgacacgcgttccaccacgcaccccacggacgtgtcggccgccagaagctccggctcgcctgtatttagcacgtacgacgacgagcgatcccactcctaacacagtacagcgacgacgacagattaaccgagagcgatcgatcaaccaaatcagaatcagggcaagaaacaatggcgcagctggtggacaaggcgaaggggttcgtggcggacaaggtggcgcgggtggagaagccggaggcggagctggccgagctgtcgttccagagcgtgggccgcggcggcgccaccctcgcggggcgcgtggacgtgcgcaacccctactcccactccatcccgatctgcgaggtgagctactcgctgaagagcgccgggagggaggtggcgtcggggacgatgcccgacccggggtcgctcaccgccggcgacaccacgcggctggacatcccggtgaaggtgccgtacgacttcctggtgagcctcgccagggacgccggcagggactgggacatcgactacgagatgagggtcggcctcaccgtcgacctccccatcctcggcaacttcaccctgccgctcaccaagtccggcgagctcaagctccccaccctctccgacgtcttctaaatcggcatcgtgcacacgtacgggccgagtgtacgagaacttgtgtatttccagacttctggagtaataataaagaacacgagtggttggttaatcgcgaatcgtatgcgcggtgtctgtaacgtacgtttatgtgtggacgttatgctacggcgccatatgtccatatgcgtgccgacgcgcgggccgggggccataggcggctaaatcaagtaattagtcaaccgcggcgatttggtgagatcgctccttaaaggctcgcgccatattgcccacatgcgttccaccaggccacgaggctcacgagcaaacgacgcgcccggcaacggcacgatcgcccatgagcgcgctcgccctgccgtgctgcggtgtacccatgccgctcatgcgattgggatttgagagaggttcggagttatttagaggagctcaatattatgagaaaagctgttatttgagaagctgttagcctctagttttaagaggatctggaaaagccggattgtacttccttcttcacagattgatcattatatgatagaatttaaattttttcacagattaatcattatatgatagaatttaaatttttttaaattgatcatcatgtaaccatattgaaaacggattttatcgaaatataattaatggacacgaattttattgtaatacaattaatacatcataggagaatatatatatatgtgctaggatgtataattggcatggtgttttatcgatttttttaggatgtataattggcatggtgttttatcgatttttttaggagaatgtgtgtatggtgtcttagttaatgcgatttaaattattattggtcttagtgaataaatatatatgatgatcgttttggacggagtaagtattaactaaactttttcagcttttgtcttttaattctacattttataactgtcgcttctcaactgacaggagctcctctaaatatgccatatgttttcgaaattccaaatattttttctgcaaacaaagtagaaaaataaacgcttacaacacacacgctcgcgcacttatgtttataaatgcacatcatatcgctatgtgcactttcgaaagattagacaatcctattttaagattaacgaacatagacaaagttatcacaatcgactgttaaaaaaataactaatcgtaaataggaacactcatattattaaataggggctcatgttaaatccgaccaatcactgagcaagttctatcataagaaatctaaccatttaagcacttgagttacgctcgattataatatataaaaagtaaaacttttactctaaaataaaataaattcaccttttgtaaaaataaacttaatgtgagattagagtagttgatatttaagtttgaagtattttagaaattacggatggtcagaagtttaattatttaattaatctcaaactcgtactaagcgttacaagtacggaaccggagggtagtaggatgaacatttattaattagtgtttattattgtctattgatggtaaatattgcactaaaaaaaagagaagtatgttcctaacctgagcattgaaatttcgtaatataataagaaaactaattgtaaaatttcaaatttatctggcattttactttccggtcataatggaagttcgaaaataatttgaactttctaagtatatttgcacgctttgcgtttcatgcaagggcacccaataaccttaaaatctattttttctctttcaagtacagaaaacttactttgttgcatgtttatactcatttcaaattataatcagttggaatttgaaaccaaaagtttcggttgcgttgatagtctccgtaggtactagtaatacgcgaaacggtggggctgggagcacttttatagcactgtaaaagaactcacacatctttatcgtttcattagtttttttactaatcatgtccgcagagcaaaactagagaggcagcggaaaatttaattatttgctacttttccgtttggtaattagccaaatacctttttaggtttacacttatgaatttaccattggagagagaagcttttgtaattttttttcactttttttcactgtagagtgccacggccggtacatgtgcatgccaacatggaacctacgcaaaaaaatgactaatctacccatgctagctagcaaacatgtgcatcttagtcataattcattaactggagaaataacgagagaaatcggcaacctgtccaatcttcccattttaaatttgcaaggcgacaagatcaatggcaccattccggttacatcagttcattaacttttttaatcaagctaaatctctgtagcaccatgccaacaatgccagccaaattaaataccgctcttaatcttagtcacaaccatccagtggatctatttcttcaaatattgattcgttgtccgacttggaggtacttgatctttcatacaaggaccaccaattgagcaggttgtcgctcgaatcttcaatggccacctcataaacagtgaacaacatccatacctctgccatagattttgcgaaagcaattttatcctaataccgttcctgattcagcctataccacaaccaattgctagcagggtagattggtcatttcatgtgcctgtccatgctggcatgcatgtgtggtgctacacagtgcagaaagtggtaaaatattacaaaatcttctctctccaatggtaaattcttaagtgcaaacctaaaaaagatatttaactaatcatcaaacgtaaaaatgttaaatagttaaattaccaggcaacaactatgataagcaaaggtaaaatctaaaccgataacactttcggtttagtcttaattaaagagcgacggacacatacgtaagagaactactaatacacgtctatcatgtctagttgctaccagtacacccaacaatgcatgcctttctttcttcttatagaattctcttttaaattacttatccgatctataattcgattacactattatattcattgcaattaaatctttataacaaaatcttacaagactatattatgatgaaaaatatttatgttgtaaattactattattatatatattagttatttttatcatatatatatatatatatatatatatatatatatatatatatatatatatatatatatatatattatattttattaaactactttttagatattcagtgcatgatcagtgtactttataggttagttttataatatgttgattaaatttaatttctagatagacttatgtttttatcccccataatagatttacttttgatgtcgtgacaagttacttttataatatatgtaaattttttataatatatgtaaattatttttaggttttattgaatttaattttatatgaccaagaagtaatttaataaaatctaaaagttatttagatatattataaaagtaatttgtaacttttcataaaaaatataataatgtaagatcttgttataaaaatttaattgttacgaacacaatgatgtaatcggatcgtaaatcagatgagtaatttaagagaaaactttataagatgaaaaataaacatacactgttaagtgtactagtagtaacctgatcgctggttatgacaatctaacatacaacaccatcttaatcatgtccataaataaaagaacaagactatatagctagtggccatctatgagagcaaaaataaccccagtaccccacacgaaacccacgtgccttcagtatctctccgccacccgacagagtccactctccactgtccatagctgccttcgcctgagttcgactaggatacatttgcaccatatagtatcattcaccaactcgaatcaacacacactagacacgcatctaatttgcacttaagtaatccgatcggtatctgcatgcgcctgatctccacgttgcgctgcatgaaacgcgtgacgtgaacaggccagctacccgggatctctcatgacgatcgacaggtcaggtcggatccgtattaatcttcgctccaaatatttaccagttgtaggggtaggtttcccactgcatgtcaaatatatatgtcattgctgacacgatctaattaatttgtccatgtcacgctaaactaaacaagcgtctgcgatttttacggcgaaatttggagtaattaagtaaaaacattttggcttgttgctataatgcatcgagctcaatctcaaagtttcagagtcctgtcagttatcaccacgaggggttagttagctgtccatgtttgcacgcgtcccgactgatcattaaaaaaatatttcttgttaaagatggaaagggaagcaagtatagtaatgacctggaatctgattgccttgcttgatttggagatgtcgagtcagcatggtctcatggattattcccggacaagtgaagatcagatctgatgtgaactcttcttttcgaacaaaacgatgggaactggcctgctaccactatttttttcctggaatgggacgatatgagtctcagctggcgctccattatttgctagaacagtgatcgatgcgatcacagcttgggctacgggctccaaccatgtcaccaaccaaatactgcctccgtcccatcccaaaataagtagagccgtaggtgcagaacgttcaaacgttaaacacaaacaatacaaatctacacttatttattttagaatagagaaagtagtactcaacaataagagaaaaacgatctttttttaaaaaaaagctaaattgattatttgtctgatgattgtttggacacctagaaattatccatatgaaatctaattgcgtcgttgatgccactacattttattcgtaagataacctagttatgcttctaaactagctcacaaccaatgaacaaagcctataatattacaagctttaacttttaagggtgatggatcgagcgcgtgaagtacgagtaactgtccacctttgcatggaaggtggcaccactgagcatcccaacctcatcgataaccagtaaggggaagttttatagtggatgtgaaatttagttcacatcatcaactcattaattataagagacaatatatataaaacaaattacctctaacacatttgccccaatacatcatattaatttactttatttgtttcctatcaattcattggtctcttgttctcatctctcttggagtttgtgtagagattgccccttgcatgagaggtggcaccttctctcacacctttcatatatctcttccacgtcatcacgtgagcttacatggaacctgaggacaagtgtgtagaggcttataatacttgccctaagaacgtcactgctcttttcaagcggcgaatcttctctttcattggtcaattcgctaagccaaagcctcattaccaccgctttgtgagataaccttttaccctcgcttccttttcttctctcctgacctataatattagttagtcttcgttgcctcgccatgtccccttttgcccaacttttcttcacacttgaccggagatggacttttttttccctcgaggggacatccactcgttttgtacataacgtttaaaatatcatcaaaaaaatttgtcaataattgttaatatagatcattatatgatatatctttgcacaaacatgcaagttaaattttgacctataaaatttgaaacaaaaataacaaatttgaccatgaattacgtatttcatagtcaaatttgatatttttgtttctacttgtataagttgaatttgaacatgtatgtttatggagtgatatatcacatactgatctatcttacttttttttcaaattttttgatgactttttaagagatatgtaaaaatgagaggatatcctcttaagggatgattagagtttccccacttgacctatgcccacaacttctttttcttctcccttgaccttaccccttttgcctttcccttaacctctggacaactagatccaatcatcataaatttctctttgttggaaaacaacatagagtagagctaacggtgaggacaattctcatcatgtcaagtcgaagaggatttgaaaggggaacatgatgatggcatacctaagaaatccttaggggcaaaagatctaataatttgccaaatacaagcatcttgttaaaagcaaaataactatgcagcatttggtaggaaaatctaggagtgactatttttccataagataaaacctaggtaagcacataagtgacccttactcttagggattgtattttcataccaatcttgatgattccacttaatttttgaaattatatgggatgaaggcacatccatatttctcttttgttgatgccgacccgatttaaatgatcaaacacatccagctatcatcattttcaaatcataatggtatctagggccataagcgaaaatggtatattttcactggccattgatcgttggcggtagcattggctgtttaagaaaacttaaaatgtatgtcagaaaaagtccattttgtagtagtgtcttccattttccttccccctcagctgcacaccatgcacgatggctcaatgcctccactagggttaaaagtcgatttaacttttcagaaacttttagtcgattggtaaatactcactctgtttcatattataactcgtttgacttttttctagccaattttttttaagttttatcaagtttatagaaaaacttaacaacatttaaaatataaaaactgtttcattaaatctaatattgaatatagtttggtaatatgtttattttatgttgaaaataatactatatttttctataaatttgatcaaacttaaagaagtttgactagaaaaaaattcaaacgacttataatataaaacggagggagcagcaaaatgaacggcctcgacatcatataaccccagcacttcccacgcctctataaaattttagttttcttgacgtggatcacgcgagctcaaattattgacacattctagaccaggagtacttttgctatatatatatatatatatatatatatatatatatatatatatatat

SEQ ID NO: 43594 - DNA, 25432 bp, Oryza sativa
tctcccgcctcctaaccccaagaattctcctggacaccaccgccgtgttcccgccaagcagcagcgtcgtcgccccgtcgctctcccgccaactgcggtgcacgcgcacgggtgggtcgccgccggcgccgccgcataggctcgtggcgcggcgggcgatgagcaacggggcggcggagccggccatctacggcggcggcggcggcgcacaacaggcggcgtcgtctgctgcggcgcggcgcgtgacgctggcgacgctccgcgggaagcaccggcgcggggagccgatcagcatggtgaccgcctacgactacccgtccggggtgcacgtcgacgccgccgggttcgacatctgcctcgtcggcgactccgccgccatggtcgcgcacggccacgacaacaccctccccatctccctcgacctcatgatcgagcactgccgcgccgtggcgcgcggcgcggccaggacgttcctcgtcggcgacctcccgttcggcagctacgaggcctccaccgcacaggtaaatctagattctagacgcggacgccacgccattgattagctcgacgacgagcagcacacatgtactgaaattaactgacacgtacgtatcgtaggctgtcggctcggcggtgagggtgatgaaggaaggcggcgtgaattcaatcaagctggaagggagcgcgccgtcgaggatcagcgcggcgagggccatcgtggacgccgggatcgccgtgatggggcacatcgggctcacgccgcagtccgtcagcgcgctcggcgggttccggccacaggggaagacggtcgagagcgccgtcaaggtgcgtgtgaacgcgtcgcgcgcggcggggcacggcgcggcggcgagcgtgtgctagctactgatcatcgatctggttgattgcgcacacgcaggtcgtggaggcggcgctcgcgttgcaggaggccggctgcttcgccgtcgtgctggagtgcgtgccggctccggtggcggcggcggcgacttcggcactgacaatcccgaccattggcatcggcgccgggccattctgcagcgggcaggttcgtccattattcgagcagagccggttgccattctttactttctcaagttttcgaaaagaggaacgtattatatgtacacaagctttgtatatattctcggtgcacaacaactaacaaaatatcacaattttttttattaaaaaagaatctacatctaccaataatcacttacgtggttatgcataatggacatcttcggaggacattgatacggttgcacagctgtagcaactacagtatcaacagcacaaatcacactgcttttttttataaacaaaatcacactgcttatacggttgctactgctacagcacagctaccgccatagccggctgcagcgtcgtgttgctgaacagggcccaacgaaaactataattcagacacttatatcaacattttttttaaacacccagtacaaagtttcgttttaatataaaagtaaaaagaaaaacattaagtctcatatcaacatatttgaatttctaccgcaggtcttagtctaccacgacttgttagggacgttccaaacaagtcatgccaaggtaaatgccaccttcttttactgatccgacctaaaccattttttacccgttacgattttgctctttgagctcatagtactgaacttcttactctatacctgactacatctgcaggtctcgccaaaattctgtaaacagtatggtaacattggggacgtgattaacagagctctatcaaagtacaagcaagaggtggaaacccagtcttttccgggtcctagtcacacgccctacaaactagctgccacagatgttgatgcctttctgaatgcgctgaagatgaagggcctgaatgtggctgctgatgctgcagccgatgctgttgaatatacagatgagaaagagataaatggaacgccgcagctcaaggtctatgcttgattgttcctagctagctagcaatggatgaatagcaatatggtttgatttatcgcaaaataaataaatgatttggttgctgaatgaagctgaatctgaatctgaagagtgaagacccatcaagtgttatgatcttctttaggtgtatttgaccatggatgcatggggatttcttattttttgtgaagtataacgtgagtgttgtatgcatgaagtatgtatggggagtgcactcaaacctatcagatagtagattccattggtgacaaagttataattatgtattctgtaataagttcatcgtatgctattgttgtggttttggaatgtgttcagcaaaatttgtagcaaagtagtactcctacttttttataagatagtcgcatgtttataaaattatattagatcccgcaaaaaaaaaagatattagaaaaaatgactttaatgaatgttcactttgatggcctagaccatgttaactacataagtaaatttcactaaactacaaatgttcttttatcaaactatcataaaacgttagatttgatacattatatcataaaaatacatatttagtgctaaatgtattaaaaacaacatatttatcaaactgcatattgaggttcgaggacatcttttttttccgccccaaactcagcctcaacctgagggacctcaagtgaacttatttccaaaccatccacatcggttaggtttaggtgggctgaaaatccaaatatcctgaaaccaaataccagcccaatgaaactacatattcactcgtgactcgtcgtcacccgtcccaatccaaacccccacccaaaacctctcggcatcccacttgtccccgtcgctctctctctttttcgccgcctcgcctcgcctcgcaccaatcaccacacgcgcaccgcgcactcactcgccgcgcggcgcggcgcggcgccgcctcacgcggcgatgatgatgatgatgcggcgggcgttccggcacctggcgcggcagcagcggcggccgctgagccacgtgccggagtcggccgtctacggcgggccgcggccgcaggatgtgggggcggcggcgggagcgggggcgggggcgggggcgacgcggcgggtgacggtgacgacgctccgcgggaagcaccgacgcggggagcccatcaccgtcgtcacggcctacgactacccgtccgcggtgcacgtcgactcggccgggatcgacgtctgcctcgtcggggactcggcggccatggtggtgcacggccacgacaccacgctccccatctcgctcgacgtcatgctcgagcactgccgcgccgtcgcccgcggcgccaccaggccgctcctcgtcggcgacctccccttcggttgctatgagtcctcctccacgcgggtacacgcgcctctctcatcattcaccccatcgatgctatgccgccgcgttgccgattgattttgttccacatctgaattttgatctgatagacgttattttaactcttttttttttctatattcgtgtttactactaggaaaatagctatgcgagttcatgcaggatgaataaattttggttgtcttgcaatgttatttctgtttggtacaatggggatgtcaataaaggcacaaatttacccccttgtgattacaaaagcagatagtgtttggttggcgatgctagcatctatgtgttctaaggaatttgattgatattggttattcttatcacaaagtttctgctatcagatgaagtttttttatacacaatatatgtagtacttgtgttattttgttcacctttcgatgacacatgagaagtcgagacttgaactgtcagtagagctctgtttcttacgttcagaacactagcatatgctgaaatttcagctcaaaacagtataaaataacccaaaagatcagcttgccaaatactttttaagtatttcacatgtatgcatatgcatacatatgagacattgagattttcgtggtgtatgctttattcgtaataggctgttgactctgcggtgagggtgctaaaagaaggtggaatggacgcaatcaagctggaaggaggtgcaccctcgagaatcagtgcggctaaggctattgtggaggctggaatcgctgtaatggggcatgttgggctcacgccgcaggctattagcgtgcttggtggatttcgaccacaaggaaagacggttgatagtgctgtgaaggtgtggttctcttgattttgttggttacttggctcttagcctgattcatgttctttcttcatgtatagatttgccccatgctgttctgcttgtttgtgtaggttgtggagacagcacttgccttgcaggaggctggctgcttctcggttgtgttggagtgtgtgccagctcctgtggcagctgctgcaacatcagcattgcaaatcccaaccattggaattggtgctggaccattctgcagtggacaggttcagttattcagtatacttcacagttcacacttctacagatatatgttcattttcctcaacagtttagattaagccagttgtatctattctgattcttgcatcatttctgtcaatgcatgtgtaattttgtcctttagcttccttgaataaataacttcaataaaatctgctacgagaccttgtcgagtatacaaattttatgaagccctcatgccgaaatatttgtaatgcaggtcttagtttaccatgacttgttagggatgatgcaacatccacaccatgccaaggtaaatgacacttgacaccatcctttcaatgtcagtaagcagctttgctttgatgtgagttgtgccgagctgaacaatttgtataatcgcttactgctctactgcaggtcacaccgaaattctgcaaacaatttggaaatgtcggtcatgtcatcaacaaggctctatcggagtacaagcaggaagtggaaacccggagtttcccaggtcccagccatacgccgtacaagatagctgccgcggatgtggatggcttcgcgaatgcactgcagaagatgggcttggacgaggctgcaaatgctgcagctgccgcagctgaaaacgcagagaaagatggagaactacccgagaacaaatgatttttttttctgttggtggcttcgagcatcagagcctgccacaatgtcgccacatctctcaatgcaatcctgccaaggctgcaggggtaactgttgtcggaaacgcctgcacagtgtttgggtaatctttcctatgccctaacgtgagtcttaaaaaaaaaaagacgatgacatcgatcccctgtccgggcaattataaactggatgtttgggagcgaattgcacatctcaacgtattcttgctctgagtgacgatttcgcatctatctcgacaccacccatcatgggatgcacacgctctgaaaggaagcacataatacacacacagatgctatccagctactgaaaggaagcaccttaatgcatttctccagccaagctaagaacagaactaaagaatatgctgttccaatgctatatattcactcgccatctagtacataactaattcagaaaacaaaacatattttcttgctttctggactctgctctacatacattgataaaaaattctatgcacacagccaccatatgacaccaaagtatatccggaaatcctagaagtggcaatatacagatttaccagacctggaaatcctaggaagtggtaatatacatttacagaactataacctgttcttccagattagcattgtaacattgactatcatggctggttttgttagaaattcagtatgtgcgaagtgcataagctgaaatgtggaccaggagcacttcatcagtctcatgtagagctaatcttagttatccttgagtaatcgccaacgttggcaacaaagagtgggtctttctcgtcgctaaagatagtcttctcgcctgcttgttctaactctttagtcaagtcttccattgttttcttcaagttggctttgctcatctgtccaccttcgcccattgagataccaaccatcgtgattttggggagaagtgggttggcttgtaaatcattgttgatgctggcatcacatctgttcatcaaacaaagatgatttgaaaatttgtgcataaatataaccataagaaagattatacaaataaacaaagcgacttattaaatagattatgataaacattaaacaaacaaagtacaaccaaagcacaaaaccaaaattgaggctattgtatagaaacatgattcatagagtgtacacttcatgtgcatgacagcaagagggaagggaaagatgaggaagaacagaccttctgaatgctctgtctcttccttgtgctttgaaacttctatcatgacctggccatatattaggaagcaggttgctaaatgggaagtgagattggccattatttgagttttcatgttttccacggttgctgttatcaacgtctgactccaaagtttctggttgtttactaatttggaagcaatcagcatcctttgaagcagtaaaactactactggcagtagcagccctgtcaattgcagcagcagtcctgagagtgaataaaacaagagaaaggcatggatgaagcaaaaggtagaactaacagatactgatgaactagttaaattagtgtaggctatcaatgagtattcacacaagaaaataacaggttaaataatttgtttcagtatctcaggaagtttgattattttttaggcctccaataatcaagttaaccattttttctctcctcttctcaaggtcagatctcagtttttcaacaaccttctctgtacactaaacaaggtcatcaagctactgagctactagaagcagctttttttaaatatgtgataaccagggtacgtgtagttaaaactaaattcaaacatgttaaaaaaatcatagaagtatttcatgaccaatctaaatcagcttggccgttaatctccctcaagttaatagcaatcagcgaagcacttctatattaaaaaatgtaagaggcgttaaataatttaaacatgcattgaggatgcacctttcttcaaatgaatcaacgacataggggaattgtggctgtatgccagtagcttttctcaaccacttatttcctagaagcattttatcaacaacatcaagaaattgaatctccgctgcttttgttacaacatttagcggtatcccaactggaccaatctcattcatcaactcttgtacctacatcaacatttcctagcaatttgaggggaccaaaaaaattgtagaagagattggagacatctcgtgcatagctaatgatcatattacctctgggggctcaaggaaactgtctgcactttcttccatcatttcagatgtcaaactatcatcaacaatatctctcctacgccgtgtgtggcgattttggaccattgagtgaaaatgttgatccattgaagcttcaagaatattgtccaacaagtttttatcaaaaaaatatggtgtatacctgaaattgtgatcagcagaagaattcatattgtgctttcaaacaaatactgaatacacctaaaggatctcctatgctttctttcctatcaccaaatagaagcatccactccgaacaagaactgctatagatggcaaatggaacttcactgaagaatccacgaatacaagataacattttagttgatcaagtataagtaatccaaacattttggcatttgacagaaatcagcacctaatgttgagtaacgtttaagaataaagaataaatcaatgttgtttggttcacaatgctgtcagttcataggaaaatgaagcttataatgaacatctgtggaaaaatatataattgcttattcttctcaaagaaacagtaaaaaatatcaagaattcaatccataccatctaattccatcattcgttgccacggcaatatttaagttttgagcactaaagacggggacaccatcaagttttttccttcttctcctttgaggaagagactttaagagcttattggcagccttaacctataatggaaaaggtaatagcctctaaatggcacgttcaaatttatgcaaaactgaaatatttcagcacaaacctgcttttcacttggaacaaactggaacatttgaggtttttcctgaaaaataacaattacagggaatatgatgaatacaagatgctaaatgtttgatacgcagatatgaaaatgactagcatagtgtatgtgtgtgtgatgggtgataaataaatatactacaagatccagagtaaaaatacatactacaaaaaataacataaatattcaggcaaaacctcatattaaaaaaatcatcatacctaccttgaaatgctcgtatgccacatcaaggcgacaagcccccaccataccacttggcacatttaggcgtttaacataagatactgaatattttaaaccaagttagctaaaattattccctgcaataactaaatgtttgaaatactaagttatgtgaaagccagtaatcagatgtatctatataatgcaaggaaaatttgctcaggaatgcaaagttatttctagaaatacaagatccaaacctgaaataactatataacacagaaaacataggccagaagaataattaaggattgaagaaaatggcctgcccaataggcaactctggattaccaagtttttggtgtatcagatgtgtaagaggtgggtcgtgggtggggttgtggggctaggcttcaggagaagctagaaaacacaactataattggttttctgttagttttctaagcccgagtgaaagcaaattctaggcaaacagatttgcgagatatttgctacaaattttgaactgaaattctatgcagtgcacaaaatctcctctatcaaatctaccccctaatagagctgttctacaaggtgcctgctgtaccacctctataatccaataagttcatgatgcatcaagcaacaagaaaacagagtatttgataacagaaaatacctgcatcattcaaatccataaagaacctaaatactggaccattttcactcttcttcaatggcgataagatccttttgaaccacataggagtcctgagaaaataaatttgaaaagtgcaattcagtagacaactaatacattatgatgccattatatgttacaatcaacaatttggattgttatcagatagtgtgagtactaagtaggcaaagccaattcaacaaagtagaaacttgcaaatgatactccctccgggttgataatatttgtcgttttggacaagagcacggtctccaaaaaacaactttgaccattgttttccattataatatgtataaaagtgttaacaaatatatgattttattaaagtacttttaagactaatatatgcatgtaatcaccatatttgaaagataatgattttaaaaatgattcataatcaaagattctaaagtttgacctcacccttgtctaaaatgacaagtattatcagcccggagggagtagtatttcagtatctgaagattttaaaaaaaaaaactatctcaagattaaaaaaaactaatatttgcatttcactgtatgcacatctacggtgcttcaggttatggagtatcacatacaaggctcaatcccactttggtctgatggtcagcaggttctagaaaaacaaaaaccaatacagcctgagcctgccatgttggcattctatgtgctggcgtcaaggtggacaatatgcccaaacgtctggtgcgagttgcaatattggcacactgggttagatggattaatcaatgtagtataataaaaccacttctaatgagagaatcaattcatggtagcggtaagcaggtaagaatttctcctagattatgtaatccacttctaagaagtgcatagtctagccgtctagcgcataattctcactcagtcaaaacaggtgaaaaaacatttcgtgtcagcactcagcagtaacgaaggccccaatctaacatagggcaacatcaacagatacactgctgcgagaaaaaaggccaagaacaaactgcgcaggaagcaaaccctccacgggaggaaatggaaatggtacctgctggcgaggaattgggggagctcgaagcgggtggtgacggccatgaggccgttcccggaggggtcgagcatggtgaacacctgccccacgaacgcggggcccccgcccttccccaaaccacctccaccccccgccttgccgcctgacgccgccgcggccatccgcgccccacggttcgactcgggggaagccgcggcggcggaggcggaggaggaggaggtgatggggaggatgagagggacggcgaggtggggagccgggggcgagggcgagggcgaggcggaggttggggacggggacggggaggggaggaaggggagggtggaggcgaaggcgtggaaggggttggacgccgacgagacaggtggtggtggtggtggagcggccgcgcggcatggcggtggatggcgccgggagagagcggcgctgctgttaaaaaagtcacggtggcgatgaggggtgggagagcgtttcgttggatttgggcttggaatctgggggatttgcgggtggtgggtgcgttgcttcggcgagggattagcttagcacgcttttggctctacctcgtgttgccttctctcctctactgattaattactctcctaatctcatctcctgtgaggtgtgagaggctagggaggttgataacttgattgatttcgagtcgtctaggattaattagctgcagtgcagtaattggttaaacgttgtttcaagtcaatgccttaacatccagattatccgtacaaacacactagttttattttgttaggtgaagctccgaatgggtcgaaactcagaacaccttttgtctattctctgtacaatacagaacatgatttcatcctgacaaataagttcgatgtcatactccatccattgtgctttgtcgaaaacactaccacagccgttgccttcaggcttcgataatcgaagcagaggacgcacctttccacggttctcaggagaaattagtatcaccacatcacggttagattgctttcctttcttctcaacaatcagcaaacggctaccatcttgatcacttcggtgcaggcagcaaagctagctaaaccactggctacattttttgactgaaacgcagcagtttctcttccatcagctaggtcaccttcataacaaagcaaccactgaagattgccgcccttctgtagggttagctcgtagtacgtcgtgccagcatcctctatgacgtagtgggttcacatactgttgtccttttatctgttctcatcctggtattgatcctaggaccggtattcctgctgttgctttttacagtctcttttctaggaatggtgcgctgtacaacccggattggtatccctccaatgtcgaaatcttctttgagagattttgtcaagaaccttatatctgtatcagatagctgaaccttcccactcataaaggcaacgaacgtcggtggccgtgctttcacctgagtgaagtacttcacttttggctgggtagctgagtctttccaggaatgtctgctcataacctgtcacggggaattcaaaggaagactaatgtaaatgtcgaagtgacataaaagactggcgatcaataatttaaacatgtggtcaaagtagagaatggcaatgatatctaataagaactagtcctgagaaaaaaaaaagaactatggaaatctgacatccctaagtacagatggcttagatcaaccactacagtacaaattgatatttctgaacaaccccctagttattccattttgcaagcacaaaatcccacctagtgaaggtaactcactttaatatgcagccatacaccatcaaaattcaatctaacagcacatatttaagttactactcccttccaagaatataaggatatctggaggggggttttttagagagattaaggttgaggtgaaggatggttgtgattggttgatatggggaagtagatggggatgtcctcaaattattggacagatttcaaactctagatgtccttgtatttctggacagaaggagtgcttgttgctatcctacatttacatcacttgccatggttgttaaggcgtaaggcgacctgaggcgatccatcctcgccttactgctataatccacactattagtagcgattagaagagggagagagaaaattagccctgcagaccagcccagaaagctcatgtcgcccacaaagcccatgccacccaaagttcaaagagatagccctaacacagtgtcaggcgagtctctcctctcacagcaccaccttgatgtcgcttcttcttccttgcgcaagctcttctcctctttctgcgctccttccctgctgattcagaatgaatccagcactccactctgcatgtgctccttccctgacttggatggatctggctgctcccctgactcaaatcaatctggtacagggagagaaaagaaaggtagtggagaccagagctaagggggagtaagatgggggatgacatggagcagagaacaaggaagaaggggaagttgctgctgccttaacctctccctctctccctctctgtgttatgcccttaaggcggagggacgccttgacccctgggagtgccttagcgctatagcgacgcctcaacaaccatgtcacttgcaattcctacttgtcacacaccctaaaagcaagttctgtaatgccaatgtaagcaccgaacacttgagcaagatgtttaccttacgcaaccaacggttcagccgtgaggtcgacaaccttaaacaccatttctcataagtatctataacctggcgcatgacagcaatccgccccctaccctccaatgcagacataaacacaactggtattcctgtaacctgccagaaataggagaagattagtatattttgtcacgtggtcccctgtcaaaatatgaagcaaactactgatatattctggtaaaatggttcactgtaattctccctttttagtgaatcaaagttatacgaaatgcactggaaaagcaacacttcatatttcataatgatattactacactaaatcattaatagatatgcaacgtgctctggaaaggtcaaaaaaataagccagagattagattgcacatttccagccattagcagacactaaagaaatcatggtttgtcaatcaagaacatggaagatccatcaaaatgaatctcaatatctacattccgtcagtagacagagcaagacatctccatgtgcaataacaaccaaaacaaagaaacttcaatcttccatttctcgtactccatcggcaaacaaagtaaagcatctacatgagtaatactcagaaagcactaaactgataataaaacatcaagcttgttgctgaaaaaactgattataaacttggcaaggtttcaactaaagaacaaataatcagaaagctttcccagaatcaattggaaatgaaagtctccaagataattagataatacttagcagaaattacacaaaagtttccagtgtctgtgcaatcatgttagcagtatataggtcaaggttgtaggttagtacaacaagaaagcaaacctggggaataactgtctggatttctttaggaacagcatctatcactttgtcaaacaatggtcggttttccctaagaagatccattttgttgacaatcacaacaagtccacgaccttcttctattgcttgccgtgctatcagaacttcagggtgattcatgctacttttagactttgcaatctacaaattaataaagatttgttatggcattggccgttaaaaatcaaatgacagcaaatgcatagacatgcaaagtatcagactggtatattcaatttaaacattgactatgatgcttctgatgcttactagtttgaaataggactgacattacaacatcaagcttacaaaaactaaattcagtacattaaacagaactacggttaagaagtaatagtattgaggaggcgattgttacaaaataaatgactgtacaaaatattactggcactggaccaaatttcacatgtattttacataaaaaggtggtggcactcgccataaatgtgaaaagcacatcaactatgatttacaaccaccaacacatccaatactagcactttagtagtgcagccccatgactaatgcaacttagtttctagcagagtacataaacaacgttaacatgcttgatgaggttgttcatcctctgtctgactctttgtacttggcaagttgacatagaacttatgcatatcaaggttaaagagcagataacccaggtgatctagcaaatgcaattggtaaagaagaacaccacaatcaattgagttattgtttattccctcaaatattcagacaaaagtcatacacatgtagtgatgcctccattagcaaatcatggcttgagaggttgaaatgttgaatagcacgccctgctcaagtgcaaatcaggattttttttttccacattccaaaggggcatgaatatatgccacattaataacatggcaccagaaacccgtagtaaaagatattcacttggagttcttcgttatgaaaaaaaaaagacacaaactacagaacaggggagcattgaaaatgttatcccttaaccatatagaaagaagcatagtaagaaatatgcaggtcattggctcagagcacatcaggatgaaattaagtaccttttctccatccagaacaagagctacaatatgagctctcatcagattctttcttgactgcaccacgctcaacgatgctggacctttctcctttcctgacctttccatccaacctgcagtgtccacctgcaccacgaaaaaaaggaaaaatgaaaatgatgactccgttcagataagtagcttgcatggacattatgatatgagctcctagattgcaccatgcaatcgcaactttgagtgaatttgacacactccaactagataatatttttaaacaaataatcattatgttctcgcaaaaaggctgtgtgacacatcatagtgtaagaccactaaagttcacaacacaagcacatatatatatggccaatacaagaaataaaagtgaaaaatataatattgaactcataaaaaggaattaccaaatatacagttcgattgtcaaactgaaactgagtccgaatagagtcccttgttaagcctgcctcggggccaaccagaactctttgttcttgcaacaaggtattcagcagggtagacttcccaacattaggacgcccaacaattgccaattgcaaaggtaacttgctttcatcaccttcatgggcttccgtctcagcctcagaggtagggtcatcttggttgagtccatctatcatatttgagtgtaattcatgaataatttgttcgtaaatggcaatacagtttgcttgagagaaagtatagcattataagcaaacacaaaagactattgccttgaactcaataggttgtggtcactcatttgttgatccctccataacaaacaaaccagttcctccagtaatgtgcatgcaaataaaaaaataaggtagtcccaactgtcaagatatcatttctacttgggcagaataaaagggacagatttaccagatgaagatatgatattgtttagagaagccttgatacctaaacattctgctaagaagaattcatcatagaggtgaatattgtactaaatgtctctcgatcagtatgacagtagaaggtaaagatgcttgaccaaggaggaagcatggagtcagtcatgttaccaaacatcaacacaaatgatcaataacaaaagagtacttactgtttgttagctgaaacatgtagtcctcaaacaatggccttagtgtctcataaagctctgccatccccaggcctgtctctgcagatattgcaactgggtcaccaaaacccaacctatgggcttctccagcagccgcagtcagcactccatgctcatcaagtgactcagacttgttcattgctacaatggtatgtatcccagatgcatgtctccgcagccattgtccaacctcaagatccagtggctgcagaccatccctaaacagagcattgctcttttaataggcaacaagtgccaacacttaaaattgactcaacaatgagaacttgaaaattgaaatcaagccatagcctactcacctgacatcaatcaagaaaatagcaaattgagatctagctaacacattcccagtcatgtcagctgttcgagcaaggatgctaccagatgttgctgctgtctcaagtccagccgagtcaagcacacggaaacggagatcaccaagcttggcaactccttcacgaatgtcacgggtgacatggtccccaggtgtattgtacaccaatgcctccctccttcgtataaatctagtttcgataatcaaaacctctaagtcagaagcaaacatttcaagagaacaagatagtggcaaacaatgcacgctgcaatgccaaagcgcataaactgatcagagtagtacaatgatgagacatttgtcagtatgtacgcagaccaaattgtggtgaatgattcatgaaatgatgaaatacataaagcttccaaggaaacgtaccaacatacttgatgtaataaaaaaaatacataataggttgcatgcgttattgcaaaatgcaaaatattagagaaggtaaatacatgctatcataaaaattaaaatgtgtatgaaaatgcaagttaagtaaattcagaaaatgataaggggtttaaatgtgcagtatcattaagatggcggcaaccataagttacaattgtaagaaagggttatcttgcaccgcgaattttctactagtaggaagcggtaagaaaacaaagtggagtaacctaaaacgtgttcgtggaaatgccgacctcacgatacacaagcaaactacgaaggggggcgtctctcaccggttgaatagggcggacttgccaacgttgggtcggccgacgaggatgacggtgggtaggagcgcggcgtccaccttggtgaagtcgaagcgggactgcttcatggggttcttcctggccttgcccttgggcttcacgggagcggtcgactcatccgctacggtggagtacacgaatccggcggagcctggaaatcgggagaggagaggagaactccggcctgcgttggggagtgggacggtgagacgaggagggaggagagggtttagggggtttggttcgagagcggagaggggggacttaccgagagaaggaagaggcgggaggcttcgagaggacgggaggggacggtggtggaggagggccgcggcagctggacggctccggcggagggcggcgcggaggatggcggcggccattgagggtaagcgggacggcgaagcgaagctgggctgggcgctgcaaaaagcaagtgcgaaaggcccaggcgcccagcgcccctgcgtgactgctttgcgtccctccgagacaatttagccgtaaaactggtgtaatctaacgaagatttaccgtataaacttatgggataacatagtactacctccaacataagatataaatatttctaactataaatatttttcataaacacaatacaaacggtaatactcgcggaattcatcatggatgcctcgcggcacatcctatcccctatgagcatatcttgagattgacaaagtcatcataaccgtcttactcgctgtgtacatgtacatcccgctattactgaaaaataattagacctaaatacgagcatttatgctaagtcgacttgaactcgagtgagctggttccatcacacggaatgtaaccagttaagctatactcactttgtcaaactatgaatcctaggactaaatgggacgcatccaactactactaaacttaagtttgtactaataggatgtgtcccatctaattttcggttcttatattttgaaatgaagaagtaaaagatagctaaaagttattatattttggaatggaagtgcatatacgaatagaggcctaaacaacatacgccttcatctgtattgtttttcttatattatgctgttattatataatacctctgttggtagtttggtttgaaacatagttaaataagcaattgtccctagaatagaaaaagacttatggctacgaatatgaacacaagatatatccaagtttaaacctagaaattaaattttctaaaatgaagatagtattgttattatatagttgggtacttgtctaagaaacatgtttagatggtgaaaacaataatatagttgagtacttgtctaagaaacatgtttagatggtgatttagttttgacagttcgtttttctgattggagataagaatttccgaatggaacaattgattttaatcatgttttaatcttgacagattgtatttctgttcagagacgagatgactacggctggtcaaacgatcacgaacatggtgcacattcatccgcttgtaggcaaatgcatccatcatataaactcgaaaactgtaaagtaagatcgtgctcttgcgtatgcgttacaacagatgctaaatttcacagctaattttgtttctgatagttcctttagtagatcaattgtctgaatgttgcaatgttgacattcaagacataagttatcttgagcatcacatcaaaacaattagacaggtacatagctagagttcattacaaggttagcagcctacaatgatcattacatcagagcctacaacgatcattacatcagacagcacctgttctctactccttgctattccagagcctgtatgtcagaaactacagccctacatcagaggacgacctaggtcacctatccataattacaacacatgtaaatacagatagatacaggagatacatagattagaacggccgttaatctatgtaaagtctcctcaaaacagacacccaaggctcaatcagagtcactgtcatgctcaaggaaacgatactcccttgggccaccaagccttagtactatggtcccggcattttcctcatgccactcaacgccttccttctccacaagctcggcaacctaccacagccatttttacagaattcaaaagcatggtacattaggtaatgagattgaccaattaagagtactagtctacagattgaaagagtaaagatcagcaacacagacactgtcaagagctgcatgctaaaagcattctattatagtggggccatatagccaccacgagatagaaagtaatataacacaggaaggtatcaaggtattcaaccaaacatttcatgagggcagctcagtttaaagaacatgctgataatactataaattaatgaagaaacgaagcatgacaacaagcaggcacacatgtgaggtcccagcttgtctaagcaaatacttaccgcgcgcttatttttcccttccctgtgccttctacaccacaaccagtaattactctaagaaaggtggctgtttataagagcacaagaaaggagacaacagtaggaccatgaagcattagaccaaatcaaagttgaataaaaaatattaacactgataatcagtgtagcacccaatcgggtcatactagaatactcacttggcatgcacacacaaatcatcatgtgaaccttgagaagcctcatggcttgtttaacatgttgcccatgcaggtcaatagtcactgtattcgttatatgcttatttctgcaaacagaagattagcacgcagatgtgatttaaaagtaatagctgggaaagttatgcaaattacctggcttcaaatatttccctgctagctctctcatcttccatgcgagctaattcacggtaatgcttcccctaaaaagacagaattttgatactgaggcataaggaagttactgagatttaacagcctatgcaaagttttaaactttgagaaaattgcagtctattggcataagaaatgttcctaaagaactgtatgctgcactacatcagaaatccctacaacctatctgctatcaccccgccttctttcttttattgaatcatcatagtcatctcagaattaacaaattaaaatgggatatcagacctcctctgcgagataggaggcataagatttttctcctttggaatatgccatggcagcctgcataggaagaaatgacaggaggcaataagaaatacaaaagatagagggtatatgataatagtagttcagattaaaaaatccctcttactttctgataatatgttttcattgtatcataatgccttccagcgacagtacgaaattcttgatacccattcccttaatgagagaagtaggtgttatatcttttcagaagtatcaaatgtaacaataacaaagcacaacaagtgacagttgaaacaagaaggggaaaacaattttactgtattaatagggtgaggcatgtgctcaaaactaaaggtattatcaagtccataaataaactagtcttaaatgaaggtcatacaattattgatcttattatatggtagctcaaacagctacacttcccagaattcattctaaagtgatatttggaagccattgaataagaatgtgaaaacatgctacagatttagaagatggatacagaaaaaattgccagaaataaaggaagtaaaggaaaaaagttcaatgtgatgcaaaaagaaattaatgatcttaacaaataacgacacaaataacagtggctaaaacaacataccattttttggtttttcttgattgttcgatgtgatgggagaattgaatgactgcagcctcttaactaccttcttccagtccatggaacttggttcatatgtgcgttgttcaggtattttgaacagtgaatcgagcacttgttgtggtgtcttagatatcgagcttgttgatcttgtagatgatgttgttgagtggggctcctcacatgcaaccttcaagtagctgttgagcaaggataacatagaaacagtcacataagtgcaaaaatagagttgaacttacagatagcaactaactagttatacaatctgcgcaattgaagtaaataaacaaagtatatgcacctacacttagcataaaatttacaggttaaactggtaaggtcaaaacattgcaagagatacaagccttgactgcaaaaaataagctcacataatttgtttgtccattataaagaccatattttagaattcctaggaaagttgcaactttagtaattaacaccatgcaatctgatgtatctagacaacttaagtttctatccgatcgactgagaatatgtcccatgatcaaagattttctattgtgcttctcgcaaacacatatatccaaataaaatatttatacaggatggggtgcaagaataatgcataggtatatccgtatattatcaatttgacgcatgagctagcaaaaatcagcttatatattggcaaattattacccaccttctctgaagctcgccccaaaagaatccgtgctcattatcggaacgattatatgacatgtttcgcatttcatctgtaaactgaataaaactataatgttagataatagttttacaggggtttaaagaacctagttgaaataatataagtatctagaaggtactaaggaacaagaaggaatcacaagcatgcttatcagactgtatgtatcatgtcaatcaataggaaatagaaagttgaattccaaatgcttgatatcacactctgtgcaaggatcattatcagtgtcaaaagtgaacaagaaaaccaacacaatttatatcattcttgtttgtcttgttagcactaaaaccacaactcagcagctcctaaaaacaagtggtagtaagtggtgtcttgaaagataccttcttatcttagaaggctgtaacacatatatgttagcaagcaagaagatacaataatacctgcactaataactacaaaattataaggtagtctatccaggtcccacactaatataatttgtaaaaaagataactactgtgacctcaataataaccactaatatatgcatgagtgaactaagaatagtctaaattttcagtacggcatatctgcatatgattgtagatagtgctaagtaaacacctggtatgaacttttttcaatgcctgcagttgacacttcctcagacagtccatttcctaggaagatgtttggagagctcatgccatttatttgagcattcgggaaacacctttccatgttttgaagggaagacatacccgagatatcaagtaatgcatccagagcctgaaagcatttcaatttgttaaacttctgaacaaatagctgaaaacttacggcatgcaattctttcagggaaacaagaggaaatgctagttgattagatttcatgcaacctagataacaatccttgctttacaaccttccttttggtttaatatgtgaaaattcggtacaaaccatcaagtttgcccactgatgggtgctcattgacccacaccaatcacttgaaagtgaacatctctcccatttcctagtatgtatcaggtagacaattgaaatcaaataaaatggtgtggatcagtgggtaactgtgggctgacccacgtgcatccctacctagatatgacaaaactttatatcgatgtgaccaacttatcatgagaacaagccaatctggtttagaatatcaagacctacctacactggctactacaaatatgattagatggagagattttcttataagaataaggtgataatattaaaaaaggattatgccaggttagatccagtatacaagaactgtgcaacacagctgtaccatcaccaccttactcatcaatgtcacaagtgaccgcaactgttgatggtatttgatgtccatcgattgtttttttgtcaatagacacaagacactgcaatctgcaaaggctagacatgttccacatgtactacggcatgtgtttcctactgtccacatcttgtgtctagcagaaaggcactctttcgcagccacagtagaccaactggaacgctattcaagaaattggtatcgtctgcgcaatgtcataagtcatgatggatattggtaacaaatgattaccaaaggtatttttcatgtgtgcatgtgttcaacatgacatcatgtaccataaaaatatttcatttacttgcatggctgttttcatgtgcaaaaaaatgacaacttatttttgcaaatgtgcatgattaatgagtggaaattcccggaatagtgcgctaacttgcacaaatgcatagttgcttgttttgagtttgggaaaagaatcaagttgaaaatagttcccgcgaagaaaagtaaaattctactccaaccaaaaggcaaactttttctattcaggacgtaaaaacatagctggaagtcactgagaaatggacccaataagataaatcctttaccttctcaacatcgcatccatattgacctgaacaatagagggaagtaacatcagaaactcattccactaagattcatttccacttccaactgactggccaatcacaaataataaaatgttaaggtaaaagaaatcttttgccctccactagttttagtaagcataaaagtgaaagatttggtattacattcaatgaaaccataaaaatggatcaactttcaacacaacacaacaccaatttcatccatgactagtttcatgacgaaaacataacttcagcagttgtgtgagtaaattatgcagcagttccgcatataaataacatttacaaacatgcagctattcaactaaatgtatagatgattttaacctgcagaacgctacccatgtatgtaagaaaaccagccaatgtccatgacattgaaaggtagaacgttgatctatgatggaaatcagtatgcttccattcttagttcatgcaagaacttagcataaaacaatcaccgtaggcaacaatctccttcacatcccaatgcttggcctaagagaacaacggtgcaccacaatgtatgttggcataacacaagtccaagtgactgatcatacaagaatcttgctctatttattcagggcttctacaatgtttcaaacaaaaaatcaatcctctgaataaccttcctataggacttcatcccaaatccaccatcacagcctcagacacatctgtgctggaagaggcatagtcaaacctaattgccacagatttgagaacgagatagacagcctattgccctttcatttcaagcattttgaaataataataataccccaactaatcaataacattttgtgttgggatagctaagattagtagtagtagtagtagcactaacgtcaaatattattgactggagggagtaataataacaattcatatagaatattagcagatcaggaagttaacacaagattcgcacccagaataagaaaactaaaaactaatcatcatattttctagttcaatcaaacaatatatttgctcctttcactagattggcttatgaactgtgcaatgttatggatggcatttggattctctttttgtaaacaagaaccaaccattccttgggggaaaaaatatatcttttgaatcgtagatgctctcctgttgtgtgtagtaagtgtttctatctttatttcattctttgatgtattataactctgctgggctcttacaacggtaaaaaaaatgcatttttttacaggtacgcttgttaggcaaaagcagcttaccgagcacgtctctgaccacacccatgccaagctccgaattatcccccagcatagagcacaggaactgctcggcctcttcaacactatacttgcggtcgccaccacttccgtccttccaagcgttgcccttccacgcgttcgttttgtttacgggcgaagtggcaggtcgcgtgtacgccttaccgatcacgtccgcaaccatcccggtcgcagccacggctaccttcttcggcctcctgctggccttcctgccaccagatccggcccgcggcgagagatccgggggccggggtggcggggagggctgcgtttcgggcgaggagccaaggatgccggccgcgaggaaggcgtcgccgccggcctcgcggtaggcggagtccacctggtcgatcgtggcggtgccgaaggcgtccagcagccacgccatgtcgcgccgctcgtcgccggcggccgacgacgacgcggtggaggccgacgacgagaaggcggagagggaggaggtcgaggccgcccccgacgacccggggttgaaagccgacgacgacgacgagcacgtggacgcctcgcagctgctgctcgactccgtctccgacgccaccgccggcgccgccgccgcagcagct

SEQ ID NO: 43595 - DNA, 889 bp, Oryza sativa
ggatcgcgacgtgttggtcgcggctgtcgctggggcggggcgcgggcgccttttctcgaacggaaacagagattcgggcgtgcaaaccggacggggaaagcaccggtgcaaaatcagcttttcttttgtctctcggggcttggttttatcccccgagttccacacacggcaggcatagtggtaaagctgcccgtccccgacacagcggtcttttctcagcaacacgatatattgacacaagacaaccaaagtcacacggtatgcctacctacaccccccacatgaccccatcgcatgcacaaattctgatgggaaaaaaaacgagcaagaaagtgagagatgtaacaacactcccgagattacgagaaagggagcaatttactagagagcgacttcacatgggagatggaaatattttacatatgcatactgctaagctagcactaccagattattgagctaagacggcggcgagcaaattacagataggaacaagatgggagttcatcgcggccaaaaagacaatcttttgccacgttgagacaagccgcacacatgcacgtttttttatcacggcatcatgtgttcgatatcaacaactaattatactactagcgtctaagctacggtttgagcacggcgatcaccgtttgtccgtagcggcgaatcggccggtccgagtcaagcgccgccgtcaccgccgccgccgtccttggtgtcggcccttccgccgtccctcgtgtcgctcatggaccgcagcaatggcgactccgaccctactacagagagagatgtcactacgttgcgtgatagtgtcactgggaggtgggccatgcaggggggtgtggtgatggctacctttggaggcgttgaaggagcgcttgcagtg

SEQ ID NO: 43596 - DNA, 10950 bp, Oryza sativa
tgcattgcactgtaaacaagcaggcgggcggtgtcagagctaaaaaatccttcggttggtctaaagatatggatattttatattatggtgtgttattattataagtaataatctcataattcattaaatgctgtaggtgagaggcaaacaatgtgggttgctcctagtcatgacaacgatactctttttgtgggcaatatctgcaagacatggactaaagaacatgtaagatgctgaaacagtttttcttttttcctattctgttgttacctgaataataacttatttgggcatgtacagctgaaggagaaactcaagagttacggtgttgagaattttgatgatctactattagttgaggacagcaataatccaggaatgaatcgtgggtatgctttacttgagttttctactcgccctgaagcaatggatgcttttaggcgattgcagaagagggatgtagtttttggagttgatcgtagtgcaaaggtttcctttgctgattcctaccccgaagttgacgatgaaataatggcacaggtaaccacttattttggtgcttttgtttgttgatgttgcaaatttgattaaatctgttgaatccttattctggttctttggttcaggttagaactgtatttattgatggccttcctccctcatgggatgaagatcgtgtcaagaagtaccttaaaaaatatggagctattgagaaagttgaactagcccgaaatatgccagcagccaagagaaaggattttgggtttgttactttttgatacacatgataatgctgttgcatgtgctgatgggataactaattctgagattggtgaaggtgacagcaaggtctgtttccccaactgagtttgatgggtcttttttactgtctactcattctgttggacatgaactaatattacacaacaccttgctacttgatggttcaggcaaaagtgagagccagattgtcgagaccattgcagagacctcctagaatgaagcatggattaagaggaaattttagggttgggcagggtgctcctcgaggtggacgttttgcatatgatcgtcctcctccacttcgccggcctccacctcgtcttttaagacccgatgttagtcgcttaccaccaccggtcaggagccgcccactgaagaggccagtagatattagagataggcgccctgttatgtcaataccagatagagttaggcgtttgcctccacccgagagatcatatgacagaaggcccccagtgtgcagatgttatgtgcaatctattctctctctctcttcttttgctgtgcaaaccactgtaggtcactttttcatacttcatctgtttacagctcctgtgtacccaaagagaagcccaaggagagaatatggaaggcgtgatgaacttcctccgccaagaagcagagctacctttggtgactatagttcaagagttccagtggatagacgcccctatagggatgattattcaccccgggggtcagcctattcggacctaggtcctcgtagtgctccccgcctttctgataggcgagcatatattgatgatggttatggagggaagattgaccgtcctttaccaacatatagggagggccgtggtcgtgattatgatacaatgtctggttcaaaacgctcatatgctgagatggtgagggcagttaattattgttctcttgtgtttcatgctttctcctcatattcctcagccaactaagacattgctattgttatgtcaggatgatgtgccacctcgatatcatgacattagtgttcgtcagtctaaggcacgcttagactatgatgttggtggcagcagtgcccggtatgcagatacatatagcgagaggttggtgtacattttgaaatgttccttctctttgcttatatatatatatattttaatatcttacctgtacattgcttgtttttgaaggcttggacgatcacatgcgggatacagtggtggcagatctgtctctggtcatgatccagtgtacagtagtggtcggcatggcatgagttatggaggtatatgctcttgaacgctctgttgtgttagggtacctgtgctcacgtgctcaatatatattagatatctattctcacaccatttggtgtttcaccttttcaggttccgcaagcagtaatgatgctggtggaatgtactcatcaaatttcagtggtagctacatgtctcgtgggtctgatgtgagtcttcatcaaaatgttatctccagctcattatctatatcaatttttgttggcccaagctttctatcatgttggtttccccaatttattcatatttctctttgtgcaggttggtggaagttcatattcatcactttactcagggcgtaatgtaggtagcagcagtggctactatggcggtagtggttctagttcatattactgaggtgcgtgttcaatctgaatctgctctgtttctccttgagtttaaaattgtcctgcataaaattttcattgatgtctcacaccaccaccaccaccatcgctgccatcatcgtcttaactgctcacttcagagaaggcaaatgcttccccttctatcaaacaaggaacaccctccgtgatcaaccatgaattgttttgatggtacagattttgcatcatatcggctatggaacacacatggcaccgtaggaggttggtgtaggccccggattgtatggagctccttaatttaaggcctacggacctggacaagaagtggcaattgtgtgtggtgctcctgaatagacatgatcaaagaagtcagaaacaccaagttggttaaagcaatagtcttgtggatgttctggctagtttctttaatgtaaggctttgctttatttggtcaagaattgtgaacataatcgccagctatggtatcttggcatgtttacttccagtgtttctaaacatttttgagagatatggagtgtttcagtaaaatagtattatgaggtagttccctgaaatacatggtgccttgaagatctcttgtgatgtgctggctgaagatcagacttacaaatgaagcctaaaagggggcgctttgtgtaaggctgttacttctgaaacatttggcatctgctctctagtggtttggtaatttgctgtgccaaaagatgattggtcagactgaaactctggactatttatttggtaactgctgaaaaattggatttgttggttgctgaaattgggagaaaccatttatatggctcaaagtagttctttcaccaagcgattacctaggccttgccataataagtttaagataacagaacctgcagttacagaactatgattatggtcttggattgccgctgttgattagcagcagcatagaattcagggcacccaggtatatctaacaagcaatgccatcattgagcacaacatttcacttgctactcgtttctgtaatttctgtcaagtgctgcatggagcatggataatatatctttgggaaagaagtggtaattggacaattgcaaactttgaagaaatttgcaggaagcatgaagcatgatgcactgactaaataagtttcagaaaaaaataaatatggttttgctatgacacctatgtttgatttaccatcatgataacatgatagttatggtatatttgggccctttatcccattagatggagatatatttgggccaaatttcttacaaccaaatttattttgtaacaattttttgtaaatagacaattttaccaagatattaacgcattagggaacaagttctctgttgatagctataggcagtagcggatgcaatgtgtgttctagtgaattggtgaaattgatggttaatactaccaaatacgaattacacagtatacagagagctgcaacaaacctagcaaacttgttagtgttaatacaaccattctctgaggtataggaaggagttaatacagtaagtgactgcattgtctgaaatttactcgattcatcatataagtgataataaccattattggatcctgagatcaaagtttgcatttttacacttcaaatttttatgtgtgtactacatttgccagcccttgcagtaactagaaatgttttaatatttctatcacttcctgtttagtgtgtttgttggagtaggatcccataagggcaacccacaattatttcagatcttggtgaactgcattagtttatcatttatggatggaagattgcactatccagcacagagagaaggtatcggtgaattcggatattggattgaaatctgagggaatcagcaccatgttgttggataattaggtgcctgtctaaaatagaaggggaggaggggaaggaagggacagttggttgaatttagtggaatgaagatagccagaaaacagcatgatcataattttacaagatagactatggaagcatttttgttcaagtagcaaatgcaaagcaacataaacgatttgtttgagggcctcgaattggtgaacagaaaacttaaccatacagtttagttgattatttcagctgctttagctacaaaactatactgatttgaagtagaaaagaacaaatacacatattaatctactacatatctattgaattattaatatttaatacaatgcatcttttataccttatggtcacaaagtttcattgcattcatttagttcagtactacttttttggtgatggtatcttctaattttgacatctgaatagtttcagtagaatcaactggcacatatattttattagttctgaatgctatagtgtatctcttgttgatgtttatctcagttaaatcatgtctaataaattcattttatccgcctatttttctgctgtttgcttggccaagtactggagtactttattttttctcatgtggtgtgagatcgatttgatactgtagcggagcactggcttggttgttttagaagatgtgctttgaccttatactagtagatagtgcagttgttatacaagatgctgcttgttgctgcactactatttcgtccataacctggaaggaactgcttcatgagaggtatactaaacgcagatcagagttccttttttctcccttcttttttctacttttcagatttgtaatgagcattgtaagcaagggaacggatttcatgtacaggtatgaaatggttgcgttgagattgcatgaaaaactatacttgattgggcctgtttgtgtctggctgtgatgatgtgctccgtatatcttttgcttgctatcgcggacttgtggtataggctatattcacagtttcatcgggaacgtagtttgcgtcgccacagccttgtcgaagggggttgattacttgaatgtcctgaggctcagctacggccaatgtgaatttgtactgatgatgcttcagcccccatggggatgttactgcgttagaatgcattaaatcatttgaaggtctatataggaatgcatcttacgactttaaggccttaggccattcacaatgtggcgtatagtttcgggttgccatctcggagattcccctctagagcagctgtgttcgtgtgtcgctgcgatgtcctacactcatagcgcggcgtgtggtttgagggttgctagatcggagattctactacatatcagattatcagccacgggcgtaccctcacgaggctactcttgttgagggcacgggtggcccggccgtggcaaggccactcgagcgtgggaaagggctcgtgtgagccgtgttggagcaactgcaacatgggcctaaaggaccacttaaaccgccggtcacactgtgctatagagaatcggaatgaaaaaagaaaattaactttgatacgcacgtatccaggctcaacaaaccaaactaaaatggacccaacctaagttgaggaaacactcttgggctacacgggccacagtgctgagtggtcttctgtggcccgttcgaatctacttaaaatagtggattaaattttggattaaagtggcacttttttcaaactgctaaacggtgcattttcgtgcgaaaactttctatacgaaagttgttttaaaatatcagattaatccatttttcaagtttgtaataattaaaacttaattaatcacacgttattaccacctcgttctacgtgaaacacttaatcttcatctttatcttcagaagatttaaacaccattgtatccccagcccaagtgtcatcaacaaataattccattgtacggttgtacccctcgtgtctgtttcttctccctccggttgcttcgtctcttctccctcacatcgcttcgcctccatctgtcagcgctgccatcgcacggtcgaggctcaacgatgaggctccgaagtggattggagattgttggccctgggctagaagctcgaatttggctaaggtgaggaggaggaaggaaggtgggaaaacatccatctccagcgccattttcgcctgttgtagcttctcctgatgggacggcccgagctcctcgtgcaacaccaacatatctagctctacatgcaacatggggacgagaatgcaagggtgggagcaaccaaatccgagcgtgagaggcacgaatcagtggggcgggaaggtgattttggggattccatctccgaagcggcggtgactcagagccacaaccttcacagcgcatgtgcggttcaagttccttgcggcacgcgcactcgaggcggtcgaagagcgcgcctcccagataaggggcgagcggctcagcaggggcgcggacggagtcaacacattggcgcatatccacataatttgagaatatattctctcacctctcaagacacttgtaggattagcttgcattatgaatgaccttagaattccacaaattagctacctagctctcgtttagagtttaacaattagctacctagctttcgttgaaagtattactagttcaatttttcatcctatataaaattagcttatgccaaaatttaaattttaaaaaataattttagagttaattttacaagtttttaacataggttttttagcattagcttttaaatcttcaaggacgtacaaacataaataaagttgtttagcatataatcagctcctggccaaaaacggggctgatggtaggacactactaggtagtttgtcccgaagacctgggtgactggttctgtgttaatcctggtatcttctctgatttttcgggttgtcatccgtcatcctaccgatgatagcttgttgtttgtccccggtgacaggtgacatggttggctggttctgttaaccctgccaccctggcatcacctgtaatttttcgtgttgttgtcatccgtcatcctactgctactgatgggcaagtgggcggagctccacgcccgcggcccgcaccagccacaccctaccccaaggcacgtcgacgacgtgggcggcaacgccgtgatggcgtgggtctctcgactctgccccgatcccgatcctgatcgaggcggccgcgtcaacacgccgcccgccgttgcacggtttcactcgagctgcgcctacacgccatccacggcggaacccgcgggcgccgcgccccggctgccgcgcacggcacgcgaccccgcgtgaccgcgactcgggccccgtcggtgcggccgtcccaccgcacgcgccgcacggtgaggtgacgtctcggccgctccatcctccgacccggccgcgtcgcccacgagaacgcgagcggtgggtcgcgccgcgccgctcgcggcgtcatcgccatgtgggggtctcacatcacggccgcgtcggcgaaaccacgcggtcacacgcacacacggggccccaccgccgcgcgccgccgccgccgcaccgcgcgccaccttgccgctcccgcacgctaccgctacccccttcgcgcacggcgttacaccaagtcgcaccgcatgccgccgctcccggcaaacggcacccccacgggcgtcacggcggaacacaaaactacggccaaacagtaacaaattgtaccatttttcttaaaaaaaacactatatccatcctaaaatataataatttttagcctttttataatttatcttaaatataatatcttctacacaaatattttcttttcaaccaattaaaattctttattatttaattttttcatatatcttttctactaaattattataatttttcaccacttaattttatcggttttcataataaccgtatttaactttaaaatctatatattctagaatggaaatggtaagatttgatacaaatcgaattatcctattcgatctgacggctagagtacctgtgggctcaacaaaaaaacacttcttttagccacgcaaaaagtcgaaacacgaaagctagaaaagaagaaaacggacacgaaactttaacgccgagcgcggctgcgccgcgcgggggtgtcgggtcaagatgtcaacccccacaacccgcggttggcgccgccgccgacgccgcccaccgccgcccgcgtgcgcccaccgccacctgtcgccgccctaaaaagactcctccgttataatcccccctcaccgtcccttcccccaacctccgacccacaccaccaccaccgcctccgcctccggctccgactcctcctcaccaccgttgcgatggcttcttctttccccaccaacgccgcggccgccggccgccgcgtgccgccgccgtgctggacccccgacgagaccctcgcgctcgcccgcgcctacaccgcgcgacgcctcgcggtgggacgggcgcacctgacctccgccgactgggcggccgtcgccgacgcggccaccccgaccaagaccgcgcgccagtgccgccacaaggtcgagaagctccgccgccgcctccgatataagcgccgccgcccctgcccgctcctcgacgcgatcgatctcctcgacgggccttccccttccgcgtccccgtcgcaatccccctccccgccgccgccagcctcgccgccgcctcttcctcccgctccctcctccccgcctcccaagaagaggaggctgcctgatggcgatgccgatgccgatgcggaggatgacggggagagcgacgtggtgaaggcgctgagggcgatcggggagggtttcctgcgggcggagcagaggcggatggaggcggcgaggaagacgcagcagatgcgcatggagatggcactccggcacctcgattcgcagcggaggctcatggaagcgctcgtcgaccgcatcattgactccctagagtaaatctcggtggcgcaaaggtgtctcctgtcaaggttttcttgcttgtcctgattgcccactggcttggcttgcgagtttaggagttaattagagttgttcatatgtactgtgatggatgtctgatgtaggcgtagcttggaaatcgtagtaacctttctatctatcttgtatggcgtatggaaaataataacttagcctgttctgtgtttattgttttgtctcaagctttaatttgttcaattgtgtgtggcaacctaatttgaagatatctgaactctagaatatagtagaatttaactgcatctccccccagacttgcagtttctgaccgccaaaaatcagttattcctgttcttttgcagcttgtcgacatggttgatacctttgtgacaactgcccaagtagtcaattgaagccctaaggaggtgtttggataatgggttaagggttatgaggggtgggattgggaaatggaaatgaatagagggttgagataaaatgaggtgagatgaatgaatggtcaagataaaaacttacatgccctaacagcagattatgtaagcggaagaaaaaggaattcactggaaatattgatgttgttgagctttgggggtatcctgattgtaccagatttcgcttttcatagcagaaaatttttccagcgacttggatttagaattcatttgctaattcgtccatccttactgggttggggctgatactaactttgtaaaccgagaggcagaactacaatctaaatttttttagcccaagcaagttctcatgtcgtggtctcatatttatagttaagcagagcataatctttgttctggatgtcattttgttggatagatctgaatatccagtagccagttgaccattacatggcacagttgtacacattgttctgttgtgtcatttgttgtatgtcttcattctataactctctaagtggttatttcaagcagttgcggaaggaaaaagcagtagtgatgttcaaattacatataatgtttttctttgtttcctgatagtgtgcactaaataaattcatacattagaaaataataaatagcacctatgttgaatgcctccagaaaattccatgcaaaatttgactacagagtgatcaaaagcaatagataccaggaaacaaagaaaaacatactgcaatcaaattttgagcatactgtttttgataatcaaattttgcttttttgataatcaagttgatctattgcaaaacagaaaacagagaaaacagaaaattctcttttttgtagaacaactgtaatgttgagcatactgtttttcatatcaagataccatgaggcctttctttagggcatgttctactcagaaattgttggccgtcttacttcttgccattaaaggtaaatttattctcttcccacttgaaattgtttaaacttgcttatatacattaatacatagattgcttcagtgagattctgtggtgctcttctttttgaaaatattgcggtgctcataagttgttctcttttttaaaatttgaacactgcctgcaaccattattttcttgactgaaccaacttgagacaattctacgcttgattagaacttttattttgccacagggttttcagatcattgatggtaattgtatctattttgtctgtgtttttgtctttttgataaaaatc

SEQ ID NO: 43597 - DNA, 21741 bp, Oryza sativa
tcacagtcctgcatgtacactttgagaaaaaaaaaagttacaagccaatttgcaagcacaaaagcaggaaaagaagagtctaacctaatgcaaaagcagcttctcttttgccctccatcctctttagattcgggaccattctggagacagcctaattgccaagctagttagctccaaagtaactcctagatcaatgtattatgtgctgctattgctaagatatgtccatattggcatgatgaatcatagcattgacagcctcattttcttctgcagagtatgtggagtgcaccccatagcagacatagaagactatgatcacaaagctccagaggccaaacctctgaaatgacatcaccttgagagtggtcatcaggaacacattcaggaagacggatgcagccgccggccatggcatcagagggaccatccactctgatggtggctctggcatgtctcgccgtaccgcgcagtggaacatggcggtaatcgtcacggaggtggcgccgaacaaagccattccccatcggcattgcccatggatcctcctcgagagggagaagccaagggagctcagtgtaaggatgagcaggaagaggaggacatgcagagatcggttggcacccagcttcgcgtatcggtggtagatgagcgcgttggcgaccaggtagaagaccaggagtgttccgattgatatcatctcgaacactacctgcagctctgtgaagagtgcgattgatgctgtgcacaatcctgcgcatagataatggtgatgatatttgtaagagcagttcaagaaatgccagaaatagtattgctgctagttatgaattatgataagttgtaacctgcaatgacattatctaaaaaaaggtacctgcattgcagttttcatgatctgatacagtggtaaggaccttgacttcggtgaagttattagtgtattttatgcttccgtttgctctatctaaattaggtttattatgtaggttgcagggggtctaacatcacataaacccatcagttcactactagtttacctcatttgtcagatctttgcaaagctgtactgccttcaacttttctatttacatttttgacatttcacggccttcgagacataactttgaccaatagttctcgtaatcttatcacagtacatttaacattataatatcatataggcatttctagtggcaaaactaacgaacgatacaatctttttcccaaaaaaactgtgaatacaatcttcattaactaatttagggtttcaaacatataactggtttatgtcaaaattaaaaatataactggtaaaatcgttgaatgttggcagcaagtaaaagagaaagaagatagtatctatagcaagctcacaatctccacaaattttaaccctccacttctaaactccaattgtgaaatggcataaactgcagatgtattaacactaatcactctatctacaacctctcaacctctttcaaccagaagagataaacaacaactcaaccacaattctacaaaaccttgcaaaacttttcttaaaaataaaaacatacaaccttatgaacacataaataccagtacgtactccaaaagttgaaatcaatcgatccgttatatatatagattaactacaaatctacaagttaacaacaaccttgtactgtgttttgaggtacctagaaagatggtggcgttcataggagtgccggtggaagggtgcaccttggccagccacgccggcaccagccgcgctctggcgatgacgcacaggtacctcgcctgccccagcatcgccaccagcagcgacgccacgatccccaggctcgccccgggcccgacgacgctccccggccactcccaccccgccttctccctgaacaccgccgagaacggcgcgctctccgctatctacacacatacacacgtacaccccatgtcaccatcagaatgatgatgagctagtaatgtgtcaatgtgagtgacaatgtgtgtctacctcggtgtagggaagcatggcgcagagggcgagggacatgaggcagtagagcgcggagacgacgaggactgagccggcgatgccgacggggagggcgcgggcggggtcgcggatttcctcggccatggtggacgccgagtcgtagccgatgtagctgaagtagacgatggcggcgccgtcgaggacgccgcggacgccgtagggcgccaggccgtgcggcgacaccaggttccgcgcgctgccgttccacaggccggccaggatgatgaacacgaagaagagcaggtggaacaccgtgatcaccatgttcagcatcgcgctctccttggtgcttcacttagcatcacacgaatccatccatcaaaaaccaagtaccaaccaaccatcaatgctgctggttgttgatgaattgcacatttgaaacgcatttctcatcttcttccaaactatactgacaaacgtacataatcaaatcacatgctgaactctagcccatggcaaggggacattagctctattctgccagtaccatgtctgccataaaatataggatctaagaacacaaaaccacatgcatgccgctgcgcctaattaaatcaagctagctagggtaggttaagtacacaccagtacaaaaatgacaaatcgaagaagtattattgagtcatttcacccataagcttaaggtaacgaaaaacacaaagcgattcacttctacttaataaacagtttttatcaacggatcaatgtccgtgtaatcaaatcaaatgcgactcaacaatgatctgtagtatgtgtacctgtagcacaagcagagagttaggacaaggatgagcgcgacggccgggaagtcgagcgcgttgtagcccttggcgatgccgtcgacctggatcctccacgcgtccggctccgtgatcccgcacgtcgaggccaggtagtccgtgaagctcctcgccaccgccgcgttcgacagcacgtactccatcaggatgttggctcccccgaagaaccccaccagctcacctgatgagagcaacagatggagtcaattaaccgcgctcgatgaattgatccatcgatcgttgaagagtgcgttggattaattcaacaatgtccctgaaccgtttgcacggcgccattaactgcggattttatggtggcgcgcgcgcgcgcgcgaagaggttaatggcaggcacacacaccgaacgttacgcggaggtagctgaaggcgccgccggcggcggggacgcggacggagaactcggcgtagcagaaggaggagaggagcgcggagacgccggcgatgacgtaggaggcgaacacggcggggccggcggtgtcgcgcgcgacgcggccggtggtgacgaagacgccggcgcccagcatcccgccgacgccgagccccacgaggtcgtaccactccagccgccgcttcatccgcgcccccgacctgtccctcacctcgctcgtctcctgcgccggcgtccacgtcaccagcgcccgccgccgcagccggtgcggcgtctgcgcgatcgacagcagcacgtcacgcagcgccgccatgactactacaccaaccaattaacctgcaaactaatcaagctctctcccactgtcattacagcctgctcatggtttaacttcttcactgatccatctcttctcagctgtgctagctgctagctgcgacgacgagccgcatcgatcggagattcatatatatatgccgcgacgcgaaagagcattcaatattcgaattcagtgttttatttggacggtgggaaatgaattgaagtctctctctgctcgcgctcggacagcacatatatgtactgagtactgactactgcaagtatactgacctagctagctagagcttgcatggagtatgctggagtagcttcaaattaaggcactgtcttttgcagcttaatttccaagcagcctctgctcactggctcagtgtccacacatgtgttcagctcataggacacatgaaagccatatttgcacatgctctgatgctcaacagttggggtgtgctaaatgcccttctctgaaacaacactgtacacccagtccaacgctgaacaatctaaaagtctgaactatatacagttgaaaaaatttaagtgatctgatctctgaagtctcctgcatgcagaaattgctagcagctagctaggtcgctgctagatactgctgtactctatataattcttcctccattttaaaatataagtaagcatttctaacgatgaatatgaaccgagctgaaatgccaaaaatacgtagaaatgtttatattatgaggattgctatggtacagcaggttgtaccgggcggtactggtaccgcgcggtaccaaaacacatctaaccgttgaatccgggatgggtaggatcgggagagaaaagatgagcaagggtggatgagggagtacctgtttcgagtcatcgttcccggcggcagcggcgtccaagtcgttgtcgttcccggcggcggcgcagagcaacaagggaacgctggcgacgtgggagaggataaagtctggcggcggcgcgagagagaaaaaacggaacggcggcggcgcgggagaggaaacaagtccggcggcggaagaggaacaagtccggcggtggaagaggaacacggcggcggtggcgaggaaaaagaacacggcggcggcggcggcgaaaatcatccagcttcgctagggttcaagccgctcgatctcgatccagacccatcaattgcacgcgaaattacaatactgcccttccaccgattatcatcactcggtaccgcttcggggacaaaactggtaccccgcggtaccgatctacgccagccgttcgatctgtctcgatccaacggtcaataatcggtaccgtaaggtaccgttggactgtaaaaatcctcttatattatcgaaacagagtccgctgtgactgtgaccatggaaattactccgtaatcatggctcctcaaaagctaatgtgttgtctgcttgctaacaaatgaagctcacatggcatgaggttcagacttcagaggtacagacatgtagatgcctcaagtagctgtttgtaaatggtgatcaaatccatgcatgcagcagagaccagatatgattcctgtctcctgatgacaactggtttagcaggtaagattaatacctaaccacaagcaaaggaggtcaaatctacatgagccctataaggaggcagcgagagagatgctataaacatgatctagtaggaaacatctcatatgcatgagcatatgccgacgtgtcgacaagccattcacacttggtgaaaattattaagcaaaaaggactgtcaggtaattagatctcactcatccattgaatttattttatttccagtagtttcacacatgtgcgcagttacaacaaagtatcaaagctgaatccaaattaaaaggacgaaataatattgttaatggataatcaagttgctctatctcctgatcatacataagatgagcaaacattatggaattcagcaagaagaaccaaagcataaaagatggtcatctcccataatcactaggtttggcagcatgccgaatcaaatccttgacctggttaggtatattaaacagttgataaaaagtgtccaatcgagatagtatatgataagcggaataaaactgtggaataaaagtgattctttgaatactgatccaattccttgatcaactttacaaaagcacgcgactttgtagacatagtgatatgcatgaggatagctggagtacattaaacggcatgaacgagaggccaagacaagttcagagcagtcaaagattcagagagcaagcataaaacgatcgaatagccacacatcaacgcgaggacgagctgctgcatgaaagcgtcagaattattcagaactgcagatcgatcggtggaatactgtatgtaattaatactcgatcgagtaaagattatatagctaaagattagctgtctagctagctgcagccttcctgcctgagcggtctaagcactattcgcgtaggatatgcttatgtaaaaagggcttaagcagcagctagctggcactatatggggttcctgaagaaagaacaacacaaggtatcacacttgacacatcgtctgccactaatggtggccttgatggaaagagagagggcggctttgcaactgctaattaatcattttgatttgtggccagaaggctagcatggaatcatctgttaatcaaagtggagggtgtaggttagatgctacaggtctaggcatgcagcctagcctgtcctttaatttggaatagggataatgaggtgtatgatagtataaatcctaatccaatcgcccataccttgaactcagaaaaggttatgccatgttcatgtgggtgttcagtatatatattgagaaaagctgagattgttcaggcccaattgcccaaagtcaaataccatctggattttgtattatgctgcagaggccaagatgtaatcctcttccttattgaaaaggtaacttaagcttatgtttacaactaacaaaatatctgaacatcaataatattgcacacaaatttaaaaggaagaagtgttggagaacaattcattcccatatcaaaatcatgaaaaaattacccatgtttgaaacaatgcctggaatagaatgtatatttcattgcttactgaattattccattgtctatactcctttaaaaaggagtagtagtagcggtgaatctttttttagataatggattaaaccggtctctacacccaaaggatgtacacagcctagtagcggtgaatctgtcaccccctattgctatattgttcaactattgcaatcaaacaacgacagggcttagctctggtgagtcggtgagaaaaaaaattcattttactactttgaactatttcattggttcacttagccaagtaaaactattttttggcctattttacaccctgaactattaaaaacggatcatattacttcctaatggttcattgcaatgaaatttggtaggattggtaggtacattataacctacctcacaatattattcaaaaaaaatcgttactatatacaaatatttgaagcactaagcatgatttaaacaccaatggatctacaaaattttagcttttgaaaatatttttgaactttgataatagtgttatctatagctctacaaaattgtagtttaaaatgcgactcatgtaaagagaatcaaatatgagaaatgctatattaagcaataaagtaaactatttttaatagtttaaaggtaaaatgaaccaaaaatagtttagttggtcaaatgaaccaatgaaataattcggagttaaataaactcttttttttttcaatttgtaatcatcacaatggtaaatgggccatatttagtgggccaagataaacccaaattccaagaaaagccatctccttggtcaaccttgggcctagtagaacaactgcagcccaccgttctttccgttctccgctaccgctagcttcgttctccgctgcggcagccggcaatcgcacggcggaagcaaaacgaggaaaaaatggggagctcgcggcgaggggaggagaagggactccctgttcctcctcctcctcctcccaaccctggtggtgtcacttcaagacggcaaaaggaagcagccatggagatcgaggccgtcggggccgatggtttgtgcccttttccccttagcatagctgtgtattagtaactcgttcgtgtccctgcggaacggaagaactatggttgggtagtaacagcttgtcgcaagatctccggttattgttgcggcggcgcggggtcggtgccgtggattttccattcgggccgcaaagagtcaagagtgttcttcctgtaggtgcgccttgtgattgggcacaagcacaacagcgtcaccatggatctttgtgtgatttggtggaggtggaagctaggttggttcttgcagtcactcaaagaatgccaaggaggaaactgagaaaatgtatttttgtgcttgcagtgtaactgctctttcttgaaatcagatcagatgcatatatgtttcacaatatctatccattatctaaaaaaaaaaaaagaactgattctgtccatgtagattcaggggaatactattctgagaactgcatcccaaagtgcattgacttgcccttaattaacctccgaatatgcagcttcagcttgtttggttttattcatcaatcttgtttggagatgtatgtgtgctttcggtcttcaccaaactccaggatgataatccaactcgactttaattaaaacaaggacaatcaaaaagaatgcttggtagttgaggactcgaagctcccatggagataggcaagtgcttattgcatgcttgtcttggctatgaggaagacatttgttgatcctcacctaacattctttcaggcaatcctatgcttgcacttataaacgcataccttcaggcatataagtttcaaacttcatacgattgttcaagtgacactattgtcatggctttttgcaaaccatgtctagtattctatctgtcttacttttctgatcctaaatggtggtccatctcatgtacttgcaaaggtttttatggtggtgatggaggatgacccaatcatttcccccaagtcaagccaaaagaaagtaatgtacgtgacttccatttaggaatcctgttagtttaattctttttggaaaagaacatttatgactgaactttcatccaggagaggtgaggaagctcagaagtacaaggcaatgaccacaacgaagcatgatatcttcctggattcatttctcccagctggatcttacaagaagctatacagttacacccaccttctcaatggctttgctatctatgcaaaatctgaaaaggtgcttctatttagttgatcttttatctgcttacctgtttatgaaatatttatctgtctttgttgtatgtgtaataggcaattaaaactcttagtggagcaaaaggagttagactcatccaagaagatataaaaatggccaagatgaccacatacactccgaggtacattggagctaatgtagtctggccgctcctcggtggtgccgagaaggctggtgacggagtagtcattggcatggtagatactggcattgaccccagcaacccaagctttttaagcacatcggaccaagcaaaaccaccaccggccagtttcaaaggaacatgtcaaactggcgaaagatttcctccagattcatgcaatggtaagattgttggagctaggtggtttgcacgtgctggtcaagcaactggagagttcaatgctacaatgcactatgcatctccttacgatcctgatggccatggcaggtgcatgctcctttgctaacaatgctaatcactttttctttacgacttgcctatgttgcatttttaatttcaaggacttaccaagtaccaactgatcaaaacattgcctacacagccacacagcgtccactgcagctggcaattttcatacgccagcaatatcaaagggctacaactttgggcatgcaagtggcgtagcacctggagctcagtgagtgaacaatgcttattccattcttcagatgttcaaagcaaaactactcttatgttgtgctgtctcttctgattatgtgacagtcttgcaatctacaaagctgcctattcttttggtggatacatgtcagatgttatagctgcagttgacaaggtttgtaaatcatacttctttcataactactattctcttccgtaggttaaaatgccagtgtaacttatatgcaggctgtagaagatggcgtcgatattatcagtctttcactgggaccaactactattacatctgggccagcatcattcctcaatttgctcgagacacaacttctccttgccaccaaggctgggatctcagttgttcaagcagttggcaatggaggccctgatgcaaactcagtagtttcgttcagcccatggataacaagtgttggggcatccacaactgacaggaagtataacaaatcaattataattggaaatgggcaagtcttctcttgcggcggcctatcacgtaattcatttcaacctatgaaattaatgaatttggagccttctcaagttctagtgtttaactgatgatactaagttccatacttctcttttctttttctttcagaattcgtagttcattttgctcttagattctatatgtcctagattacatcatcattctgttagggttgcactgaagtagctagaaaactaacattatactggggctttcttcgtttcaatttcttcacctggtaccaattttgtttcaacagtcttccttgttctgtccagcatcgacaccaggcgagaccatgtaccctctagcattggctgatgatgtgtgcaacacgaattcaactggtggatcttccaactgccaagatccggatgtcttcataagatctcttgtccaggggaaggtgattatttgcatgtttgtgtcgtcaaactactacgaaggcgacttccttgctggcattgtcgatacgattcagaaaattggtgctgccggagttatcatcactgaccgttcttcgagtgactccgacattgaatatcatcccacatttccgacgtcaatcccttcagccatagttgtgaacagtgctgatgcacaggtgattgtagaaacatttttgcagaccaaatgatttgctaatgcccttgttcagttttactattctcttatgcagtaactgggctctgttgtgttttgcaaccggatgcaggctctattggagtactacgacgacaacttggtccgagacaaggaaggaagtgtcaccaagttcggcgcaaccatccgaattctggatggacggcgagcaatctacaccagggaggcgcccgtcgtcgccgagtactcgtcgaggggcccggacgtcgacgacatgcagatgcaggcggcggacgtgctgaagccgaacgtcatggcgccgggccatcacatctggggagcctggagcccgacgagcgacgccatggtcgagttccagggcgagagctacgcgatgctgtccggcacgagcatggccaccccgcacgtcgccggtgtggtggccctgatcaggcagaggcaccccaagtggagccccgccatggtcatgtcggcgatcatgaccaccgccgacgtcaccgaccgctccgggaggcccctgatggcgcggcgtgacgggggcgtcctggagcgcgcgacgccgttcgacatgggcgccggggccatcaacgcggcgcgcgccgtcgacccgggcctggtgttcgacgccgggtaccgggactacctccagttcctgtgcgccgtgcctggcgtggacgacgccccggtgctccgcgcggtgggcgtgccctgcccgccgtcgcgggcgcggtggtgctcggacctgaacgcgccgagcgtgacggtggcgagcctggtggggtcccggcgggtggaccggcgggtgacgagcgtgggcgcggagaacgaaacgtacatggcgcacgtgcaggcgcccgacggcgtggcggtgcgcgtgtcgccggacacgttcgccgtcgcccccggcgcgacggccacgctgaggatcgtgctcaacaccaccgcgccggggaacaccttcagcttcggcgaggtggtcctcaggggcgacaagaagcacaccgtgaggatccccctcgctgtcttccccgccgcggcgttgagcccgtgaagccccgaacagggatagtcctggtatatacaaatattacttacgtatacgtatgcgagcggatggagttgtacgatgaatgaataacatgtatacatacactatactcgtgttcgagcaaacaagaatacgagccatgtatcgtataatcggatattatgggccgcaacggaccaaccggactgtgcccctgctgggttattcctctagttgggccggagcacggaggagagctggtcagccataatgggctttcgttctgatgcaaagcaacggcctctgctaacttcggcttgtcgagcatctctagcagcttttgccagatgccagactaccatggacgggtttgactgtggcttctctttttaatttttttgatttgatgtgtccagtgatctaatgattgtttagcattcttaacgatgatattaactagaagcatacgccatttacggatacggaagtccacgtcgcgtgccagcgcgctggctggtactcccctatccccttctgttctggagtagaacagaagccattgactttcagctttctttccctttccccttcgcggttggacccgcgtggccgcgtttgagcatgcgtgctacaggtaacgatggattagaaaaaggattatccgcggatgaggcgcatgacgccgcctcgacgcggcgcccccgggccgccgcgcttatccgcacccacctattcttactacggacagggggttcagatcaaacggcaaattttttttccaagtcacacatcgaacgttttttatcacatgtacggagtattaaatattttaaaaaaataattacacagtttgcgtataaattgcgagataaatcttttaagcttaattgtaccatgatctgacaatgtggtgctacagtaaatatttattaataacgaattaattagacttaataaatttatctcgtagtttacatgtgtattatataatttgttttattattagtctatgtttaatatgtgtatgtatatatgaggtgtcgcggtgtcagctatagcgcgcgtgttgtttcaacgacgcagcccgctcgctttcacggtctcacttttcacccatggcggccaccatttgacctgtgattttactccactcgcgagtgtgtgtgcaggtgagctgcatgcacatcgggatgtgacgcccgccggctggctgggctcgcgtctgcgttgcgtgaagcgtgatggcgtgggggctctccgtatcggccgcggggcgagcgtccatattccacccggcgcgcaggggtgatggcgtgttgctccgtcggtcggtgacagcttcggcgtcggactttacaatggaccggtggtggctgctcggaaggaacatcgggccgactgccgagacgttagtcgcatggagaacatcatatgatttcatctgatctgcaaaaccggtctcgttatttgactggtactaatttcaactccccccacacaccccccatatctttgatttttttttttttttgggggaggtagtcgtatctttgagagaatgcttctcctgctacccgagaaaaaaaagggacgccccgatatagcaaacatggcaggagtgcactacttcatctctcttttaaggactttagttgcaaattttttcttcaaactttcaacttttccattacatcaaaactttcttatacacataaactttcaaattttctgtcacatcgttctaatttcaatcaaacttccaattttagcgtgaactaaacacactcttaagcgataaaataaagtctatcaatcttcaaaataattgttcacctgaattatttatttcagctattatcgtattatgccgttgtatttattataattaaatctttatgacaagttactcggaaggaatttttttttagtaattttgctattgtagattttttttaatattgtacacagttttgtttatatgtctcattaagtattttactatgtttattagttcatttttaaatgctgaagtgatgttttttttatatttcacccaatgttttgtgatgttctaacatttacatattgatgtttcatatgtcatatagaataaggacgcaacatttttttatatatattctttcattaaagtgtaataatgtaatatcttattataaagatttaattattacaaagatttaattgtaacgaatacaacagcataatcaaatcatatattgaataaataatttagaagaaaaattgtttaaaactaattaattagtagttagtttggtatttaatgagacatcatggaagatgagtgagagagaaggggggaggccatgtggagcagagcataggaggaccaccatgcgtactacagtagcatatgatattttaattttcgtcggacgtccgacgctaagtcatctctaaaagaatgtttttcctcaaatatccggctcaaggagaaaaattggatgccccaatataacaagcaatggcatgcgtaccacagtagcgtccaaaattttagttctcatcggacattggacgcctagtccttggactcctcggacgtttggtgcgaggagaaaaactggatgccccaatttagcaaggatcagtacatgtgaggaccattttggcttctactcttccaagtgataaagcaactttgtacgatatccgatatacgatttgaatatattgttatatttgttataattaaatctttacgacaaaatattatatgattatattttgattttttaaaagttttgttgttgttgccttttttttaatgttgcgtacaactttatttgcatgtttcaataattatttcatgatatttcactagttcatttgtagatgtttcacgtggttattttttatatttcaactagtttttatgatgtctaaacatttacaacttgatgtttcacttgtgataaaaaaattcaacataattaattattggtaaaagtatatttagatttgtcgtatgttttttctttgcgatgaagcactcattgtgactcaacgttttatgcaaaaggtgtcagtgatactgtcaatatttcttaaatgttgcatttttctaaaatatttaataaaattaattgaaacatttgaattaataaaattaattgaaacttagttaaatgttttaataaaattaattaaaatatttgactaagttttgtatttttttcatcaaaatataattgcatttgatcttgttgtaaaattttagttgtagtgaatataagggataaataattttgaaggaaaaatcattcaacgctagttaattagttagttttgcattcaaggaaccaccatgagagagaaacaagagtgtgggggaggccatgtagtggagagcagaggaggaccagtttgagaaaaagaaaagaaaaaaaaagatgtagtgcgcgtacccataaaaaggtctaatttttcagttcccgtataatgtcctactcctagtactctccgtatcttttgattatgacatatatagtgtggcacaaaatttactattttcttcacttctactacctttgattatgacatatatagttaaataaaagttactacttatagcttttcttttttacttatttgttatactctcgtcgttccaaaataagtcatcttttgcataagaatttattataaccctctcttatttatttttcacctactattttatttcaactaatcataatttttcatctacttcttatctcaacaatttaatactcacagagacttctaaggtgtttgtattttaagagtccttgcattttggagcttggacaattggacttcggagtggctggacaccatctacgggcaactcgaaaatggaaatatccgagcgatgtgcaatcaaaatgatttgccaccctgagaacagaccattgtccccgcgcagaatcgaagattttgccaccctacgggatgggaaagagatttgtttgacacatgatctgtttaacgaattacggacatgggcgagcactgttctgtgcgtgctgctgcccactgtccaaactccaaagcacccacacccattccacggccatacacatccgccgcccagacttttggacggggtggatctcttttgaacagcacttttcctggggaggcagccggctgcggggaggtctctagtccacgagtgttcgcgagcgagattatctcacgaatctcaagttctcaactgagctagatgctgactgggtcaggcgctaccccatgctagcctcttcgggtctgctcttgactaaaggatcggcttgattattttctcaatttttgctagtatgtttttaaaattgataaatggtgtttttatataaaatatacgtagaagttactttttaaaacaaatattttttaaataatccaccctcaattaatcacatgcttatttgtgtgtgtatttaacgacttaaaaacaaatattagaaggaagctaaattaaaaaaattctaaaataatcttcaaaattgagttttgtctagaaaatatgcttgtgcgttgcaacagataaatgctattttaacctaattattgttatacggtttggctagggtgaatttcactatgggaattcgcttgattattttttctagaaaatcatgagctgcaattaggagtccaacatttatctcaagttagcatgcaagtttttaaaaagatttcttatacgactccttttgcatttccaaaagcaaacgaacttagaatccgactcaaacacgaatatgtatttaaaaacgaacaaatttaaaaaccaaatcaaacacaaatgacgtaccaaaataccggtgaaaacatctttaatttttataatagtacagatggtggcagatgagaaacgctaggggtagcttcacaaggtatagggatagccaacctggattcgatacatcaccccttttaattatttgatattagattcttttctaatatttgtgtttttttttccttgtaggcagatgatgaggctgccagggagcaacttgggatccaaaggtcttgtttagttggggaaaaaattgagtttggttgtcacatcggatatacggacacacgtttaaagtattaaatgtagtctaataacaaaacaaattcagattcagccagaaaactgtgagacgaatttattaagcttaattaatatgtcattagtaaatgtttactatagcaccgcattatcaaatcatggcacaattagactttgtcggtgacatgggaccgggagtatcatgacttagagacttgaggcagacacgatcacccacgtggcctaaccccctcggggggtcgggcccgagggtgatacggccgcccttctctttgtctccccgaggggtcggaccgctcccgtctcagccccgagggccgaggcgccccgaccccttgtgggtgttgcgccgcgtatatggggtaggtgagcatagcggggctcacctaaccacatttattgcggtttggacgagcgcgtcacgccgcatgtaacgcagtgcagcgcgctcgtttatccggtctgtgatcagtcacagaccggtcaaatcgtgggttaggtggcgacaggcggtctgacgcacgcctcgccccatcccgtcaggacgagagcctccaagcactcgtccctagccggagccggcgtgttagctcctagagatggcacgttggttccggtcagatatatgccaggcttcatcctaaccattacaagcaagacattgtatgaagaggggcgaacatgcagattgataaactgacgcgtggtggacaagaatgaccgatttgtgaccggtctgacactggtcatgtcgtcagcagacagccatgttcccacgtcgcgcctgcttccggcggaagtggaggtaggtgtgggccgtcccatcagaaggtcattcggacggcaaccatacaagtctccgtctgtttatgaaaagataggataagtccccacaaaagaaagagagggagagatggtgcatgtggtatccccttgagatataaaaggaggaccttgcccacttagaagaggggaggggaaaaaacgatcccagaacgatcgggggctggcccgcactttgtagcttcttcatacacagatccaccaaaacacaggagtagggtattacgcttctcagcggcccgaacctgtatacatcgcccgtgtcttgtgctttttccattctcgcgaaccttccacacacagacaaggagtttagaacctcacccagggcccccggccgaaccggcaaaggggggcctgcgcggtctcccggtgaggagccccaagctccgtcagacttaaaagattcgtctcgctatttacatgcaaattgtttaattgatttttttttcatatttaatactccatatatgtctccaaatattcaatgtgatggataaaaaaaattgttttggaaactaaaccagggccgagtttagttccaaaatttttcttcaaacttccaacttttccatcacatcaaaactttcctacacataaacttctaatttttcctcacattatttcaattttaaccaaatttccaattttgacgtgaattaaacacaccccaggccaaaatacagtagtggcatcgtcccagcactagcagtctagcactgactgaccaacaccaccagagaccaaacatggcattgagggctggtttggttggtggtctaaattggtcttactaatttttggcaatgccaaattttatcaagttttggtatggctaattttggaaggtaaagttgcgtttggattgaagccaaaatagcctaacttaactattgaaatgatctattttcttaggcatgccaaaatttgacttcaaaccaaatagacactaaatactattaaaattactaaatattaataagactaatttaggcctcaaaacaatccagccctgaaggtagggcagagaatccggagtgagatgcagacaaaaaaaaacctgaaaccacgttcatttcagctcagggcttcaggcggtagctgggccagaaaaaagggagaaacgaaaaagggcagggcaggaccgcaggagacggtgcacttccgctgacaggtggaccacagactactggtttactcgtagtatgatgaaagaggagtagacgacgagtagttcttgacgctagtggtggtggagcctggaagattcgggcatgtgtagattctaatttttttctttaaatttttaactttttcatcacattaattttttttacatataaatctttaactttttttgtcacatcgtttcaaattctttaaacttttaattttaatgtggaactaaacacagctttcagcgagagatgagagagagcccaaagcaatggaagaaaccaagtaatattgtactagtaggaaataggaaaagcgttcgaaatttacaatctttgacccgcttcgtcctcaatcttcttgcttatacacagtcataatccctcgtactagaaattaccgtgcaaaatttccccacacacgtgctgctatggttctaaatttctaatcggctctgatgagtcaccttcccaacagatgagagaggattttctggctgagtttagcaattagcacagctctttgatcctatctttgctttcttgctccgcctacctggatggatggatcccccctccctattaatacagcacgcttcttcctcttcctcctcacgattcaagccaaacgcagccggccgacctcctcccgtgccttcctcctcgatccccggagagagaaaaaaggctccatcttttttcctctttccgtttttgggcgcgaacgcctcgtcccccccggatcgatcttgctcgcgcgcggtccgtagtcgcgtgctctgttcgaaaggcgagtccctttttttttttcttctccggccgcgggcgctaatttttttggagggcgacgcgccacctttggcccggccatgaacgcgctcgccgccaccagccgtaacttccggcaggccgccaggctgctcggcctcgactccaagctcgagaagagcctcctgatcccgttccgcgagatcaaggtgagacggggttttttttttttttgattcctgtttccagcttgttttgctgcggttgctggctttgttgtttcatcaggcgtagcgtaaccccgctctctgttcaggtggaatgcaccatccccaaagacgatggaaccttggcgtccttcatgggttccgcgtgcagcacgacaatgcccgcgggccaatgaaaggtggcattcgctatcaccctgaggtgaggattgtggtttgatgagaatctgtttttgattttgtccagtaataatgccggggatgtaaatcatcttccttattatctggaaatttgaccggagatgattaagcatgaataaatagtgaagtggttataaactcggaatgttttgacagtgactgtctcatgtcaatgggatcattgtttcgttttggtgagttattagatctacggtacttgttaacttgttattccttccttgtttgcatatggcctttccagttcggtgagttattctttaggaaatgtgcgtgatgttactttcagtttcatacctttatttgtaatctactttatgatattttgtggatcgtctgggcactgggctgtcagtttgtcatgcagatggcgtgaactgaaaatccttgatattttgcaaagcatgtgttgcttttgtactactatgcgcttatgtgcttttacattcagatttatatttctttctgttgaactgtcaacctaaatgtatcttttccatactgacaaaagaatcccaatgggcacatgccaatcttcttcctctgtcaaattgtttctgtaatttctgttttttcttgaactattatttaactggcattttgagaaactagaaagtttgatgcccagacatgctacagatgctagtattcagtattggagacaaccactcaaccagctttgttttcttctgtgataatttcttttgttctttactgctccaatcatacttcggttcttgttgctggaagccattaaatttcatacagataggtgcttgttataattaaacctagggaataatcccttaggtttttccaaaactgcgagcttatggtattttcctgttgaaaatgccagagttatatatgtgcaccatttaggttccaaatgaagatgagggattttcaaattttaggttaaaaaaaaaacagtctcctggagtactaataaatataaagcattaaaagcgctatgagcttctgagacttttattgtcgtgttttactttgtacttaataaataaatggatttcctttgatgatgaattgatgtttgttatcagttagctaacagaaaagcagctaacctatcaatcaattcctagagtaagcaattgatgtcagcagttgttaatttgcaaaggaattttttgtaagtattaccgtaagactttcacaagctaatgtagaaagtcaactataatattttctgctgaccatactttgtcttataaattattcattgtagtctgagattcatctgtttctcatttttaaaactacaattgataatgaattttgggtgaggttccccctcctttataactttcttatcttcttaaatggcacccagctctcttgcgtgttcgagaaaaaataaaactaaaactaataagctatggtttcaccattctgctttgcaggttgatccagatgaagtaaatgcacttgctcaactaatgacatggaagactgctgttgcagcaattccatatggtggagcaaagggtgggattggatgcgctcctggtgaattaagcacgagtgagctggagcgtttgacacgtgtatttaccagaaaattcatgatcttattggagctcatactgacgtgccagctcct

SEQ ID NO: 43598 - DNA, 10493 bp, Oryza sativa
  unsure (1)..(10493): unsure at all n locations
atggttgaaggacaatactccatccgtcctagaatataaaagttttaggcttggacccggttattaagaaagtaggtagaagtgagaggtggatggtcataattggatgagtagtggaggtaggtggaaaaagtgaatggtggagtgctgttattggttgggaagagaatgttggtggagaagttgttatattttgggacaaatcctgagggctaaaagttgttatattttggtacgaagggagtaacatgcatcatcataacagcaaaaaaaaaaaaaaatctagctttcttcctgaaaattttaaaaccgcaattcagctatcaaatcagtctgttcattatcattttatcagtatgccagcaacatatgtattttgtttgtaataatcaatggaattttccagggttttggtaatgttggttcatgggctgcacgaatcatccatgagaagggtggcaaggtgattgcacttggagatgtgacaggctcaatcagaaacaagaatgggttagacatacctgctctgatgaagcacagaaatgagggtggtgctttgaaagattttcatgatgcggaagtcatggattcttcagagctactagtgcatgaatgcgatgttctcatcccatgcgctttaggtggagtgctcaacaggtaaaagctagtgtccatgtcgatccttaaattttctgccaatatgagttgtttatcgggtcggggatgactcttgaaactctgtccttacctggttgcagttgcattttcacccattatacctatctgttttttcttttttgtacttttgacattaaatggtacacagttgttttagacggtaatcttgttacatgttgaagaacctattttatctgattattctagttcaacagtagtatgcaccaagaaaaaaatagccaatttacatataattgatcttctgaagggaaaatgcacctgatgtgaaggccaaatttataattgaagctgctaatcatccaactgatccagaagctgacgaggtaaccacagaacaaaacattgtaccctaactttgtctttgagaaacatcagaaatgttgccaattttggcagttctgattgatgctgtatgcactacagattcttgccaagaagggagtgaccatattacctgacatttagccaactccggtggtgtgatcgttagctattttgagtgggttcaggtaattgaaatgccggttcctacgatcttgtttcgcattagctttggatgaatacagcatctcccttatgcgctttgaacggttgcagaacattcaagggttcatgtgggatgaggagaaggtgaacatggagcccacaagtacatgaacaattctttccagcacatcaaggccatgtgtaaatctcatgattgcaacctgaggatgggggcgttcaccctgngagtcaaccgggttgcacgtgccaccctcttgaggggatgggaggcatgaggccattaacaacactcatatccatgtccgaaaatgttggacgaccaatgtctgatctgataaattcatcagaagtggccggcttggaaggagctcacttgcaataatattcaagatagatcggcgtcggcgtccttccaccgttccggcgaaaaataataataaatatattaagggtacctaacaaaaatgtgatgtttcttctttcgtttttacaaaaggccgattcaatcgtgcgtgattatagtattgacaaaaaatggtgtaagctctagaggcaatttgaatttcacaaaggttgtattctgtcattgtcattctgtggttcaaagtctgcgagatggttgacccccaagtctgaattatataaaataacattgcaaaaaaactagaatacccacatgaactgatagggcttgtttggtttgaagccaaaatttgccctaccaatattttggtagttccaatacggttttggtactaccaaaatttgtagcattgaatttgaactattatagttttaaaatttggtaccaaaacaaatatgcatttgccaatgttaaagttaccaaaattttaacaggacaaaaattggcatcaatccaaacaaacccacaatacaccctcattcaatctcaatgctaccgcagcaaaatacgcggagttgtgaatgttttgcgcctgagagaaatgtactgaaaaattgcacaaagagagagacggggatatagttcaccaggccgaattatttgagcccactagactgggggcatttaagcccaaccccaaagaagaagcaactgggcccatccatggcggctacggcccaatagtccggctccggcacgccgcaaaccctagcacccttgacccccctgcctcctttatatacacgcatccccttcccccaatcgaaagctcaccgtcgccgccaaaacggaacattctcccaagcccctcgtatccgtcagttaatccccaataatctctttgggtggtaaagtatattggtatctcttgtatgcacatcttcgttttcatatcttgtataatcatggattcgtggtggctgtgacgactaggtgaaattcaagctcaacagaccaaatcacaggtctctctccaaggcctttggagatgggatctgtatgccgagtttccgctcagccgagccatctatgatccatgcttactcgcgctttgtttgcctatttggctagattgtttttaaccctttggccagattgtttttttttccgttttgttctgcttggtttggtttatgttccaatttcacgagcgatgctaatctcgcacggttgggttgtttaggcctgatgccacgtcactgttagccacgagcattgagctgtgatgctatgatcaggccgagacaaagctgattctggcgtctcacaagttgataggaacctggggactgctgttccatcggtccacagagccggtttctgtgactacatttaaatttgattcaaatttgatgtttaaattggattgaaactttgtcaatacggaatcttttatggcgatgatgataaacttaaggcttgtttctcataacattcgcagttgccgcctaagagctttcgccttgccgggcttgagagctaatgctgctaactccttccttggatgtctgagccatatggttttcattacatttacatttgctattgggtcttgccattagtattcttggttatgattagggttaagttctgtctcctgtagcaatgataattgtactgtcatccaagtatccatgtgtgtggttatgttttagttttctgttcatgtgtgtcatgttttagtttgctttgctgacgggcaaatgatgatgaaatcaaggcttgtttctcataacattcgcagttgccgcctaagagctttcgccttgccgggcttgagagctaatgctgctagatccttccttggatgtctgatgcctgttgcctagtaaacttcacgtgattgatgttcaagcagtttcatgtttcatatttaattgttacatcttagtagagtgcttgttatgcctgcccagtgatgatgaaaacaaggcttgtttctcataacattcgcagttgccgcctaagagctttcgcctcgccaggcttgagagcttatgctgttaaatccttccttggatgtctgagggcccgccttgtattctgtttacaaaacttaattacatcatctccagtgtgcaattctttttgtttgctcatgttctcatttcaagatgcagcttctatcaacaggtttgcgaaagttctgcctggctgatcagactagctgaggacatgcttattcacaggttcgcagcatctacacactgtttacattttggcagtgatctaaacatcggcgatcatcacagtaagcgtgcaaccatttcatcaacacaacactgtttacatctgatacttagactgagaccactgtcctcaagctacctatgctgctccaataccagaaaacagtaacaagacataactgaggacccctgctccacggctcctccaataccagaaaacaggaacaaggcatggtatgcaattgtatcaaattggaacgaaattcccaagagctttgtatctctccgactcttgccaactccatagtgtggtttctaccaccaggtgcttatgttccaaatgtaaaacttgggccccttctgaatgtcaaaactgagctttatttttgtttggttgaattctttatgtttcgcacactgtctttccagtctgcgaagttacaagaatgctcgtgggtttcaccttctgctgctggttcccacttttgcttatttattttttgggacacaaaaattcctgcttggtttcggttgattagtgatgaaacaattgaccaagcttactactagtcactggcagcttcaattcaaacttcaaaacatagctgtcaaactggaaatggagtatttaactattatcacttttgatatgacgtttaataatttagggtgggtttagttccacgctaaaattgaaagtttaaataaaaaagttaaaagtttatatgtgtagaaaagttttgatgtgatggaaaagttggaaactaaacctacataagcacataaaaattcatgtatcataaatatatatgagtataaattatgaaattatatgagtgaaattatgaaacgttatatctaaaagtgataaatatctaaattaccgcgctaaaaaccgtggacattcactgcccataagtacaaaactgacacaggtgtgaattgtgagaaatgcgaagccgaggcttgcataaattcagctgaccctcgcgacactcggccacaaccggcggcatggacggacagcggggtcaccagccggggcgggggcgcgggcgggcggcgccgcccggatggaccggcgacgccgggtccgggcagggctccggccccgacggctcctggaggtacgggtgggggtgggcctcggggcccggaggcggctggggctacggccacagctcggcgcagagccccggcggcaccgcgttcgggtttggcttcggcggcggcggaggcggaggtggaggaggcgttggcgggcgcggtggctccagcggccgcggcggccacggtggcggtttcggctgggctggcgggcagggccacggcggctggggagccggcgctggggcgttcggaggcgggagtggatcaggcggcggcggcggcggctggagcgctcgcgggggattccacggcggtgacagccaccggcctcagcgcggtggcggcaactgaaactctgaaaccgctggacattttgccttgcatccgttgtacacagtagctgtgtgtaatatgtccatctttggttgagctttgttacctactgaaatactactaagatatatgggtacttaagttatcttcggttcctgtataatatgtccatttttgttcaaactttgtacctgaaatgctgaaataagatagggtcaagtgcagagctgatcatgctcgtatatatattccggatcgtgttggtgatgttttaattctggactgaacaatctgccatgtctcaataaaaaggtagttcgactcaagtttctcgagaaaaataaaaaggttaactcaatacaaaatcgaacaaaaaaaaataacaattgagttcatggaatagacattctttggaggcaaaggaattgtggccctgttacagacatcagaatgcagatttcgagcttcacatgaactcatctatgataagaagtttcagtactacaaggcagcacgttcttggcatcatgggtaccaggttttttatcttccgctgcaaacgttggttttctcaatttagaccggccgtttgaaacccttctccaaatcaaggcccacaaatggaggctcctgcacctactacaatatatcaacgtttcagactacccaattctcatttctatttagtgtttgcctaaacggccacctagcccattagatggtgattaatcgctagtcagcgacaatttgtccagtttacaccctagacagtgaattagtcgatttaccgcctagacggttctagtcggtcctaggccgcctggacgggacagtccctgggcgcaattggacaatgggacagtgcgtctaggtggcgactaggcgatagaaatcaaaatttgggcgcaataaaatttggaagcgccacacggggccgactcagtatagatgaggatttaggttaccttatttgagagcctagagagagagcgctgcccatgcctactccccttttcacgccgccacaagcgagagctctgccaccgtacccaccaattgccaccgcgccgccacgttcttcactctcctcctttgctgcttcacgttcttccccctcctctgctgctcctgctctccctctcatccttcatccttgccgtcaatggaaggtggcaaacacatcgattgaagcagtcaaacatggaaccactcaaacagccagtgccaaccctagatcaggccatcaggggactagactcccttccaccacctcacctcctctattcttccagctccaggtaaatttttattcctctcctaactccagcaccttagatctgtatcagatctgtatgtatgtgattgagtttttgagaggtatgctcatgtgttggtgttggtgctgtactgctactcccctagccttctatgctatatatatacctatatatatatatatatatatatatatatatatatatatatatagagagagagagagagagagagacacacacactaaatatgaaatataaagttctgatttatgaattatgatgtgtatactgatgtgttcgctattcctatagatttgtactaaacccaatgctttaaacccaatgctttgtgtgcagtgtcagtgcgttgtattgacttgatgatttctgaacttaactatgatttatgctattttcctaaatgcctatatttaatgagtaccgaatgtctagaatcagtatttttctgtgaaacaaatagaaaaaacgcctaattcgcctaatccgtctagtcgccgcctaatcagcctagtagctagtcagtaggtggccgtcccactagtgtttagcaactaggtgaacactgtattttctaagtccttcaaatatgtgaaataatccatgagatgatagaaccatatctcatcctcaaaatatggtgctgtatttttcgttactggtcaaaactgaagcactaactatgataaataggagcgaatagttgttattccaaatcatctcgaagtttctaacttttgctggtttcagtatttctttgaaatgtttgtacaatatcctaatagcttagtagtccaaaaggacctaaacaaatgttacaagaaccataaaaaataacttgagacaagaaactaaaccaaaaaaaggtaatctactaaccacaactgcaaaatttaaagtaacaaattgtgtcagactcggaatcgtatcaagataacatattctggcatatattgagctacatgaaacaacatgcttaaactttcccttaaaagaacaacacatttaaccattgttggaaacaattatggaagacatttgatcagcacaatgtaaaattatttagtaagttattaaatgattagtgcaaataaaaaaaatgacttggcactttgccaatggtggaactgcaaagaaagaagaaaacattaacctaataattatttcgatttcatttgtaatcacagtataagctagaagaagatttcatgcccaatgaaagaagttcaattatgcctctggaaatagtacactctcaagcctaatacaaccaaccatcacactctatagagccacagagacattttttcttcttgatgttaccattggcatcatgaacctgatctattgtatagttgtagtggtatgaaagttcttggcggggtggaatgtcctcacaggcaaagaacataatgtgaggtacactcttgtcgtcatgatcatataggacattttgtgcataaaggttaggggtgcaactatggttgatgaattttgcaaagttgcccatctttgaagcatcaacagcaaagccagcttcctcatctttatcaggacccttctgaagtgagggtatggatcttgataggccctcccaaagggcttcatcataataattatgaccaatagcgaataagtattcatcggtcgaccttttctgtgcctcttcatcctccaacacttctccaatgtattcacatacaaagcttccagatggtatgaagtcaagagttcttactccccagcccatcaatttggttttgaagacttgcaaacgaaacctaaggccatgttgaccaactctgttatgacatgtaggagggcacttgcatgaaggtccacactcataaacaagaggttttgcttctaagatgcggcctttatcattgaaaggaatctccccaccatttttcactgcacatgcacaccttttagaatctgagcatccaccaacacaaccacagcctgctggaggtgctggctggtagttacgggggtactgcaggtgtgcaatgtagcgatagggcattgggtactcatcagatattgaattaacaacagatacagggatcttctccaatcctcgggatatatcttttatgataataccaccatatgattcagcttgtcctgaattcagaatgtcttggatgtcaatgtgtttctgacctgccattcttctcagtcggaacatataaacataacgatcattaccctctttctccctccagtatttctcgactatatataaacccccatatatataagtagggatcttctttcgctggcagtttccattgaggtgagtgacgaaaccatggataacacggactggtgtgttagtgtccatactcttcttgagtgctaagttggtaccctctatcttctgattggctatagctgtcattgctccagaatacaccaagacatccaaattattcttaatatcggaagattgtgcatatgatacaatgctaacagctatgcaagtcccatcctcctgtttgatatgatctacacccacccggtgtgggcgatgaagaccaacaacacaaagctctaccctcaagtggaagatatcaccaactttgattccaggcacattgccaatatatttcttctcatcgcagtctgtgatgaaccgctccctgaaaattctgtaagcttgtagatcaggtctaatcactgcttctgtcgacttctcttcttcttcatccaaaaggtccctgtaaattaagcgaaaattctgcagagatcccataatgttttccctagcgaggacaactccattctttggcatcccttgactaggaccatccatgccagttttgctcttcttatatggagttgatgtttccttctcacctttcactgagaaatcacgcatggccgagactctaacaccagaatgagcactcgcataacaccggacagaacttcttgttgctggagtgcacggtgtcgaagagtcttgggctctgtagaattgagtaccagagggccctgaagattcactatcggagcagaaagctttcgagaacgaccgcttgaacccaacctggaacctccatggaagtactaccttccgccccttacgattcgtttcgtcgccattgttgccaggacatgctaagttgctacttttggctgcagcattacactcatcggcacctccattgccactgtcatttccctttttcaccttcggcgcgcaatccgcggcagaagaaccattgctattatttacacaaggcttcttcaaaccctcagaaacgcattccccatctcttgcatcgctgccgctctcaagatgcacatcagcatctccgacgatgccatcggggttggacttctccaaaccacaatcttcggcagctgccgttccaacgccaccgcccctgccattcctcaaaccctcaaatccggagccctccgccgcgacgccggatttgcccgaaccgccgtcgtctccggcaacacggggaccgccctcctccacgctccgcgcatcaccagagcccttcgcgctcgcgctgcgggtgcatctcctcgattgaggatctccccggcctccactggacccgacgccttcccccgacgcccccaacccgcgacccttgccgccgggcgtgcccgcgacccctcctccggcaacggcggcggcggcggcagggggcttgaccggaggcggcctgacgaagcccggctggaagcgccacggcacgagccccttgtacctccgcgggccggccgccctcggcggcaccaccacctccgggatccccatccaacgccccccgcactgcccccaccaccaccagaagcctctaaccctgcacgcggagatgacgctccacggaggcagcggggagggggcgcggcggaatggggccaggtgggtggggtgggggctgtcctacaatggtggatcgggga

SEQ ID NO: 43599 - DNA, 16337 bp, Oryza sativa
gagggaggtgagtcagggggaggcggcggtgagccaccgccgcgtggggacgagcgccggtttgggggtgccgagcagcgcggcggtatggttaccgggatggtggatcggagtcggactgggccacgcgagcggcgggcgggggtagccgggtagggcgcggcgcgcagcggcgtttcgatttgggaattgccaattccactctctccgactgttaataatctgttcgacctcgaagcagccgtttgccgtatgtactccctcggtcatggaataaatcaacttctgaaatttaaactttttcttaaaataaatcaacgaatatagaattgaatgtagcacattctaatacaataaatctaaacaaagatatatctagattcgtacactagaatgtttcttattgtttttattttctagacagatagagtactaccttcttagagcatccccaggagatccttcatccggtcctccatccgatatatggcatatgcgagatgaaaatggacctccaacagatacggcattgagtccgccaaatatggacgatgcgccaaagcgagtagatttcggccaaatatagcgattctctctcctcacgccatatctcaacgcccacatctcccgcccacattcggactcccatcgcgacctctcctccatcgtcgtcgtcgccggccgcaagctactgacgccgagtcgccgcaagccgcaagctgtcgccgccgcttacgagcctgtcggccgcctgtgctgctcgtcgtggagtgtggagaggagggtgtaggcgtggagagggagaggagtaccagatctggaaggagccgtgcggccgccgcctgccgccgtcgccttgcgtgttgtcgccgccttccaccgtcgccctacgtgttgtcgccgcctttcgttgttgccctgcgcgcggccgccgcctacctcctctgcccctgcgcctgcccgccgctgactgcctcctccccgcccatccagggccctcgcccgccagcccgcctccgcgaccattgactgcctcctccctgtccatttgcgccctcgcccagacgtcgatcgtcgccccttgcccgcccgccaaccctcggccgcacgcccgccaccgtccctcgccaactcgcccgccgtcgcgagtagagaagagtagtagtagtagagaagaggaaataggaaataggaatagagtaaaaggaaaagagtagtagtagtagagaagaggaaataggaaataggaatagagtaaaaggaaataggaaataggaatattttttgctgtgtttttatgtacattttattttattgatgatgctacgaatatataaaaaaatgtttccctcaattcaaatatatcaattaaaaaactatcaattaaaaatatatccgttaaaatttactcgtttcaaaatattatcgtgataaataacaccgttaaaattaagttagttggaaatatatcccttaaaatacaaatgtaaagttagttggaaagatattcctaaaatataggataatgggatattctttttttggatgatactccatatggacatttgcaggaccaaatatagatgagctgctggggatgttcttatctatctcgattcataaatcgaaaatatttatttcttcgatacctctttgtcgatgagagatacctgtaaaccgaatagtatgggtattggggtacgttggtacgaaaatctacacgattcgacatcaagcaaataagaagacatggattatactgttttggaccactcgtaagttaatagtcataatccagtttatatgagattgatatggaaatccatagattataagagagaacaactgatcccaaagttaccgacgagatccttgtcgagatggcttcgacgaaattcctagcgagtagacttcaagttctctgtattgctgctttggtcgtgggttggctagtgctatgattcgatgccttggacccctcaggaggtgtctacttataccgtgaatctccttagtctccaagtataacttggagatcccggaccctacacgatatagtataatcctaactttcttcaagtagaactctgtcacgttatttgcctatgaggtttatttccataatgtcttgtcgattttcatattatatgcagaagtctatcgcacatacgaagatatgccgtatccgtatattatataagccgtaggatagaagatataccttatccgtagccataacactttaacgcgcctatccatcaatactaatttgctattaataaaatgcattttgttcttttattctctcctttaatttttgcgttggaatgctaggagtaacttatttgtgagaaaaagggagttcccataagccactaagattaattggatccgtacgattgtaagacagttttaaaaagtgccatcaactattaaattatttagaaccataatagtattacaatttcatagctcatttcaaaatatactagtgctacttattctccggacgcatttgtttcagaccaaattgcctccgtcttcttctttcatctctttctctgttcccccatctctctcctttcatggaaatacagcggcggtgaactcattctggcatcgaaccactggttctcgtctagtaggtggttgagggcgatgcagactttatacctctatttttatcaaatcctcatgaaattattccctaattttatctactcttaatgctattattccttacttacacaaaggccgagtttagttccaaaccttttcttcaaactttcaacttttccatcatatcaaaacttttctatacacacaaatttttaacttttccgtcacatcatttcaattttaaccaaacttccaatttcggcgtgaacaacacacccaaaatctgatgaatcaattactaaaaatgaacttatttttgaaataaatgggaagagccaaaagtgaaattatgatggaacggctggagtagctagcagacacaatagatcataaatatgggtccaaagtgcacacactctctctccttgaattagctactagtactctctccagccaaaatataacaatttaatactgggttgatcgcaatctaatactacgtatctaaatggtttagtaatatgaaagaatatggataaacccctatctaaattcgtaggactatattatatctagtcggactagtttgtcatatttgacaagaagtactaataccggtggagacttaccaaaagtttatagagtacgagaaaagcagatagtaaggggttttactacctattttatcattgtggagacggatagtaaaggatgtaataactccacttggcaagaagcaattataaaacattaaactcttttctcttttcaactgagagtgtatttagttcttttgggtgtaaagtttttgaagtatacggacacacatttgaagtattaaacgtagactaataacaaaataaattacagattccttctgtaaaccgcgagacaaatttattaagcctaattaatctatgattagcaaatgtttaatgtagcattatattgttaaatcatagcataattaggctcaaaagattcgtctcgtaatttacatgcaaactgtgcaattgtttttttttctcatatttaatgccccatacatgtgaccaaacatttgatgtgatgtttttggttaaaatttttgcctgaccactgttctacatatggatcgtaattttctgtcaacacattatgagagctagaaataactgtaacttgatttgtcttatcttaaaactcgaatattagagaagtacctaatatcaagtaattagaaggggtgagacttcgaacccagatcgtttagcccaccaccttatggagctagccgaaaaatccatgagcgattctctgatttgtcttatcttactactcactaaatgaattatacagtgaggaaagccttaaatccgacaatgccactacatatcatggccatctctctcctctgaaccctagaatccaacaatacaaccgtggttgtgtttagttcacactgaaatttgaaagtttggttgaaattgatacgatgtgatagaaaagttgtgtgtgtatgaaaggtttgatgtgatgaaaagttggaagtttggaaaaaaaaactttggaattaaacagggcctgtggctgtgtttagatccaaagtttggatccaaattttagtccttttccatcacattaacctgtcatacacacacaactttttagtcacatcatctctaatttaaactaaaatccaaactttgtgctggactaaacacaacacagcctttgtatcaccgggagcggagccctgcggcatgcattggccaagtggtggtggcgcaggccgctggcgttggcctttgtacagcgagacgcaggcacgcagccacacgcccacacccccacgctcgtggtggttttgaccggtcaggcggtcaaataatccattgcgatcacccagtctctctctccgtcgtcgtttctccctctctatcgcctaccggtctctccgtttcacacaatcacatcgctctaccgacttgctagtgttactccagctctgtttcacaaaccagcagagtgagagacggagacaaaccgacggaatagttgggatctaattaagcaggaggtttcctgttacgtaatcatactggttctactcccagattaattggtgatcagtactcagttggtgagcaagcatggcaccacctaggatgctagtggtacaatcacccgtgcacggcaatgcgcggcgatctgtgcgtgatctgctgcggtttgcccggatcaatcagaagcgctaccgctgccaagacccaattgatcatctcacatcgttttcttcccctctgcattatggtgaatgaatcacaccaaacctaatttgctacagcagaggaaaagaaaagagaaataaaaaaaaggaagcacaattaacaccggtatctacgtacagcagggagaaaacgatggcgctgtgagagtacagcgattacatatgtaccacctcacctaacaagctactacttacgtagtagtaagatctaatcatctaagtagcattacagcaaacaagacatcacagtagtgacagtactatgtgctaggagcaaatgctttgcttgatgcttccaagcaatcgtgcctgtacattgcaatgcagcttctcacctgcttgcttggaagcaatccctgcatctgatcaccgactgttcacgcagctaactgatgctgagtgctgccgctgctgcttgtgtcgtcctcggacaggaagcaatgcagccttgccgccggagcaggggaaggagaaggcggcggctccagctccaggcagagcatctcggactggagcacggcgcagtagtggccgaacgtctccggcgacacgttcaggtcgaagccgacgccgaagaggaagtcgacctcgaggtagttcatctccgggaggctgacgccgccgaccttggcgaagtaggcgttgttgtagcatctgcagtgcacgcatcttcttcagatcagacatcttgtttgcagaaacaagctaaagcttttactgttagtggtagtaggctaccgaacatatgtgcagctaacgtcaaactcaaaccagatgatataccatgggccaaaaaggcacaccaatcgagttattttctagattattatcaactgggcaattaagtggtacggttaatatcaactgggtaattatttcagaaacaagaagatttggggttagatgagatgctcctggcaggagggagttggggctaatgagcatcagcaagagggcaagttgacactgccccatcctaggctagctagctagacatcacaacttggcaatgaattaaattccaaaaagagaaaaaaggtggtgagagggaaaagggtggagaaaagaaatgaaaatcctatctttatgtctttgggtccccagtgtatgtgtggtttggatggaaggaacagtggaaccaccatggtttctttgttggacaagcataatttcgctgcccacacacacatatccccacagaacagataacactttggtgcgttcagtgtgaggccgtgagataatatatcaaatttctgcactgcagcgtgttcttctcatgaacagttcgatgaagttttttttttaacttttttcaattgggctgtgcttgttaggacttagggaagggtttattggtttctgatgtttaaagaatccactgtgctgatgcttcctagttcctacatggtggtgtttggtgtattcctgaaaaaaaaaaggttcctacgtggtactgaattccaaattttgatgacgatattatctcatcagaaggttctttatccataattcaccaagattgcgtactattgctcacacaacagtccaaatttggggttggcatgatggtattaactcttaactcccaacaaatacttggttgacagtgatttgaacaggcacaaatgaagcaggataagaattgcacaataatgtttggtccaagaagatcagcagctagactgaatcgtccttattaagcctaacaaacgtaattaggccgaaaaccaagctatctacacaaaaaaaaagtaattgttcaaagaataggccaattggcgtatttctgaatgaattgggaaattcagagtgatctacctagcatgttggatcaaaattcataaagaaaaacagagcattctgtttctgccatgttctggtccgggcaccgactggactactgtagccaagaacagcaacaccgcaaagaacccagaaactcgattcgatcatacggctatcgcatcaattattgcgtgaccacgagtggccgagtgcgaggcgaactcacatgtcgtccatgaacttgacggcggcgagcacggcggtgatgaggaggcggtgcacgctgtacgagtccacggagaacgcgcacgcgcgccggcggcggcggaggaggcggtcgaggtagatgtaggcgaccacgtagcacgccgggctgcaccccgcgaaccgcgcgatgcgcgccatgtacgcgcgcaccgtgatgtcgggcttcgtcgtcgcccggaacgccgacgccgccggagctcccgccaccgccagctccagctccgccgccgccgcgtcgttccgctcggtcacgcgctccaggagcgcggcgaggacgcccaccacccgcggcatgtccgccaggtcctcctcctccgccatgatcgatcggagaggatcactggactcgcgtggcgagttcttgcagctggtggagaggggagtggacctgaacctggtggatggctgaagtgttcgtcatataaaatggagggaatgcgactgcagcgcgcacaaatttctactactcgcaacggcactaccatccaagtagttttgtgaattgtgattaaatcgagcattttttcccagcattgggatctcaatccaatggttcaattcatctcacacctccgtacattgcatttggaaatattcgttgtatttttttgacttggttggtagcagtatatggctggctgttgatcagttaggtactctaggtagtatctttggtgaagtaaagagaccagaatccattctttactgtcaatagttgcatcctaggctgttctacttggcacattctgtcacaagtgtcaaaatgataagaggtgtgacgttggaagagctcgaaaaatgcacggcaagcgagctaagatctggctgcgagaggaaggagtaatgttcttcttacttctgcatatttgattccagccagtgaaagagtacagtttttcatcgtttcgtgttaattactcgaagaaagataatcatactcaggattgatcagccaaggacgtgctagtcacatattgacgacgttcttcagacggaaatgctgatcacgtatgcttggttaaaaggtcaaacgacaagtgtgcaccacaatacgcccttaagctataaacttctttttttcagattcgacacctataaactcatcctgatgtgcaaaaatcattaatagtttgttcttagcatttttctctactctatggtcgtagtagaagagaatattctcatgtcgctagatgcttggtatcttctgcctcgaagtaaattaatcagtaattatgcgctgctatgcactctggagtctagagcctgcttcgttttagtaatcgttaggattaaaccaaacatttttcgtgttcctgttaactttctcgccaactaatgagagaaccagtagaaggtctcgatcacattctaacttctaacgtcctaatctgaataatagtgcataagaccaggacataatttgattactcagaaccacaatttgctgcctgaactgagttccgttcagaaaagaaataaatgggccattattccattaataaagcctgaataaagtgagcactagatcgttcatatttacctcgctgttaatttttcacctatagctttagcagtgagctcgtgaaggaatctggccattagtttagtgctaatactgcatcttgatctgaatcaagcgaagtgactgcaactgcaaccaccaccacccctcgtgcagtccctctagtgagtgacccccacatgccctaattcgcactgtcatgagcaatctgcaatcagtcagatgaactgatcaggcaggtggttgggagggagatcatggagggcgacttcttggcggcttcgtggcagatgaggggagtaagtaatagtttgagacgaggtgaggagacgacgacgaacctctcgtgggagggtcgtctcttcaggatcaggatcgccgtcttcagacgtagacacggcggtgatcggcggcgctcaggcggacggatggaggagacgacgagacgtccggcgtccggggaagaatcggcgaggggcgctcgctgcatcccggggccctcggcgccagcggtgggccggccttcaatgtttccatacgagaattgggccctttgctgggccgggttgggccttttggccgagatgcaacatgcgaatcagactgtctataattgagggatgtaaaatggactttctttttttcttttttctttataaagtgttgccttgaattactttctgatattcacaatgtggtactacaattttatggtttgtaaaaacaaacgcgtttcttcagtaaggaaatcttctatcaaaagaacaagaaatgtctgttaaacttaaatctttttttaagggaaaacggcacgagattgtgccttttcattaaatatagcgggggaacttgtgccttttcattaaatataggggggaaaaatacagccctagagcaagaaaaagtaaatttctgttaaatcctcaataacaacaacgcatttactcattgtatatgtactagaaaataaaatgagccttgtacttggcggccattaggcgaatttacaactttcttaactgagccaagttgaactgaaaagaaggtatatctatgtacgccatgcgattttgtctaaggaatcaattgccaaatgcatctaccctgtctggaacagacacaactatagcatctaaaaagcactacaagcaagtaatgcattcattcaggatgtaatgctcatgagattgttgatgttctttcacaatcatgtgtcttgaaaggcataggtattgatcaatgacttgtactcttcattctcctcgcaccgtctacttctaagtacattcatcaacctgtctgcgctttctgcatcgtttttctccttgaaattcgcaaggaggctctcaacattggtgggtcttggtctccatttgcttggacttgcaactgcagtggctttctccaaacatgacagtgcttcagatgattgaccgtccttcaggtatgctgtgccaaggatttcccaggtgtttggttttggatttccacctttctcaacaaatctgttcagagtttgctcagccttggtaacaaagccttctctggcataccacgctaataaaatgttcatagtcttaggatcaaaactggaactcttggatgcccattcctcgtaaagaagttcagctccctcaatatctcctagcctaacaagggcagatagtacctcctggtaacccaggttatgaattgtggggaaagttgctttgtaccaattccaaacgcggtagacttcttccttcttgccgaggtggctatagagtgtcatgagataatgaaaacattttttctcccgtcctgtcgttctcttttcagcttctttcagggattcttccgccttctcagagttccccaacttaatatgcatactagcaagagttgtgtaagtagtccagtttgcaacaacagtctcatcgcgaatcatctggttaaagacttgttccattgcatcagcatcttgcatagccgcacaactctttatccaaatgttgtaagtgcagacatcaaaagcaacgtttctttccatcatctcatcaataagtatggacactttctcagcctcttcagcatccacataaaaattcatcaacacattaaaaggtaatgtatcagttgcaaatcccttttttctcatctgctcaaatgtgctttctgttttctctttcatcatagcttgggcataaacattgagaagagaaccatatgtccgcttgtctttcaatggatcaggaagctcctcgaagtattcttcagcatgtgaaacaccacgtacttttgcaatcagatccaactggattgccatatcactagatgagagtgaaaatctatctctgcgctctgtcatccaatcatacacctaccatgttcaagaaaagacctgatgagactaatacgactattaaatttgtaaggttggtcataaaaaaataccaaaaacaataagataacaagaagagaagacttccattctagaaaaataccaataagtaccatgattttctaccctcagaggtacaaagtatatgcacccaactaccttttcatgactatccagggattatattgaactgatgcattagtggagttattactgtccagggattgtattgaacttatgcattagtagagttactatccagggattgtattgaactgatgaattattagagttactatccagggattatattgaattgatgcattattagagtaagcacaaaactcaacaattctatatttacatatctgcaagatatgctttcatcactgaattcataattggtgatgatcagtggtaaatctactcaaaatactaccctagaagatcttaaaacacggacgaattccaactttgacccaaccttaactactagccttgtttcctaacttgcatttttcacacggcatttactagcattacttctacattaaacttcagactaagcagtgctgcaactaccaaatggcaactatctatgtactcctatagtcctatgcaacgttgtgcccatcagatagaaaattccccattttacgtctttagctaagctatgtgtatggaatgatattacaaacatcatcctgctataactcgacctaaagtacaatgaaaattcccaacattgtcggatctcttattaactaacccccccccccccccaaaaaaaaaaaaaacttagttaagaaaaaaaaagggggtaaattagtagtagatgtgcatacctggagcgcgaggttgaagcggcggaacttgcgcagcttcctcgcgatgcggcaaagctcccacttgtcgagacggcgctcgccctcatcccaggcccccagcgtgcgccccaccggccggccgccgggccccaccgcgatgcgccggtacaggctgctccaccgcagcgcggctctccgctcgtagtccagcgcaccgtagctgtgcaccttcgccacctgcttccccgccgccgcggccgccgacgacgacgacgatggcgacgggttcgaggaggaggacgcgcacctcaccgtcgcggcccccgtcccagcgccgctctgcctgagaggggagggcctcgccggggccagggtggaggagccgaggatgtggagcagcatggctggcgtcgccggtggtggtggtggcggcggcagcggggagcgcgcgggtggaggtgcggcgaggaagggctctctgctcgggaggggataagaggagggggtgggagtggagcgggtgcgttgagattcgtgcgcgcgaatccgcgggagtcggggcctacccctcgctgcctccgcatcttcccgcgcggatttgtattggtgggccgcgatccattattatatgggctgactacggcccatttggtctccatagactactagtgttagactatcggtcaattataattacagtttcctatctgaaaaagaaagctcgttccactcaaacaaaaaaaatggttacaggaagattataattacacgtcaattataattacacgtcctgattattggtttggataggatgagagtgatttctgattaggacgcaggagccaaaactgggctagggagcaactgtaacaaaatattgccaaattttgggagccaagcacaaagggaaaaaaaaaagatttacataaatgagatgctggatccggaatgaactatggagcaaacttgaacgaactcatgctaaaattttatcatcaagacgaacatatgccaaaaatggagaattatgtcatactccctcctttatgtatagagtgattttacagtcatgaggaggtaacgggggttactaaatttggtacatctctatagtactataagatactaaatttgcattaaaagatattggtacctcttaatacctcccaatgaccgtaaaattcctctttttctagataattgtcaatttgtcatactccctctcttaccaacaaactaagcaacattttgttgggatttgctaaccatcaccgaattaccgaacattttgtacttactaaatatatagtttcagcttttctttttaaagaaattattcatgcacatctaaaacaacccttgtcaaaggtagttgtcatttcgtggtccttgcgtcctaccacatcgtcttggctctatttgaaagtgcgttgaaaggcagagtagcagatgaaaaattggtggagtagcgaacatcagtgagcttagatgttagactttttgcctagctacgatgagcaaggaaaagattgctaggagagactcaaaagcaaggaaagtcttgtccaatttgcctaaagtcataccgagcaaggaaaccaaacatgaccgaggaaccacaacaagccaagcagtaacttcaaattttgggagattgttgacgagagcgtcaccgaaatcacacgcgatgttgctattttgaaccaagtttatgtacaactgtacataccattcatcaatgatatcaccaatctcaaatttcttgttcaagatgacctgccatcaagacaccatggtgctcaattgtaaaaagaagtgagcaaaccccaacactgattgcaacacaaacatgaactcctaataacttccatctttctttcctttttcattttacccataaggagattacctcttttccatacagccatgttgagttatataccttctccaaaagccatatgctacaaacaagcacaagtctactccaaaagcacagctagaagtgttagctgaacacacaatttttgccaacttggcagacgcacattgcctagtaaaccagggcgacgacgataagagcatgaacaaaccgcagaacgccccatcagtggccggtaaataaagggaaccatgatccagggaaactaaagtaaactacagctacttcctgttcctaagttgcttgttaactggaactggaactagggctgcttaaggcgcccctctcctccggcattcccagcctctgaggtggagctgtgggctactgagctcagttgagatggctggcaaagaagctcggcctctgggtgccgagcattaagaggaacatccagcaacaggtcttgatcagaatcagtgttggcatactgaggaggaaccagcatggatagtttatccgggggtaacatgaataagttaagtgctctgtcactgcaggctaaatctttgccattgcctggtttcggcataaacgacgcttggcactttagacccatagcatcaccatatttagaaactcttttaggactcctcatggttcctcttagttctgtatgcacaaaaagaaagaatagataaaaataataaagttagaaggtttctccatttcacttacattaacctaaggacgaaataggaaatgaatatataggatttgttttttttccaaatataagtaacagtatatgcaggtcagaagctgctgacctacggagctttggaagtgggtgtcatgaggccttttcagaggattcatggtggactttgtaaggcgatttgaagcactggtctttactcttgtttcttcactgtcttttccctgtacaaagggaaacaactatcaaaatgtgcaaccaaggttttgaagatcatatattcaggttagacatgttctaaaaatacatataacgataattgaactgagcaagaaaaagatacataagctggatacctccatatgtagggaaactaaaggtgagtttgcattctccagagtatcctgattttcagtatggagattagccctccaaaatagacatcccaaacaaaaacttccttagattggtccacaacaattctcaatataaactaatactcaatataaacttccgtgctaataaggatgtaaaataccttctagcattatctgatgtttgcaccagaaacttctttggctgttcagttataacattttggttgcttgttgccttgctttcactatatacaaatgagaccgaccctgagtaagattcactagtaatatatgacttattatcagcaggaatagagcttgcttctgattcttcctccagtgattttgaatttggtctgagaagcatacttccatatcccatctcaaaggaatccacaggagttgcactatggtaaattagatcctcctctgaggatcctgaaaggtaaagtagctgctcttcatgcattatggaattaagatcctttgcaagtttttccatttgtgaaggcttaggccgagtgacacaactccttctctttgatggcacaagtgattcccaagcatgtgattgtgctgaagctgaattggcaagatatcagataataaaattattaatatatcaaacaaagttgtaagagaacagctaaaaaacaattctttagttacatacggaacctcgagaatggaaactaatgcttatggttggtggagtaatatcccttttctgagggcctttattgtgcttcatcatactaacatgtagtatagaaacacatatattattaatgatgtttcatatgtactggattactggtctttactaaagcatgattttcaccatattataggcttgatgctatctgaacacaatgcatggacaaatttcttaatgatataacaatcagcataagttattatgaattgataatgctggactaaagaataaaccaacactgaagaggggttgccaaaaaaaaggttccgatagctttattgtgtccaacgaaaagaaaaaatcacatatgcattataagagggtagcactgcatgagcattacattggagacaaatgttaagcaatgtacttctgacatcaatctcaaagctcaagttcaattccttaaacattatttgtttgaactgaaccaaatcatatactatatggtacacatcaagaatggaaagaacaaaaaatgttttaacagaaacacaccagggaattggagatcactcaccagtcatttcacttgcatcagcagtgccatagggggcacaactctctgagtatgatagtgctgatccagaccagatcgattacttaggtcaggatctcccatcttacggaagttttgatcagaaaatggtccattctccattgtgatgtggcttggatttttcttcagttgcttctgttccttcagcttcaatgttggaggtttcagcttgctagctctaggttcctcagcatcaatatcatcccgagcatgcattggtgtgtaattcgtcagcgaacccttagttctccatcttgagccacatgcattgcagagcactggcttatctggtggcccatttctccagagaggagtacctgttccatcatctcccataagtaacaggttcaaaattgatttgccagtaatatgtgtggtatacaagtatagagtttattagtagagtgtcca

SEQ ID NO: 43600 - DNA, 19240 bp, Oryza sativa
gcaaaagcaggtggttctttttatcttgaacaatagactgttaactgcatcttattgcattatctgtcaaattatctaacagcatacatctgccatggtcaaacaagtctagatgtgtctatctgaatcaaataatctgttcctggtgtccagaattttacacccaaaggacaccgagacctcaaccatatccacaaagttctcctgacagcttctgatggttcaatgaatttcagctaataatcatcagagaacaaacagagggaaccacagggaaaaaggattaggaatcccagcccgacggattctgaagatttttgcgattttatctaagactcttcccagatgcataattgggagaaaacatcacctaaaaaataaactagctagggggaatcagaactaaaacaaggaaacaaagaactgcagaaggaaaaatctaactttatgaaagaaagaaaaaaagagctcactggtgactccgcaatgacggcaaggtccttgctttcccatgcctctcttctcccctcgcctccacaagcgaagaagaaagggcccaagaaaattccaacaaaataaacaccggaaaaccaagcggaaacaggaaagaagcagttctgtacaagcaattcttcagcaaaacaaagggggaaaaaaatcaaagaactgttgctcggtgtgaatcttttcagagccagaggggattcctgggaacaattccacagcccatgaactcaaagaccaagacttgcttggtaggtgttcttctttctttcctttctttctgttttttcccttttttttgttctgtatccagtcttttagagagaaggtagaggagaggaggagaggggaaagggatggagaaataatggaggaaggaatgcagacggaagggaggagattttacaaggccgggtgagtctttgggtgaaagccattggggaggaatccaaaagaaaatatagtttagaagcttgtaaatttctttttattaatgagggacagagaagcaactaggaactgggcaaggtaggaaaaggaaaggggggctatacaacagcaaaggccagcacttcttttctcctctagtttctttcaccctttcattatgggtggtttcaatcccatttcattattgttgcttgggtatgactaaggagaagtgcaggacatatctagcactaattagtcaatttgattaactttaaagccctccatttctggtgccattggaagaatctttttccttacgacctttgcatttcgccccttacgaaaaaaaaaacaacaatgtttgtgtagagcacccaacacaagctcaatagaggggtggttgaatgttgaggttgatgcataaaagattgttttgatgtgttaaaacgacgttcctaacaagcacaatacaatgtataataattgtttagattgatttttattatcgaagaaatgtatcatatttgtcatgccttctaaatcattcatctattgatggaataggtgcggtatgtaccgatttataaaaccatgtaatataaagcgcgggaaaatgtattcatgtatatttaaatgtggtattaatagacgtaaagtgattcatagcgccacataaaaacataatgatgaacggttggatgtgtgccggtaggaagtatgcaaaagcgccaaatagcctatttgtttcgattccagtaatacatgggaatgcaattaacaaaaaaaattaatgtaacaataaccctatatacatatgtgagcacctgcatttactttttacgaagtcacttttattgtgacaattttcatagttatatgataaatagatgtatattttttttcaggagacgggaataagatagaaattgagggtgctctagaatataatatagaatatgagacccaacattattccgggactaaatagtaaacacaaaaggaacagctccctcctggccgcagcatgccagcatcatttttcaggcttttccccttgaatatataggaattcttttttcaacggcttagcgtactactacattggtttggtggaagcagctatggtaggataaagataacaatagcactccaaatcccaacctgcacatgtctcacaccgcatgtttgatttgtttgtaaaattaattgcacgggattccaatctatgcaaaagaaattccattcaggtttttgggcaattctcatttagcaatgaaacggcacataataaaaacatgcattttatctcctcattctggtatgttttaaataacctaaaactatgccaatatgccacccaacatgcttatattgctccctaatttaattatgccacattttaggtcacaagagattgaactttgccacacaaattcagggattaaaaaagaaatatccattccaaattaaacaatgccttagaattcattcacttacatatattcttttagaatctttcgcccatttatctcatcttatcccatccattatctccaattaaatgcaaaaggagcaaagatatggccatatcacactaggtcaataataaccacatcgtcatcgcttaagagcatcgacaagtgctagctaagctccaagaatagtagctcagctgacgcattttttcacatcggaacagccaggcgatacttaaatccagtgatgacacaatcgagacaaaggttgcatcagaaattagccaaaaaaaattcttataacaactcaagaaaagtaggaaacggtaaagcatggaggtcgcctcatgctggcattatcttgctgcgtccccactaaaaaaaggtcatctctcagttaacacacttgtgctactagttagttggcacaggtcagcctgctgctaaactttgcatgttataccaaacaaaattagttgcaaacaaaatggcatcaggataccccatttcagccacaaatcaatccagatgcacctgaacaaaatctcagaaacaatactagaattcaacattttcattttttctaaaaatgctagattaagcctcagggctgagtcacatctttttaaagtcaaaaacacaaatagacctttttcgtaccatttttactttcctaatgaattccccaccttatctcgaaggcggggttaattaagcccgtagacaacctcgcaagacccggcagataaaccaggggattcatcattcatcacccatgtgactgttcattgtacccatctttgtgggtatgatttaggttagctcagctaaggcaagatattcattcagaatttcagatagaagaaccaaagaagagacggtgacagacaggaaagagagatagagagagagaatatttggtgcatatatgtagtatactcttgttgacctagcaaagcatgctcctttccttggtgatagataggattgtattatttgtttttctcttttggaggggataagaaatggaggtatcaaaacagggggaggacgaggcagtggtgccaactcacctcgtcaccccgtccgaacgaacgcatgccatgcgatgcgaggaaaataccaccaaactcgcactttgctttcctcgccctctctctctcctacggtcctacccagctcataattaaactgttactgtccatttctactgattttttttaagctcacttcgtccacagtaattacatcggttctgaaatagattgtgtcctaaatacgtgcagtcaacctaaaaatttgaatagttaatgaacacagagatatttttttaaccaatcgcacgagacgatgcgaagttttattgatagagaagaaaaaaaattacaagattacaaccctggagggtcgtaaccaggaaaaaggaaaaaaactataccatcacccacactccgacatcgccaacacacaagcccaggagaaggctagcaccggaccggccgccgctaagcgtgaccgaccgccactagaccaacaaagggacacagacgagatcgcctcctaggggatgccaaaacgacgtcttcaagaagagaagtgaaggaaaaaccgccgccgccgtccgtcgagactcaaaggagccaagactgggctttcgcccgacaatcatccttgagggctgagacagcacgacaacgcactcaggagggagaatgaaccatcgttgtcagtccggccaaggccgaactgagttttcacccgccactcaccacctgcaaatccacggctgatgcaccgatgctccaccaccacacaaactctgccaacatgtgggacccctgcaccggcgtccccggccggccagccttcgtgcgcctaagaccgcgctacacccaccggcagctcctcctcacacctaggtcgcctcctccaccggacgcgcctctcgcgccaatccagcctccctccatcagctgcgcctctcgcgccaagccagcctccatctccgccaatcgcgcctctcgcgccgagccggccttcgctgccatcggttgcgcctctctgcgccaagccggtctctgacccctccaccaaacgatgccgcaccggccaaatacggccgtctcccacgccctcagctagccatccgaggccgccatacctccggtgaccgcagtcgcagccaccaccacagcagccgctgctatcgacgcccagccacctcgccgtcgccatcctcacctcgcagccgactccttccccgcctccacttgccgccgccagcaaccctcatctgccaacgtcaccaccgccttcacagtcacggccgccgcaagtcagccgcagtcgccgctgccaccgacgccagccaccgcctccacgaatcgccgccgacactgccagcggccgcttcgctgtcgccctccgccacgctgccgccaagtcctccgccggcatcgtcagccgatgccgccgccgccgccaactgccgcgaccaccaccgccgccgccgtcgcccactgccgtcgccagccgtcgcgattcgaccgccgtcgccgaccaccaccactggccaccctccagatccggccgagaggagcggatctgggggacaccgccgccgtcgccgcacaaggaccaccgctgccaccttcgcgccctcggctgacgccatccctaccgccatcgccatccccgccgccttcaaccaccaccgcccggcgccgcacgcccctgcctttgccgccgccctccctgccgctagccgccaccccgccagatctggccggagcggcctggatctggcggtcaccgccgccccgtcgtggacgcttccttgctcgcccgaagcgaagcgaggtcggtgagagaggccccgccgccgccgtccttgcggccggccggctttgccggcggccgctcgggcggcggcgaggcggagggggaggagtgggaggaaagaggcggccgggttcatcgcctcccgtgccatcccaggggagggcgacgcgagcgtctgcgaattcaatggtaatttttatgctcgtgaatacagagatattaggatttagcttgagaaaaatgaataaatgatataggtagatctgtcatgaaaaatatttttatatggttatatttctaatagtagcttcataaacatttgtattggagaatgttgataatcaaagcaataagtaggaaataatggggatggtacattttattcaatttttacttctgcaaattgttcttgataagtgtaaaagtgtggcaaaaatagcaggagaaggtgccaaccacaggttgcttcctactaaatatcccctgagtttgtttgagcctgcaaagcctgatgagaactttcaagctgtggaaagcagggttctcatttccttgcgtataagttgggaactcggagctttcgttgacagggagaccaatccgtttcctgcgtgtgcctgaagcccggaagagctgagcttcccgtgcagtgtcactctcttcagaattagcaaggaaatttgctgttgttgttgcagagggaattaatccagctcgcatttatctcggaatggaagaagatctaagtgtacaatttacatttattttacccgcggtactacgtatacttcctccggactcataatagttatcgttttaaacaagagtgaggttaaactcgaatctttgattataaatcatttctaaaatatttgtctttcaaatatggtgattacatgtatagattagttttaaaaagtactttaataaaatcatgtatttgttaacacttttatacatattataataaaaaataatggttaaagttgttctttagagaccgtgcccttataaaaaacgataagtattattaacctgcagagagtacagcgcaaaattaatagattattattgttattgtttctggtgtgcacagaacggcgacgtacagagtggtatctggtcaaaactcgctggttgctggcttgatttgccgttgtctggaaattaataactactaggagttgagttgttccaagaggtataggtgttggttggttggccttgttaatgtatgctcacatcatgaccacattcttcaattttcgtggttcggctatctagctatcgatctagtccagatttatgctccagcaggcatctaacattgtcaccatcaaattgctcaactttttcgtattaaaacgagatatgttgaatttacgtctagaaaggaaacacggtgaagttattgtactattgagattcttgtatattgtaacggggattgaaatttacaaagttaaatttattttatgagccaatactactaggaataggtcaggagtatttttctaaatcataaaatataataaattaggttcagtaagttatattagcaacatacctatattggtgctacacgctgcaacgaaatcacacatcccaggcggtcagaataagttttttagatggccgagcgcaccacctatgatcaaaggcatgtaaaaatcaacgatcttcataggtggggttcaactatctatgaaaatcaaattttcataggtggatagattaaggctacgttcgatagaatgggttgggaaaccatccctccgcacgaaaaacggagcagtccattagcgcgtgattaattaagtattagctaattttttttccaaaaatagattaatttgattttttaatcaattttcgtatagaaactttttgtaaaaaacacacggtttattagtttgaaaagcgtgcgcatggaaaatgagatagagaggttgggaaccttcaggttcgaacgcagcctaagccaactacctatgaaaatcaattttcacaagcaacaaggttaagccaatagcatgcagagatgatttttcttgagagaatccattctataccaccgagtttgtttgagtttaatgatatgccatcgacattgtttctttctataatatataatatattgacgactttatcaattgttctataatatgtcattgggctaggccttatttttaaaaatacccaaagtactcttagagatagaaaattaacaattgatttatctcaatagaagtttcataaaaatatgaaaatttttatgtggccttcgtacacaacatggaagtttgtatacaagtttcgagtcttttctggtatatttaattttcgtaaaaaaatatttttatgtcgtatatgagagaaaaatcttcttataaaagagataatagcacaaaaatatcttatgtagtttatgaaagatgacttgtattaaaaataataataaaaaatattttatatggcatataacaaataaattatattttttttataaaaaagaaatgtaaaaaacttgaaacttctatacgaatttccatgttatgtaaggaggccacataaaagttttcatatttttatgaaatttctaatgagataaattaattgttaaccttgtatgtctattaggtcattttggttatttttaaaaagaaggctcagcctaatggtatatcgtagaacaattgataaagttgccagtatattatagaaagagataatatcgatagcaaatcgttgaactcgaacaaactcagtggtatagaatagattttctcattttttttgggggaaaaagagaaacaaatcccctaagaacatgtagttacggtcgtcatcgtcatcgccgtcactgagttgcgtttgtcaccacgcccaggaccaacgaccgtcatcaacccaccggggccgcgccactcgggtcagcaacccgcactcctcaacaagctcacgctagatgcccatgaagcagcctccacgtccccgatatgccatttttgacctccctgggccatagtcgtcgtcgccaagtaaccgaggactactgccgccacaacactcgctagtaagaacctctaccactatatttgacggtcctgagtcctaccacagtcttgctcctcctcctcgtcgatcctccccgcctgcgcccgactttggctcatcgtcgtccaacatcgcccaaccgaacccactaccaggagagccagtgtcatcagatttggtggccctggcctctttgttggctgatgcagtggctgtggtggtggtagcgtagctgtgcatgaggaaagaggtgacaatggggacacatacatcgaggcgatgacaggggtgcacgtcggcagtggtgcctaggaggagaagggagcatatgactttgattattagctcagggggagaggggagtgaggagggcggagagagggaggcaaagggataagggtgttgtggcttggagcggccggcccggtctccaattttaaggatttcagactatttgtaaaaataaatagaggatatatgtaaagatggttttttttatagtgactaacgaggatagtaaacccaatattatcggcaaaggaggattagagcaaactcatttcccatgcatacacaataaccaattactatggggaaaacttagcgtcaagttaaaacaagccgttctttaaaaatcaagtcccctccctctcaggacgctggcgaggagctgaggacactagaggagaagggctagcaagaccgaccgcgggaaagaccgaccgcgggaatctaagtcatttttcgagagttgcccttgtagtaaaaatatatattatactttttggataacaaatcgttttccatactgagagagataggaagggggagaagcttcatggaaacttagatgaaacattgaaacctaacatgttgctacgaatatattatacgaagattagtcactgaaataaactgtttttttttcttgccaaaattcttggcaacgctaaatcttgccattagcaaagtattagtaaggtttgaaatgacaaaggaatttattttagtgattactcttccaaagagcttgttttgatatgtatgcatcatatggtattatccccggtcttgcattcaagctccactgttcctatgctccgagttattcacaaacgacccgggaaagctacaagttgcaatcgaagtttcagatgttaattcaattcacactttgctaattgcaatgaccgccagtaagagcaagtttaatagtatagccaactactaactccaaatcatttataattaatataatatcaattcatataatagttgcttactacactattaatagttggtccaacatgtcatacatacattacgtattggagtccgtgctacagctggctatatatctacagcccgcagctcttctctctcttcttttatctctttaaaatatatttatagctgatttatagttgctattgtacctgctttatttagttgttgctattggctcccagttaggtggccatcagtcaaagcgcggtaccttgacatggaagcacctgttcttgtgatgttcttgatgggggtcaaaggggtgcgtgcgtgcgtgttaccatcaacacgttcaacgtcgccgactggctctctgatctatcgcctcacacaaatgaggccaactgaaaacgaaaacgggaaccggtgaccattttcttaattagtacgcaatgaggccaccgaatgcatatatacacatgacgcaccccaaaaatctctttgtgttggcaagtttacaaagatgcaaaaataaggaaacagaagaagaggaagaaaagttttgctccctggaagccggtgggccccacgatgagacggtgctgattcataagatggtaattagatacttggattggatggatatagtaccatctcaaccagattaggtctccctcactcagttttgctgtgggttgggttggctttgctcgctccatgggcgagagagccagccaagcaaagcagcgcagccaagcgtcgtcccgtgtgctcatcgcgtccccgctccatgtggccgacgcggcgtcgcctctcctgtttttcttttgtctccgtcgcctcgcggtcgcggctcgccctcgtctcgtctgggtttggatctgacgcgcacactgggcagatgtgtacatcccccgcacctcacctgactccctcccaacgcgcacacgcaccaccaccaccgcatcaaatgcgcccgcgcgccccgtacgcgacgtgccttctcgcgggcgctgttgctgcccccggccgcccgcttgggttgggttggttgcgttttttctgtgttggttccacgtcatgtgaaccgagccggaactaaaacaagtataatcaatcgtacataaatcaccacgtaaagcgtaaagcaaccgggggggagggggaggagttcagttaacccatgtttcctcgtgtgtgtgtgtgtgcgtttttttttttcttttttgggtggtggttagggactcgatctcatctcgctctcgccagtgagtcggatgccaccatttgttattattagtagagaattgcaagtaccaaattcgggagttgggttcaccccggccagtagcgattggatggaggctgaggctgctctctctctctctctctctctctctctctctctctccctgaattagctcgagaaataaaaacgggaggagagggacgatgtgctcgtcgtaactaatggcgaggcgaccgaccatgagatgatgagaatgaataatgataacaggcctgaggattgaggaatcgaagccggtggggtcccggttccttgaccctggcaactggcgagtagagtagtgtactggtactggtgctgatgctttactttcggttgtcccatgagcggccagcccatgacatctcccccgtcctaatcaatctagacgacgacttccattccgtcgtcccaagcgacgaactgacgacgacggcgacaccaccgccgagacgtctcgctccgccggccaccgcctagctcgccggccgtttgcaagggcttgcggttgaaaacttgaaaatgcgagccacaatgagacggtaaattcgatcgaaattgtgaacttaattccaagcaagcttgtcgacggctacacattgaatcactggttcagcgaatcatgggcggatctaggaaggactagaagggacttaataaagtagataagcctataccctttcttctaatgaatactccatatgacaatatattttaatgaaaagtttaatgagactcctataattctaatgccggtaataagaactcgagacccatcatccccatgacagatccatcattgcaacaaatcattttttttctttcttcagcagagatctcgcatgattttacagccaacgggctttgctccgtgcctggggccaatgcgtggaaaatggtgcgacggagatgtcatcggccaagagtcacgctatacagcaagtgggttgacgtaatgtaagataggatacatggtacttgtgtatgaaatggagcaacttgctagagcacaagattgttatggtctctcctattcctcagttttttttcccctccttttggccaccagatacgagcaactaggtcagaaaccgaagcacatggtttcaacataaaaacgcgagttttttgcgctaaagtgtgagccttgaatagcccaaaggtggcaaggtgtagtatcttccgagctggggtttgggaaggggctcgattgatccagtgatttacacaggctgggcatcttcacaattggcagttagtggtcctgtggtagagatccgatcagtatcctcacctcaagggcaaccgggccaattcagcgaaagaatatcagggtctctcgtattcccatgtgcaaacacttttggctctttcacctgcagtaaatgctgaggttagcgaccagagccagtattcaatcaccaccgtgagtttaatgtttgacagaaccagaaataggatggcaatgctggcatttggctggagtatgtaatctgcatgccgataaggtagatagctactctgtaaagaatgatagcgtaccagtgagagtagtgggattcgaggttgaattttcgctctggagaatccatccacggcaaacaagcacttgtagccactgatatggcggtgttcactgtttggtacaacaataagaaataagaaaagcattacagcgtgaaatgagtaccagttgtgcctttgattatatttattcatgcatggtaacaagagttgttcggtaatttgcttctactcaaacaaacatggaggtaatacaaggacttttccaacattaggtgaactccccatatatgtaggccccacttctcagtggtgcttgcaaaagtccgcttcaatctttaaatatccagatagtaacaaaaataagtgcataaggtattttagcaaatactccctccgtttcacaatgtaagactttctagtattgcccacgtacatatggatgttaatgaatctaaatacatacatatgtctagattcattaacatctaaatgaatatgggcaatgctagaaagtcttacattgtgaaacggaggaagtaagtaaacttacttcagcagatatgtgaaatttctttcctgatattcctcgatggaaattttttcctccttagaatatctgccagtgaacagattttgagatgctcataaatggcatgataaaagatactaacaaagataaaacactacagaggatacctccaaggatattcactttcacagaaacgtgaaactccactcattgcagtgaaggcatcaatgtgaacaattttgtccttcattacagaatctggtaaaagagaagcaaccaatagtatgtgccatcaataaagatattattgtcaacataccccataatcgctaaaacagtagacaccactagatgagacactactagctgttcaatttgtaatgtgctgcttgcggttcagccaagcccttgcagttttgttaacagaagaaaactatcataatttcacgtattccacataacttatgtaggtctcacctgcttcatgtagagcctttagagcatatccaccaggataattattgtaggatgccatgaaagttacaccagagtatcctagactatataattatatgtgagtttccaacagtagcatatattgtgctacttgaaaaagataccatattaatattttacaatataaccatggttaaattattgtacctggaaagaaagccaccaatcatgagaacataaagtaacttccacccagttttctttctgttattatatctgaagatagacaaacatatattcacgggtcgaaatcgcaaagcaaagaaagagaggaaacgccattcaatacgaagggtatgaaataaaaggagttctgataatgaagctagcattcctagcttggatcagtaaattgataaaatagtacttcctctgtttcacaatgtaagtcattctagcatttcccacatttatattggtgttaatgaatctagataggtatatatgtctagattcattaacattaatatgaatatgggaaatgctagaatgacttacattgtgaaatagagggagtaggaactagatatgacagaagattgggtatgctcacattctgcttgctgctagtgaagcagacacattaagcatgggaatcgaagccataatgaagcgaagctcctgaaacacaacatcagtcatcatgtacaagaatggccaaatataaggatggaactagtatcaagagatgtagagataccttatgtggaagctttgaataaagcacaacaaatgagaagactggaagtatgtatggcactatccttctgtcaagaagagcaccgacctgtcactgaaaaggcttcatgagatacatttcttacttccaataaaaaatcaaataaaaaaaacaataaccaataatgcattgatagtaccaccatcagaaaagatacatcataaaaatataattagttgactcaatcaaatagtatgaagtaacagttttgatataaagtacatgtagagatgggaagccaatcaactattactagctaagcatcatgtttcatgcatattaaatacatgataagaaggcatggaataagttatatacttgttcaagcaaaaggcacatgcactttttagccacgtaagtagcacaatttcttgtatggaagtttcttatctcaccatgcaaagaggatatgctaccagcatggagcgtggaagtgctgaggtgaagtaccaatggatggaatgtgtctaaagtttatggtagtcatggataacagggctgggagcttcgcataagtttcaggagataatacatagatttcaccacatgaatctaaaaagaagaagaggataagtcttgaacaagaagtgtatatatgttgcatccttttttgtattcatgtgactaatagagattaacatcatgttcagtgcatatgaaaatgaaacttcaatcttcccaatcttaatacaaaagatatgtgctttgcatattctcatatgaaatgtctctgtgaagtgacttagtgaaagagagaactgatgcatatatatttggtagtaaaaaagaataaaattctggctaaagagaaaggagtgcatatgaaaatgtctccgtgaagtgacttagtgaaagagagaacacatgcatatatttgctaggaaaaaagaataaaattctggctaaagaggaaaaaaacggtgtttcattgtgcactgaaagtattaactagaattattataaaaaaaaaaggaaactgcagtttggcacatgcacacaaatagaaaaaggatacaccccactctgaactccggttcagaactgaattaaaccacaaaacctcaaattctggccacaggattcgccgccacagtatagagtcaaccagtacagtgaagcctaagaacattattcatagtgagaaatgtttcttgcagatttgcacagacttctgttagactattggagaaagttcaagaaagtagaaagcaacataccaatgcatataatggcagtgcttacacaacatttgattgcttccaatagagaaatagacctgctctgtcacagcatagtcaaattgcacctcagccccaactttcccagataaagtaagcagaagaatacatacaaagtccaaatagatataacaacttgatatatgatagtataagtgagtgctatcattttaatagcctggtgacataccaagttactcacttagagattattagccatgcctcaataaaaataacttatagagataattaaccacagtcccctcatggtccttcaaacaagtttactaattcactacagagacacaaatgatgaaagcacaaaaccgcaaaatctggttgaaccatgaagcccttatgattctatgacaaagttactttgcattgaatttgaacaaacacaaagttgggaagtaatagagagtattgacaattggtatttgtacctagtgtacgagataagagctatttgtgcatagcctacaaaaaatgagtaatataaactttggacccttgcttcctcaaagatttcactacataaaagagtatgaaatgactgtgcaactgccaagagaaattcaggttttgtaggtgaaactcaccagcaaaagtgcaagtcctattgtaccaagaagcaaaatcatgtcacacctaaaaataactgctgcgacaatctgcaagcaatatggagaattacttcagaaggataaagcggaactgaggatctttcaatgctataaaaccaatttgtaatctttattggtctgcaaataaataactgagaatcatttctcaatttagtaaatcaacaagaaattgaactgaacgaagagtaaagaaagaatttctcagtttcatgttgaaacttgcaactttagaatgtcatgtccagaactcagattctttggagttattgtgtgcagtgcaggatgtcaaattttgaattcaacaatatatgcaactcgaattgaaataaattcttgctttctgcagtgtatacaaaaatgtgaaaacagcagcatgcaaacaaaatggtgtgaaagtaaggtaaaagtgttaaaaaattagcataccagggcctgtaatgtgcgtcgatggtttcccttgaaccaaaaatagtatgtcaagttaactgcgagacagaaagaaacaatgagttgcacgattattacacaaaccccacatatgattaatgctactgccaatagtgtcacaaaaatcagtaacactcgaacagacttgtgtttgatttaaacaatgtcctcaccaaaagctaaagctaagacattcggaaggggcctggttgagtagaacaataagtgaaactgggtagcagttagtatcagatagaatgcttcagcatgatgaccaaacttcctttttacctgtatatcagaaatgaactgagaaaaacgttatggtgtccaaggacagaataacagactcgtgctcacgggacgattcagtgcaaattatagaaaacaaatgttactcaagatgggcatagaacagtttgacataaacacataacccaaagggatatcttgatgatatacagcacttagaagtttgtgcatgagatagtagaaacaaaaattaagttctcttctatccagatttgtatggaatataaatggcacagagtgaaaggtatcgtaaggtatatggtccaaaccaagccaaaaaaagaagattcaaacaaggctagcatactgcagcaggtatgccacaggcaagacgaccatgcatcttaggcccttggcaaattcacagacgcatcaaaacaaaaaccaaatttgataagcaaggttccttttttttaaaaaaaatggtggccattctatgagttgctgcacttcaaggccaggagaaggttatacaggtaaaaggattgaggtttaccccttttcagggaaacagcgttttcagaatattgggggtaggtaggagaactgagaaacagtgcatacttgcaataaacccttttaaacagaacaagaagtgaaaaggaatacctgaactcggagaagtctcaaagtcatcaggataatactacccaacactatccgaactaaaagggcaaaatagaagaacatcaatatggcaacaaaaacagatacaacatgcaagaagacatgtgctaagttattgacagcacctgctagaagaccataaacctttggaacatgacataaatgcattacgaagactgcaggcgatgagataacagatacaaccaatgctcctgaagaatatatgtagtaaacggtgttaatgatctgcgtcatgtccagattacaaaatctgcaaggccagtcataccatatatagacactacaggcatatctagtaggagtatattgtggtaaactggtaatgccatctgaccttgaccatctacttgccatttcattatgcttgagccaagcaatggtcattagcggaaaaattgtagcatagtgcacagatcaaggcttcaagtgaacatagtattacctataaatgaccgagggacaacaccaggaaattctaaatgatcatactgcagcaaattgaagaaagaaattaaataagcatcaagcatgttgtattgatagactagcagaaatgattaccttctcaatatgatagttgtggtagagaatgtcatgcatggcctagaacatacatgagcaaagtgttagcctaaacattgtaatggcattacagtaaaagtgcaaacatacactgtggaataggtaaaaaaaatttaccaaactaaacggaaaaaggcaagaattagcaagtaaaagattcaataccaggcaaaggaaagataaatgagcagtagagaatgaaacaatttcccaaagcaaatttcattcaaattgattatcacgcagagcctaagggaagttatcaaacataaagcattagtttttagacatgaagggttgaaagttgaaactcataattatcctgcaaattttcctctacttctttaacattgcataggtgacactggaacttgagcaacttcagcttttcaacgctcatgatataatatatatgatgtatgaactaccaaatatagaaagggtgcatcttggatgtctacggcaaagatacccgattcatcaatattcagcatggattctgcgtgtctgcagaaaatgtaaatgaattcacataagctgattgttgttaagtcatactatcctacaattcacatgtgcacaccaatatcatctagcaaccagttgcaaccaaaatgaacattagcaaattatcagcaatcatcctgaatcccgtgtctagtaactgaacagcaacagagaataaggacacacactactacttgagcaaacaacagaaaatccctactgtaattgcacacaaagcacgactacaatgtaatccagccactcggatgctcaacggagagggagccggaaccggaacctgcacgttgaagctctcttccaccttggtgtagggcaccatgacggcgtagaacgcggcaatcgatccgagcaacaggtcccaccctgcaagcgagagtagtgcccccgacgcatcagatcccaaaaaccctcccaccaccgcagcagagccctgatttggagaggcttcgcgaggccgagagcgagaggagagcactcaccgtactccctcagcagcctcgccgccggcgagggccgcggcggcgccatcccggtggccggcaaagtgggctcgcgcgtgcgacgagccgacgagagcgagtcgcttccggaattccgcggcttggtcgagccagatcggcgaggctgtgctcgagtcggagtccggtttggttgacgcatccggattagtgggcccggcctagcttagcctcttactaggtgg

SEQ ID NO: 43601 - DNA, 4604 bp, Oryza sativa
ctccactccagactcaactcctggagttatatttaggagttggagttgtaccaaacaggcccttactattacaagaccatatcagcagaccacgatgacgaataagggcccgttgaccagtcggttgggccgaatggctcgcaagcccatcgtcttgtgcaaacccgctgaaagcagtagtcaaatgacgtggtgagatcgtattgggcactggcctcctaaatcgctgagaagccggctaatctagcacctttaagatatcttatatttgccacctgatgaaaaatgcttagtggtttagcacgatatctcgtgctgccctgcaacgctttaagtaaagcctttgcaaattgagtaattgacaaacaaaagtgacgagtatttcttactgcatatattttctggaagcaacaaaatgcttgtctgggcatttgcgatgcatgtcctctttaagatgggcagcacaaatggccaaatggccaaaaaagaaaaaaaatctggaaattaaataaacttgctacaacataattaatcgtcttgcatattgcaagtgttcaactgaaaacgcgcggtaggtgcgcctatcattagcctgtctgaaaacgtgtgtttcttccagcagagacggatgcagtgtcagtcagacagtcaccacacactgtcatcagacagagaggagacaacatgtgaagaaggcgagtttgtccgagagctcacgttcgttttaagcgctgtggaggtgcagttccacaatcattagcggctatggcagcaagcatgatgggcgagtacgagtacgagtggaaggacgaccgctagctttgtgccttccctgattcgtcagggtgttgctcgtaccatacagtaccactttgcgactgtgcatgtatggccgacagacaggcaaggtgtgcatatgcatatgcctctcgctttcggtgcccttgcatgcatcgcagttcgcagcagccatgtccaagggcttttaagcaggcaggcatgatccaaattgccagactagactagcagtagtgttcactgtgcttggtacttcgtcaggtatatgtaggagcatgcatgtctccacattcatattaagatcgactgaatattatgcaacttgatcagctgattgatactaggaaataacatgcaggtgagtgagacttgagagttctaattaagcttcctactacattttcattcataattagactgaatatcatgcaacgtgttgatcgatcggctagctgattgaccaggaaattaaatagcatccataagagttctaaaagctttcctagtacattttcattttacatcgatccctgcttcttcgatttcccaattgccaccatcagatcagagaacaataatccatcaccgatccatgtacataagcatgcgttcgtcagaaggaggtgaaggcgcagctggcggtgtggtcgccggcggcgccggtggtggcgtcgtcgctgcagggggtgtgggtgtggcggccctcgtaggtggtgatcaccatgcggcaatcctccgacagccgctccacccgcttcttcacgcggcagttgttgtgggtgcacctgtagtagctcctgcatttgcatgcacaatttgcacacaaacagtacacacgcgcacaccaacacagattaagtacggactggtcagcaagctgagagagagagcgattcattgatgcatgctacagagaaactgcaatcacaaacaaatgaagaagagcgtcagcagcggatgctgctagctgatctgaaatggcactactggcctggtgacatgcctgcatgctcaaactgatgagcactactagtgctgtcacgtactcagcaagagttcatcatgaatattgtacgatgaaatgggcaaggttaattataaacaaaaaaaaaaggggggagacaattttaattgacatgaacccttttttggctaatatattattaaaaaaaaattgtgttacacaaataagaaaaacatttaatgtgtacgcaatttccgcatgtcatgatcaccgactcgtaactgatcatgcatacatctgaatactaattaagtttcatacggggtataatagctaataatgagctcaaatttgggctcaatactcaaatatatggaaggacaaatactgcatgcatcctctctttcagaaaatgaggctaataagagctccaccatttcctgaaagagaggatgcatgcatcatttgtacattgagaaaatggggctaataagacccttagggcatgtaaatccaaaagaaactagactagaagtcaagcacaccggcaccaattctcacaacagaactccccatatatctcttaataagtactgtgaactgctatagataaaatcaaaatccttgcaatttatttactaggaaatattgttttcgcctagagcaattcatagctaggaaacatggagagttataacttctaagggcatgaactattgtctatataattttttcatgttatatcttagacgatatacaaattaataactcatacagtagtataagaaatactttagttctatagatagcatatatgaaatgtgtaaatagtataaagttttctattaatcaggccgtctggtaatcaacaaacaattttttttttcctctctactttctcttgccttaacatcataaaagttcctactaccatgcaggagtagcgcattctctcctaaacgatgacattttagttacaccattactaatgtgtgggggccaaatccttcggtcatcctagcaaaaaataatgctatagtggctctgtttaacccgaacacccacatcccgcgccttgccccacctcaaccatcgaattacagacatgaatggtgtaactcacagttttgaccaagacatgcatactttgacccccccccccccctcttttttttttgctaggatcactactataaaaaggattttttcgtgcggaggtcttgcccgtctgcacctaggtgtctgcgaaaataaatattttcccgaaaataaatatcatcgatgactttgttcaactattatgaaaatatgatactatttccccatcccaaaaaaactctatgtttagtccataacccctgctttcgaaagtgcttgctttcccttcgagggtgtcctcgaatcgggctagatctcgttccagtgttatccccctaggacaaatgtttttcaaaatgacccgaaaaaatgccaattccttaggcacataccaatacaataaaaaatgctagaatatccttcaccttagaaaactacaatgtatttatcccgtactttagcaaactccgatgcatttattgctccaaaatgaagtctttgtaggacaaacgagatgggctaaaatgtggtcttttttgaatggtagcggtaataaatctaataatatgacttttgatgtataaacataataatatagaaattattattgttcaaactttgaacatgatatgaatgtatccgttattaataaacggagggagtggtattttagactgttagttttcatttttatgtttgaacgtgacgcaggagctctgctattcaattactatgagttttcactgaatatacgctgttttcgttggacttatgtgcttgcttgcatatcaattttatcactcaaactatacctaaaaccataggattgcagagatatactacaggaagaaatcatgcacaagctgctaacaggggcttccccttcttacgggtactaagtatctctgaagaaaaatattgcaatctgaaaatgtgtgcaccatttgtcccggtgcatccatatgcacacaggtggatgtgcaagcgcctgtcctagcgctgcagatcaaaaatcatgataggttttactagtgccataaagatgacgcatgatcagaacttagaccaagcagaaaagagaatagtagcggctttattttttttttcttttcaaaatcggcttttctgaatcaggtggcagtctctggttcggtaggtacccgtgccaaaacatagggttaaactcaggtgttcagggatactaataattagcatagggattcgatgctctagatatctcgtttttttttctttagtagaaatatatgcatcatactgtggcatgcatggtgcattattattgcatggtatactctttcagcaaagttcaccagctcatgctgatgcttatagtgtatatatgaaacacacatgacatatgcaaatatgaactttgagaatggccacatggagtttcgatcactgacaggggtggatccattgtgggtagtggggggacttaagtcccttctgccccactggatcatcgttgataaaaggaagatgaaaggagaaaaatagggagaaaatgaaaaataggaggattgaagaagtaataaggaaatgagtccccccttaaatcttgttttggatccgtctctgatttcactgatatctatgatatatcgacgtattacacttaggaattttttttcctgaagagaccgtattttgcagtgttcccatattttcaataccataaactactcgttacttatcttcggtcaacaaatgcaacatgggg

SEQ ID NO: 43602 - DNA, 2928 bp, Oryza sativa
  unsure (1)..(2928): unsure at all n locations
cgtttacttctgaacaattaaacatatatctatttgatgttttatcgatactattcaaagcataagatgatcgatgtgtcacaaattaaggtggacaatttctataactacagaccggtttttttcctctaaaaaatttctgtgtagatgcaatgccagcatatatatccctaagcaatattccagcaccgtaccatcatctatccacgaaccctctattatcatgttgtgttttgaatgaagaaattttgcggaaaatatgtgtggagaatatgggtaccggcctaccgggtacccacacggcctccatattctactagagataggaggtgggccacatccatatattatgtaatagattaggaaactgatgccgtgtctggctaggtttcttctttgtaaccctggccccccaacctatataaggcgggcagagagccctgccttctccaaggggcatgaacacagggattcacaccagatcatcagattaatactacacatagcgggtaaaatcctaaaataggagtagggtaccttttatcgagagggcctgaacctatccaaattcttgtctccgcatccattcactgttaggtctcgtgcgctatccctttatattgccgaattctagtttcgacaatatgtgggaaaagtaccgaatcctcaccatcattagattgtaggaatggttggagagattcctatgaaatctttccttttcttcatttttctagtgtctaaacatgaactcaaacatcatgtttggaattatttggaaaaaaaaaagaaccaaaggagttgagctcaagatcctcgttttcaaaatttatatgcattcccactctctctctctctctctctccctcccccctctttttttgagatggattctaatcactcaggtggatgtccatccgtttattgcatgttaaataaataattatgaaaaaaattgataaaatagattaatataaaatatatcactctacgaacatgaaagtttaaattcaatttctacaagttataacaaaaataacaaatcaaaccatgaatatacgtctaataattagagttaaatatgtcatttttattataacttgtagaagttgaatttaaacttgcatgttggtggagtgacatattacatatatcaatctatcatgtcaatttttttttgaaaatttttatattcatttagttaacatgaaacagatgggtggatatccacttaagttattaaaattgttttcccccttttcatctattaaaaaaatattcctttatggttcctctagtgcatttggacatttctcttgcataattcctgtaggaatctgcagtgtacacacacatacacacatgtaacatcatagcaagagtaggctaggtgcaaactgatccttaattagtcgtcaactaatctacaaaaatctgcattcactctttcttcttttaaagggtgaattcgcactcatgtaatcaagttattagatttgtgaaagctcttttatttgatctataaagattaacaaagaagcaattctccatttaatattatagctattgtgaagcatgtaattcaactatagttgcacaaccatattgccacaaaactagttaaacctcaccccagataaactatataatatatatgtgattcaagataggcaaattaatacttaaaataggaattgtcgctgttctccctctcttcgatcttgtgttaggggccgcattcgcgagtgtgtgagtgtggtggtgtacatatttaacggtgtgcactggtatgcatcttccatgtaaccgggaaaaaaagataggcaatggatcgattctgatcccgctgatcttgtttcgagcatattagctatggaggcagctatggtagacttctgttaattatattagcagctgtggaagaacctctaggggttgcatatctctcaatttatgtattatgtttcgtgtatatatataccttgggtggaggctgttcttgacaaccttctggccatacttcctccacttgtagccgtcgtccagcacatccacatcgctcctggtctggaagcagaacctcggctccctcatcttcctcctcaccttcatcttccccttctccgtccccttccacctgcccatcagtcaatctggcctattattacctcatcaaaccctaatcaacaggaggctacaacctcaattcaaggtgttagctaggacgaggtgatcgatcatcgtactcaccatgaattaggcccatggcaagtggttgcggtggcagctgcagcaatctcgctatccactctcgccgccgccgccgatgtgtccgcctgatcgatcgatcgagatccaagattgtaagcaacaagtaattaaagaacggcataccatgaccaaattgagatcgattgaaggctaattgatcacctcggcggagcccaagtgcgcgaaaccggcgggcttgtcgtcgtcgcaggcggcggcgccgcagccggagtcgaggcagaacgggatccccgggagcagcgggtacaggcagccatggtccgacgagaacatcacgccatggttcgtcccggtggcggcggcgtggtcgtggaccagctgcggcagctggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 43603 - DNA, 25003 bp, Oryza sativa
  unsure (1)..(25003): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaccaggaaaggaacccccattgccatcggtaggggaacccatctcccatacttcggtgggcaaaggtccctcgtaaggttagctgccactgcaaagccaaaaaacccatagcagagctgcaagcaatgctggggcagagcagagaagccctcaacaccaagaatcgccatgtttcggtagactagagcatatggtgctttccagtacccttctgggttgccaatgtcaaaggcactgtagaacaagaagaaagttagtggtgaaattacacaacccatgacagttccaatggcctgagcaataatcatcgatctcggtgatgttaatgttagatgtcccgtcttgaaatcatgcatcagatcagcagatatggacaccagcgatttcaccaaaccacagcctactaggccagcaactacaccagagtctttcccagcccaggctgcaagaatgaagagggcaatctttccataattgtaggccatattgatgtcagttaggcctgctccataggcattgcagaaaccaagggcaggcgccaataagtatgctatgacaacataataccacttcatctcatggaacatcatgggaatggcaattactgcaataaaagttaatccaagataaccagagaaggctagccaggaaggaatattgtctgttgtaaaaacttcattacgatgaagttcatcgagcactggcatgtcttcccctgtaagtggaatacaccttatatcagatcatatataaactagaaaggtcatattgagttctgtcagattatttacccttctttgcattcttcagttttgagctatcaaacagattcttaatagtgagtgcaactatcttcacaaaattgtataggccatcacctaggatgagagctacacagatgaaggcctaaagaatatatatgaggtggtaagaatcaaaagatcatactatacttgtacactaccaaaataaaatgacgaaactaaccttgtacccttgcaggcttttcatgctgctttcaggtatatctgctgaataccaatcccctttcaaatcactgatcagtggccacattactccccatgagagaatggcgccgagtaggagagacagattaacaaggtgggagcaaatcatccctgccccaacatatgtgagactgaaatcgaagaagaatctgataacccaaaaagttttgaatcagatgaacttgttttttgaacaaatcaggtgacactattgttggtcaaaatttatttaatagaataatgagctaagtgattgttgttacgtttgttgccaagcttttagtccaaaagttggaaactgcgagaacccacaattgtctccaccagagtaaaaccactggaagaagctccaaaagaaactcatagcaaaatatttggtgaatccatttacttgctgcctgatgtgccaaaaaacacgttcagttaactgaaattttataatgaatagtagaactcattatgagttatgttagagaaccacatactttgccattgcatccccatgaggtgtgtggaatccatttataagcacagctgttgcagtcccacttgggtaagttaatttgtagtcaattatcatgacctgaaattttaccaagtttaagaaacaaatggaaattatcaagatctggaattttactaagtttggtaacaaatgaaatcatccatttacatgtggaaaagcactgccagctgttcattttttatgtattcacaagataaatatgttgtgaaatgaaaaggagaatatgtccagaatcacgcataataagtctttgcatgtggacttcaaattatgctttcaattaaattcaactgcaactcaagattcaaataataagtatgctttttttcagaattaaaaaaatatattttatttataaaagtacaactcaaaccacaagcaaaatagctatattttcttcaggggactagagaagtaccacacgctaatgagttggtattgtttgtttcagcacaaatcactatcaatcgattaagcaaaaatgttggtatgtcttaaccaataaccaactaggtggtttaataaagccagactgaaagaggtttcatgacagagacaaatttatttaatataccagaacgattcattcagcacgccaatttcaaacaactaaacaagaccatacaagaacaattcaatcagcagtccagattcaacagggaccataaggccatcaatcagatacgttaaaatactagctgcacttcaactctatcacctagctaaatacaggcataattgtccttttttttagcttatgtaatctgtgacatcgtgaaatgaaattaaaacacctacgaaatgttgaagggacaaaagatagaaaaggctgaaatggagatgatggtcagtttaccacaattttgtgaaattctcacaagggtgaactggtgaacgacaaaaacgcctatgaaatgtagaattgcagttctaaggagtaaggagctacagcgaaccgtggtcaaatggcagaactgttgaaattataagcatataatgatttaatttattctataaataaatcaagacattgcagatataaactagcatgagcgcatcattagatctacacatataaactaagcagtaaaacacgaacagaactggtcaaatggcagaactaccgaagatacagagtaaggctgtggaagctcactgaccttcctaagagggacgagagcgagaagtccgacgaagctgacggcgagaaggaatccagtcatccacgcaatgccgggctccttgtagctccccggcacgttgccctccgtgtcctcgcccgccatctcgtaagtcctcttgttgagcccaagcaagtaagaaccaaacccacctgcacagaaagatccaaagaaccaatcagtcgggatctccattagactaggtagacgacgaatggaggatggatgcaatggggggtggtcctggcctccaactgcgatgctgtagcaggcgacggcgcaggtctggacgacggtgttctcctgccgcgtgaacgggcgggcggcgaagccgaggcgggcgagcgcctgcgtccagccgcggaggacgacgaaggcgatgagcgcggctgagacgttgagcgtggggacgaggcccgtggtaaggttcagcttcatcacgatgacgctgtacatggcgcccacggccaggctcgccaccagcccgcgcgccgtcagctgctcccgccacggcggcggcgcgccgccgccgccgcgggcatgcgtggccccctcctcggcgtcgccgccgccgtcgagcccggccatctcctcctcccgcgggtgcgctaccaccagctcgaggcgcggcggcccgggctgccgcttcctccgcctctcctgcttcatggcggaaagaattttccggcgtcagattcacccccgtgtccgagttccagcggaggcatgtgaatgagagaatgaagggtcggtgaaacaaaaagatcttttttttttcagtacgaggatgagttagcacgaatatgatgctagctagtgagctcctcacttgtgttcttctacatccgttgtgctaagcaacgaagctatgaacaagtgcgctctctcgccaaggatcagtgcaagaaatccataggggcaaagaaaaagatgaaatttttatgggtgattctccaaagaaaatcactgccttttatcttcagtgtggtatcgaggattccagaaagataatgtaaaaaagacccacctgaattagcctggattctctcttgctcttgctccaactgaaaagacaagaacagcgagccaaacgaaactgaaggtgagaaagagaactgaatagcacgtcacaaaagaaaggggaagtgattggcaaagagaaatagcgtatacttggttttgtttcgtcagaaaaggaagcaaggaggtttggtaatgtttttatctaccaatataatcactagtagaagaaatagaatttatctcacccatttatttatgagttaaataattagtagaaaaaaattctcctagcattagttgaagtatttgaggtggtactataaaatatatctattaaacggtttagattgattatgttgacaattactccttctatcttaaaataaatatatttattttgagatgggaggagtataaaacaatttctttttcagatagcatcaactgtcaacagtaatggggaaaccaataaaaataaataaccatgatcagtggaagccagtgtacaggaactaaacagcagacacatactccctccgtcctataaaaaggcaaacccttggtttgcgtctctaactttgactgtccgtcttatatgaaatttttttataattcgtattttcattgttgttagataataaaacatgattaatattttatatgtgacttgtctttttaatttttttcatattttttttaaataagacggacagtcaaacgttagacacggaaactagggtttgtcttttttttttggacggagggagtcggcacaacatacagtaaaaaatcgcttccattaacattccgtgcaagaaacacaggcagagtcccgccactcacgcgcaagcaaaccagcagaccctgaatgcttacgaaatgacaaaggttataaaaacaaagtcaacaaagaagaatcagtcaatcagaccttcaaagcaagatcgaacgattttaaactaagagccaacctgcaattatacgtgacgccggtaaaagaaggaagagaaaaagaccgcgaaggcgaagctgtcaagaaagcttcgtcaaaactcaaaacgacagtgaacgaactcgcgacctgaaccattaacagtcgtctgtcagtaataaacagcaacagaaaaagcattaactcgccggcgtaccaaacaactagtattagtactcctgctttccttcgtaccggtctcctcctcgacgagacggcgacgtcgacgacgacgacctgagctgcatgagccaaggctatagcgccgcggtggctaaggagcacacgcgaccggcgaccgtacgtaagcaaactggccgcgagcaagaacatgcatgcatgatgatgccatggcatgccaagcggcggcatgtatgcgcaaatttctcaacctggcgcaagcaaagcaactgaagcgagcgcgtgcgaagcggcgtgcccccgcgcgcgcgcgaggtggggttggggcggcaagcttcacaccggccgtgccgcttgggctttggctgcttccccctttcgttttctgcgggcgtgtgtgctcgcctcgcccacacgccaccagcccaccaccgcgatcgcgacacacagatatcacgacagaattccacggccctcggccgcagcgtgtgcgcgcgcgtgcgtcctcccggcggttcggtccgtatgctggggcggcaatggctgtgtacatccgatccgatgtagagaccgggtttatcctattttctaaaaatatgctggggcggcagtgtgaccgtgtgagtccggaaagacggaaagtagtaacagtggcctctgatgaaagcgtgaaacgcatctcggcgtcggcaagtaggcgcagagatggatggataatctgtggatcatatgcaaacgcgagatagcctcgagacctcgagcagatagtaaaaatcaagctgtagcaatagcaaatatcatgcgaatactggatgaaaaggactaatcacacgaagaaccgcaccgccgcaccgtactgaatgaaaaggactaatcagtacgtatggctgtgttctacagcgcattttgcttttacaactcccccgtttatcacgagtatacttttcaaactgatattttttatcaaaaaatcttttatatagatttttttaaaaaaataaactattttttaaatttgtagtgagtaatattccctccgttataaaatgttacaaactagaagggtgagtcatattatacccattctacatcaacaaatctggacagtattttagaacaagaaaactaaacagaatcataatattttaggatgaagctaggatatacttaattaattatatgctaatatttttttatacgattaaaaagctaaagctaaaggcacattcgaacaaagcccaaatcagtgaatcactgaacccttcacgcgtccatgttccggacaccttcctgaggaggcggacaaatttatggacgcacgaagcgcatatgttcaggagtgcagacaatgcaggctgatgcatctgttctcgacttctcgtgtggtttggagaagttgatagttagggccctccatgtcgtgcccccctcatcacttcatttagtttgttttcttcctatcattgtgggggtactagtatctcttacccgtctctcatccagcaattttttttctggtggaattaagaggttcactttcagttgaagacaaggcctttccctgaagttctgagaagactggtacggcggcaaatctttacataggactagaggctggggcgccgcctgcacggactaaaacgacaatcagtcggtaaatagatgagggaaatctatgaaaatttgataagcgacatcatagattacagttcaactcttgtggatatcaatagcatcgtaattagtattgcctttttccgtaataaatatcctactacagatggacactttattatcaacgtagagcatctctgttgaaatttcggttcgttacagactcttggttcacatgaatatacaatgtttttattacataataacccaaaattaatagaaaaataatccctggtacacattgctatacactttgggtttttgcaaatagggtaactgaagaataatgggcccaacttttcaagattacattcagcatcccatcatattctgaagaatccaaacatgttggaatgtaagtacatgaaaacatacgttagctaatgaaatcatatattgagaagcacctgcagatatataccataccctaataaaaccttaccgcactaagtgcccgagcacacgaaaaaattgttcataggtcaatcagtgataatggaacaccaaaattccattgatgtttatttatgagctagcagctaattagaagtgggtaaaatttactcagctagtatacctcttacaggcacatgggaaccagcctctagtaggatttgttcagttcacgacaccgcaaactccaagctccttcaacagaagaaggtcttggggaatggaatggcaccgagcagaagatgctgatcgaaccaaaagaaaaatacactatcaaagcacagcaaactaaaactccaaatgaatcaaaacatcaagactgcaggaaaagtagtagctccccaacatcaatactggatccacgtgctgaagaagttggtggaggcgcgaccatcggccaccacgtgcggcgagcggctagaccggccagttgacgacgacggctgcaggttacgacgatgacgatggcggcgaggcacagttcctcgcaggcaaaggagagacgagaggggaagaggagaggagtgttcgcctcgtcgctttctccgcgtccgcctcgaagtccgcgctcggcgacaacggcgaagcgaggggggagaaggaggtggaggcgctcggagacggcgacggcggcggaggcggcggcgacgacggcggaggcgcgagacgatgcggacgacgatggcgacggcgcgaagcagaggtggcggcgcgaggggaaagcggagacggcggcggttagggttttgggctagtgcgtgccgttttgcgaaaaaacccctcagcttccacattttagagcgcagacctaattcacggtttttctcaccttctaatagaatacccggatctacgaagggcctaaacgtaaaaatacaactcagtaggggtgggcaaaattagaccgaaccgaaaagaccgagaccgagaccgaaaaattcgggtagttgttcggtccctaacatcaaaagaccgaatttatttcgggtatttcggttattgggctcggttaaccgaaatacccgaaaggaataagtccattttgcgtccctcaattcttgccctttatcgaattacatccctcaaccacaaaaccgggtatatcacctccccaagtgttaaaaccagtacaaaacaactcccttggtggtttttgatgctgacgtggcatcctagtcattaaaaaaattaaaaaatacgtgaggtcccacacgtaagtggcatttctattcttcctctccaccactctcctctctcctcccccttctctctccctgaacagagcacggccaggggaggcgccggaggtgcgtgaggtgtggggaccgtcggaggatgcggcgggtgcacgccgcgagggagaggatccgctgtcagtagcagtagatgcaggtggtagcggtggcggtggaggagaggaggatgcaggggttaggaccgaagcggagctcgaacaaggacccaacacaccaaggtggacggccagggacggcggatccgaatgccggcactgtgcgccgcccggatcttccagctgacgcgggagctcagccacaagtctgacggcgataccgtccagtggctgctccagcaggcggagccggcaatcgtcgccgccacggggacggggaccataccggtgtcggcgctgacatccgtcgcaccatgccagggctagagctaggactctcataggacggccacatcggcgtgctcgccgcacagtcgctcagccagttctaccaccaggtcggcggcgccggtgccaccggtcaactgccgcacccgcaccaccatcaccaacaccatcagcagcagcaggaggaccgggaggatgagcgcgacgacggcgagtccgatgaggagtccgggcagtagtaggcgcaccgccaattgttcatccatgcatctcacgttgtctctttggagaagaaaaacagaattccaggaaggacatgcagctaatggaggggggatgcttttgttactgttgggttgttcttcatggggttttttatgtctgattttttcctcgtgtggtgtcgaagctcgaaagaggctaccacttgctccggcgacttgttgggatggatcatgatcatcttcagttgttactcctgctgctccatggatggtcgccggtttatccccctccaagtgtttaggtggcagctcaatcttttgcactccacagtcagcacatgacatgctattcgaaaggtagcttgatgagcttatgtattttgctggaggttggcggcgcggatagacaacaggaggatgtgttgccggccgagcagatcgacgccgtgacaggtgaaccctccccgcgtgggcgccgcggccggcgatcctctcccttgtggcatgctcctgcatcctccggcggtccccacacctcccacgcctccggctccgccgtccccggccgtgctctgttcggggagagagaagagggaggagagaggagagtggtggaggagaggaagaatagaaatgccacttacatgtgggccctcacatatttttttaatttttttgatgactgggatgccacgccagcaaaaccactgtcaaaaaccacgagggagttgttttgtactggttttaacacttggaggaggtaatatacccggttttatggttgagggatgaaattcgacaaagggaaagaattgagggaggtaaaatggacttattcctacccaaaataaccgaactagcccaatagactaggaggcccagtaggccagtactaagcccactaaaataaaccctaaatcaccaaccctactcctagtctcccactcggctcggctccctcaccctcacagccgcactccccactcctccctctcgcgccgcgcctccgggctctagcaccgcgccgcctgcctccaccgcgcctgcgccgcctccgtctccaccgcgccggcggccggcgccgcctccgttcgccctggcccactgcgtcgccgccggcgccgcctccgtccgccctcggcccaccgcgtcggcgtcgcctccacctctgcccgccctccgcctccctcgcgccgtctccgccttcaccacgccggcgccgcctccgtcgtccaccgcgcagacaccgtccttcaccgcctagctcgatttgcttttcagtttgtctttctgaatctgcttgatttcctagttgcatgtgcagatcagcagatgcatcatctctctattgatctattgagttgccttttgatttgtcaaccatacatttgttgtttggcttttgtgattttttttgttcagagacttctgctctcgggttagttcggtcatgaccgagaccgaaccgaactaaccgaagaccgaagtgctcggtcttcattttttttgggaccgatcggtcttgagtttttgatgactgaaattttaaaaagaccgaaagaccgaaccgaatttctcggttagaccgaatgcccacccctacagctcagaggatggttggcgagggacgccggacgaattacgaacaaaacagagggcttttttgtaaatttccaccacgcgtactgtagcaaaacgcgtacgtggcacaccccatcgcgcgccccttccgccagcctttatatattccgatatcatgacacagagcgctcagtgacaaccgattttacgtcaaggggatggagcgacggcagatccggtgttggcggcttggtgtagtggcggagctggaaccatattaagggtggtgcactactttactgtatagatggcggcatttactctaaataatgatagttgttcatttgtagataactattgataaaaaaaatcgttgagtagcaagtaaaagtgcttactgaaatataagacgaaaagaaaccgcgaagggaaacatcaaaaattacataaaagacgttcaatctatataaaatacatccccggtctcaaagctgtcaatctcaatatcatcgataagtaatccataatagcctacaataaaagcagaacagaagtcagaaacatcttagttttcaactaaaaatttatatccaacaatgaagatgtaaaaacataaaaataaatgtgtcgcaatattcttacaattttactaagtgatggttgatggactgatggcagcaggacagcaggagtccttgtcccttccagaaatcaattgaaactttcagttcttcaaactttaaaccctagcttatatataaatttggatattgaaagggtgctatcaacaagttacaaatcaaattaataggatttaaaataagactagaactagaagagagggtaaattgaaagtttggaactaactaaaaggaagatgttctcaaaaaaaaaaactaaaaggaagataatacctctctttagtctcttgcttgtgcactgctgagtgctccgctgctagctgcaggctgcccctgtagtctggctgctcgctgccgcagtgccgccgtaatgctgcgggctgccagctagggcgaccagcagcaggctaggacggcgagcaatggtgagtcggcgaccagcggttgagcgacaggagtagacggcgactcggcaaactgtggtgagaggagattgcgttggatcaaagacgaacagacacacagccactcagatgccgtatcgcgggaaaaagaaagacaaaaggcgaaaaacgggagtcgaagagatgtgcggtgccggcgtggctgtgattaacgctcgaggcgtcgctctcgctcccggtggcccagatggggcgctattttcatgggcctcaggtcttccatgacttgctcatgggccaggggtggtgcacgaatttgggtcgaggggttcccatgtggtgaaaatagggggtaagtactaaatctgaaaattaggctgggcgcctgtgaacccccctaagcccattggactccatccctggcttggtgagacagcggagaggacgttgccgaggcatgtgacaacatatcctgaagcggtggtacacggggcggatgacggatccaacacccctgttttttacctgtggccatcatgagatccaccgatgctatccttcgacgtcgttgcctttgtcatcactgtacgcacgcctctacctttcgcagtttcaccattggtggaggcaagatgtccatgccagtcgctagggccattggggagagagacggaggatgagagacctctgtcggtcgcttggccctaggtgacttgctacgaagctacacgatgcaagcagaaagacgatgagaaaaggggaggatgccgatatgatagtttctattatttttctctcctgttcaactaggaatgaatattctaatgaagggtgtatagcaaataaccacattttgagagtgatttttttcaaagattaacttttttttgtgtctagcaactaaattcgcgaaatcacgatatagaagttagcaaaatttgcctagtactacaaatgtactgatctgtcacaccctaatccggcaccactatacaacggcacctgacatgagtgtgtcgtaggaaaaataacatgaaccgcttcctacgagaccacgatatcggtaccagtctgtcgggtcccaaaactaataattcggaaaccgacatattaaaactgtatcaagccctggatcagtagattgatacaggttcaacaatctggttcttcattgcatacatttagtcaaggtttcaaaggagatattattacataataatattagggtatttacaagattgtggctaactgttacaacagaagccatagaatgactcaactctactgttttgctatagacttaaaccatctatctaatctatacttgagaactaagttagaatgagactaacttatatgattgaactcccagcttcagcaagaacatcaaattgactctgaaaaaggggggttgaagcaagggtgagtacaacgtactcaacaagctattatattcaataatgaatgcatgaaatggtaatatctgagtagagctaggtttacttgcagaaagcaaagaatatagaggaagaaagcctagaatgttttaaatacaacaatatttaataaagtttggaattaagtttctaaccaaataccatatgagtcccaatgctcaaatccgtgagcacggctattcgaatagattcatttatactttactgcagtaaatgtacgctttacccgcaatccatgacgtgccaaacacattagccttgtcatggcaaagctttttagttactaacatcagtggtacctgttccatgaactctagtccccatgcgctctgaatgtaacgttatcagcagcgagaggagttctgacgttccgaggtttttggagagaactggttgagagacccccgtgtaggatcaaggaggccgactagagggggggtgaataggcggttttaaaacttaatggtacaaaagaatgcaagtcttccacatctcattatcgggaaataacctagtagacaacttatgcaaaagagaggttaatcctataaacatcggtttatcatctatcaccaaagtaacaattacacaaattgtttaatccaagatctttcaatcttttctctctttggtgatggataataattcgatataaacaatatagagagatgagatgaaagatgatttcaaatcaagatagaaatcttataataaacaaaatatagaataagctcccctcaagtgtacatacatatggatataaaggaacacatatgcacataatcaatcaagatcaatgagggagctcacactatattttggatccacaagagagaccaagttagaatatgtgaagtttaatacatacctctcatcatttttattttcatatccaaatgagactaatcaaagaaaggctcataaaaacgttagtctcatataattagatttgtcattaatcaccaaaaccaaattaaggcacttgaacttacaatctccccctttttggtgattgatgacaaatccattgataataaccacatttggatatgaaggatataaatcaacattatattgatatgccaatgacatgctgatgcatatgatgcatatgtaatgctatgatgtgggatcctagaatatttcccccttttatagctatgatcataaggagatcacaaatagatcacaaatattctctcccttttggcattaatcaccaaaaaatgaaaaagggctagaaaataggcaattacaaaatcccaaaaaggaataaagactcacaaggccaaatatatatatatatatatatatatatatatatatatatatatatatatatatatatatatatatatatatatagaaatagcccatttagaaaaactcccccttactcatagagtcttttctttggatagagaatttggaatatgtttcatatgtagaaggggtgagtttgagcacttgaactttcacttgagatattctcatcaaaggtttttttcaagaatgtcaaaaattgagaagagcttggtcaaggctatttggaagaattttactcaagtgcatgatatcggcaagtaatgacaatgatgagctagtgttgggttcaagatgatcaagggatactaccatttgttgagagaccacttgtgtataggaattcgaatttgggatcaaggaatggtagttggctttggtagcaaggatcaacttgtatttggtggcaaagattggaatttggagtctatccatgaaggcttggttttgagaagtccaaaaaaaaaaacttttgagtttaggtggtttcatgtatcatgggcatttcaaaaaccaaaagagttcaaataaggaacatatccaacatagctcaaggattcatgaagttttcaaaataacaaagatctcattatttgaaacatcttatatttcaccaccatgctcaaataatcaacaagaagtgacatgaactttgaaatccatgtttagctgaaaaggcacatagcaatggcgacgtcttttagcaatagaaacctgtgtaactaagctcggaaaaatatgccataaatcctggagatagttcatgtaaaaatacaaaaatttcattttggggtcctttcccagatctcaaccgaattgaagaaacaaatctcacaagctttcagccaactcaaaatttcagactttttcagatttttggagactgaaaatgaggttgaaaaggcatccaaatgaccagctaaaattctgagtaaatttgtaagtaaacttcaactattgaggatcaaaagccatattgtgatcttcttcaaatttgcaacccatttggagatacaaaaatcacaaatcagcccaaaaacatggttgttctgaaaatttcagcaagctgagcaaaacgagaaaaagtcaaaatctttgcaaatcaaatcgaaatgagttgaaaccttgcagatttgatctttatacttgtgaggaacttttccaaaaagaatttcttaaaaatcatttttctatcaaaagataagacaaaaggagcattgtaggcctttagggtgagtaaatttgagttgagagctcaaatcacattcaaatttgaaatcgatggagtttgacatttgtaaagccttaggaggattatagatacactttcaagccaagattcacaaagaaatttggctctaaaggcttaacacgccataagcaagtttaggccgaaaatggtcaagtcaagatttttgctgaaattcaaatggttgtagagtttgaatggttggtattttggaaaaacattgaactagataaatgtttgaaacgaccaactctaaaagttttgtatggaaagcttttccaaaaaactcaatagattttgatttagagaaataaaatattttcaaccaaaacaagaccctaaaagatcctattgagaccaattttgctattttgtttgacaaatggaaattttgactccaaaagccttgaaaaacatttgaaatacaaattgggatacatttgaaaggattttcacatatatgggccatttaaataagatttttgacttttgtctaaaataggctcttttgaaagggtatggatgcaaccttttggaaaattcatgtttgggagcaaagggaatatgggtttgattcagattgctcccccttgatgcaactctccttttttgcttcatgaattcaaggtttgatactaaaggccaagtttgagaaaaaggctacacaagctctcttttcaaatacattcctccaaaagtgcaaaaagaagcaaatgagatgatatttgagagaaactaatatgcatgaagttcaaatatgattttgagccaaaaagatacaattattcagatttaagaaataaactcaccaaagtgatagaaagtgaccatatatggtctagttaaaatttttggtgagttttgacatcaaatttcttttaatatgttggtcttttggataaggttcaaaaaccaaaaacatttgaaataaccaactctatctaacttgttttgggctccatttcaaattctctttagatatccctgtagagagaaaaatagttttgctcgaaaacaagatcctagaaactagaattttagtcaaaaatgcatttttactttgcaaatactttttcttgcaaactaaagtttggaaaacatattagaggccttttgaaatattttccaagtaatagttttcaagaattatagtttttctcaaaaaattgacttttggtcaaaatgggcgttttgaaaacatttctaccacttggattactttgttcacattctaagggttgtagtgcatatgtaagaaatgcaatactttcccttaatgcgatattcccttcaacccaacaaagatgagcaaataaacacaagatccaataaagatcaaataagattgacaataagcacaagatgataaatatgttgcattaatatgatcaagcctatagcttcatatgccactactcattatgctcaacatgcatttatgatgatgttcataagaagaggaaatttaattttggaactatgaaaatgcaatgcaacatacacaaggctatataaaaaaattacaaaccaaaagcatgttaccgagatggcattggtccttgatgtgaattctccatcctcattattggctccaattcttgaacttggtgagaatcacattttctcgcataggccaaaacccaatgcctctcatgtacctatattctcattttggcacattttggtccccaacaaaattgggtccatcaatgttagttaccaaaatacgaggcacccaaatggtcctccttctaggtgcaagtctaggtaaaccaacatatctagcaaacacattgccttgcctatttttcctaagcacataatcatcaaaaataatattaggcttaggagtattacctatgggacaatttttaccaatatgtccctttttgcggcaattgtagcaagttaggttttgacctctatgacttgtcgttttgtcttgcttcttgccggtttgcctcaatttgaagttgcacttctcatccttcatgtttgcgcacacggaggcaaagtgtcccttctcatgacaaccaaaacatgtaatgtgaggatggttcttactcacatttttctttccatcatttcttaagtatgcatgcttccttgcatatctaggcatgtgtcttgtcttcttagcattctccttgcgatgaaagccaagtccacacttgtcatttgtgctcttttgcttgcttaggatttcgtcaagtgtgttcttccctttgtagcttctatccaagtcttcttttaaatctttgacttgggcttgtaattgcttgttttcctctacaaggttagcaacaatatacatagaggaggaagaacaagaattttcatctatgcttgagctacaaggtacatctaacaagtcatcacaagaggtggacacactagccttagatgtactacatgagctagctacacatggcatatcatcatcaattaaattacatgtgatgcctatgtccacctttggcttactaaatgcatttccaatgagaagagactcataagcttcttttatcttcttataagaatcacaaagttccttataagaatttattagctccacatttgagtctttcaaagagagaagagttttctctaaaatttgattttttcttcttctctttggcaatgtatttactagcctccctaagaatgttaaaaagatcatcatatgaaggttcatcatcatcaccaccatcatcaacaacacaagtattttcaataatactatcgagagaatcattctttacctcattcttacaatttgtcattaagcaatgaggtgatgtggatggtattgggagctcctcatcatcacttgaggaggtggagtcttcacccgacatcgattcttgtgtgcaaccattctcaacaagtgtgggcacttcatatttttctttaagctttacccacatagcatgtgcactcttgagattgcatacttcattaaacatgtcatcactcaaaccacaaaataaagcattagtagcttgagcatcgagatgtaggcatttatcttgcccacttgttggagcatggtcatccaaagcatgagaaaagcccacatctacaatccaccatatttttgggctcatggccgtaaaataagaaatcatgtggattttccattgtgcataatttgtgccatcaaacataggagggtcaccacccgtgtgtactatatctctagaagccatccttttctctcggaatagttaagtccacaaaatgagagaccaagctctgatacaacttgtaggatcaaggaggccgactagagggggggtgaataggcggttttaaaacttaatggcacttaaacaaaactaacctaagttgctaggcaaggtaaggtgcaagggttaactaagcaactaagttaagttttgcaaacctaggtgatatgggctcaaatatgtctctatgaatgtaaatagcacaaatgtaaatgcaacaaataaatgagacaacagacaaggaatttttcaccgaggttcggaaactcgccagtttcctaatccccgttgaggcgagcccaactccaccgctcaaccacgaaaccaccgcacgcccccttcgtcaaggggtgggcaaggcgggagccggcccacggagaggactacccaagcctcgatcactcggggtagttcttccttcactccgaaggtggtgaactccaaaccactcacaaacggcaccgggcctcctccacaatctcctcggagaggtcaccgagcaacacctatacaagccgtctaggaggcggcaacctccaagagtaacaagtctaggatgcttgccgaggatgatcaagtgtcacactagctataacaatgaagcaatgcacttggattggcttaactcactctctaacacctcactagataaacaaagtgcacaagggtgtgagagctcttgcaagggttcaagataatgcaatggagtgccaaaaccttacccttgctgctggggagtgggtatatatacccccaaccaccaaaactagtcgttggaaccgaaatccccaactctgtgccctgccggtcagaccgccgttgtgaggccggtcagaccggactactttgtaacggctagaaagctagccgttacagggcaatcattgagcccactcaacctggtcggtctgaccgcagtgtagtggccggtcagaccgtcaacggctcggtcagaccgccgtcggctcggtctgaccggttgcggctctggcggctttgtatcgccaccaaaaaccaaaccagtgcaacagaccagtgggccggtcagaccggctttaccacgccggtcagaccggctaacaggcctggtcagaccggcctaaggcccacggtcagaccgcaggtcacttttcagctcaaccgaccgttaataaaacggcgatatctcttgactcgggtctcggaatttggcgttcttggactctatggaaagcttattcaaagggctatccaacccatgaacaatccatccaagaaacacaacttttctctgggagaaagggctcacactccaaaggatactccaccggacataaccacatgaggctacccaaacctataggatttgcccacatctctctttgtttaggacttgagaaaactcaccatacttggctagacaagcccaccaaatacacctacatgcatatgaactaatatggcacaagatcatccacaagctcgcttcatagacccctcttgatagtacggcgcctatctagcaaatccggtctacaccaaacaccaagaccgggaaaagactaagaaaacattcttagctccattatacatttgccttgcgcatccaacttggggtcaagcttgagtcgagatcaacacttgtgaccatttgattcaaccatgtttataccaaggtattcacaatacacacacagtttgtgatatcacaatttatctcaaatatttacatgcacctcggtaaatattacaatcgccctgctcggcgtaagtttgcctcctgcgcgaggacttaagaagaaccactatacagaggtaccaccttttctagataacttaatcagctaggtctatgcccatacgagaattgcggtcgtactcgtatgttcttcacatgtacttggcaattttatgtcggttggaacagtactagccacccggaaatcaaccatttctaccgtattgttccaatctaagtttattatattttatgcaatctaactaggcatggctaagcaaaatctagcatatatctggtttgctatatattcaggttatgcattcgaaatcatgtatggctaatgcataagataccggagatatagaatataggattattatgctcaaaggggaggaataataacttgccttgctccaacgcaaataaatccaagataggcaacctgattatccgatccttgaaatatcacaggctgccatccaaaatagactctactaaagaagagaaagaaccaaattcaataaaaatcacaaaataataagaaagcgatgaagggcaagaaaggctgggtttggggtataaatatctcctttataaggtatagggattattggctaatattttatgtggaggttttagagggttggaggctaaggtggagaggggatcaagcaactaatgtcgcttatatttcatgagtgggctttggttgtttggagagtaagagaaataactggttaagtgagtatgtggctaataatggctggtggcaggtttaggtagtataatacctaggatttggttatatttaggccgattggggatagggcaatatatcggctagctctatattttatatataggttctaggtagttagagagtaggtggctgagagtaggatggataggcgatactggtgggtgtggaatttggatgacgggtgggatttatctagtaaggtgtcagctaggatttggttgtgtgctagtcgatgctagtgttgaacagcataacgattagatttggtgtcttctctagccggtgtcgatggacagtataacggctaggaggtgggtgcaggttaattcagtggggcgaaagtgttactccgacaaccgtgagtggcggcggagcagctaagatcacacagagcccgagagctaattgtgtgacgtgctgtggaggtcgtgggaatagtgaagctccgaccgttatacgcgtcgaggtgtaaggtgccaggagcagcacttcgaccttgggtttgggttttgccgggctttacaaccaacggttcgacgtcggggctagtagaccgcgaacgtccccatggaaggcgtaaagtttcaaccggcggctttttaatggctaaagggtaatttgggacggaagaaaatatttaaaaaggcaaatataaattcaaacaatatttgaataaattcaaataaaattataaaataacaaattgggtatcaaaatatatcttttgaatttagatgaatttaggtccaagtttcatcggaatcggatctacggttcaggagatatgggcttctaaagtttggattttgaatcaaatctagaaaatgtgaaatagtactgtaggggcccacctgtcagttttccttttccttttcttctctctttcttcttccttcttcttcctcccgttctcttcctcttttctgttgccgagtgagttgagaggagggagaggaggggcgccggtactctggtggttgagaggctgcgacgtcggcggcaaaacatgttcccgagcgacgcgcacccggggagggtggtttccggtagagagggttagggtcttagggaggagaccggaacggcgacggcaatagcttgctccggcaacaagaggaagtggctgtgatggtttgtttcaaaggggaagggaaaggggaaaggggtgaaatggattcgcctcgtctaggcaaacccgatggcgcaagggcttggccaacaacgctccggtaagggatatcgacggtggccggtggtggctagacataacaggagagagagagctcgaggagctcggctcatatgtggagaaaaggggagggctggccttctatttataggcgtcggacgtcggttttgaaggtcggttgtagaggagaagatggagttggtcttggtggcggcgacgtgagaaggaagacgacggcgccggctgtggcttgtgattggttggagatggcggtttgctccaaaggctgacgtcggcggcgtgaggtggcagatgacgtcggcggcgatgccttagcggcgacggcaggacgttggcggtcggcagagctgcaagcagagccgtgcacggcggtggtggcggcgcgtgatagcggcggcggcgcccaccgaacagggagaagagaggagcggcacggctggagtttggttgggccgactgggccgcgtgccaaagttgggctggcacaacaaggaagggtaaaaggagatgggccaagggagaaagtgaaggactttggcccaaactgaaaataaatgtttttctacattttgaatgggatttggatggttagactttaaatttggaagagatttggataggagaattatttgtggttaaatagggaattaatttggaagagggaaatatattcttcttagcacaagagcaatcattctaatatttataatatatctattcttgtgccgagaagtcttagattataggaactggaatgggagtctagatcaaaatagaaatttgaaatttggaaagggaattaggataggtttataatcaaaggatgggtccacaattaattccaattaaaatcggaattacttggtttaggttctagggcaatagtggggaatttcttggaccataattcataaaaatagaaagggttttcaaactaaatttgaataaaagaattttagttgaaaaaaggttttaaattaaaaccaaatcaagaaatacctcaatttagccaaatatatttttaaatgaaaaacacaaaagaaattaaataccagagaaggattttatgcaagttagttttagaaggtccctctaattatattttcctaggtttataaaattattaagaacataaaaagtggcatgatgcaagattagaaaatggttaattttcggtatgttacacagtcccaggataaagcgttggtatccacagtaacaattataaatcatcgcattctttaaattaaataaaatagagaacttatttacgttaacttaagttgcaactcttgggcaaaccagagaatgcagcagatgacatgaagcagcaacagcaatagcagaagctgaggcggcgaaaaccaacgaactaacacccaacaccacatgcggcgacaaaaggagagagcaaggcggcgagacggcgctcccccacggcacgtgcgcatgcgtgcaagggtgaggtgggctgctgcttggctggaccgagaggagtggcgcatggcccaggcggggagaggaaggagtgggttgggccggccaagaagaaacagcccaaagaggaaggaggggaactagactttctgtagggttttgagggagaaggatttgatgttggaattgaattgggatgtgtttcaagtttgatatgtgaacccaaaaatataaaggattcaacaaaagaagtcaaagtgagaaatgtgacattcttagaattgggaggaatatttggcaagaattacgagggaggatcgaatttcggaatttgactttttgagacttgattcggaacatgaaatgctggggtgttgattttttatatcgacgagagggaataaggagatatttgaattgagatccatagtacgacttcaattggtttttattaatttaggtttttaacgttttgcaaaaagtgggacgttacatgatcagagtagtcaagctcagcccttactacctcgattttgctatatctcactcgaaagatttttttctaatctctcactcgattttctcacttaaatttacagtgcattttcttgtaagttacagtgtaatttatgaaacttacattgtaacttttataagttacagtgtaatttttgaatcttcgcatgtaagttttaaaatttatattggatttggtttttttcttgaagatatggtaatttagtgtccattatggtgtttcttagttgctttttgccttttactgtgtctatcggattttaatccaaagattaaaaaactgtgtgatacgatcataaaaatctttcgaaagatgtacaggtactccctttatgaaattgtaagcatcgacctagcgcattagcccaagctagtgagaatatgaattttaggaataagttcacttcgtgaccctcaaaag

SEQ ID NO: 43604 - DNA, 18391 bp, Oryza sativa
cggccgcccttttgcccaccgccgccgccgccagtggccctatcccatgcttgcggagggaaaaagagataggggaggatgaagaaggtaaagagaggatgacatgtgggccccacagtgggtcccacaatatatttgtgtgtgagtaacaaatgggtcccacacgaattttttatttctaatgctacctaagcgccacgccaacaccatgtggaaagaagaccgagttaatactgccacgtaggcgtcatgttggtgaaaccgccctccaaaaccgtcgagggagtcaaattgcaccggttttaagagttgggggtcgagataaccggttttgtggtttagagtcacggattagatttcgatcacctttgagggtcacgaagtgaatttattcctgaattttataggtgctcaatgttctttcctttctttatataatcaaaagtacctacactatccaatatccggcgacaagcaaaaggagaacaatgctgattgcatcgactgcagcaccttcttctttgatcatcacggattaaacaatcaaaagctctgaccttgtcgaagatttggagcacaaattaaagctctgccattctattttgcgtatcatgctctgaatgctaaaagcaaaatgtatgcctttggtgatggatcaattaaaaaaaaacgaaagcttagccttttcgaacacctgatggactaatttaaacaatctactagcttctggtggtttctgatgcagaagtaccaggcaacatcattcgcaaatctcaggtcgtacatgcaccacttcaccaataggctgtggccctagtaactttcatggatagtatacttcaagcaatgcccacgagaatttctccctttccacacgttgttcttttgcgtgggcagcagccatgcaggcgtgaggaaagcagagcacatttcatggcctggaatttttcctggtggtgttaggtgcttagttgggtcactttccgttgagcacaatgccattctctgaagttttgagaaggctgctgcagtacagaatgtactgcaaggagtaatcagaggtactacctccgtcccagaatataaccatttttaaagttgaacatggttattaagaaagtagatataagtgattgatgtagggttgtgattggttaagatggaaaaagtgaatggtggagggttgtgattggttgagaagagaatgttggtgaaaaagttatatttttggataaatcttgagagttaaaagttgttatattttgggacggagggagtataatggtatagtacattgtactactacttcaatttggacgatcgtgtactatagtcttcgtgtgattactttattaaattagcgtaccaggtgcctgcaggtattcgtagttgaagttgacaagcattacttgtcagtaaacgtggacctttgcatagtccaaagttaggctgtggccattacaagtgcttgcatattcttggacagtcgagtaacctcactatgattggtatttttttgcaagttttttagtactgaattgcttttgtactgtcgattgtacatttgtactacgaagaacctgaactctggcgttaaccaacctgatattttccacaaatgttcaacagtcaacaaagagatgccaaccaccagaccgacctgaaaccatatcgaccgcgtcagtgaagcatcatatcacgattctcgcatgccctactgccctgcaatgcaaggaagaaagcttcatgattcttccaaattccaatccgtagcagtcagatgcagacggacgcaagggcacgagcaatggagattattcgtcagtaaagctgatatccaacattccaaccacgacgaccaggaaacagagctctgaactttgctttgatgcggacggaattgtttcttactgaagcccaccgcctatagctggagcccggaattgttagggtttcgggacaaagtcgttcttggtactgttcgggttattcatgtgctgactttacgctaacatcttcatcaaggggtcttcctagctctgtgttatttcccttctagtttcatcggggtgttagagatatagttttgtattcctatctcctaccctttttctctgattctctctcgattctgtttctataaatagattgtagagatagagatgtaccgggtctatgtgtacttatgtgcatgattaatctaattatcgcaatgactcctagcgctttcacgccggccatcgtaggggacgccgctcgcctctaaagattggtcgaattgggtgcgtgatttccttactcaggtgctcaccccctcctcacctccgtcgtcgtccccgtaactttctcttctccctcgacggaggagagtgttggttccatcgtcactaccgcgagcctcattcaactcatctactaatcactatgctgttctgtttacaatggtttgagaatcctaaaagcggaaacattctttggttcccgctaataaacccgttctttagtggtggattaacaaaaccagacaaaagattcagtcttttcgaagatctgtaggacagatttaatcagctagtggtttctgctgcagaaacaacaggcgaccatcttcttctgaagaaaggaaaaaaaaacagcaacagtcagcagcgctcttcaatctgtctgtggatggatgctctgaaccgaagcgccagtaacctgaacgcacgtgtttctatcgtttccatccgccaatgttcgcgtgggttgcaggcgcgaaccaaagtggagcacgactaatggccgagatttttattccttctcatcatcgtataattcatccatccaattattcagcgaacctatccggccttggcaacggaatagcctatctgacagagtgacagttacacccacaaaacctctactgacgaaaagctgatgcaaacttcgcgttgaaacgcaccatattgaatttgaattattgatctctcgatgataaacatccgcaaccttttttcactattatgcttcagtcttcagagggatgtaacaaatcagtgcaggccaagctcggaggtgacatgcagtggaaccaaaaagagctaaaagtcttaaaaggtcgtagcgtcaatgagtgtccagttcatcgtgtttgtgtcagcgagttaagtaccctgtttgtggaagtagtgacggtgagattgccacgaaagggaaaaaggcaatgtgccaaccttcacaaaaaaagaacttgtggtgcgagccggagaatctgttggtgataagttgagggaaccgcaacggtgggcaaatgcgatcgaaaaagggatcgtcgctgatgcggacatgatgggctgacgggaactggcacggcacgccgagatgccaatatttctctcgccagatatggcacgacgacgctactgtgctagcacttgtcctcgactgtgtttcagtatcgtagcacttgacaataagcacaactaattgttgtgttttcatctaattttcttctcaactgatatacacagtacagaaccccaacccctatgaacagcatttctgcttttggggatttatccgtcatagctacacccgttcttcctctcgctgcgcctaaatcttaaatctaagtccaaaacgctcgatacacgatctcttttctagtgtttctgcattgacgctatacgtctatacgatctctttttttacgatctatacgtctgcattgacgctgtaaattacagcgatgcattggctagtttcccggtatgaacttcatgcagatgggtggcttgaccttggccagcgcgagcagcgacgaagggaacgtccaaatcccgtcgccgcagatgaggccggacgcgacggccggcacgagcagcgcggccctcttgccgtcgaacctgtgccagaggaacaccacgaggctgccggcgcacatgtcgatggcgaagctggcgccgacgaggaacggcacggccatggccatgggcagcggcatgtaccgcccgtacctgcgcggcaggaagtcccgcgccaggttggcgagcaccgcgaacgcgaagaaccccgcgcacagctgcaggcagtgcctcggcagcgccgagaacccctccacgccgatgatggccatgttccggtagatgagcgcgtacggcgccttccagtacccgttggggtcgccgacgtcgaacgccttgtagaagaggaagaaggtgagcggcgcgacgacgcaccccatcagcgtgcccaccacctgcccgaccagcatcgaccgcggcgaggtcagcgtcaggtggcccgtcttgaagtcgggcataaggtcggcggagatgagcaccagctgcttcaccagcccgcacccgacgagcccggccaccacgccgtcgtccttcccggcccacgccgcgaagatgaagagcgcgatcttgccgtagttgtaccccatgttcatgtcggtgagccccgtgccgtaggcgttgcagaaccccagcgccggcgccagcaggtacgcgatgatcacgtagtaccacttcacctgccggaacatcaccgggatgaggaccacggcgatgacgctgagcagcgtgtacccggtgtacgccatccaggtcgggatgttgtcccggttgaacacctcgttccgctgcatgtcgtcgatcgccatggtgtccgcgtccgccactgcaaatgcgtaatgaactactcctgtaagcttcagcctgaactgaaaatacgcgaggcgatctaaatctttttttacggtgcatttacctctgttgttaagacccctgcgccttgatctttcgcgtacgctcttgagagtgacaacgatcactttgacgaagttgtagaagccatctccaacgagaagtgcaatgcagatgaaggactgcacaggtagcgatgttgagtttttttttttcaaaaaaaaaaaaagctaggaaatgtgtatatattgtgctgcctgaactagtctagtagtactacaaatgtaccattattgggacaggtgaactgatgaacacaccttgtaaccgaacaggcccgacatgctactttcagatgccttagcagagtaccaattccccttctgcttgccgatgagcggccacattattccccaggagaggatcgcgccgaacaagagagagaggttgacaaggtgagaacagatcatcccggcaccaacatacgtgagactgaagtcgaagaaaaatctggtgatggaagaaattactcagcaaaaagttgtttttgttgcggctttaccactgaagcatacaatgatcagtgaaaaagaaacagtaaataaaaattgtatggaaacagtaaaaaaattacgtatgtttccaagctttcagcccaaaggtagggaactggaggaatccgcagacgtcaccgccggtgtagaaccactggaagaagctccacaagaagctgatgccgaaatacctgaggaatccacggacttgctttctggcattgaggggaaaccattgaatcaagtcagtgaatcccaactatttctgcagcgtttttggtcggctcaatcatgatttcatcagcacttggctgaaatctgaaataaagagcttacttcgcattcttatctccttgaggcgtgtgaaacccgtttatgagaacagcagtcgctgtcccacttggatatgttagcttgtagtcgatgaccagcacctgcaaaatatcggtttttatcagattccttcatttttgcatgattgcgataattagcccactttttgttcagaaaaaaaaagactgaaggacacaataaacgtgtagaatagactttatcagtagtgtactgtagcactccaaaccataactgaaagacacaacaggtccttaataagtgagaaaaggagaaaacgatggttaatgtttgttaatcgtggtcaacgattgcaactctgatgctgaacgatcgtacaaccaatgccatttttttcagaacgtatgacagtaaagatcaatctcggaaaattcagggaatctgtcagaaacggtaaacgctgaaaggtacggcatggaaaggggaaaatcaaagaagagcaaagggagtcagtagtgtacctttcggagagggagcaaggtgaggagccccacgaagctggtggagaggaggaaccccgtcatccacccgatcccgggctccttgtagctccccggcacgttccccggcgtgctcgcgccggacagctcgtacgtcttcttgttcagccccagcaagaacgacccgaatccacctgtgctccacgcgaacgcgcgacgcggttagcgcaacgagacgccaagattggccggggtgatgagaggggaggggagacaggagagctaccgccgtagccgatggtgtagcaggcgacggcgcaggtctggatgacggtgttctcctggcgggtgaaggggcgggaggcaatgccgaggcggtcgagcgcgtgcgtccatccccggagcgcgaggaaggcgagcagcgcggcggagacgttgagcgtggggatgagccccgtggtgaggctcagcttcatcacgatcaccgtgtacaccacgccgatcagcagcgccgccaccatcccgcgggcggtcacctgctcccgccacggcgggacgcgctccgcctcgcgcgccgccgccagcgcgggctccgactccatgtcctccgccgctccggcgtcttctcgatctccagcgcgccaccgccgcccagcgcgtggcggtccatgctgccggccgcacccgacgaggcgccccccctggggactagcagctcgagctccgagacgtcggcggcggcaccggtggccgcggcggctgcaggggagagatgtaatcgtgagcacatttgtttacgcgtaccagggcgacacaatccaacaacccatccatgtgcgcccagcgcccttgcattagacagaagagtacaagcgccgttgaattgaaacgggcaggattagttataaaattggcttctagcaaagccagaggcatttggccatctgccactctgctccacgggggtcagtaatgacagaggccaacaaggcgacgaacaaaagaaccacaaatcacgagcagaaaccagaaaggcagcaaaagcacaatccaacaccaaattgtaacgagcaccgcatgcagaaacctctcacctgtactgtcctccctgcgaaaacagcagcaccgctcggagacgacgatcagacgaacgccaccacaccggggatgggaacgagaggaggcggcaggcgggtcaattaaataggcgtcaactgcggggaacgactgaacgagagaagcagctcggttcactgtactgcaccccctctgcacgacgtatccagtacacgtgtggatgcgggggagaagtacaaaaaagagaagggggggagaattttcagaggtgcagtacaaggggaacggacggcgacgaaaatggcggggtcggtcagtgatgtgcgatttttttttccaagagcaacgaggggttggcgtttggaccctgcacctgcagcaacctcctcttcttcttcttcttcctcccgtgcacttgacttttgcatggttgggtgagggatcgcgacgtgtggaaatacaggaataaactggtgatgggagtgtgccccatggctttgcaattttctttcccctctttccgtggtcggatgctcggattttgtacatgtactgcttgtccagtttcaatctacgcgatcttaatttgtgtgatctagagtcgtagtacaagcattcgcaatatttgaggagttcgtgtacgcaaatgcaaacctcatgtacctagtcgcatgattgctacagatgcaacagattcagtatcgcttgatttcgtgtaaatagtactagtagtagtatcatgcgactgaggtatggaatatatggcattggttgtcatactcatacccgtctccacgaatcggcacacgatttaaagcatgacaaaagagatagtgaagtgatatcattaaatgagctggaatttttctacgttagaagtgaagagaattttatgggtggaaaagagaaagaaaatgtgatattggagttgcagtttgtataaatttattcaccgtattcaataatttagcgagaccagagatttatcgttggcatctggacgtgtgttgctcctcttattcctgaggcacacgagtgtagtgtgcatctttctataataataatagaaaaaagagccttatcagttgtccatattttctaataagccaaaatagcttattagagaataaaaattaatttataggtaaaaattttatatatttgttcatagtgattaaaagccaacgctaaaaagaaattaagttcaaaatattttaaaatcaaattcaaaattttaaaatttggtttttgctttgaattattaggccaaccgatggggctaagagttttggaggtgtttcactgtgttaagctgctgctacacagccgtagtagtgcggctgacaccgtagatatatatctttgctctggtattatagttactgccccgctttcagtcacaattggtactaccgaacaccccctctatgtgttatactcaactaaattttaactgtgcaaatatagttatcgtgcatgtgcactcaaccgcgttccacctcacttggtggttccacgtcactcttaattcaattgatgtcaagttagtcctgatataattataaaggaaaaaattgtactcctggtatccagcttttttctgactaaaatttagggggcatatttaattgcaaattaattcattgtttttggaaagtcaaattcataatagagttggccgcatgaactcatgcctgttcagtgtatggtgttccgaaatttaatactaagaaatagataaggtaaagtagcattcttatgaggctacttgccagaaatgatataatcagaaaatgatatgatcagaagttggacatgaacaatgactctgtatatccaaatcgaaagtcaaatagcataggctagagatcgtcgagcactcgagcccccaatcaatctgtagctattacgaaacccaggtaattaagttaagaaatccggtgcatccatctcatttttcaattaagatttcccattgactgtagtttttttttttgtttggggggtattattcttcctagaatattggtggagtacagccggttgcaacggtttgtagtagaatgaacaatgcgcgacacagtattgtgataaagcctctgcatcagtataaaaaaaaggaactgaagtcgtaccattaaatgcccttcttttgagattataatgttgattataaagagcacgtagcaaacgataagatttttctaaaaaaaaactttcctcacctatatttcttaaaaacattttttaaaagtgcattttttgtaatattaatttattcgtttgtatactcaagtaattaacataaactcagttaacaattcatcatccattagcaaattcaaattgtcctaaattagctgggttttctatcagtattaaagaaattctattggttacactggagtactggactaatatttaactggtacggttaatataaacctagcgcaactctgttggaaagtcaaatgcatattagagatagccagttagccacatgagctcatggtttacaggaatcaagtgtatggcgttccaaatttaataaagaaaacagataaggtaaagtagaattcctctgatgcaactcgccagaaatgatctcatcagaacaggggaaacatacactaacatttctaaatggcaagtcaaacaggcataacatatagagatcaccgtgacccaaatcaatctgtagagtcgtagagtggacgatcgacaaggcctcgttgtgatagagagcatcactgcatcagcatcggcctataaaggcaacgagtgtcatacggagtattagcgttagttgccaaaaacaagcctggagttagctccatgtatggcagtatggacttctgaaaggagctagaaaagttcttaactaaccaaaagcatctgaaactgacgctactttcctcctggtactgctactctgctaagaagattttaaggctacgaaactttcgtagaagcctacataacgaaaaggttgcatgggcacgatgaacaacttggagacacgagacccataactgggccatcaagcccatcatgccgtcaagaatcaggaaaaggcccaaactgtaaccgctcctactacatcagcccaacgtaccaacctcatgggcttaatcggcccattacgcgctggttcggcccggtacagcgcatgctgcaaccgcgtacaggccatcggaacgacacgtcggatcgtcggcgtcggcagcagcggttaaattaacagaggcgggagggcagcaacaagtcaacctgccaccgtgccaccgcctctccgtccccatcaccctcgcaattactccacccgccggccagcccaattgtcgaaatggcaatcacccacatcacatgcagatcctccctaaaccactcgatcatcccgcccccactcctcctccttctcatccaggtagatcccaacagccgatcagatctcccactccattattcgcctcgcccattgccccgtggccaccggcgaaaccggagggaggggagagacgcggttcctcggtcgccatggaagggctcatcaaggggctgatcaacgtggcgatcaacgccgtcgaaggcgccggacaaggtgagcggggcggcgaggacgacgcgccgaggaggcaccgccccgcgcgggaggaggaggagggccgcggcgacgagcggtcgcggtcgacgtgggccgaggtgagcgccacctgttcgcgcgattgcggaagaagataaaggaaatcgtgagggatgtaattggttgggtttgtcggtctaagcttcttagtgttttggggatgtggcaggtggtctccgatcacaagggcggcgaggcggaggagcgcccggaccatcggaattcgaggcgggtgagtgacgattgctgttttgtctgggagaacattaatccagaccggaattcggttttagttaatcttcttctggtagtttgcagttagtgttatggtagtaggggcgtagttaaggcccgtttggcacagctctggctcccaagtccaacttatttggagctggagctgttccaagcggtccaaatcctttgtttttcggagcggagttagcagagctactccacaaatttgtactacgggggtggagctgggtttttctgctccacagctccactctaccccaaaagacccataagtgcttaataatttaattctctggttgaatttaggatgggaggcaagagaggagggaggatggggattgggagagggtggatggccggaagcagcatcagcacaaccaggttttccattttgtgtacacattttctgtaaaaattgtaagtgtgccactctgcttacgtagctgggctccacgtctgtagtatgaggaagagtacaggagggacagtagtagccgacgcccacagcagcatcagcaagcgccagcttacaggaggcagcaacaggttcgattcagttatcttcttcctttttctttttgcaatacagatatgtacatgaatttgagcaattcacatattatatgtttgtcgtgttgtagccttggtggtgctttggtggttgtgtgtggcacattttgagtttgttccttagtcacagaatagtgatatagagtgtacaggtctagtagtatatgcgcgttatgtagaatgactctttatttctttgatcttcttgtttaagcttcttcctgaaaaataaagagttggtctaatggtacagctcgattgaagcttgtatatctcaaccttggctcattagctttcaaaaggaaaacaaaaggagatggaagcttggagtgaatactaaatagagcttgataatctcatttccggatgtgtttttcctatgctcgttgcgcttgactaatgagttgatcaagttaataatgtgctaatatttactgcaaaatacatgcttataatctcataaacgaagttacaattatttaacagttcttcctgctgctatttagtttttttttctagcatcagtttgaagatgggacaggtattttgagtgtatattgtggaggcttacctgtttggtttggggtactcaggatggagatgagagaaatgatggagggtggcagactgttggtgagaaaaagcatcatggaaggccacagcaggtttgcttttggttttctaacaattagatacaataacatctgcaaatgttataacttactgagatttttaggtatctgtttttgagtcaatttgagcccatgtttatactcaaggtcaactgactactataaataccccgacaccccgtatcactgttcttgtttggctgaataaagtcaataaacttattacatattattttctaaaagatatttaacgtctgtcagttgatgctgtctttgaactggttagcatgcaaaaagggcccctaagctattccattttgttcaaccaaaccccttttcttaacttgttgatttgagcccctgagatatctacaatgtgtaatcaagcattctattgcactctctgttatatgacaaaatgagccccaagtgtcaggcacagttgaccaacaatctttcaggttttgagcaataccattgaccaatactttgaagctttatgtatcagcccaagcactttggtttattgtactttttgagaactttagtgtttgcatcgttctaccactgtcagagtcagttacccttttataaatgaactgatcgtcagtttccatttcacaatatgagatcgccgtattaatatattctgagcttccttatcctgtctgaattctgagcaccttcataattactatactatacagtctgaagcatggaatgcatacagaaggccaccatctgaacaacagtactgtgaggatgctggtcagatccaccatggcctaaatgtagaaccaaccagggaggagctcaacagcttatcaagagcttgtagccggctgtgggaactcgatatgaaccgcctaacacctggtaaggactacagaatcgaatgtggcgaagggaagaaggtatatcagaagggtgatatggcatctgaaactttgttcagctggctaggcgatgatgtgcttagaaagcccacctactctcgtttctgcgcgcttcttgacaattacaatccacatcaagggtacaaagaagttgttactcagcaggacaagcacgaggaagtagcatttattgaagagattgccaggacagcgccaatcaagtacttacaccggtatttagtgctcaagggagtcgcgtctcaagactatgaggacttcaagagaatgctgacatcgctatggttcgatttgtatggaagaggtggcagttctagcagctcttctgcatttgagcatgtgttcgttggtgagatcaagggacgacgaggacagggagagaatgaggtctcaggattccataattggattcaggcaagttcttgtaatgttacaacagttcttgtattccttgcataaaaattactctgattggtatttcgtgaaacaattgcagttttacctggaagaagccaatgggaatgtggattaccaaggttacatattcccaaggaggcgtggggaatcggtaagtatctagtcttaaaattgatagacaagatgaacttgattatgagtaatggagctaaaatgtgcaatgctccttttggcagcctgattcagagacacagctattgactattcagtttgagtggcacggtgttctgaaatcggtatccagcactctgattggtgtcagccctgagtttgaggttgcactctacacgctctgcttctttatgggaggggaagataaccgcgttgagattggcccgtacggagtaaacatcaagtgctaccgaatgggaaacagcaaaattgggtcagcatttccaattgcagataactgaattcgttccatgcctgctcctgcgtgtatgtgattccttcagctttcagtttcacgaagttattagtgtgctgttcgatttggtcgtttacacaaaagaaccacattgttcaatttgttgtcacaatgtctctactgaaaattgtattatttggattaaccatgctgtacaagttgtagtcacaaagtcctgtaatttgtttttctcaaaacccgtaacaaaaaaatatcatctcagcacaaaaaaaaaatccttcagaagtcaatcctgcattgtgattgtcaactccgacaagagaatgaacaggtcacgtcgcggcagtggcagcagcagccgccctcatgagcatgagccttctcctcgcgtgagcgctcgcgctcgcgttctccccgagcgcagcaaggtggagcatccgccgcctcgccgccgccgcggccacggccacgtcgtcctccacggccgccgccgccggcgagctcgagctctcctccccggcatcatcatacacttcgccgtccagctcggcgtgccgcgtcgcccgcctcagccgctcgaccacctccgccatcgcggggcggtccttgccgtgcttcgcgaggcagccggcggcgagctcggcgacctccctggccgctctcacggagtacctcccctgcagcctcccgtccatgatccggccgaaccgcgggctcccggcggggtgccgccgcacccactcgaggagcttctgctcgtccttgggccgactcttgtcgatcgaccgccggccggcgaggatctcgtacagcacaacgccgaagctccacacgtcgctcttggtcgtgaggtgccccgtccggacgtagtccggtgccgcgtagccgtacgtccccatcacctgatccaccaaagccaaaacggattcatttctgaagaattcagaagtgatatgatccgtgttgagttgacacattttctgaactgtgatgtttgcacataccgctgtggagacatgtgtctgaccttctgatggcccttcccttgctaatccgaaatctgacagtttgggtctgaactcatcatccagcagcacatttgcagccttgaaatcacggtatatgatctgacaaacaaggaaaatcaggtgaaaatggtgtgttttctgatgaagacgcgcagtttttcggagaagatgtggattacctgaaactccaggccctcgtggaggtacagtaacccctcggcagcgcccagcgcgatctgcagcctgacgccccacgggaggacggggtgggatcggtcgaacaggtggtcgtccagcgtcttattcggcacgaactcgtacaccagcagccgctgcgggcctcgctccgtctgcgccgcgcagtagccgaggaggttgacgaggttggggtgctccacgacgcccagcagctgcacctcggcgagccactccttgtgcccctgcacgagcacgatacaatggagtcgtcacaaatggcggaagcggtcgagatcaaccgggagcgtgtcgtcatgtgtgtgcgtgcctggcggctgtcggggttgagcctcttgacggcgacgggggtgccgtggggcggctcgccggggaggcggaggacgccgcggtagacgcacccgaagccgccccggccgaccatgagcagcgggctgaagtcgcccgtggcgccgcggagctcgcggagagcgagctcgcggggggcgccctgcctcgcctcgtacggctccggggtgctcaccgccgaggagctcgccgacggcctcgtgctcgcccacgacgacgtgcacgtgctcggcgcggcggctggcacggacacgttcgagcacgcatcggtggaaacggcggcagcggcactcggggagggcggagccggtgccggcgccggcgccgccacctccggccgtctcttgctcctgcgcttgtcctggaagaggcacatgcagcccatttcttggaggaagaagcccggctgctaccacaatttcaggtacttcaagaactcagaggttgcagagaaaaagatcacgcattggtgattaaaacagagacattttctatttcttctgttgctcgacaatgacttgtctgtacttctacgtgattaaaatccaaccaggagaaggccaagagcaaagagaacacagtggaaggaagaaccaatcgatcagagaagaaaaatccagcaaagccagatttctgccagatggaagagaaatccaacagtagacagctgccgatcacaagaaactcaatggcagcagatgctcaagaggagacatgcctccaaatggccgaatcgtttgatacaacagtcatggaccatgaactgtgtactgcctaccgtgatccggctgaccggctccgaagaatcaaagtgctcaaccagtcagttctcagtcacctcccctgccaacctctttatccttcttgcttttgctcgaagcaagcagaacgcacacacggtttcctgctaatctgcattctgcaagcatcatgggtgtttgaaatgttcaaacttcaaacattacggcgtccattggatcatcaacactacaggatgcggaaagatatccgcagccacatctctggctttctcccaagtcccaaccaccgcctcctctccctcgaccgctgcctgaaccacgagaggatgactagatgatcccacacggcacactacattgatgttgctaataacatccttttttttcttcctctttgtgctcatctagtcatctctcgttctcttttttcattcttggaaatctgcacccggttgacaagaattattgactgccgaacagtgatgtacttcaacgtattgacccggatacgtcgttgttggcctgctcggtgagctatctatgtcctgactttttgcttcactctgtgtccatcttgacctgcatggctgactatcttgtcgttcggtccaaaaaccggcgccttatgagcggaggacaggataaatgatgtcccaaattatcacagcaaaacagattcctgccgcaggtaagggcatatacaacggtatttattaatggtctctctattgccatgcaaataaatttaatatatcgaagaaagataaacgagtatggttgttatgcatgacagcggcttatagtcgactcttagcatttataagagcaatttttgttgtatggcggtgaaagaaaggaaaaaaaagtaagaaaaagtattttgatacattaatgattagagactatgttgtctctaactgttgtaagatgctagtctctaggtaatgtagagttcatatctgactctacctttgtacacgtcctaagctaatctagtagagtatttcttcagactccaaatactatagtcaataacacgtgcattggcacgggttatatactttactagtactatgtatgttccatgtgttgcacttgcaaggggatatagagtaaaacgaatgaatggttttataaaaaatcatttttttttctattatggttttctagcggatctattctcacgtggaagagaattttttaccattcttgaggtaccacgaggtaccaggtactaagaggtaccaactttgtctatccatccgtttgcaaaggatacgatcggaataacacgtgtggtaacccttcgctctgcatcctcgtcttaatttgctctgggcaccggtgacgtccgcggacggcgcggcctcgcctttcctccagggtgccatcgggcgtccgtccatcgttgcggccttcgatccaaggcgccacctccatccgtccagtgcgccgccgggactgccggccatcgatccagggcgtcgttgcttcacaaagacagcctccccgcttcttctgctagccatctccaccctccccgctgcagggcaccgttgccttcctctttcagccatctccgccccctttgctcctggtcatcgtgttcgccccaactccacacagcaccagtgagtacggatccaaattaagctccacactttgtcagtcatgccatgtccatagcatgcagagtggtttgttattctaagccttgtttagttccaaagttttttttttccaaacttccaacttttcatcacatcaaactttttatacacacaacttttctatcacatcgtaccaattttaaccaaacttccaaacttcagtgtgaactaaacacagccctagtagctcgcatgaagtgagtcttcagtattttagaagtgccaaagtctgtttctggaactctgaaccttctgaaactcacctgaagtggaagtgtggaactctaaattttctttagtgtagtattcaggtagtacacaatgcttattcagatcttgtttgtgg

SEQ ID NO: 43605 - DNA, 1128 bp, Oryza sativa
aaagctctgaaacccagcctctccagcttctggcttcttagttcatttttcagaatctgtaactacagattctcagaagctgtggactatttggggcagcttctagcagaagcagcttttgggaaaagctgcagctgggacaagctcccccaaataggactaaatttgtctgcttccagagttccagttgccttgccgcatgttgctggaggcctcagcctcgccgtagcctgtagctaccgccgccctggcgcgattggcctggcagctgccggtgcccttgcgacgcccttcctcactctagcggattagggagaagagacgaggagacgacgccatcaggattgaattggcaaggggaggaagcgggagtgccgacgggatgggaccctgaagccgccattcccctcggctcaccttccccgaggtctatacatactaatagggaggagggactagacccctcttcctccctccggcctccctccgctgtcgccgaagaacgggagaagaggaggaagaggggccgaacaaaagaagggattacaatagcttgattaggggaaactagagagctctcccgcctgttgagtctaggcttcaaggatcaaagttccagtatgaattagaagaggccgaggagtaaggtagcttacaaaggaggaagggagggtaatataccattaaacttcgtttttattcattgcaatgcaagtgcagtattttgctagtaccattaatcttgagtattatattgttcgtgttccatattattttctccaaagaaagactcaactgccgagtttccggttccacatccataatttcatcgacccggacttcaatttacagggcaaaaacaaaatacagttcacgaaaaagccaaaaacgcccttttgccttgcaagaagacgggtcaagggttaagcaagttttgaagggcaaaagggtaaataggccggaaggccaagcgtattggaagaatatacgcttggaccgggagattacttaggccaaagggttcggttcctttcggtgttgcctcccacagcaatctggtttggctctcgggccctctcatagggtttagattcctcgccccctcgatcctcgacgacgcgaggtgcg

SEQ ID NO: 43606 - DNA, 23859 bp, Oryza sativa
atacagagcgtcagcttcagtagttatgctgcgaaattacccggtctgcgctgcaggtcttcttcaacgtgctatcttcttgaaaaaggatgcgcctgctgccctgcaccatagaccaaaggttagcgacgacttccagccatcgacaagaacacgggacagtactagctgtacccaagtccttgtagttatcgcattgtttttacataatgaaaataacatcctcgatctctgcgacacacagccaactagccaagtcatgacggagtaacaagtaactagtacatcgagcaaatggctgctgctaacaacggcgagacgcgagtttcgtattatgggctggtttggtttgatgtctaaattagacttaccaatatttgacaattttaatagtgttcagtgtctatttggtttgaagccaaattttagcatgcctaacaaaataggctattttaataatgaacttaggctattttggtttcaatccaaacacaactttatctttccaaaattagtcatgccaaaatttaccaaaatttaacactgacaaaatttggtaaggcctattgaggccacaaaccaaaccaaccctatgtgacagagcatcaggacagagcgatggaatttgagaggcaataaagaaaaatgcaaagctagtgatgacggcagcggagctgagcgaagcatatttttattcgttgcttcgcacgcctacaatttgcagttttgcaccgacaatataattgcacgccaaaaatgaatggtcccctgacacaaacgtccaccggactgcagttctcttattatcaccagaagacgagatcacgatcccaaaagcaccaactcagcagatcacctctccccctcctcctcacggtgcaaatgagcatacctcacgcaagtggcgtccacatgagctagcaagccagggtgggtgacgaggcacctgccttttttcccgatctcccgatcactagtgctcccatcattggaggatgagagatccacgcggatgcaaagatgcaatggtaggttcgagatgagagaaacagctggttgttctgtgattaacgccccggtggagcctgcgaatttggcgagaaaagtatacactcaaaccacctttttttcctgctccgagtacgtgcacgcatgggatcggtgtggcaactggcaagtgctgaagtgcacatgtaacgcccccataataaccccatttctgagttcgttcattgatgcaaagtacggccacgccgccacctgatggcacacgagcacggatttatccttttacactgggtaatgcaatgcttttctttcctctattagggctctctaggacgcgggaataaaaaacacacaaaaatataaaaaatacagtattaagatgatatgacttgttgatattataggaaataaaaccatgaaatgttgtttagatgttttaaaacaaaaataaattgcagcaatttaagtcttgtatattgaaatgtgtgtgtgtgagagagagagagagagagagagagagtgagtgagtgagtgtgagtgagaaagtgcattggaatttttcgctcgattttgtaaaggtgaatagctaaagtggtcctccaaattttatctgagactcagtttagtctttaatgtttttatatgtccatattagttcttcaagtttttattaaagttcaaacttattcttgaactcacttagaagtcatatggctaaacataaccaacaactctcttgataaatgacacttataccctcccttcactcacatatataagagaaaattttgcgtgcaatgaattcttttatagatagtgcatagtaatttatataaacgaaactaaattatgtacttgcaagtgtatacgatagccattagactcaagtttcaagtgtatatgttgaaataatggaaagtacatatgcattgttgtttattcatcttggttttctcttttctagggtagggtaaaaggggcattttctaacagaactgttgaatagaaatagccatatggcatattaagtgggcccaacaatgattttaagccaaaacaaatacttagaggatctatatggataaaataaaacctgaaggatcaaattgagtcttcggtgaaacttaaaggactaaattagctattcacccatcttgtaaatgtgaggtgcgagcacgtgtagaatttatttgaaatatggagggatttttcccatccttttaaattcatttgaaataatcttaaccatccaaaagactcgtatataggaatttttcctttaatttggattgaatttacctagttttcctacaaatttggattgaagcccttggtcttcagatatgcatacaatggttctatttggcacagctcgagacctaagattttctaacgctagccatttctgcctatagaaatccataaatatgatctaacattacagtttggataaatctttctgttcgtattttataggaaatattaaatttcaaatcactgtaattttacttacaaactttaaatccaacaaagatatgagatctagagccgtgcccagggccgtgccgtcaaatttgtaggccctgtacaaggctctaagtgaggcctaaatcaagtaacaaatatagctaaaataatgtatatactgtagagcaaatgcgatataccaagaatagtatattttttaactcttgttttgcataatcagaaactgtcaaactgaaaacggagaatggtcgttgttgttgctggcttgctgcctagtgccttgcttgttggttgcttgctaagttagtattcactggttgaataaaaatgtgaaattggatgagccggctggcggcttggtgctcggaggagacgagacgtcgagactcgagacgaattgaataagtcacagatacgaaaacgaaagagaatacaaaacgccgtgggccctcggggctcggagttgagaatacgaagcgtcgcacacgcgaagtcgccacgtggagatacgcgcggactcgaacggggttctggcgctctggcctcacacgaatacatgggatgggccttcttcagttgggctgattttttgaggccctatacggtcgcacgagccggatgcccctgtgcacggccctggccgtgtcagttatgtgcatgagcctatgtttgagggaagcttctggcagctgcagtttttttaaaaaaattcttcagctcccctaaattgtccagattattttaaccaaattccaaaatatatatatttgtagaataaaaaacaaactaggagttagaagctagaaacccatatttttatattcttgtcatcatttgtttcatagaatctcgagctaatagaatcttgagctaacatatatataacagggcctcaagagcctattaagagaaactttagattctgataaataactgatgagaatttagcaggtgagaatccgaaaaggttaggaaaaccaacttatggtatctagtctatttttaaaattttgtaactacagtatatcataatttgaataaaaactaactattcgagggaacttgtgagatgtgttacaaaatccatgcatgggcatgggctccaacgagaatgaattaacggaaatcatgatttagcaattgagccaaggtgaagtaccggaaccggatcacaacggtaggcgtgaaatggagcaatggagcccgataggcgatagcgctttacatgcccattattcaacgacgtccatgatttagcaactgccattaggtacacatatatcacgaaaacgatgtctacatgtgctgattcaacctgctcccacttttcaccctactttgctgaagcagttagacgttgcaagtcgcaactatttatcgaccagccttcgatcatccccgaaaaaaaagaagacttctcgatcgtgctatatccttttcccgtgagttatccgaattcctacgtgaatcttttcgataagtttggcgagaagcctgctagctcaccggccggccggccgtccattcgagcccaacctttcccgggtcgccgtcgtacgttgtcgttgccttctcgtcgccatgcatgcggctgacgcgaccaacgagctgtatgcgcgtactgtgcgcgtctgcgtgcaaccgacgccaacagtggtcgcacccgtctcgcgaaaggaagggtgaaaaaaaccacgcatctgcagacggacgtcgtcgccgctggccacagtacgccccccaccgaccgcgcgtacgcctcccgaaaggcgcttttttgaggggaaaagatacacgactactcagaatctaatctatcctcgcctagctagcttttagtttttttgttcggtcgatcgatcgatcatccgatcgccacggggtcgaagagcggaggcggcacatgtgctcgtgggaggcagcagatacggcactctcgttcatttgtttcgtcggccgcggcgcgatcgatcggcagtgaggtaggagcggatgggtactgggtacacatcatacatacacgatggctgaatctgaacggcttcttggtggtggccgcgccgacgcgcgtacgtacgggcaattgataactgatcatctagtatgctgtatgcatatgcttgcttcctctttgcgccacgtactgtagcaaattggtactgtactgatcatttctcttgaattcgaatagttgagctctgttaaattaaacaccataggagtattttgtttcttactaccgtatatttgtatggaacttgtctggcgaggccagcatcaattcgatttctcatttctcgcacagactccgtttcggaaccagtacacaggaaatgaatgaattaacggcatccttggtacttgggaaggaagactaatggactagcgtcgacgtgttgcgtacgtgattccggtagaaaaattgggggcagtcggcggaggtcgacgtcagtcgacgcttcagtacgtgccagatttgcttacaagtctcggttgtatatatcctcagcctcagatcattttgcctgatcaaatttgtttaattattagtttgtcgcagtcaacgaatgacctggcatcgacttttacctacgtactacaagtcgtggattggttaactacaagatgcaaagagaattcatgcacgtaagcaaagtgagcgtgaaaactaaaaactaaataaatgatcacgtagatcaactatacaaaaccactttctaagaggagcactgctgcacgtatgataaatctcaaatgatcagcgtatgatacattgatactttgtaatatcttgtgagtgcggtaaatatagggactaaaatgtcttcacgtaatcaataaatcatgagaaaaattcctatgtactcttgagaattcgtccaatcctttatatacccctgaatttagcctcatcctttatatatccatgagtttttattttgatctcctctatgcccattccgttagttgaccgttaaatatttttgaaattgacaatattacccctctcttttacttatgtgctagtttaatgataaaaacataattcttatatgaaaaaagatctatttgtaaataaacaacgggaatataattatttgacaacaaattttaaaaataaataaaaacatttaaataaattttaaattaactttgttttcatcaaaatttgaacccgacaaataaataattttggttcacaatttctagctaaaactcttatatggattttgtcaaaaaaaaaataaatttgttcaacaatttaaattttcttttcaataaataattatgtcccatttgattttatcatgagttacagtttttcacattgtgaattgtaagaatgggaaatggacgatatggtcattttaaaaaaatttaacagtcaactcacggtcagctaactaaatagggatagaggagatcaaaatgaaaactcaagggcatgtaggggatgaggcaaaattcaggggtatagaagagattgcgaattttttcaggggtatgtagggaattttctcataaatcatctaatataatcactgtgtgcatagcaatttccttctaagagcaccatgttaacttaaaaaaatgattacatagatcataaaaagtatcacgttgtacatgttgattaaatatattgtgcctataaatttgcatttaacatcgtaggcaccaaaataaccaaatacattgtacattgtgggaacccatgtatttaatcaacatgtatttttgttatgtacattgtgggaatccaaattaaccaaatcctaggttaaaaatctatttgttatgcacattgtgggaacccaggcaccaaattaaccaaatacaacttagagtatttattattgattataaattttagacttgagaagctacaactaagtctccaatcaagtatattatttatgaatttaaaaataattaaatcataaagaaaaccccttttgatatttttaaatatcaatacgttcaacacacatgttaacaattagtgcagtatataatgaaattaaaaaaaaacttttgattatatggcagatgcacatgcacgtacaccaaccacacatgaaacacgacactttatattcgtgaatataatttctaacgcatactcaagtagatggaaaccgacagtacattctttatcaccttaaagttatacttaattctatgtagccttcaactttggtttcttttttttgttgctcagaagtcagaagtaatattgttccgtttacattcgttacactacaactttttccttgttatcttaaatattttacgagtgcgcaatatgaaatgctaacggttccaaaagggtccgtccttttctcttcacaattcacaaagaagcataaataaagaaacaaaataaaaaaaaaagatactattgcgcaccgctaatgcggtggtaatgcagcgccaccattgatccaaaggaaaaaagaatagaaaaacaaaagaaaggaagaaaaaaaaaaggaagtctaaagaacagaggaagagaacaaatgccagcccttccgtttcgccctttcggctttcctccgtcgtggtggactcctcccggctacggccacacggcgccgcaccaaccccccaccccccgcgcctgaattttttacaatttagtccttttgaaaacttatttcacaaatagacccctggagaaacttatcccagaaatgattttttctgggataagtttttctaggggtttattttagaaataagttttccaaaaggatcaaattgtaaaaaattcatgacgcctgggacccaaccgcagggacacacacccacacgcgcatccatccatccatccatccaacccacctgcgcaggacgcaccgcaccgcaccgctccgctgctgctgctgctgctgctcatcatctctccgaagcttctcatctcctctccactcctcctcctcctcctccccctcgccacctcccacgcgctgccacgccggcgacacgaccactgcctccccccgcgcgggcgcgccaagcgccgggatcccgctgctgcgttccagttcgcggccggggcgtagtaaccacaggtgaggtttccttttgggcggttgcggctgcgttttttttttctctctgagaattgtggtgcgcccccgccctacgcgggggatcggtgaattggatgcgctttgtcttcctgatggccgctgcgagggaaaagtgggatctttttgttgttgttctactgatttgatttttgcggggggggggggggggggggcgttctgtcctgtttgcgtagtgagtagagttcacgctgatggtggtggggaaggggaatggaacggatgagttgccagaattttgggaatcggggggcggttggcattggtctagttgggttagttttacttgcttcgttagctggattgttaaagctccaaacttttcatggctcttctgctcagtttgagcctgtatggtgtagttcaggaggtgtgttttgccgtgggttggttagagaatttgatgagcctggaatcgacgtaatgaatattggtctctcttgctccagaagaactccgaatctgttgccttgatggcacgtgaattttcagttgataaagttggagtttcatcatggatttgtgtggtaacttgcgggataaagtaagtttcagttcgttttagaagttgaatttctctatcctactttatgagagattctaagagttttctcgttttgctctgaatttatctgtatatgaggacttttaggggggggggggggatgaccaatttcttgaaaaacctattgtttaattggagctgttcatttctagttcccaattttcagtaaatgcgttcttagcaagtgattgcttgataccacgatgataccccgcaaatgcatcctctccgtaattcaggatcatatgatgttaaattgttaatcactagttctttcccagtatgtgagttcctttttttgttcttctctgtaaatttagcccttgtttgtgtcacagtctctcagagttctagaattcacactactgataccgaatcttgagcacagtcagtttgactgtttgagcattacgtatgaatctgtttctacaacgatgtatgtaatgataatgatgattgtaatttgtaattgatgcagtatatatagactaacatacagagctgctgatgaaacattagcttatctttcttgccagcttaatcaactctttgataccatctaatagcaaactccctttatataaaatacagacacaaagttacacagttgaccattatttcataccaaaatagcttccccaaatactatcttttatctgcagtgcatgcccgtaactttttgtttcttgtgaatttcagcagtgcaatacaccttaaaatggggtctacacgatcaaagaatgaagatgacaaggccattgtcttatgccacgaaagaaaacgatatgttagagaagcacttgatggaagatgtgcattcgcagctgctcacttcgcttatattcaatcactgagacacacaggatttgctctgagaaaatttttggagcctgaagtgccaacagattcttcgctgtacacatcgacatctgcaacaccagaacctcctactattcggcagaaatcgaggaacttatctccatctatttcacatcaggccagtgactctttctccccagttccatcccctttatcttccggacggttccgtatcaatcatatgaaatctggggggaaccctgtcatgaccattgaggagaaggtgcctgttcctgtaacagcaactctacaaacatcatcccttgttcctaaagctgtacatgacctggatgatagttccacatttgaagcacctccagggacaccaccgtgggactactttggcctttttaaccctgttgagaaccaattttcatttcatgacgagaaggagcctggtcatgactttgaaaacgctgatgatatcaggcgtcttcgggaaaaggagggaattccagagctcgaagaggaaggggagaagactcctgtgcatcctgacaatgttaggcgcttccgtgatgagaaaacttcagatctcaaagatgcagaaaaatctcctatcaatggaagggaggatgattttgcagagtcagaagatgatttcgataatccatcatctgaacctttagtgagggtgttccagaaccgcaatgatatgcctgttgaaaatactgtgatgaatcagacacctgaacatgtggcttcagaaaagttagcttcagagaatagcgtttctttttctcgaaaacaggagaatagtgattctttttctcgaaaacaggagaatagtgattctttttctcgaaaacaggagaatagtgattcattttctcgaaaacaggagaatagtgattctcaaattgacaggccaaacaatgacaaggaggtgctagacattagcatgtttgaaagtgatgatgaaagccctgtggcaagccctgtaaaagaagtgagatcttccattgctgctcttcctatgaatgggaaatcaaaagaaccttttcatgacgttagaaatggtgcgaaggatttgcattcatgcatgaaagagattgaaatcttgtttattagggcatcagattctggaaaagaagtaccaaggatgcttgaagcagataaagtcaatttccggcctttactgcctgaagaaaaaggttaggtatcaataaaattaaattactgttctgtagtatcttatttggaaattgcatggaaaataatggcagaaagattttgggatgcaaaaatatcatgatgtgaaaattttcatgattcttttcaatgttatccatctatagaatatcttttgcctgtgatttttatcatggacaattctgtctttactaattttattgcaattttggtgcagcacatggatcaaaagcatcaggcttctttgcgacattctttgcttgctgcggtggggaggaaattcctattcctcagcgtaagtttttatatctgaaatacagtctttccgcagcagattatgttgctgtgtatagttttgcatcatatcatgtttgtttcatgccgtttattcctggatctctggttaaaagatttgttttttccacaaatggaaaaattctatgttatctacaagctgatatgtactttccacattctcacacgagcaattttgacagaatcttaattattttgtcttttaccttgtattatatatgttacagctttttttctcccttccaccataacaagaggtgcccttttgtcataatgcagctcctcctgaggctgaagtgaagtaccttacctggcacagatcagtttcttcactctcttcatcatctagaattcctcttggggtgacttcaaaagatgatgctgatggtctcactggaaatatctttagtggtgtatacatgaattctggcagtcacgcttcaacactagatagattatatgcatgggagagaaagctttatgatgaagttaaggtacttgtattttggctggtcttgttactaaaatatttactttagtttatctgttctagccagtttttgaaatattgtaaagtagagaggtagcaatgaagtgttttaggattgaaactagccttctttttttttctttttttttttgcaaaaagggaaataagatcgattttgaactaattaaaacagaacctacctagaacatgtaataaataggaactagccttttttttttttttgcaaaaagggaaataagatcgattttgaactaattaaaacagaacctacctagaatatgtaataaatgggacatacgaaaacctgaatgtatttgatagaaggattgcgactcactatatacaacatggcaattgcacaaagtgctactgtaatcattccacagcaaccactcaggctatttaggacaattatgtaagtagtgtgagccagttacattattttcttatgtacctacgtaatacagccataaaaaaattcactaccgatgcccacttatatgttcattttgcactttttattcctattcccttcacttaattcctttgtactaatgttcttgaataaataagctatatccgtgtatgtttgccttaatctgtgaatttctatgttgtaaacatagttaaatcatataatgatggcaaatttgatgatttgtttgaaatgctaacctttatattgtcttcaggctagcggtgcaatttgtaggcaatatgacgaaaaatgtaggcaattgagacaccaggaatcaaaagctgaaagccaaatgagtatcgatagaacccgtgctactgtgaaggatttgcactccagaattatagtggccattcagagaattgacatgatctctaagaacattgaggatctaagggacaaagagcttcaaccacagttggaggaattaattgggaggtatggttcaccatctatgttttactatactgttttctagtgacatgttacaattcaatgaacactttaatgtcgatgtcagcatatttgaccagcctgatcaaggcccctttcaacaccttaggtcaagttattagtagatttactcctggttttggattatgggttttgaccataacttgcttggtcgaacaaccgccaggtgtatgaatgaaacaaagggccaacttgccctggtcctgtttttgctctagtctacattaacagaagataaatggataaggtagtacttaccattgcatgttgcttggggatgatttattcctacctccagcattgcccaagtttcataaagttgtttgtgagctttgtagaatataataaagcaatttgatgctcatgtactgcatgttacctttgtctagttatttactgatagttttccaatatttgcattttaatagatagtatatacatctcatttgcagtttaactcgcatgtggtctacaatgcttgagtgtcacaaacatcaacgtgagattattaagtccagcagtggcaacacgaaggtcttaattcggtcggagtcacaatttcaagcagctctactcctccaggttgagctaaacactttatattcaaccttcctgaaatggatagcataccacagatcgtacttgcatagcctaaattcatggctacttaagtgtgtgaaaccactgaggggcaagaagagctccaggaggaagaaggaagcagatactcccataactaaatttgctgttgcacccatgtttaaaacctgtgaaagctggataaagttattggatgatttaccaaccaaggacttggaagatgctatcaaaggcctcgtggcagatataaaccactctgtgcctcgccaagaaaagcggcgtggtacttcaaagttgacttcctcattatcccgttccagtagtaccaagacgatttcctcattttctcggaatggagagttaaatggtgaaatgtcagagatccacagaaattcccatactacggatttacagtcaagtttggagacattcctagaggggtttgcagagttttcagatgtttcactgaagaagtatatggaactcgcggttgacattaacaaagcaaaggaacaatatgagaatgtgaagttaaagaacatgggaaagtgaataagttcgacaaagtcagaccaaaggaactaatttctggaaggaagaatgggctacaataactcaaagccatttagaagtggataagtggatcacccatgtgtatattagcctgtttaaacaataggtataaattactgttacttttctttttgggttcagtttgcaagataggtttaggtgggagaggaatacttgtagatttctggccaatgccatgccgcagaagtgtaaatctgaggtttaggtaaaattaaactgatggtgggggatacaatatgtgtatttatcctgggtatatcattatatgagttttcccttttcttctctttttgatctgtgtagaccttccagtcctttatacagctagacgtatctatacagccaatttctccttttgcggtgaatccctgatcgaattgtgattgctagaaatgtactgtttctgtgcatttcgcagcgaatgtttcactctgaatgctgtgttacactgaatgtttgtgttgaacctggaatatatttccttcgttgctttttactaccttctcaaaggcctcaaaacgtcaatttcgcaaggtggtattgttggaggcatatgtcacgcgaatgtttcactctgaatgcggtgttacactgaatgttgtgttgaacctggaatatatttccttcgctgctttttactaccttttcaaaggcctaaaaacgtcaattttgcaaggtggtattgttggaggcatgtcacgagggccttcgcctgggcctgccgaaaccacaagaaccgtgaggtgttggctgagtccatgaggcgaagcagctggcgaagctagatgatgaagaccgaggggttcgccaccaagcccatcatcctaacaagccttcactacgggcgaagaccgtagagcgaagcaggaaggttttgctctggttagaagcggttacggcagagggcttggaaaacaccgtggcccatggaggcctttcgtcagtaatgggccagcctaggagttcacttataagcttatgaatacaaaggatactgtatgccctcactaaagtccctatcataagggtaccatgtaaattccactgtataaattaaaccctataaagtgtcagtgtgtactaaggctataaatagcaccatagggctatgtaatgggggatcccaaaaatttcttaccaattaatatattacttttactattccactcaactcagtgagtgaaccatatctttcgatgtgacgcagttgtctttcgacagcaggtatcaaggaagaagcaacatgattttgcctagaagaaaatttcttaaaattttctttattatgctcttcatattctctttaatgaaatttatgaaatatcccaatgaatattacagtaactatctcatcctgttttttctttgttttatccggacgaacatgatgtgtacttgtgcagagtgtgtcgtgcatgtgcagtggtgtacgtgtctaatataggggctgtaagtgtaaactttttatattatcatactacctctgttccaaaataattttaattctagattatttgacctatattaaagtttgagaataaagaatatgatgtttcttattaaatgacgtatagataaaagtgaggatggttgaggatagaatggagagaaatttaaatgagaagtgattaatataacaattagtactatattgtaataactattttatgataaattaaaccctataaatataattattataggacggagaaagtattttttttcgtttggttttatatgtgcttcagatattactggtgggtgtgtgggtgttcctaatgctacatgcagcagcggcccatttaggcccaagagttcatcgcgaatcgtcgtcttctctccatttccctttgccacgaacaaattccagaaacaccctcccatatccctcgcggcgggccaacggacggggccaccccacggcttcgcggcagatctccctcctcctcctcctcgtcctgggcggctccggcggcgtcgccggcaggggaagccagaacgcgatggatctgtggaacaagctgcggagcctcgacgcctaccccaaggtgaacgaggacttctacagccgcaccctctccggcggcctcatcaccatcgcctctcgctcgccatcctcctcctcttcctctccgagatccgtacgtcacgcgccacctccctgatccctccctctccgcctcagatcccccttccgatttttcgggtttccgcctgccttgggtgtgggggcgcggtggctttttttgcggattggttccgtttgttcacgtgtgttagggcgggtgcgaaacgggaggagtctgtggttggttggccgtccgatcgagtgggaattggaaataacgggcggataattaacagtccaatttaacatgcatttgaatcgtgtattcgtattggttagaaggtggcgtgaggaattaattacatgaaggtaagaggcgcttggtgtggagggtacggtagattagtaggatgtatgatctagaatgctgttgatttcaattgccatgctatggatcagttggtgttatcacttgtcagagtgttggtatttgtttcattttgcaaggatgtttttgtgtggatttagtgagtcatatgtaaattgttctgttatgctaatatcattaatgtgaagagccatggtttgattaatttgagagcatttcatgttaccatttctagttctttttttctgatgggtagattaattgttatttgccaatactttactagttatttcctgcactgaacattcttaacttttctgcagggctgtatctatattctgctacagatagtaagctcacagtcgatacctcaagaggggaaaggctacacatcaatgttagtgtggatgttcattttcattttccccgaagtttccaattttcttgcattgctaagacattttgcatctccagtttcctcttgttaatttgtgcccctccatgcatgtattcctatttggaaagccacgctcttgggcatttaggctccatctatatattatattattaagacaggcttgataggagacatcatgttccttgtggaggctagaaattcccacattaatcggaggaaaacaaaaagagagttaaataggaatacaatttagaaataactgaaattcggaattagaaataaggaatattggaataacagtccatatagaacccaatacgagaataattaaaatctctactacttaaaaagactaagatgattctgtcgtccatcattgacgtcacagcgcctcacgcgcattcgcgtccaagtcgtgtgcgtttcaatcctgctgcatggcaccgtatcgatttaaaggatttttcttttaaataaaaggggaaaggaaaacgtggcaggaagactgcctatgataatctgagagcaaatcaggaaagagttccaataaaaacgacttcacgccaattcaatcgtcacccaatttcttgctacgtaataggagttttgggttgtgcttttatagagaattgaatcgggttttttcttaagattggtttgagatattcttgtgcctttcatccagaaaagtaagatatgccccggtcgatgattggcgatttatctgtagcccgcttggctctgtagctccgtatgcatgcacatccaattaagctctctgatgcaaagatggacatgtttatgagtagattttgggatttctccctgatgtgcaatcatgccaaagatgtctaaattgaatcctaatcatttaagattgatcgtaaatattaattagtttctcccattacaaagctcgggcacatttgctagttccagtctaatttatctttctttactcttctaaaaagaggagttgaggtgattggtgtgttctcacccccacattataagatctttagtggttgcatatacgtggtaacaggatatttatacgttctttgcattttttttatgtgaaaaaaaggcattccatggacgtatgcgctaattggtcttatgtaaccatgtaaacaatcttgaggtccgaggtatttttttttgtatgtgtgtaatcttatgtggccactgcacatgccattttctgcaactagttgaggaatcctatacttattgttaatttatgttgctgcacttttgcagtttgatgttacgttcccagctcttccttgttcacttgttgctgttgatacaatggatgtcagtggagagcagcactatgatatagtatgtacgacagttttcatcagtttccttattatattatatatattttgatctgttttaaaaagtgcttcccaagcactgtatcacataatattctacctgaggttccaaaccatctgctttgcagagacatgacataataaagaaaagaattgataatcttggtaatgtaattgaatcaagaaaagatggagttggtgcccctaaggtatgttttcttacttttaacttgaaaaggtgtacaggtgaaactgttctgtttctttttccttcacattcatcaccattggaactgttcactagtttttatcttagaaaatttgagatatactttagttagccaattaattttataaccagaccttgaacattgtggtctgtgatatttttcttttactctggaaaatagctggtcctattgtgcttccgttataaaattttggccttcatagtgcttgcatgcagccaggaagttattttagattcttctagttgttagtgactattcttgttgtgattttccagaaaaacaagcataggttatttatgctgccactttatttatgtcagtaacctctataaagaaacaaattgaatataaatccaggcatactggcatgaagggatcggtataatggttgtgaaatatgctgtcaaggataatgttcttatatcatatccacgcatagtagtggtgtactggcatgaaggggttgtcatattattattccttactgtatgatgggtgtgcgctatgttggcaaaaacaatatttaactttaactaacttgaatcatggaactctagattgaaagaccactgcagaaacatggtggaagacttgaccacaacgaagtttactgtggatcttgttatggttctgaagaggtaccttgtacacttctctaataccattatgttgagtttgcctatttttattaatgtaactatttatgtatttacacctatattatttgcaacactaatttttatccttcctcttccattgaaattgtaagaaaaactaatattgtttttattaattcatcagtcagatgatcagtgctgtaactcctgtgaagacgtccgtgatgcctatcggaaaaaagggtgggcactcaccaatatagaagagattgatcaggtactacgcacttaaccatttttcttcacacttacaagagattgcataatcttgttcaatcttcctgcacatggttcttagcaaaactcgtccatgtattgccccttgtcatgtgtttgtccttggtctgttcatttgctaactagtcagttcttgaaacagtaatttgtggttgagcattgtgtttccttatcaccacatagatcaatatagaatattactgcactactatcttgatgtcgacggcatgttcattatatatttgtgtaatgaattatattgggagccatggcttgtactgcatctagccatatgctagtaagtagcctgcaacccaattggcaatccaaaatatgtctataaaagttaagtttgaattatagcctctatcataatgttgtttggaaaaaaaatctgtattaattttgatcaaactatcttatagcttgcacttgattttctcttatgttgcaaaatgcgatgtttggtcattttgttgcatgcaacatgaatatgttaacaaattaatgcaacccattttgtcttcctaatgaacttatttaagagtttgtactgcctgctgcctgcaaccaatgcatgcagacatcttctctatcagttttatgcttctatcttatccttaattgacttatgttccagtgtaagcgagagggctttgttcaaaggttaaaagatgaacaaggagaaggttgcagcattcatggatttgtaaatgtcaacaaagtagctggaaattttcactttgcccctgggaaaagcttggaccaatcattcaacttccttcaagatctcttgaacttccaacaagaaaattacaatgcaagttgattttttttcttcatccaccttattgaaccattgataatactgagcataaacaattaaacatgaacttataatggttttactgaaacagataagtcacaagataaacaagctttcctttggggtagaattccctggtgttgtcaatcctcttgatgggtatgtttggaatttagagaagctatatcacatctctctttggtccttattttccatgttcctgatttcctgtgtatttcagtgtagagtggatacaggagcacacaaatggattaacaggaatgtaccaatactttgtcaaggtaatatttttagtatctagtcacgtttttctcttgtggggaactagtcatgctatttaatatggttgcacaatgtcatgctgttggcgtatgaagagatgtcatgctgccttctttagtttatgtgcctcttttgtgcaggttgttcccacaatctataccgacattagaggacggaaaatcaactcaaatcaggtaagcaacaccgttctataacatactttattctgaagccaaaacttttgattttaattctttttttcttttgcagttttctgtgacggagcactttagagaagcaattggctatcccaggcctccgcctggtgtatatttcttctatgaattttctccaattaaggtgaagaatggatatactgattttatgtagtccttgaagcattaggtagcgatatttctgtgctgtctattgattagtctgtaactatgctatctagtctacttagctgcatgctttaaaaccacaagcatatgcctgtttttgtttcctgaaagcatcatgtcagttttctagttacatgtcaatttgtttagctcttaatacatacaattagtcaatataggctatttagctgtatgctcggatgatcgtcacaagcatgcctgcatttatttcctgaaagcaacgcatttgtataagatattatgcaacaattaccatctttgcctgcattcttcgtcctttagattgaagttatgtcatttgcctgataatttgattgttctttggcaggttgattttactgaagaaaatacatcgcttcttcacttcctgacaaacatatgtgctattgttggaggtctgtcatagctcgcaaacttgtttatctttttgtgctttccagaaaacataagcaatagactgatttttgcatgaacatattttccaacccatctttcaattgcaatcgtacagggattttcactgttgctggcatcatagattcttttgtctaccatggtcatcgtgctataaagaaaaagatggagatcggaaaacttggataattccatatttagcatataccctgtaggatcatagtttgaattgagtcgactaatgcttgcctgagaaaggtacgaagtaaattcaggaggaattttggctaatatgttgtaatacattttctagccgctcagacttttgctgattattcaagcctagagcatagacatgtttgtataagctgttgcatcgtcgtatttaactgtgttttgggctaaatgtactgtaacatattcataaaccttgcagaaagatgtatttcgctccatccccagttgcccaccccacaccttttttctttttttggaaaatttcatccataccacagacaatttggtcagtagcaataaataccacaaaattatcccacatccgttttataccacaactccgtcagatttgtttcaaaaatacctatctttacttctttagtccaaagagtacttttcgcggagatgccactccattaatgtggtttcgatgaaatactactcactaggatgcaaaggataaaatgtactaggatgcaaagaataaaatgtcacttagtaggttacctttagggacagcatgcgagcgtgggcgggccctccagcaccgctccataggaggccatgctgaagagtggtctttgccaccacccccgccgtctcgtaggatccacgcactaccctttcttgcctgctctcttcctatggggctacgtgttccccgccttcggtgccacctgcacacgcgcatgtcgtcctcgtggccctgccaccagtgagcactccagcaccactgtccaattcggtctcccttgacgctcccctattccttcctctctctatatccaagggtattttggtcttacaactctctaaactgacacaatatcctaaagataaaccactgagtggtggtttatcctttgcatatttcatcgaaaccccataaggccatgggggcatattgtcctttttctcactttttgggcttgtttactggagcatctccaatagattaactaaatcaggctctccaaacatccatatagccatctctctatctaatttggcaaatttaactcgttactcactccaacagcctctccatctacgctctccattctgagtctatgacagtgagacctatatgcagtcttttcaccatatttccaactacaatgccttcaatattccatccttcagcggcaacaatgctaagaagagggggagaagccgatggtggtggtaggcagcgagagggatggatagccaatggaggcggcacgtagcaagagaagacgagagcggcaacaacagcaccaactatgacggcggtgggctcacgaggtggggaggtgaagctgtgatggctagcgacggaaggagcgagcgaccttggtcggcggtagaggtgcactcgcttggtggggaggcggaggcctgacgactattgacatcggagtaacgaaggagggtgttgtcgagctacccaatcggtggcgtccttgctatcgagctgccccgccagtggtgccctccccacctcaccgttgagtcaccgccccatcctcgccgtagagccgccccgccaccctcgctgtcgagccgtgccaccactacgccctttcacccttgcccctcccttgtcgttgctgcgctgtctcgccctagctcctcctcgccatcgagccaccccgccaccctcattgttgagccgcgttgccaccacgcgctctcgccctctcacctcccttgccactgtcacaccctcctgcccttgttccttcctcgtcgcacccgctgttgcgctctcccgccctcgttccgtctcctccaaccacgggcagaggcctgtgctgggtggccggcgctgtggagccctgctggtggctgcctggcactctcaatgggaagggggcaagactgcaggagggcggagaaaaagaatcatggggcccatggttgacaagtgatgttgggtggccaaatttggtcagggagggaagagatttggctagggagaggttgttggacttggaacacttttttttttatagagttgctaaattttggcttagagagacacttggagaggagatgatctttgtcaaagttaccaatttttgacattggtaaggtgataaactaaataagattttaccattacaataccaaactctgttaaaaatgagtaattctacaaacttcaactcacataacacaccaaattattgttacctctgtccataataattgtatttctaggatttgaatttgtcccaaaaaaaattgttacaatagagtactaatggtctcattaatcacatcacgttcaaatttctttctattttactctcaactacccttccactcttacctatacaccatttaataaggagtatcatagtctatcttttcaaaccttaatatatgctaaataatctagaattataattattttgggacggaggtagtaagatattaaacctaacatcttcatatttttaaccttctcataatttgatattgcccgtctttagctttactaataaatggtgaggtttattttggtaacggtaaacatatactacctccatattaaaatatagcaatctagaatgagatgagatatattctaggactatatattcatagtcctagttgttacattttaggacggagagaatatttttttaagcaagtttactgggaagctttgcaaatacatgcggcgtgcacattggtccagaccaaacgagcaaatgttcgatgtactcaagccaaacgggcagctggctgaaactgttcctgccagcaaagccagcggctgaacggccaaccaatgccgcgctgcactgaactcagcatcagtcgcgcgggccagagcaaacgttctctctcgcaccgcacgcggcctgaccccgcccacgtcggcggccgtcccggactccccccggtcgtgcgcgccccggagaaatcgcgacagggagagccgcaccgcatgcgcccccggccatcccatcccgtcgcgctccccgcccgagcgattcctcccgatcggccgtccgggccccgtccccctccgtcacaataagtgcccaaagtcgacgaggcctttttcacgtgcccgcgacggcgacgcactctt

SEQ ID NO: 43607 - DNA, 1821 bp, Oryza sativa
ccccccccccccccccccccccggttcccccgccctgtcgccgccgcctcctcctctcgttccagcgcgcgagccagagagagagagacgggccacggaaacgggtagtaaaccacgaatcattccgcccgcgaaaaaaacgattggcgacaccgggtgggcaggcaggcaggcaggcaggcaggcgaccggatgattgatcgtgtggttgattgattgatttcagcgaccgagacgaagggaggggaatgtgttgatgttgctgggtgtcgtgtccaggaaaggcccggacaggaggaatattaagcgcgaaaaggcagccgctttgattcaccaacactttgattccagcgacccatgatctgtcactctgccggacaaactgctcactcctcccgggtaataaggctagcctacactctattactcctagtgtgtgtattcttttttgagattatacttggcgtaggtgaactgtcccggtcggaccattcaatggggattctttcattggcaaaaaaggacgtcttctctcaacagtgatagactgatagtactatacgagtacagagtatgtatacaagcagtaatgtggtagtatcaagtagagtatatactttgaaaaggttgtgtgaccactccggctgattgcttgagcttggtgcatctcatggaaagtgagtttatgtattaaaatggctattgttcgaaggcgaaaagcaacagacgaaattgtcacgaggatatgatgtgttttttttatcagctactactcttcagataatggttttcctgtataacgaaaactcttcggataatggtgataagctctaaacaaacgagagtgcatgcatgcacgcaggaatcgtggtagttacagagcgttaaatcggtacggtttggttccttaaactattttatagcccgtctcgtacaaggttatgggtcatgactgtgaaatgctccggctcgagaaattcagagatggggcatagcatcttcagtgcggctgtctctgctccacaaagcctgaagccgatatagtacagagaaaagatgtgctctttctctttgatggaagcatctggtgttttaataacatccgatggtacgcgagatttcgtctggtgatactgctttaggagctcggaggttaattaagttgaggcaggccccgggaattgccatcgtgggccatgttcttgtccccgttagtggacaagatggttacatcgatattctgtcaatgctggtgttccagagtccaatcctttagtaagtactgtagacaagttgtgatcaactgatcaggacaggttcagagacaactatgcaggaattatcctctctttattggatttatttataacctgatattggtagatatttaatcctttcttttttaggggcaataatgttagtggacgaaaatatgtcaagcatttttctagtcatttgtcccttttgacaagttaaagatctcaactttatggaaaacagaaacattcttattttttttataaagttcatgatcttagcaagagaagaaaattaaagggtatattcgcaacagatcaaagagcaatgactaggaaatcagtcagatcttcccccatatctccttctagatacaaagttttcaggatcattcaggttcctaccatctttcaggtgcaaaatacctttctattgtgatcacaagcaaaatatgcattctgcacaaagtcacagcaagccccagcagattcttttctctttccattggtgatatcaagaagcaaagcgtttcctaccctgtaaacctaaggactcttgaaaccg

SEQ ID NO: 43608 - DNA, 17169 bp, Oryza sativa
gtcaagcatttttctagtcatttgtcccttttgacaagttaaagatctcaactttatggaaaacagaaacattcttattttttttataaagttcatgatcttagcaagagaagaaaattaaagggtatattcgcaacagatcaaagagcaatgactaggaaatcagtcaagatcttcccccatatctccttctagatccaaagttttcaggatcattcaggttcctaccatctttcaggtgcaaaatacctttctattgtgatcacaagcaaaatatgcattctgcacaaagtcacagcaagccccagcagattcttttctctttccattgttgatatcaagaagcaaagcgtttcctaccctgtaaacctaaggactcttgaaaccgaagaaaacaaaaccaaagccaatttcttgattaatcgccaaggcaaggctaaataaccctttatgtcagggttgacccaaacacctcacctcatgaaggaattccagagcagcaacacaacggcacgtaatgccaacggtaagaacaaaggacgccactctggaggcaattaaaattttgcttcccaagatacggacgccgttttttctactacgtttgattgcactaaacacaatactttaatggccatacggccatacagacgaatatcttaatggccatatggactaatattcccctaatccttcgtcaccagtggcaggcaatggcattaaccgcattgtctagtggcaacgggagaaactgatgttgactctctgatgagagaggcaggcctgaacatgtctggataatgctcgcatcgtcacatgacagtcgaacacgaccgttgagtgtgcttagttaccttggatctaaagccatttcaggctggcttcaacgctgcaacgcctgcttgattggatcgatgcagatactacatcttcgttgacgagagatcccatggttttagtgtccgttgcgatggtaaatccaacacagtgtttggttcttgatgcctgaagaagcagctgaagaaaactgaggggagaaggatttacagtgtcctttcaagacggctctgaatctcagtatctgaatctgatgattctgatcacctaacattcgtttaattagttgataacttgattatatattactaacagcttttacccatccatgatgctgtactatttgattctgattctgatctctgagccgacccacagctgcagttttgtcattatccaaatggactccatcaaagatcacatcaaaggccataagacagggacatcagcaaaagcgattgtccgttaacccaaccaccgtctaaaatgccatatggaatgattacatttcatctcatctcatttgcccccaacacttcaccaataatcaatacttattagcaaggacacagcacaaaaccattaacatcacaaaaaagagagggaaagaaatcactaatagtaataaagttgttatcaacaggttgtttacctttccttccgtcataatttatctcttcctagcactcctccactagctcctacataaaagaccggattaatcaaatccagggtcacagctgcctccattactaaaaaaaattgtatctttaaaaaaaaggggaaaaaaatagcgattgaagaagcaatttgtcacaaacagttcatgcttcacctaacgcgaaattggacaaagtccatctataatcactagcagtagttggtaaccgtggacaagaagtatacaagctaataagctatggattagtatggaatcatatagctggaaacatgtgttctttttttgctaatcccctccctaattaccacacacatgccatctagctcagaatgatacatgcaaactcagcaaatcatgcacatttttcttattttctcaaaattaaatggttgaattagtcaaggacactattgcactaatgccagtagccgttggaagggcaacagattaacaacaagagagtacatatttcacatgtttgcagctcctgggagacagtccagataagagcatctcaactgccttctagcattttgacaatgccaacttcttcaggctcaattatggaatggattatacactgattactctccagaactaaattatccttagcattgaaggtgcacagaaatgtgcagtatagattaagtaataagacgatccgaaatgctgcgtaattgcgcttaatgtaatgcagtatagattaagaaagcttgttcgtaccactaagtaactgcaagttggcaatgtaccatatatcgtccgtcccaatctgggagcgtgcaagaaagaatcaactgatgataaatatgaaacaattggattagcattataatgatggatcaagtcactgcttttctttcagataagttggacatggcaatgcagatgtagaaaggggaacaagacttagcaaagggggaagcaaaactggttaccccttagctcatccatttgcacattttcataggtgaagcaatagaaagaaaaaggagcaagccaaggcaatcgtggaattgccagtttaacaagaaggccccacagagcacatcgggagatcctaaagattgtcccaaaatcccttgttatcttttcgaacggccaaatcccttgttatccattcactatctgtgcaattttcaccctttgttctatggaaggaacaaaaaaaatccttttagataggcacatgaactgaacaaattgcaaattggatgcagtttcacttctgaatttttatataatggacatagattacatctccggctctccggcttctgttataagaagcacagccataagtttcacttcagaatggcagagagtttctctcaagaaaggtgcaggatttgacaatgtggttgcttaattccattttgtcgattcatgaaatggacagaaccaagtgaagcattccaaatttctaattccattatttgttgcgaggatgatgctaaggcagtatcgaaaagtcgaggagacacacgatcgctgttacaacatggacgaacacctcggtgtgccactgaatcgagctgagctgaatagctgatcagctgaagcgaagagagcagagcgatctctgcacgggccatggtggtgggtggcgatctcaagttctcaactctacgctctcagaagccgttcatctctagcaggtaggtgcggcgcttgctgagcgcgctgacggcctccctgtacgggccgtcgaatgcgtcggcgacgaactcgtcgagctccttcctgccgccgccgattccgccggcctcgccgacgggcttgatgacgacgagcgtggcgccctggatccgcgtgccgtcggagagctcgagcatcggcgcgtaccggagcttcatgttgcaggcggggacctgggtgcggttggccgcggcggcggcggcgagcggcttgtcgcggaactccctgatctggtcgcgccccatgctgagcgtgccctggccgtgcgcgtccgtgagcgccacccgctccagcgtggggtgctccttgacaatctcgcggaggaggtaatgccttgtggccgcggcgatgagggagctgatggtccacaccacgcgcagcttgagcccgccgttggtgtagaacgactccgggatgctcccggtgtcgtcaccctgcgaggcctcgctgtccccggcggcggtggcggtcgccgccgccgcggcgggggcggcggcccggtccaccctggtgccgccgaggatgacgcagctctggagggtgctcccgaacacggccttccacctgagcagcaccccgtcgtcggtgccgacgtcggagacggggagctccatccggaggttccggatgctgctgaagttcttcagcacctgcgccggcgagtggtgctgctgcgcgccgcagccgccgccgccgccgccgtgcttccccgcgcgctccccaccaccgccacccctgaccccggcgtcgcagtgcccgaacggcttgagcacggcgagcagcatcgccttgaggaggtgcgacagcaccccgcggccggcggggcgcgggccggcgaggccgagcgcgtcgtcggcgtcggccgcgtcggtgatgacgcggtcgatgcggaggcaggcgtcgtccacgagcggcacgagcgagttgaaccgcttggacacggccgagcaccgccccagcgagcgcgcgtcggcgaggcggttgaagatgaggagcacgagcgagtccgggacgcggtcgaagtggtcctccccttccgcctcccgcggcaggagcaggtcctccgcgaacaccctgtgcctcgactgcattttcggttccgcgaacaaggagattgtgagatcgaagaggaggagggagggaggtaggtgcggtaggaggaggcgagtgaattgaagggaggaaggcggaggtggtgggtttataaagaggagaggacggggctcgctaaacaccatgactcgctgtcgggcccttgcaatcataccgttacagatgcggcctctcctctcctctgctcggcgtttttgcgtgttgccattgtttaatggtcgaccaattagtgtgtagggctaatggcaactaggcagcaacggtacactttccatcggcaagtttatactggtgtggtgtaaatacatgtactcgcgttcctgctgcatgcagtcaccgcgccctacgtacgtggcgagcgaggctgtgtaatgacactgtgcaacctcataaccggtggcagccagacagaaatggcctgtctgtgtgggagagcagtgataataacacgaatgaaatccgttctgatttctagtggcatcaaactggcttccgttttccacgttttctatgcaacgagtttttcatatggtcccttagaagtaacccactctctatttcaatttacttatcagtctacgtactccgaattaataatacttatcattttagataataacacggtcttaaaaacataactttgacaactagtaccttctattataatatatataaaaatatcaataaatatatggttttattaaagtactttttaatactaatctacacatatggtttttatattctaagataaatattttaaaaattatttgtagtcaaagattttaaagtttgactttacccttgtttaaaacaactaatattattagccaggaggaagtagtatttaatttttttttattaaaaaacttattgttgtcatattgtaaagcacattcagaagtgtctttcccttcatatctttcatcattgtagccatattaataatattacttcttaccaccatgagttttaatgctggctttgggtaatattacttttaccatgagttttaattaattgtaatttttaaccaaacgtcctatttagtgtgacaagcaaattgaaacggacggactatatccatttattaagttgtggtatctcaacataagtatgtatgagttgcggcgcaaataaacgctataatacgtggtatggtgtctctttgataatttttttaaaaagctattgtcagacatgatacatcatgcataatacctctaaagctcgcgtgcaaatgagtcatttgcatcagcctaactagaaaatgtagcaagctagcttaatttgccaaataaaagtttgcacaaaactattgcttgctaaaatcatactaaatcaaactatatatagtcaattattatccaaaaacactttttcccattctttaaaagaaaagggagaacaacagaatctatgagatctaaccatgtacaacacttttggggataaagtctctttacactaatcatgcatatcattgaatcaaaagcaatttaatattctggcgtcactgaagtagaatagagacgataagtgcataatacaattctttattacttgcaactaacttttatatacgtattaatttctgttttgtactaatacatttgaaaaataaaacctttacacacatagttgccattagaaataagctaatatcaaactttttgaacatttaagaactcgaagagaaacaatccaatctgtaaaatatttccaacaaatattccttggactgaaaatgtatactgctaactgtcaactgattttgttggcacaagagttgcttttctcatgaccggtttactgggcagatatcctgctgatcaagtactatgcacggccgtgtacattttacagagtgggcgtgactttctgcattgtacgtagtagcagaaaaaaacttactgctccacgaacggaactaccgaaatcaaagcaagatcagtagcttcattatttgtcctatcataaggacagcttaaaaccaacacgtttccgttgtgtgcaactttagttcgatgtaatagtactacttctgtcccatattacttgttttgacttttttacaatgtttgatcattcgttttatttaaaaaattagtacaaatataaaaaataataagtcaaacttaaagtacttttgataataaaacaagtcacaaataaaataaataataattctatttttttaataaaacgaatgatcaaacattaaaaaaaaactcaaagcgacaaataatatggaacggaggtagtagctgtttaatttgtggtccttcatccttgtgtgctaaggctaatacaccatgcatgcaactaacatcaaggacatgtatggtagtcctgtggtgaggagaattgcagttattttgcaatgttagatttttttgcttgttctaatctgccacctattattgattaataggtagtaggtatcttcactaattgtgcgtctctctgtcctagcttaggttcacaaaggtagatgggagtaggtgctatgacttatgaggagtaggttcaaggtttgtcttcccaactgagcatttgtaccaattgaactttgccaaatgatgcacctctatctctatggctaccgttattttactgggttttgctttcgggaaatattggagttggaaacaaaaccatataggtagttccaatgtctctgtgaaacatgacaaaaaaaatcgatagaagtcatcttttgtttatcttgatttcccaaatgctgatattttcccttcctatgtaaattgagacttggaactataaataagcacaacaatgaacctaatgtagaactttttagataatggattgaaaagcattattgttgttgaagtatactgtacaagtccaagctttggatgaaactagcttatacacttgtaacaaaatatggcatcagggttagaggtataccccgctcaattcctggccagtgaaatcaaataaaggaaagaaaaatctaggagttaattttcaaaactaggtgtagatattttaagcgataactggttttactaggaggataatgcatggatatactttcattttctcattaattctcggtgctaattaaaagtaacttcattgtgattcgattcctaggaagtcgtcataccaattttcaagcttcctcttagctacaaatgttataaaaccggctctgaaattcacaccggaaaacgtcataggagatccaaacatgatgatgacaccgaagcacgatatttggtaacggagttcagccgtagcctacatatcagggacactgaaacaaattcgttgtaagggtgcacctaagaaatttctagagcttggacgaaactttgggtaaatgtagtatcctttctgaacgcagctcctccctcttttccaccatgcatcagttatcccactcagatgcctagagtcactagtctttcggcctcatcttttagcttatgtttatgcttataagccaaaatttaaatttttaactttaaatttggagttgattttagggttttttttttcatcgtagtttattttcagcctttgcttttatatcgctaagaacacgtatataaaagttttatttataaatcattttccatttataaatatgttgtttctcttattccatcaataagcaaaacgatggagtactttagcctttaggtttaccatggtttggttatccggcctcaatcataaaaggaattaagaatacaatataccacacctgaaaacaatttaaatggaagggaagataacctaccacgctcgtgtgcgaatatattggcaacttggcatccatgcaccgatagaggatgaccgtttcaatgggagttttccactcccgcacaggcacccacctcgcaaccgaatcaatcagttgcacacgagcgacgagctagcgtagctgctaccagtttgcaagcatgcgaccatgcgttcgtgcccagcgttgcacgcaaggccagaggagaatctaatcgaccacgtcctaataatgcgatgcgataacatcataacagtattatcactaatctttcagctcactgagttgtacatatggtccactgctggtaacatgattgggaaccaccaaaagggaagcatcacaaacaaacttaatactgcaaagaatatgatatatattcgtattgatgattgatcggtcagcccatgaactgtccgtactcgtgcttaagctaccaattggtgcatttgttttaataaaaaagtatgtgcatgggttttgaatgttttgataccatgttgctgccaactaggctcttcccgagctataaataatcatggtaactaatcatggtgtttcccaaaggtagcagcaggagccaagaaggaggaaggaagaagaatggggctctcacctagaatgctatagaaaaaagagtccatgtcgactccatgatgtggattggaatcaaaactaatcgaagtttagtagttcacttattgttggagcgtgtcatgatcttgtgcctaggaatgttttttaatgtgccattgctttcgtctctctgctggcagtgcacctaattcttcgatggagattcggatattggagaaaaaccttcccacggttgcttcactgcactaccaagtgttgtactgttatcatttgttaattgccaggtagttatcccgcttggattttgaaaaaaaaaacagagaaggaaatgatttgtcggactaatttgtaaatattactcaaactataaatatttttgcaacattgattgagattgagatcctttaacttacccctctaacaaacctcagtgatctacaatgatagggagttagtcggagtaattgcttgtcattcatcggttggcactgagatgagctcatcagtgtaaagtggaacacaatgttagagttatattctagatggtttcttatgcggattcccttcgctttcctctcccggttgtgattctataagccggttcgagatggatacgatcggattcacgctgctatatgtactggcgttttcggtatgaatcgatattgttttctgtgtaattgtctcacatggtatcagattagtttcgattctcgcttccgctttctcgccacgatcatttcctttttcgacgcgtgcgccctctaacttcttcgccggttctcctcgcgacgccgcgatgtcgtctaatgcggagtcgccctcttccaaaactccgccgccttcaacgggttctcttccaccaacggccactgctcatcaagccgctgttgatgaaatctccaaagtcgcagctgaagccatccgggctgccttcatcaagccgtccacttctgtcgatattgaccctgtcaccgccagcaacgttgcggactctgcggcgcgcattgcttccgcccgcagtccgtctccgacttccatccctgctggatacacttatctcctccgcaccgatcgactcttctcctgcggccgactcggtttctggctctgcggctgccctgacctctactgtgccacccgccaccaccgaggtccctgcggcaccaaccctgccggcacctcttgatttggccgccctcctcgccaatgcacagctacaagccggctcggttgcttctcttcatggcatccctatagagcacggaccacgcctccctattggcatacctgtgacaggccatctcaccggcagtctacctactgttcctcaggctgcaccagtactagatgcagagacgactgcctctcttcactcccaggctgtctctgtcctaaatgtgaaggctctcgtccctattactctcgacattgccgcagcaaactattccaagtggcgtggcctcttcctcgtcacgctcggcaaatacgccctcaccgaccacgtcttctccaatgcgttctaccccaaccatgcgcattggcttcaaatggactgtgtcattttgggttggctatatggctctatctccgtcgatcttctggaaaccgtcatgacgccaaacgccaccgctcgccttgtatggctcgccctcgagaaccaatttctgggaaatcgggaatagcgtgcgctccacttgtcagctgagttccgcaacatcatccaaggtgatctcaatgtcaccgattattgccggcgcatcaaatccatggcggatcgtcttgctaatctcggtgaaccagtacaggatcgctcccttgtgctatgcttgctcaacggtctcaatgagaaatatgatcatctcaagactctcctaccgatgcaacgcccgttcccaacattcattgaagcccgctcgcaacttcttctagaggaactcaccaagtctcaccggctctccagctctccggccaccgccttcattgcctccacagcaagcggcggcaaccgttctgattacgggggactacttagttattcttgacgactgctcccattttgtctggacttttcctcttcgtctcaaatctgacacatttcccactttgttacgtttttttgcttatataaaaacacacttttccaccaccatccgttctatccaatgtgacaacggtcgtgaattcgacaactctgccgcacgtgatttcttcctccgcaatggcgtctccatacggatgtcatgccctcacacttctcctcaaaacggcaaagccgagcgcacgctccgttctctgaacaacattgttcgctctctactctttcaagccagtctccccgcctctttttgggttgaggccttgtacacagccactcaccttataaaccgccaccccactaaaactcttaaacatcacacacccttctttgcactctatggtacgcacccctcatatgatcatcttcgagtttttggttgcaagtgctatcctaacctctctgctactgccgccaacaagctttcccctcgttctaccttgtgtgtcttccgtagctatcctactgatcataaagggtaccggtgttttgatcctatttacaatagggtttacatttcacgtcatgtggtgtttgatgagcattcgtttccatttgccgaaaagccttttgttgatagctgtgctgctaatctcgattttttggaggatttttctttacaggaccagccggctgcacctccagggtttactaccaagattcaggataagtcagtacaaaacccatcaactggatccttttccacgactacactacctgcgccagctgttcctccgggatttcctgccagaacatcgcaacaaattattctccaagcgccacatcacgccaaaactagaaccaaaacagctccggcatctcctagatctcccacttctccctcaagcccaacctcggtcggcccatcctcactctatcagccatcgccaccatctagaccatcgccaacatatgggccactgccatcaacagggtcatcgccatcctccgggcccaactcgccctagccatcgccctccacttcggatcgctccagtctctgccttgggtgccactgccgcctgttgtttttcccacgcgcccacggagtgcccggttgcctggtgttcctgcgcctccctcaggccttggtgtgtctcctgttataaacacacatcaaatgactacttgaggtaaagatggaatattcaagcctaataatccctggaatttacatagtggttccctttctcctgtacctcggacctacagggctgctcttgctgatcccaactggcgcgctgctatggaagacgagtacactgctcttatggctaacaatacatgggaccttgtgccaccactaccaaatgccaatgtcgtcactggcaagtggatctttcgacacaagttccaatccgacggtactcttgacatgtacaaggcacgctgggttttgcgtggattcacacagcgtcctggcatcgactacgatgaaacattcagcccagtggtcaagcctgctactgtgcgtactgttctcagcattgctgtctctcgctcatggcccgtgcatcaactcgatgtgaagaatgcttttcttcatggcactcttcaagagacagtttactgcattcagcctcaacaaatcactttatggactcaaacaaacccctcgtgcttggtacaacaggttcgctatgtttttgctgtccattggtttcactgaagctaagtccgatacatctctctttgtctatcgtcacggttccgacactgtctatctcttgctatatgtggatgacattgttctaacagcttcttcatctaacattcttcgttggacaattacttcactacaaaaggagttttccatgaaggaccttggacctctcaatcattttctcggcatcaatgttactcctcattcaggtggcttgttactcactcaacgacaatactgtctagaaatcttggagcgtgcaggcatgtcagattgcaaaccttgtcttacacctgttgacacttcggccaagttctccactgaaggaagtccgtctgtctctgatccaacggatttccgtagtctcgctggtgctttgcaatatctgactttcaccagacctgacatttcatatgccgttcaacaagtttgcttgcatatgcacgatccccgtgagtcccatcttactgctctcaaacggattttacgttatattcgtggcactttggagtatggtttacatattcaacgatcatcgtcctttgatctcatggcatattctgatgcgaattgggctggttgtcccgacacacgtaaatctacctttggatatgctgtgtttcttggtgacaatctcatctcatggtcctctaagcgtcagaatactgtatctcgttctagtgctgaagcagaatatcgagcagttgccaatgcagtagcagaaacctcttggcttcgacaattactccatgaattatatgctccaccctccaaggcaaccttagtttactgtgacaacgtcagtgctgtatatctttcaacaaatccagttcagcatcaacgaacgaagcatgtcgagatcgatctccactttgttcatgaacgagttgatgtgggagcagttcgagttctacatgtaccaactacatcacaatacgctaacgtattcactaaaggcttgcctagtccagtttttaatgaatttcgatccagtcttaacgtccgttgttctgacgttgcgactgcgggggggtgttagagttatattctagatggtttcttatgctgattcccttcgctttcctctcccgattgtgattctataagccggttcgagatggatacgatcggattcacgctactatatgtactggcgttttcggtatgaatcgatattgctttctgtgtaattgtctcacacacaatgtgcctaattttcactccatattttgcatgatatattaccgatgtgctcctgcataagcaagcaaaatggcgaacacctcgaaaaaggagagggtttataaaatacatctccctgcaattatatccaccagcctaccacatgatattttgttatattagcagcaactgaaaaccaggtccctggtggcctggtcgtcacacaatttggagtacagctacaggcagcgagagagagagagagctccgggaggacggaggagccagaaatatccagagcaagtacacggttggcagggtggccatcctgtcctgtgcagagtcacacactctgccgcgagccacggggacggatcggcgtccgagcggaggagaggaaaacaaaccaaaccaaacgaaaccaaaccgggaggaggagcacgacgaggtgggttgtggccgctcgctgtttccacatgacacggcgcggctcgaggaatgtggatggcgctacctgcgtgcagcgcgcgggcgcgcgccggtagaggagacgacgcggggggccatctcatcctcaccatctctcatctctgctcggggacacgccatgtgacgaggtgtgcgcgcctcccggctagccctttgctccgacaattattggcggccgctgcatctgcatgagcggacacgcgccgtgtcgccgcccttgctgctgatgctaatccaataaatctctcccacggtgttttcacgggctatataggttggagtacgatctaaagtagtaagatggtgatgatgagcagcagttttggcctagctaggcgcctcggtcgcacatgtcaaacaggggtagtgcactctgatgagaacgaaatgggggaaaaaggcacggggtcttttctgcctggatcgagattccagtgctggtgccgaaagaaaggggagaaatcgtacaggcatcatgtgtggaaagggcggcggaatctggtaaagagtggacatgatgctgatgctgttctccgacaatgctaaaaggagtggagcttaagtatggttggcaaatcatggcgtgctttagctgccagcaagataattgttgcgacttgcgagaagtaagccgcaaattatggcataaacttgaaagcatatacacatggtctgagcactcaagagagtcacagctcaagtttttagtcaagtcgctcaaaatttcctcctcatccactgcaaaccaaaataaaagcagatggggaaagctggtacattagtcacgcacgacaacagcacacaagcaacagagcctaccagagcatcatatgatcagatctacccacttgcaatccagtaaaaaagaacagagaaactgacaaaccgatggagtaaagcattccttcctcgtgatcaagctgcgccaccgtggttaccatccgctgcattttctgaagcaaggtggcccaccgtaggataccgctctttaaacttatcttcccaatcttgcaagacctctagctcgtctggaccaaggccatccaaatctccagtgaggtcaatagggtcaaacgacatcaatgcaagggcccgagttgcatccctcccagcaaacaaggaatatggtccttgaggaccataaaagagcctgggagttaaaaaaaaaaaactgagaacacaatcatgaataatgaaaataaaactattgatgcatgatgacaagcaccagtaggatctaactgcatctcagagctgttgttcaagagcaaattataataagcatcagatagagctatgcttctgacaaaatacaagcatttcttttatgcacgatgtaatatattaggagatctcattttaaacctcatgtggacgtggaaattgagaagtatgtaagcacagaattgacagttgttgcagtatattgcgcaagtaccagtgcgtttatgactctaatccacaacatggcacttgtggaatatttgtacaaagggtccagaccttcaggtacatatacctaattctttggcagtacatggggatagtggatacccaactagaaaactacagtatgagctctagagtctagacagcatcaacaaataggaatatgcttgttgtctgttgaaatagcagactatctactcctaattgcaggctgcaggacaaacagttcactactaaacaacagttgcagataatgtgccaactagaatataccatttgctagacaaacatggactaaacaaggaaagaccacacatgataaattgggatcaatgagacagcaagaaaatatgtaacttaaggaatagtaaggtggtctggtggagacaaggctacaagcatccaagcataaaaaatatttttttacaagaaatcagaggagaaataaacaaagaaatagtacatcaaaataggtgtaagggagcataggaaaaatggtagagtgaaatacaacaaatgctaaatatggtagtgtatcgagccagctgtttcaaacaaatggtctagttattctctaatattaggcaacacatttaagcatctgtctggtgcacaaaagaaaacttaaagctcatcaaatcagtagagcaataaataggcaattaggcagtaagtaaaaaaaggagtttagctttagaacttagagaaatgatccaacaagacaagagtatcacaacccttttcatctaaagttcgacagtacccactaaatttcttttgctttcacattgaaaggttgtgtaacagtacaaggcatacatggatctgttatcccacattgtacgagcagttatattttgaattaggaagttccatgagacgaatgttaccaataccgatattttacacattaagcaggcagcactaagtaaaagcactaggaacaatcaaggaagctaggatggtgtcatagctaactaaagtggaccagaggtttgaggcttgtgcagacgatccaatatttacagagccacatatgtcccactacagcatttgttggttgcggatatgcagcaagtcatttgaaccaacgcccttggtggtagatataacttcaactctctagtctaagtttaatccaggataatcaaacgcacaacaacatccttacaataaccctagtgagaaccagcaaaaccatgccaagttgatgactgttgctcaaacttgcatagacaataggcaatttcctcgttactcgtgtagagttccctaaaccaatttaattgcaacaacagcttactaagctgataagacccatcgacctactacctcagggctcgcatgtctgaacaaatggaatgtcacaccaccagtttgataacctactcacaagcactctatggtccatgatttcacatacttggaagagctcgtagtttcttaccactttgaaacttgcttaatggctactatactaatgctgctgcctattcgtttcatctacttgttccagcttagatgtgtcttagcagtgtgaaatcagttcaacagcaatcctagtctgccgtaaaccatga

SEQ ID NO: 43609 - DNA, 3669 bp, Oryza sativa
  unsure (1)..(3669): unsure at all n locations
nnnnnnnnnnnnnnnnnnnnnnnnnnnnnnnnnnnnnnnnnnnnnnnnnnnnnnnnatcaattacccaattaaatctaacaatccccaccaaatttcaaggctcatgagaatgctctctattccatagcagcttttatataccagtgttttggtgaagactgttaagttgaactttcacctagaaaaggagctacacctgaccacaactgaacaatggactatgccttgaattggtagtcttgtgcagttaggtttcactcaattccataactgatactaggcaaccattagtattccctcgggttggagcttataagtcatactccaggcctttcatgagtatctagagatcacccaaatctcatagactgtgactagcagtcgaacttatataggtgtgttccttctaagatgttctgcaggtcaacatctctgcttaatgaaagtcactcggaacacgttgaggcataagccatccttccatacagaatagaagagaagtacatcatgaaaatgagcccatttaagggtctcttctctcggttacacaatagtttgtttcgccatccaaattcacgggatctccgatcacaatggacaggtttccactattgtgcaactctaagtgggtctcaagcccatttccctcgatgcactgtctatcacattacgtggtagccccttggtaaactgatctgccagatttttagctgtctggacatagtccagtgctatcactccggagtttttctgctttctgacatatttcagtcttttctttacatgcctagatgacttcatgttgtccttcgaactgttcaacttaataatcactgtttgattatcacagttcattaggatagctggcactggtttttttttcaaccaccggcaaatccatcaggagttcacgaagccactcggcctcaattgtggcagtatctagtgctgtgagttctgcttccattgttgacctcgttaagatggtctgcttgcaagacttccaggaaacagcgccacctccaagtgtgaacacatatccacttgtggcctttatctcatcagcatcagatatccagtttgagtcactatacccttccagtacttttgggtaaccagtatagtgaattccatagctcattgtaccctttagatagcgcatgaccctttccagagcttgccaatgatcatctcccggatttgaaacaaaccggctcagcttgctcacagcaaatgagatgtcaggcctcgttgcactagccaagtacatcaatgaaccaatgatttgggagtatctcaattgatcccttgctattcttcggtttttccttaatagcacactggagtcataaggagttggagctggcttgcagtcactataaccaaagcgactcaaaaccttgtccacatagtgagattgcacgagtgtaatcccaccctcatctcctctcagtagcttaatgttaagaataacatcagtcactcccaaatccttcatttcaaagcttttggacaaaaagtccttaacctcctcaatcacattgaggctggttccaaaaatcaatatgtcatcgacatataaacacaagatcactccctctcccccatcatagcgatagtacatacatttgtcagcttcgttctcaacaaagccagcagatgtaagtgttgtgtcaaacttctcatgccattgttaggtgcttgcttaaggccatataaggatttcaacagtttacacaccattccctcctgaccttctagtacatatccgtctggttgatccatatagatctcctcttctagctctccgtttaggacagctgtcttaacatccatctgatggacgagaaggccatgagaggctgccagagcaagtagtactcgaatcgtggtcaagcgggcaactggtgagtatgtgtcaaaaaaatcatcgccttcttttgggtataacccttggccacaagccttgccttatacttttcaattgtaccaccaggcctaagctttttcttgaaaacccatttgcattctacaggcttgcacccatatggacgctcaacgacttcccaagtaccattagacataattgagtccatctcactgcgtaccacttccttccaatagtcagcgtcagtagatgaatatgcctcttctatggttcttggagtgtcatccacaaggtatacaatgtagttatctccaaaagactttgcagtcctttctctcttactctttcgagttgctacaatgttatcctcctcaggattttcctcaggcgtttgatcattgtgttctatcggtgcaaagtgctcatggggtaaaacaggttcttgactagacgtgctaggtgtatttttcatgggaaattcattctcaaaaaatgtggcatctctggactcagtaattgtaccaacacgcatgtcgggtactccagagtttactattaggaacctatagcccacgctgtggatagcataaccaaggaacacacagtctacggtctttggtccaagtttacgctttttggctataggtacatttaccttggccaagcagccccatgtgcgtaggtatgagaaatttaatttcttcctttcccattcttcgaatggtattacttccttatgcttcactggaattttattcaggacatgacaagcagtcaaaattgcctcaccccaccattccttggaaagtcccgcagtatctaacatggcattcaccatctcagttagagtgcgattctttctttcggctaccccatttgattggggtgaatagggaggcgtcctctcatgaataattccaaactcttcgcaaaaggacgtaaactcattggaaaaatactctccacccctatctgacctcaaccgtttgattttcctttcaagttggttttctacctcagctttatagatcttaaagtaatgcaatgcctcatcctttgttttcaataggtacacatagcaatatctagtgcaatcatctatcagtgtcatgaaatatttctttccccctttagtcaacacactgttcatttcgcacagatcggaatgaactagttctagtggtgccaaatttctcgcctcagatgccttgtgaggtttgcgaggatgtttcgattgaacacaagtatggcacttggaacctttgaccaaagtgaattttggaattaaactcatgttagccaactacgtcatacaaccgaaattcacatgacaaagtcgcgaatgccatacattggactcatcattcttgctaatatggttcacaacattattattattattacacatgtcatccaaagaaaaacagaacagacctccgctgtcataaccttttccaataaaagtttcatatttagatacgacacatttattggattcaaacacaagtctaaaaccatctctacacaatagagagccgctaactagattcttctttattgaagggacatgctgcacgttctttcccgaagtaaacttcagatcgaccgtaccaacaccatgaacagccgcaagcgacccgtttcccatcaacaaggaggaacctctcccgacctgataaaaagaaaacagggaaatatcagaacacacatgaatattagcannnnnnnnnnnnnnnnnnnnnnnnnnnnnnnnnnnnnnnnnnnnnnnnnnnnnnnnnnn

SEQ ID NO: 43610 - DNA, 2959 bp, Oryza sativa
  unsure (1)..(2959): unsure at all n locations
taatatggttcccaacattattattattattacacatgtcatccaaagaaaacagaacagacctccgctgtcataaccttttccaataaaagtttcatattaagatacgacacatttattgatttcaaacacaagtctaaaaccatctctacacaatagagagccgctaactagattcttctttattgaagggacatgctgcacgttctttcccgaagtaaacttcagatcgaccgtaccaacaccatgaacagccgcaagcgacccgtttcccatcaacaaggaggaacctctcccgacctgataaaaagaaaacagggaaatatcagaacacacatgaatattagcaccagtatcaacccaccaatcaggtgaatgaaaaacagagagaactgtaggtaaaaaattaccataccccgatgttcctccgccctcgctaataaccatgttggcagacttcttgtccttgcgatcaggacaattcttcgcccaatgcccaggcttaccgcacacaaagcagtcgcccttggcctttcccttgcctttcttcttaaaattggttgtagcctttggtttgacatcaggcttgactttcttgttgttgttgttgtgggatgcatgagggttcttcttttgcaccaaattggcactagaacctccctcgatatttttgccccggttgtcctttactctcgccttctcctcaacacccaaagagccaatgagatcagtaacgctgaactcttgcctcttgtgttttagagaagtagcaaagtccgaccaagaaggtggcaatttggcaataatgccacccgccacaaacttgtccggcaactcacagttgttgttctcaaattcctttgccagcatctaaatctcatgagcctgttccactacagaacgatcatcgaccatcttgtagtcatagaactgctccatgacatacagctcgctgacggcgtcggaaactccgaacttggcctcaagtgcatcccacatgtccttccctgaaggcatgtgcatgtacacgtccactatattgtcagtgagtacactgatcaatgctccacggaacaggcaatccgaagcctcaaacttagcctcctccttaggagagagaggcggttcacttcgtttgccctgtgaaacatagaagcattgcatcgctgtcaaccacagtagtgcacgtgctttccatcttttataattagaaccatcaaaagcatgtggtttcagtgttgcagcaaagccaactaccgaaaatgacctatcaggtttttggattgttggaaatttggtcataattcggcatattttaatccaaaataacaagataataaacatgatatttacaatgggatttgatccagtgatagtggtgaatgtaatcaacatgagcatgcttaatgtagaataagcatcaacaatcacataataacacaatgttgacattgcgatgaacattaacagtaaaacttctaattgaaataatgtaagaaggttataccccaagaatggtcatccgctggagtttgaggcagtattgcctccgttggtgttgacgggagcctccttctccttgtatccagtgttgccattgtctccagtgttcgacatattggtgaaggtgaagtagatgttgatgaacagtgagtagtcgcgccttgcgctccccaaaaacctgatcgcccgcccgtccgtgcaaacgtcgcagcagcgcgtggtttcggaggcctactctcccaacgtgtgtgcacacacttgtcgggatgggattaccgtagcagcaacagcgttagaaaatggatgaaagtgtgtctcactattctcgtgggaaatcaaatccattctcattttataagaggaatggaagatgaagagtaagagtcatggaataggaagaagaatagagcaactaattgtcatcaactagccatgaaccatcctccactacaccaccatcaaccaacaatcaattaggagtaattgatgtaagttaccaatggaataggaagaggaatagagcaactaattgtcatcaactagccatcaaccatcctccactacacaaccatcaaccaacaatcaattaggactaattgatataagttaccaattccctaatcaaatggattaattctcaaaactcttcatcccattgatatcccataaaagaatgaatacacatgaattcctagcataatgagccttggaatttatttgatttaattgatttaaatggatcaattacccaattaaatctaacactctccactattgctgctgcttccacaccttgctgtgcttgcggctcgtgtagagcgacacgacgatagcgcaacgacggccacaacgacgaagagagacgtggtctagtctcctccttctcccgccaatcgcctcctcctcccactaggctcgctggaactccacctcgtggctagcatcgggcggcagctgaatggcggcaacggctcctgacgccgcctccccctccctctcccgcgtatgcctctctccccttgtcccgttgggcgcctccccttacctcccaagcttcggaagaaaagagcagaaagaaaaggatgctgacacgcgagcctcacattttttcttctcattgacatgtgggtcccataattttttttatttttctttgctgactaggatgctatgtcagcgaaaccaaagatctatactacatccggaccttttttgcacggtttgtataggggtggagatttctggtattagagatcagagactttagatagactctataggccgagatagaactatataagatgccgcatttatgcccaccatataagttatgtattttgtggcctaaataggcccatcatagctcaaaccgtaacaaagaacaccagatcatcgatnnnnnnnnnnnnnnnnnnnnnnnnnnnnnnnnnnnnnnnnnnnnnnnnnnnnnnnnnnn

SEQ ID NO: 43611 - DNA, 4830 bp, Oryza sativa
  unsure (1)..(4830): unsure at all n locations
gaggaagaagtgaatgagagtgaggatgatatgtgggtcccacaatactttttttttgtgtgaatgacaaatggatcccacattttttttattctaatgccacgtaagcgccatgtaggacaaagacttagtcaagaccgtcacgtaggcgccgcgtcagccaaaaccaccgagggatattgtttacaccggttttaatagttgaaggagttgatatacctggttttatgtttggaggatatgaatcgtactcggacgatagttaagggagcaagtatactttttcctcgcggaaatatcggatactagccgaacgttttgcgtgccgggtgtcggagatgaaaactccgaccccaaaacgctaacgtggtctcactgttcgagcgagatcagcgccgtggatgcccgtatatgctcttcgtttttttgcgattaccccgtatgctctttcgattatcttgcatatcgtgcccttcgtacgaagagagaggccattagttcatcatcaatcatgcatcagatagagctacggtgattaagtttcttttcccttgcgaatgtagtactaccaagtcacgctctgagttttttcccctccaacggcttgatcagcctacagtgcaagtaacgaaagagcagataaaacaatcatgaactgaaatgttacagggtatacggttgtacatttaggactgtagttggtcagacaaggaagaacacagggaggagatcaggacacagggaagaaaggatcagatatttgcagcgtttgttatatagttatcgttggttaggacaactttcttcgcatagtgttttgtcattcgatgagaaattacagttttacagcgttccagataatctgccttggaacaaggttcagtatacccttcgtatatagaaatcatcaaaccaaagttcctgttgcacacggtactagcaccggcattgcacggagcagtatttttggttgcatctgctactgctagttctttcagtatccgagtagttacttctctcctctcatagtctcattagacgagggaaacgtgatttacacatactcacaaacacatgaaaaataaaaatgattgacgacgttggatctagcatcacatgaaaaataaaaaaaatattttttctttgatgggaattctatacgattagcatgcaaacagccaaacagtaacttacacattgttagggcctctttgatttgaagaaaaaacatagaatttttagaggatttgaaccatatagaaaaatttcctatgaaaccctttaaaataaaagattgaatcctatcatatcctttaaaattcctatggaatggacaatcctataggaattttgaaggaaatttagcaagagctccaacctcttgaaaacattcctttgagtctatctctctcatccgattcctgcgtttttcctgcggttcaatcaaacggtcattactgtgttttttctgcgttttgcaatcctctgttttgcatttatatttctgtcagaatcctacgtttttcctattcctccattttttcattcctaatattcaaatgacccttaattcacccggcaatcaatcggattagaaaaaaaacaagcaaaataaagagaaccgtcatagagcagtccgcaacgccgcaatgctcgcccgtacgccgctccgcctgcccatgccgctacacgccgctgcgcctgcccatgccgctccatcgccccaaccgcacgcccgccgtatgacgagtcggatccggcggtgccgagctcgtagccgctggatccggcgttttgcgagggccaaagagcagcgagagagagagttggaaggcggtggtcgtcggtgaggaagagtagcggcgaccggcgtggaaagtggaggcggcggccgacgacgagaagaggagtggaggcaatccatccctcatccccaagccctcccttcaggccggaccttcgtccccatcgtcccggtgatgtgaagggaggggaaagcagcaaccgtcgttgcgcaacggcggcgacgacggcgacgacgctcgtgaggcaccgaccgagcgagcaaatgaggagtgggaaggtgacgggatgctcgaccccctctcgtcacgctgcacccactggagggcgcgggtgcgagccaggttcggtgcaggtaacgtaacccaaacacgcccttatccgcgcgcctcatcgcctcgccaagacgccaaccaaacacacaccccttatccgcgccccgcccgcccaggaaatcccgcgcggccaatcacagcacgcccgcccgtgatcgcgagatccgacgccccacccgtgatcgcgatcccactcccctccacccgcgcgggtacccccccacgtcgcctactcgcctcgtctccccgtcatcgccaacgtgtcgcggctttccgccaccaaatcgatacggaacccggcgcgcatccggtcctctcgtcgaggcgagaggaacctatacattcgccacactcccctgcttcgcttgcttgccctcctcttgcgtagggaaaaggaagaacacaagagcaagcgagagcccagaaatcctatcctcgactggaggtttttgtgtattgtatagtggtagatttttttactgacttgggagttgtgtgatagtgtgggttgcgttctttttttagtgtgtaaacgatgtcgtctttagtgtcgacgccgttcacgacggcaaccggggtgcagaagaagctgggggcgcccgtgccgctccactcgttcttgctgagccggcggcagccagcggcgggcgcggggaggggacgcgcggcggcggcggcgatacggtgcgcggtggccgggaacgggctgttcacgcagaccaagccggaggtgcggcgcgtggtgccgcccgagggcgacgcgtcgcggcgcggggtgccgcgggtgaaggtggtgtacgtcgtgctggaggcgcagtaccagtcgtcggtgacggcggcggtgcgggagctcaacgccgacccgcgccgcgcggcggggttcgaggtggtgggctacctcgtggaggagctccgggacgaggagacgtacaagaccttctgcgccgacctcgccgacgccaatgtgttcatcggctcgctcatcttcgtggaggagctcgcgctcaaggtgaaggatgccgtcgagaaggagcgcgaccggatggacgccgtgctcgtcttcccgtcgatgccggaggtcatgcgcctcaacaagctcggctccttcagcatgtcccagctcggccagtccaagagcccattcttccagctcttcaagcgcaagaagaactccggtggcttcgccgatagcatgctcaagctggtgcgcacgctgcccaaggtgctcaagtacttgccctccgacaaggcgcaggacgcccggctgtacatcctcagcctccagttctggctcggaggctcgccggacaacctccagaatttcctcaagatgatcgccgtctcctacgtgccggcgctcaagggcgccgacatcaagtacgacgaccccgtcctcttcctcgacgctggtatctggcacccgctggcgcccaccatgtacgacgacgtcaaggagtacctcaactggtacggcacccgccgcgacaccaacgacaagctcaaggaccccaacgcgccggtgatcggcctcgttttgcagaggagccacattgtcaccggagacgacggtcactacgtcgccgtgatcatggagctggaggccaagggtgccaaggtcataccgatcttcgccggcgggctggacttctcgggacccacgcagcggtacctcgtcgacccgatcaccggaaagccgttcgtgaacgcggtggtgtcgctcaccgggttcgcgctcgtcggagggccagcgaggcaggaccatcccaaggcgatcgccgcgctgcagaagctcgacgtgccgtacatcgtggcactgccgctcgtgttccagacgacagaggagtggctgaacagcacattgggcctgcacccgattcaggtggcgctgcaggttgcgctcccggagcttgacggtggcatggagcccattgtgttcgccggccgtgaccccagaacaggcaaggacatttccagattccttttggtctcactcacctacttcgcaggtaatcctgtacttgtagctgagcctgaaactgttttttcctctgtttgatgcagggaagtcacatgcgttgcacaagagggtggagcagctctgcactagagcaatcagatgggcagagctgaagaggaaaactaaggtacgcaattccacacagttcctgtataaattgtagtacccgtatagaattgcattgtttctgcctgagagcaaaggcaaccacaaacgtcacatctggatagttctgaattcactttcatatcttcttgaggtttttgagggatttaagattgcatgctaaacaaacatattagcttaacaacttcactgtcatgctcaaaactggtattgcacatgcgccattcatcccatgaagagctcttgtacatttgatgccgcaatcctgatgtgaaaattccagtaatgcataccatcacatgatattaagttcaatgaaaagccacgtgttatgcaatcattagctgccaactgaaagttatccttcaaatgaaacaatacatcatgtgagaacaaaaggctcaatacttaaggtgcataaagtatgttcaactgagaactagaactactcgtataatcgatcaatcaactcttccatcctctgaagaactcatgtacataacggtgccannnnnnnnnnnnnnnnnnnnnnnnnnnnnnnnnnnnnnn

SEQ ID NO: 43612 - DNA, 1339 bp, Oryza sativa
ggtcgtcgttgccgtagccgaaggcgaaggaagcagcaggcagcgccagcaccggtgccagccggaagcagctgctcgcccccctcagcggcatcgaaggcaagacgacggcatggccaagatggtgtcgtggaacaggcgatcctcacggcagggatgtagcagcgatgacgaggctagtggcgccttggcggcggcggcggaggagattctgtggaggaaatgtcggccgctccagttccctggccgcatcacctatggctcttatggcaaccagctgcaaggcttgccggccacctctccccctctccgcttgcccgcccgctcgaccgggctcgtcgcttgcctcttccccatctgttgccggtagctctgttccctccttttgtcacgaggcgctcagggtggcggcgacggagcctctcaaaacggcgaaggtcttgcgtgctcaccggccggctctccctcatcgccgacgccctcccaaggagggtagagtagagtagagtgagaagagaaaagaaaagaaaagaatagaagaaagaaaagaaaagagaaaatataagatagaagagatttggggtccacatttttttctttacatgtgggtttcataatttttcatatcatttttctgttgactaggagccacgctagcgaaaccagagatctatactgtctcaggatcttttgtgcacggttttgtagtttaggggtggagatttctgatattgtggactagggacctcagacagacttgacataaagtcgagggatgttaggtgaagttattccttatggagttgggcttcggccgtcccgacatctgaattcgtacaaggatcctagcagcaggagaaatctacaccaaacattgttctggcttcaacggacaagatgcatgatcctatccgtagttcctgaccataatagagcacacgtccttggaattccaatttcgagatccgagtctccgagacaagaacattgcagcagcagaacacgcgagaaaattaagcaaagcgtcgctagtggcacgtgtccgcttaccacgcattcgcacgctcccgggcgacgtacgtgtcactagccccagcctactcacccgaggcacacgtgtccacctcaccggggcacgtgtcgcgccgtcccctctcgctccgccttatatagccgcttctgccatcgccggtgccgagctcactcgtgcactgcgaagctacacttaccactgcaaccactgatcacagagctagaggttcacttaggcgaagcttaattacacagagcgcccatggcgtccgggcaggacaggagggaggcgcgggccgaggccgac

SEQ ID NO: 43613 - DNA, 6151 bp, Oryza sativa
cctcccagacggcggacgccacccgggacaagctcggcgagtacaaggactacaccgccgacaaggcccgcgagaccaacgacagcgtcgcgcggaagacgaacgagacggcggacgcctcccgtgacaagctcggcgagtacaaggactacaccgccgacaagacccgggagaccaaggacgccgtggcgcaaaaggcgagcgacgcctccgaggcgaccaagaacaagctgggcgagtacaaggacgcgctggccaggaagacgcgcgacgccaaggacaccaccgcgcagaaggcgacggagttcaaggacggcgtgaaggcgacggcgcaggagacgagggacgccaccgccgacacggcgaggaaggccaaggacgccaccaaggacaccacccagaccgccgccgacaaggccagggagacggccgccacccacgacgacgccaccgacaagtaaactcgccggaacaccatccgcaagcacgtagtgctcctagctatcgataataatgtccacattttttttgttgatgatgcagggggcaagggcagggcctgctcggggcgctggggaacgtgacgggggcgatcaaggagaagctgacggtgagcccggcggcgacgcaggagcatctgggcggcggcgaggagcgcgcggtgaaggagcgcgcggcggaaaaggcggcgtcggtgtacttcgaggagaaggaccggctgacgagggagcgcgcggcggagcgggtggacaagtgcgtggagaagtgcgtcgaggggtgccccgacgccacctgcgcccaccgccacggcaagatgtgatcccccatgagcgcggtggacgactaataaaaaaaactcccagcatgttaacctttgtgtttcaagtttcactagctgcttttattttgctttcgttaagtttccactaccgtgtatgttccttctggtaatctaagtgcagtggtgctgaaatctttataaagcccttcagtttaccgcttaccacttttgcttcaaatgtctcgtgtggtttagtgtgcatgttcgttcttttctctggttctggatttgggatattatcgtgggcacgtttccaaatctctatatatgagcctcccagaatgcttttctaaagtaaattttcgaatgctagataatcctgaaaatctcatgagaatctttttttggcgagggagtgctcgtttaagttcgccaatcgccaccgatcggcgcggctcgtagagaacggatagagaagtcgtgggctcttggacttgtggtggtgaactgtcgtctggtgatgcatcctctgccgcacaaaccaacgtgaaaataagacaatcgctgatggcctgatgcccccgagtgaaacgtgattgagctcagcatctctctcaattcgtccatccgaatcgatgctgctgctgccggcataatgcgaaggagcgagatagccagtttagccacgcaccagaataccagacggttcgaagtgagaaaatccgagcaaagtaggactcacatccgtttccgtttacgtttataatgttcccattggatattataagtcatttgatttgattttttttctcggttagtttgatcaaatttataaaacaatatacttatattttttttataaaaacaaacatattatcaaaataatatatttaatattaaatttaatgaaactatctctactattataaaaattaaaaatgtttttgccaatggctcggtaagtcttcgtgtcccgaatctgcctcgcacataatcactatcagtttaactatttatgtgtctctaatccgtatctgattttcctttttccatcgtgtggtcagtccctaacggacttagactcatacacggagccgctctcctcatccgtttccaggcataggggtgtaactacgcatccgtctggaccacctgatccaaacaccctatcacacgagcagcctacctaactaatggcacccgtaatggcacccgtaatagttatctataaactatctacaagagatctatgtcagtatattttcctacttggaagagattaaatggagagaaagagcagagctatctactaacttagagatagtctatagagaaaaacgagacaatgtattagagagctatagatacccatatagacatactattgaagtggtttactattaatctagtctattgttgagatgtacatgttttatagatagcacattactttaccattgtggatgctctaaggctgtgttcttatcttcaagttttcaacccctctctctcattttccgcactaaacggcgtgtttttttaaaaaaagtttctatatgaaagttgcttaaaaaatcaaattaatccatttttgaaaaaatagctaatacttaattaattatgtaataacgcgtgctttgttttgcgtgcccgggagaaggggttcccgaacgcagcctaagcaggcctgatgaacatacataattttaccatctcatatttttctttgcaaagcccccatttctttgtcagctagccttccttgccaactttgcacatgtatatagagtcaacattcacatatctatctctaccattacaaaaattgaaaatgcttttaccagtatttcggtacgtcatccatgtatgagttggttttttaagttcgtttgattttgaaattacacatctgtatttgagtcgggttttaaatttgtacgcttttagaaatacggaaggagctgtataagatatctctttaaaaaaactcgcatgctaacttgagatgattgaactcctgattgtagctcatgattttctagaaagaaatatatccaagcgaattccaatagtgaatttcaccttaactaaactgtataataacaataataagattaaaataattgtcacccgttgcaacacacgggtattttttaaaaaatatatataaagatgaacatgttatcaaaataatatattaaatttggtgtagaagatgttactaattttcctataagcaatgctaaaaagtaactttgattaaaaagaaagttaaacgatttataatatggaacgaagggtgtagcatttaaaaaagaaaaaaaaaacaactttgattcgggacaatgcacaaacagtagtacatactacatagtgtgatcaacttgatgcttattattgccttgaaaggcgagtcataagttacagaaaatgaacactatgtacacaggcctgaatttttctcttgaacaaggaaaagataaatatgcactcagatggtcagacaacaaaaggccccgccaacataaatcagttgcagatccggataacttttttcacttgaatgccacatacagtcccttacttatttggattatttgtccagcattgtgtaagacggcaggtcattcacctccaatacatcctctagtactagttcacgctccaactgagttcttgtagatttcaatacctcctggcaccacgaaaacgaacagataagcatgccattgattaaaacatacacacagtaactgcataatatgcacctactcgggcttacattgaactccatgtaagaagcacgtttcacaagccactgagcatcgagaagccgaaaggctatgcagtagaggtgatcaaatgcattctcatctcgtccaagcagttcaacaaaacgaactcctgactttgaagatggaacacctgcacagttcgaagagcgttaaaccaggggaatgggaaccacaccaaccattatagtgtaaagacgatttttggaaactgagatattacttgactgtagatccagcatttggatcagcataaatgaaatgttgatcccagcaaccgcaaaagggtactcccagtctgctctctgcccttgtactttgttcagaagcgcctgaaaggaaccctgtaccagaataggtgagtaattatacaaaaacaaacagcattaacaaatcttctcagaatatcatatagaaggtatttacaggatagttcctagcgaaaaatatgaggttctccaatgatatgaatcctccacccctgcgtggacaatatcagcattagatggctttgtaactgaattcgactggagcagaaaatggaataaatggaatacctgaagtcagttgatggatcagtgccttgccaacccatctccttccatagttctgatttcagtggaggaatgtcacggttggggtatgctaacctccaaagttgtctcaaagcatcctaatagcaacaatgcaaaattacttgcttgaataagagggtcacttgtggccacattatagccaggcctaagctattgaaataggtttacatacttggtgttcaacacgggagccatcgaaagggatttgcaatctagaccttaaagtattcagtctatcttcctgaaagaaaattgtatacattaaggttcagaattacatcaattcctgtgtgtctattataccttttctcaatacattacctgcaaaggactaagatacactggactgctgttctggttgtccaacgaaaagggaaacaatctaccaaatagtgatccagagccaacaataatatttgctgcacgtagaacagcaaaggggaatcagtatcttattcttgaaagcactaagggttacatctgtgaaatagttgcaacacggcacaacaataccacttgtagtgaatcagagaaaaaaaattaaggcatgggtttacagaatggaaaaaatactacttccactgctacgatttcttatgcaagtgaacattgctacatcaacaatttatttgcatgatttcaaaaaatgaaacagggtcaatgatatgacacggacatccaaattagcaaacttacttcacaacagttattctgtttagtcaagtttactaacccacaagaatgtttttgcagttcttatgaaaatgatgacatcagcaaatgaagataaggtactaaaggctccataagagaactaagacatgatgacagctgcatccattattcttgaattcgtgctaaagcagcaagccagcaattatataaagtatggcatgggcagacacaaaaacagaactatacctgtgtgcattagatcagcccgacaacctgactaccattctaccaatggttactcatcaccaatttttttttaaaaaaataatgcttgtatgagacaaaatcataaacatactgtgtatgagaaatataggcacattaacctagaatatcaactctgaaagatggtgtcaatgggtagcttactgaggttataatcagtaaggattatctgtaactcattacatgtgctccaaaattagaaaaccaggaaacagaaatgaacaatgacaggattggcagccaactagtgtcaagtgggacaaaacttattcaaagttgcaaattgcaagtgaacagtacctaaccattgtgcccattgcgcaatcaaatttgagaaaagaaatgaccagtgtagctgttccttctttctatcatcatcccataagtcttgccttctgggatcatataccttcagatggcggaaaattctgtcaataccttagaaaaggatatactacagttgtgttcgtccgaaaaggtagtagcaatggtaaataaaactatgataagaaaggcctgacctctgatccaccagtatcagagctagatttccctagtaaaggttcattaagggaatctacgctggatatgtcaacatgctcattcttccttccatcgacatctccatgatggagtcgcctccttagattggtcattgacatgaagtacttgtaatctaaacaaacaaaacggcacacaaacaaaaacgtagaagaatcgtcaatgtaataacaagtgaactattgtgtgttatctaacaaaacaaacatctcacaaatggaagacagtgttatgaatgttctactattaatcacattatatattcatgtctcatgtgtaagccaccaaccagaagcctcataggctcacagcaagtaatttagattgccaattttatcctcctgcagagaactagacaaccacagattctcttcgaggtgaacagtccatccaatttcgatctaccactctacagaacctttgcaaactccaatttttcagaagtttccatatgccccccc

SEQ ID NO: 43614 - DNA, 6483 bp, Oryza sativa
ctccgcaagacctaagacataaacccggggctcaccagtacaaaatcaactactttcccaattcccaaccacggccaccaaagtctcctcccgctcccggaatgcggcaaccccgacaggttcctccccccgaaacttcaaaaccctaccccgcctaccacgattcgatgatcccgccagagcgagcgcagaaatcccgctcgatcggcgcccaaattggagccagaaaaaaaaaagcaaagaggggaacgctcgcacgtcacgtaccctggggtccttccgggatcaggaggatgaggaggaagacgaggagaggaagctccccaccctggctcaggctgcctttggcctgggctgtggggattcggaggaggcgactcgaggaagctttaaaccgaggagaaagagagcgagagatggagagaggctacgggaacgggagagaagaaaccttcggtccaaaggcaaatgtggagtacgactacgagtgtatgactgactcggttcggctgcttgctgtcacgcggacgcggcgcacgacacgttagcaaactttcgtgggctgtgccgtgaccgtgaagacgaaagcccacgaagaaattcgcccccccacaagcgaagtgtatccaggccgcccggccctagcctcgtcgcagctctccgcaggcggcagggatcgcctcccgcccgacccggcgcggcggtgatgatgtggcgggcgggtggcgcgtcggggtcgtcgtcatcgagaggcacttcctcgtggatttgtatcaggtgcagttggtactatcactataacttacgcagtccactgccacatgttagatccgaatctaacggttcacatgcacccggatactgtagaacactgtagcaagaaatgttcagtattttttgcgtcagtactgtagctgaagatctggtccattcatcaccaaaatgaacggttgtaatcgcatgcattagtttaacttgcagtcgctattcctactgcaagtgatcccaatcccttcctcgtccgcaaccgctgctcaagatgacaaagatgtgttgaccaagacgagaaaaatgtttttctatgaacaacacattcttgcatttagagaaaaatgttttatctctaaataaaaaatgttttgaataactaaaataatgaaagatagtggaatcaaagattaaaacatttttgtttcacacatggaacataaagtttacaccgtttgaacatcgacagattctcaaagaatagatgataaaaatgtaaaacaccattaaaatacacattgcaatatttcaatttaactcaaataaacattaagataaaatagactgaaatatcaaaaatcacaaaatttacaggtatagatttggcttatttctcttctccggtggccaaatctagacccacgtcggaatggttaagcgatgtggtgtgcgggcgtccaacgcgaagagtttttgatataatacgggcctgtttaggtcttctggcaaaattttacaccatgtcagatcgaatgtttggacatatgcatggtgtattaaatataaacgaaaaaataactaattacacaaattacgagacgaatcttttaagtctaaatgcgccatgatttgacaatgtggtgctacagtaaatatttgctaatgatggattaattaggcttaataaattcgtctcgcggtttacagacggattctgtaatttgttttgttattagactatgtttaatgctttcaaatatgtgtctgtatatccgatgtgacacgccaaaaatttacacccctgatataaacacaccctacttcagtacttgtatatattaggcatgagtaggccgtactatgtactcacatttgttttccatcaccatttgactcacaaaacatcatcactcatgcatctttacctcccattacaaaaggacgatgtactggagatctggaatgcaattaataatattatataaaaatcactccccgtaccgtaataagttttctttttagtttctttcatttgtaccaaagtaagttcatttataaagtagtcattgcatgaagtttgtgaaactagaaaataattgtattgggagtattgataggccatgtttagttccctaaaacttttcccgaaaacatcacatcaaatctttggacacatgtatggagtattaaatatagatacattaaaaaactaattgcacagttagggaggaaaatcgcgagacgaatcttttgagcctaattagtccatggttagccataagtgctacagtaacccacatgtactaatgacggattaattaggctctaaagattcgtcttgcggtttccaggcgagttatgaaattagttttttcattcgtgtccgaaaaccccttctgacatctggtcaaacgtccgacgcgacacccaaaaattttcttttcgcgaactaaacaggccctgatatttttataaagtaggtatattctatttatgtttgtttgtattgttacatgggttagatgaaaaataaacttattttgagatgggcggattatgtatagagtaaggccaagttcaaacacacatgaacaagaaaaattgcaataattggagtagtatgtttttcaattctacaggaattgaaaaacacatgaaacaaaagatgacctttttgattaaaccataggaaaagctgaaccaataaagtttccaagaggtttaatctcttgcttattttcctttggaattggcactatgaacacaatttctatggaaagtttcatatcttcttcatgtgaatcagaggggtttattgggaaaaaaatacaagggaaatgaatcctccaaaaatcttttgccaatccttcctctaggatttgtttcctatagattattttttttgatacaaaaattttcatatgattgtaatctgctgacctgttccatgggaaaataagcaagaagttagacttcttggaaactttgtttgatttattttttcgtgtgatgcaatcaaacagcatctttcctgttttttgtgttcttcaattctggtagaattgaagaaacacaacaattaagtctctacatttttttttcttcttatatttttcttatcatgtgttttaaagggtccttacatttaccatgcatgtcaatgccttttcaaatactatcggagtatcgaactatataatttaatgtgctaaaaagaagccattcttgcgactgaggtagaaatttccaccgtcatatcatattgtcacttgcgaaaaggattcctgctaatagaaaaaaagataagaaaaaaaaaaggaggattcctgcttggtgagtgcgcatagtacgaacgttggaacttgaagtctccaccaccttgctcttttatttttgcatcccagctgcttatcatcatctagtagtatcattctactatcaaggtctccaataaggagttcatgtagcccccaaaagattaagcatattattagccacttgcagtataatgtccccagaaaatcatttacaagtacagtctcttcgctccgttcatagtctttgccccttttggaataaagggcagtgtgtggaactagctagcttatgcacacagcaacaagtactggtgctaaacgattagtggaaccgatccttttttagtgacacaattttgtagtaatatcagccgttagtgcacaactgcacatcaatgatgcattcatggaactgagtagcttggacgtacaattatcatcatctttaaatggtgcagttctttctgaaccttccattgtgacaactgtcatttgagttgatcgagcagctaatccacgcattagagagctgtggggtcattcggccggccgcttagtttgtattgtagttttacagggttttgtcttatatcagctaatcctgcaatgttaagtttgatagtaacctgcattcatcactcgagtggacgaagaagaaatcggcacagtaagttgtcgacgggtttgtacatcacatgaacttgtccctctaataatattggtggacgcaggattttgagagtgtgggtattcaagatttacactatgaaattgaaacaataaacgcttgtgttactaacggaaatatgtgtgttttttttaattaggtagataataaagtacagaaaaatatagtagaagatgaattatcttgttagcttaccatgattttaagacatgatagatgtatttttcaaaaaaaaattgtcttgcaaaagaaaaaggaaaataggagaaaacaatcactgtaaaaaaaagcaaggcgttgctgagaatctaagggcctgtttagggagttttaaattctgagaagcagctgtttaatagccagcttctgagaatctagaaaaactctgaaacccagcttctggcttcttatttcatttttcaaaatctgtaactatagattctcagaaactatggactgtttagggtagcttctaacataagcagtttttgggaaaagctgcagctagaacaagcttcccaaacaggaactaaggcttcaccactagctaagattcacgggttaactaaccgggcaacaacaactacaagttcagcaagtcagtagtatagctaaacttttaagaaatatatgtgggtattcacttgaatacctatgattaggatgtactccctccgtcccataaaaaaccaatctagaactggatgtgatacatcctagtactacgaatctaaacatatctctatccagatttgttgtaatagaatatgtcacatcctggtttagatttattttttgtgggacagaagaagtaggcctatgctctctgacgcatggggccatactgtaggggtggacatctcacctgttagggacttatatctctctgattatatgtcgaggagttgcttcaagttgtttggtttgaggtttgaacgttaatccattggctatcatcgaaagtaaagtaatacctctgtctaaaatataataacttttaacacctagaatttgtctcaaaatataacaatttcttcatcaacattcatttctcaaccaatcacaaccctccaccattcacttttcttacctaccttcacttctcaaccaatcacaaccccttcctatttaattcttcctacttttataataatcgtgtccaactctaaaactctttatattctgggacggagggagtagcaattattatcatacataaaaagatgtaattgggatgaagcatatggtttctcggcacaaacaaaactaaggggtgtttagattaggggtgtaaagttttggcgtgtcacatcgggtattatataaggtgtcacatgggatgttcagacactaataaaaaaactaattatagaatccgtcagtaaatagcgagacaaatttattaaatctaattaatccatcattagcaaatgtgtactgtagcaccacattgtctaatcatggagcaattaggcttaaaatattcgtctcgcaaattagttataatctgtacaattagttatttttagcctatatttaatactttatgcaaatatttaaacgttcgatatgacagggtgtaaaatttttgggtgggaactaaacatggcctagcaatctgaattttgcgtccgcctcatgcgcctcggtaaaaaaaagtattgtcatcctctacgatgttattgctagtagtaaatagtaatatatatttttttataccgcactaggtatgattggtttttttttgggtagtatacatatttggagtggaagaagtaggctattagagaatacgaatccaatgataagattatttaagttcactattggcttttttgttttcaaaagccatgtcgtaaggacaaaaagaaaaacttttactgataaattattatctgcctagttttgatgatttatcaaactgttatcatgaccactatgtgcaaatgtactatgcatgtaaaccatttcatacccattgtttcgctcgcctatagctgattatccctaaatcttattaacaacaatagtaatttatggataaaacttttaaatatgtgttttttgacttgtaagtagatattggaaaacaaattatactgaacaaactattaagataattgaagttttaatattgaaaattttgactacggctgataagttgatgatctaatttgcacacaaccatattagccgctagtgtgtccctttaacaaacacacgataaatgtggcgaacaataaatttgtcaacctccctaaatccaattgaaaactaaattctggcaacctagcaaaatgcgtgttagtgattgatgtactccctccgtcccataatataagggattttgagtttttgcttgtaacgtttgaccactcgtcttattcaaaattttttgaaattattattgtcggtgacatggggccgggggtatcgtgactagaggcttgggtagccgcggtcacccacgtggcctgaccccctcggggg

SEQ ID NO: 43615 - DNA, 12551 bp, Oryza sativa
gaagtcgctggccattaaatgaaggttgaaatgggcgtccaccgggaaagcgggcgagcggggcaggaggcgtgtgctctgcttgtcagaggtcacttccggctgtagacgagccctcattgtaaaaagcatgtttcccttcttaggcagagagaggcccatgtggtgacccctgatcagataaaaaggaggaaggggggttgggactctggggaatgggttctagagcctgaactctctcccgctctccgctctctgtattccttcacgcacagatccaccagaacacaggagtagggtgttacgcttctcagcggcccgaacctgtctacgtcgcccgtgtcttgtgcatttcctctcccgctgacgttcctcagatcgagggcgaagaacctcacttagcgcccccggccgaaccggcaaaggggggcctgcgcggtctcccggtgaggagccccacgctccgtcaattatttattttatttgtgacttactttactttattatctacggtactttaagcacaactttttattttttatatttgcaaaaaaaaatgaataagacgactggtcaaacgttacaaagaaaaactaaaaatctcttatatcgtgggacagattgagtaatagattggcacgggtacaaccaatacgtcacagtaccagctaagcagtagtactagtaattttgtgctggcgcaatttctggttgagactggttgttagtacttgtttgctatcaatatcatcatcggacgcacagaatacttgattaccacagagacggtagcagtgaggatggaggttagtctccgggctgccgatattttaacctcgctttctcgcggtaatgacaaggtgacaaccacccccaaaattgaccgcaggctgggataatattttccgaggagaaagattgcaaccaccatgcctatggggtatattttttttatcttcctcaattctccgactccaaacatcgataatacacttgggtcctctcatcctatcaatgtttcgctgcacgtactggcgtactgctgcaaccccactcctgttctcttttctgagcgatgaacagtgtgctgcagctgaggctttaaaatcttttcatgtttattctgaacatacaccggctacatagtgaaagcaaagtcataacatatattcgtattggatagtactacttcatccgtttcacaatataaatataagttattctagcatttttcacattcatattgatgttaatgaatctagatagatatatatgtctaaattcattaacatcaatattaatatagaaaatactatattttttatattcatattgatcattaacatcaatatgaatatgaaaaatgctaaaatgacttatattgtgaaagggaggcagtagtacaggcagccactcgtattagattcggaactgaagacacacctaggacctgaatcttctgtggcaacccgttgtgcatcaaattcggtattctcgaaaacatataacaacgcacttataactttttcttgcgatgaaaaatactataaaattaaaggttccttttagaacagcaaaaaaagaggaattttggataattgaaatttagttggaaaaagatccctagcttcatattctctgaaacaaagaaatggctccgaatgcatatggaatacaaagaaatatctcctacaaaaacagacctcatgttttctctttattccgtctcaaattcctgcgcttttactatagtgctatcaaacaataccttttttaataaattcttataaaaccttaaaatttaactacttcatctgtctcaaaatacaataatccagaaccggatatcatattttttattactataaatatggacaaatagtatatacatattcatgctactaaagaatttagagaggtgacacattctagtactgaaaaatattacatcttatccgaatctcttgtattatacgatgtaggaagggaggaataacatagtactcgtcgtttgagtgcgtttgttatccgaattccagtactcaaaaagattcgtgagcggtaaataaaaaaaatcaccgcggtggagagagcagtgacgctgcgactgttacgtggggccttagactgatgtggcgggagtacctgaataacctgatctcttgtgtcacattggcccccgtctctcttgtgcagattctgcagctgccatctcccccgcgaataaaaccccccctctctctctccctctgcccaccaaaggcaaaggcaaagcgaaccttggtcacagagctagaaaggcagcgcctctttctttctttcttttccagcaccgcgcgcgcgcggagacgcacagcacaggcgcacgcactcgtctttcgcttctcgcctcgtcgatcgctttttggattcttcccaagcgagagagagagagagagagagagagggagagaggggcatcgcctcctgtctgcccccattggcccaagcgcaccacccccctttgtggaatcctaaattcttgcctcctccccacctccactctcctctctgcttcttcttgccatgcgccgccgccgagggacgagggtcagtgtgggctctgtttgtgtgggtggtttgtggttgttgtcgttgttgttgctgcggcgtaggtcaggtgtttgattgtttgatcgtgagggttggggggggggggtgcgtctcggggttgtgtgtgtcgcaggtggtggtgatcgcgcgcgtggggttgggggtggggtggatgggagctcaggcaatgtcgtcgcaccaagggagcgggggcgtgtcgaggcaggggtcgctgtgcggcctcgcgctgagcgaggtggaggggcagctgcacggcgtgaacctcgacgacctgctccgtacgggtggcggtggggcgggggcgggggcggcggcggcggggaggaagacggtggacgaggtgtggcgggacatacagggcgcgacgggcaacggcttcctgcggccggcgggggcagcggcaggccagatgacgctcgaggacttcctgtccagggccggcgcggactccgggagcggcggcggcggcggcgccgactgcgcgcgctgggcgcgcgcgcaccaccaccacgtcgggcgccccgtgccacggcccctcgggctgggcgccgggccggtgctggacgcgctgtaccacgacggcccggtgtcagggagtaagcgcgcccccgccgcgggtgagggcgccgccgcggagaagacggtggagcggcggaagaagcggatgatcaagaaccgcgagtcggcagcgaggtcgcgcgccaggaagcaggtgagctcctcacaccgaccatctcgatctctctcgcgcattggatcgtgctcgcgcccgctcaagcactaagctctggttggcggcgcaggcgtacacgaacgagctggagaacaagatctcgcggcttgaggaggagaacaagcggctcaggatgcacaaggtatgcttcgattcatcatatgaaaatatgaaattatcaacactccactactcaaccgcagcatgcccagaaatatccatgaacttgaactccattatctaaaaatattgcatgaactttcctgctcgtgtgccaaatcaggtgtccaagcctgtttttgttcatcactttcaggaaccttaaggatttgtcacatactagcggtattataggatggagtttctagcctttgttattttgggtgttcttttgctttctaaactcatttggatttctagtatgggacaaattaagacactgtcgcatgtagtaggtcactcaggccaattcattgctaatgtgctaagatttttggggccaccatacaatgatgtataaatggggtctaccatctatttggttggaacaaacaaccgggttgttttcagcggtggagccaggattgccactctaattccattctaagggacaaaatgcaacatatctagtatagtacgtgcttagagaattgatacttttatgattaccatattcttgtttggtttcaccttaagtctacttgagttctctttaggcaggtcttggcacaattcttttctagcatgatgatgcaagcttgagaaaaagaaattgcaacagatcgtagttgtgctagcaaatcaagcattcagaaactataactgcctgccttcaactgaaacacccccgtacgctcgctgtttggtttacagggatttattccaagcccctgtcacatcggatgtttggacactaatttagagtattaaacatccactaattacaaaactcattccataagcttggactaattctcgagacgatttttttaggtttaattgcgacataattttgacaatgtgatgctacagtaaacttttgataattatagattaattaggcttaaaaaattcgtctcacggattagctctcatttataaaattagtttttttattagtctatatttaatactcttaattagcgtccaaacatcctatgtgacatgggctaaaaagttttagtcccatctaaacaccccctagccttttgttttatttcgttgtctctgcgtgattggcctcgctctgaagtggttatgagaggacgtctggcgatgcacggacgatacagttctgtccaatcaaatggtgttccgtcttgtcctctgttgcatcttgcacaaaggaaaatttctctcttttcctctggttaataactatagggactagctatatagtagtctaacatttgattgagaattattctaaaaatctgtcaaatgtaaatacaatacaattacaatataattttaataattataatatatttgtattctaattacggtcctcatcgtttggcatattcatatgcttatcaaccaaaaattaaattttcaacgttaaatttagagctgattttagggttttttcatcgaagtttattttttagcctttgcttttagatcgctaagaacatatatatatatatatatatatatatatatatgttttattcacaaattatttttcgtttgcaaatatgtcgtttgtcttattccaccaatatgccaaacgatggcaccctacatatgtaactaacatgcagttacaataaaaataggatgtaaatttgtgtgaagtcatgggtaggcccgcggggaggggtagtcacgtgcccgcattgtcacaggatcgatcccaaattatcccacccagtaccgtgcttttttacttttttttcttagaagcacaaatcttgatgtgtatcaaacggctaacaggaatctcaaacacatccaacggtttagaaactgagatttaaccatcaattttctgtcaacaaactgttagcaattccgataactatatactcgatttttcaaaatatcatccgaaaatagttgtgctctacaatgctgcctttgcttgatgatgagttgatcactctacaattggtgcccaaccatttctttcacaatgcctatcgtgtgtttgtcggacagacactctttctgtattccacttgactaaaagttggtgttctttagtataagctctttaacataaggatggactaaactaggggtttagagaagtttattacatcgtatgtcagctcgagttcctccattggcatgcatcagcatgatactaggatgatggaacttcatgtcaataaataatattgggccatccttttcaggttagtgtgaaaattctaccactatccatgtgctaacaaagtctgcacatctatctcgaactgcacctctctcatagtttagtggttttctttcacttgtttatacgccttcctatgcccatgtcaagaaatctgaagacagtatgtaacgttgcaagtggcaacttctccgaaagacgagatttatgtcctatactttgcatctgggagactgggagtatgaaacgcttgcctcattgtcctaaattgatattgctcggatatgaaacgttcagcaacagataaacttagttaaattcgaaagggtgcgtacgtttagaaaacacaaattgaggccgtgtttagttccaaaataattcttcaaacttctaactttttcatcacattaaaacttttctacacacataaacttccaacttttccgtcgcatcgttttaattttaacaaaacttccaattttagtgtgaactaaacatagtccgaaacgatctttttgtttgtatgttttctcttttttttttccgggcgtaaagtcgtacttaaggcaatagtagcactgctttgtttacccacatgcagcgcagtctgtaaactgcatgcatgcagcatgcagcagattcagacttgcagtacgtggaaagtaacaaagctccgtttgcgagctggactagtgaactgtgttctttttgacttctcagagaacgatgaactagtaggcatttgctctttgagatctgcttcaacagtggagatttcttttcatagttcgatgcccaatagtgacactgatggtttactgtttgcaaactgacggtgtttttatgcttgctacaggcacctgaaccggtagtgcagtatgtgccgcaacaggagccaaagaatcagctccggcgggttaactcggccgacttctgaatcatgttaatagtagaagtaagctgccctggaattaaaggtggttcaagctgtaactgccatgttgaaaattacttagctagtaagaacacccttttctctgcagtctccagattgttgggtgctgttgcaagagtgttgtactcctaacttgtggtttatgcagccgcagcctagctttcctcccgctggtgcaatgctttctgtagcctgtgattgcaagagtgccccagataaactgtaatgttaccgtattcaaaatgggaaaatggcaatgctagtccaaaatcatactccaactatttttcgcacaccttgggagtgtagacaaagcagacaaaattcaggatagttttgttttgctgaagaaaaataacagaaactttattcaattcaaagctgagatatgatctatacatcattcttatcttgatttataaaggaactggattaacataagtcttcactactgatacatcaactgctgtcagcatcttcttcaggcagtatcaatctaaggtcctcattgtccctgtagacttgtaccaaagcggcagccttgtatgcaaagaaacccatcattcctggaacaagctgtataaggaggagaaacagttgctcaggacatgttagggcaatttagctaacaaagttcaggataataacccttgctacataattgtcacagttaacaagggagataaatgaaatgcgtgtaattcataagatggagttgaatctgatatatgcactgcaatagctcagagctgtgcttatacctcaaaatttaaaatgctattttgaaagtgatctgacaaggttgacaatccaaaaaatatagcgggtatcacaagccttggagacgaaagagctactgaaataccacccaacaccttctctattgtattcttcaaatcctcgcttcttatgccgattctagcattgtcacatatatagggacaattaatgacaaagtgagggcaaaagattgataataaaaaatgattaacattttcaaacctaccttttcactttcttcttcataaaaatttctggaacatctttctttgacaaattatctgtgtgccgatagagaagttgaagatacaagcaactgttcaacataatgtgactggttagattattttttatcgttgatagttgcaatagaagttaacccagtctgttgagagagtagccccagcgacattatattgaaacaaggtaccacaaacttctgagttcttaagttcaataggaagcaaattgagcttacctgaaagcaactccaaaagcataactgacagcagcctgttcaattggagcgttacagattcagtcacaatcagcaaaattatagatagagttaagccatttgagctcaggagataactttgattctgtttcatatcggttggttatgaagttagtggaacaggagatggcttaatgttgactcacactaccacaataactcgaaactacttagtcgttttaacgtcggcaaagagtaatgtctaatttgatgccaattataaatttgaaaaatctatttacctccagagaaaagactaggagacagtataaactgcacgcagctccaattcctgtggtcaggagcaatagttcatccttaagctgagagagattatgattgatgaccatcagttatgggatgcaaaagcttcactgaaaataattcatcagaaaaaagaagcacaggagagctgaaacgaaaacctactgcttcatatcttagaaggttgagttccttccttctttccctctcatcctgccgatcctgtcatcgtttgcaacagcattaacatttctctacaaattgcttccacaaaaaagatggccactagccaaaacaatgaacaattgagcagcaaacccagaacaccatgacagacacaagaccttggcagaaagcctcttgctgacaggaaggctgctctcaccggagacccaatctctcgtcgccgcaatcctcaacattccctcgcccatgacatcctgtacaaccggatgattctcagtgttgctctgcaaaaattacaccagacaaaacactttgaattggtactatacatcttacagcttcttcaggttgcggtggtgcgacatccgctgaattttcttgttccgccgccgcctctagcacgccgaggtcgccgccgttcctcctccagaccatgtcggagatcttggtgacgaagtcgccgtgcgcctgcctctccgcgaggaacatccgcaggacctcctccccgaggctgtccccagctgctagcatcagaagcagaactcatggaatcagcaccagccaaaccagaaaaaaaataaaccccgaatttgttccgagaacactggccgcgagctagaagtcgactgctactaccttggagggaggagtagcggagagcggaggcgcgcggggaggcgcgggcgcgggcggggccgagaagagggcgcgcggccgcggcgtcgaggccgcggcagcagcggaggccggggagccccatagccatggcgattccgagcaaagctgttcgctcggctgcggctggctataagccgattagccgaggcctctcctccgtttcttcctggtctcaaaaccaagcgatgtttggaggagccgtccctcgcaaaccgaaccggcaaaaatatcttccttttgggcctcgttttctgcctccatcttatggcccgtttacgaagtgcaaaatttatgtgtcgtgcggtaatctaaccgtttcacctgaaattcattctagtacacataggattttgttttccgaatttcagccgagaaatgttggtaagtgcaatatctaaagaaaagcagagggggaagaacagtcaggtgcttaactggtagactcaattcaatagaattagctacttatctgttaccaaaatatttaaccaagcgatgacacgaccaaatatgcatgtgaccgtattcttcgctcaagagtcaagacattgaattcgagataggtttatcaactccatctgaagatcatctttcactgcactgctcttgaaatacagacgcatcatgcagaacaatgcaggcaacagcaagtattcaacatggaaaaaaaaagcagtaataactagtgagaacgcaatgtatcttgtccataaatcatagcaggatggtcatgtcctgtcctggtaacatccacaaacatatagcataagttcagggcaccaattgttatgccagttacaggaattattcaacggagaggcagtgtgacatccttgccatgaaggcagttcaacagacgggcactcgttagcccggcggccagttcatctgcctgcctccgaggagatgtacatgtatgtggtaaacagattggcctgcaaataaagatatcaggtgactgaagatgaatggtctaccaaatataggttctaatgtataagaagactgaaatgagacgtacatccactggggccatcattgatgacaatacggtagccatcttcaagtccctcctgctttgcaacaactttggcaacatagaggaggtaaccgagtatttctacatgcctctcttctgcctgtgaagatgggaaacatgaaatgcatttagtttcgaagatactttattcattttacttgttactcttgttaacgtttacttgtcactcaacatgagtccatgtcagttttttacgggcttggtaatttgtggcatgtgggtgcattccgaggtaagaatgcagtgagtgacaagaaagccttactcatcattcatgcttaggcaatctcccacatgcatgcaccaactcatggcgcctgcattagtgaggccaaaggcagtccataacagtaatcacattcatctacccaacatgaccaaaatgacatttatatattctctatttgggtaaggagtcagcaggttggattacacagctaattgctcctaggcccacaagggagggcaaggacaaatgagaaatgggcaaatttgaaatcacgaaagggttagtaaatttaggtaaactataaatcgactacatatgaagagaaaggttgacataaactggaacataaattgtgataatagatgagtgttaaatgctacctttgataggccagttaatccatccttcactttgggaatgatcacaatgtgggtcggagcttgaggatttatgtctctgaaagccagaacctgggaaacaaactcacagttcatgcccaaaacaaattcacattggagaattaagaaatatgaacaaaagtgtttgatccaaaacataagagtaatgaactgttgcagttctaggatttagtcatttcaatgcaataacagtagaacgacaggcatccagtttacttgggccttaggagttggaaactggagacttgtattgcagtactttagtacctagtgagagagaactatgtattcgacatttctggcacccgtgagaatgacctaggtaaggatatagctaatctctccgtacagagtgctccgtcataccgtagtgagcatatgacagattcatgtgaagggtgtggtctcctagacattattggtttgcgtcaaggaggtgactgccatgacaaaggtgtccggcctaagcagtttctggcattatggaggacaaggcgaactggtatgttaagtagagaagggatggggaaacagatcaatctgtctcttaaccagaactagtacaaagtgcatcctttatatagatgatgacttgtcttcacgaccatagactccagtagtaacgattaaaacaattataacagaccactaagttgattatgccctcaaaagttccttatcctactcatagttgcaaatataacaatggtatcaacaatttattcaactgctcctgattccaaaacaaagcacaatcaagcaattttcagtctaactgggtatagagaaaagaaactcagtgggaaatagaagaaaggttccaaaaaaagctaagtagttggaagggcaagttcttatcagtgggaggccggctagtactcatcaactcggttttgagtagccttgcgatgtacatgctttccttctttgaggttgctaaaggcatccttaagaaactggacttttttaggtctaggtttttttggcaaagtgatgagcacaaaaagaagtacagattgaccagatggagtgtgttgtgtaaacccaaggagtgcgggggtttagggatacaaaatcttgagattcagaataaatgcttgttgagtaagtggttatacaagctgatcaatgaggagggggtctggcagaatttgttgagaagaaaatatctttctagtaaaaccattatgcaagtgcagaagcgaaggggggactctcacttctgggcaggactaatgggggttaaggatacctttcgttcttttggttcatttaaattgcatgatggctcacaagtgagattctgggaaagaccgttggctcgggaatcagtctttagataagaaatacccttctttgtataatcttgtaaggaataaaaatgaggtggtggccaaggtagttggaagggtacctttgaacgtttcctttaggagggccatagtgggagacaatctccatgcttggcatgagattgtagctaacgtggttgacttaagcttaaaggggcaaaaggatgtgtttttttgggaggctaacaaaaatggaactttcacggtcaattcgatgtacaaaaagctcatgtatggtaatgtaataccgaggaaatcttttatttggaagctaagacttcctttgaagataaaaattttcttgtggtatttgaaagagggagtcattttaaccaaggataacttagcaaagaggaggtggaaaggtagcccttaggtgttcttttgtagatctaatgagacaatacaacacctgttttttgat

SEQ ID NO: 43616 - DNA, 6679 bp, Oryza sativa
ttctttttgcaggtgattttcagggggacatattgggcaagactttggtccttgttgcttaaggaagaggatggcactttggtgaaagaatactgcaaaatgttagagatgagagttttagagttctactccaactatggctggaacttcagaaggagaattcaagattaggttggcacctcgtgtctgtttgatgtggtgtgcctggatggtggttttctgtttttgttggttgttcttgacaccttttgtggtccaagttattttgtttttgttacccatgtaatgggtggagtttcaatgctcatgtatgaacttggttggctgtgtacatcccgttggatgtagaggccgggtttttaatccattatctaaaaaatagagaaaagaaactaagcagtagtaccttctcatcgtcaaataccacagtggaaggtatttccttcttgatgatcttgtcaaatctgcagatgcaacaaatttcagaaatcaattcaattgcacacttttctgtgcagaatgtaaaacttcaccacattctaaatcaataatttgacatcttcagaaacttaatcttgattacaaggaaaaacttacacttgactaccatcaagcaaactgcaaacagcatgctcttttggcaacaaatgaaccactgatcaatgcttaacttgactattgagttccaatgcgctgtggagatgtattatagttgtttgtcagacattttaaatttaatgaaaagggtatcagacgatttgcctactgctttaatgttcaggcattcagggctcacttcataatattaatccgttaaacgagtgtttcagtgacacaagtaggattggtatttggctattagagaaatggtcaaataaattcctcaaaatgatgtcataaacctgactggggtaagcagagacagatgccacttacttagaaggaaaaaaaaaaactgggccataacttatggagtaaaaaccaaagcaggctacagtacagattggtacgcaagctagtgaaaaatttaattaacaatcatgcttgcactattgtacagctcaatagccccatttcgtatttgcgccaagctcttatttgtggtgtgcctcatttccagtagtaataattagtaaaggaccctaatcacatgaatccagcaattccatctacacgaattacttctgcaaacgctcgctcaagttcggtttaaagagacagggaggtgttcgaatcaatgatctcccagcgtactaggccatgataaactagtgatgccgcaatctgccaatccatgagatcaagaagcacacacgagtactacactgcctacaaatcagagcgggttttgcggcaggagagagagaggtgctcacatggtggggttgtcgttgggcacggcggcgagcgccgcctccttctccgacgccatggtgagggatcgatcgaacttccccgagcacaagtggtcgccgccgcgagtgttcttatgtggataaaaggcacaccagagacgcaaaccctcgttttccacgtcaatttactattctgcccttacaattttgggtcatgcggctcatgccatgcccattttggttaaatctaaaataccgattgcagggtgcaaactctactaaatcattaggccacgtggccaaaccaaaaaccaagttcacatatcatcaaaatatgccacgtgtccagaagagcacgttcattttgaacgtgtgtgaagagtctagataaaacaaaggaaaaaatccagagcattctaaactcggttgaaaaaaatcacatgataacacgaaaagaattagtgaaaaagattgcatgccgaggaaacaatggataagaaaaaaatagtatccaaaaaactgccacaagttttttaaaggaacaacttttaaatctaactataatataattccactataactataccataacaatattgtaacttgtatataagtattaaaatactatatgcaactttatatcacttatatagagattacaatatagttaaagtagttacactattgtgtacaatgtaactatagtgtagttacattgtagttatactacaactatactatagtaacatttaaaagttttttttgccaaaaaacttgtgacaactttttagcaattcccaaaaaaatataaacagcgagccgatgttagctgtcgtaaaccggcaacgaggaagacatttaccgcaatattttccggatccacggaagctgttgccaacgagcaagatccactcactcaatggagcaagcggagggcgtcgagccgtactagctgtgatagtccgcgagtgtggacgcgccaaccagccaacgagcatcgaggtcgagcacgtcctcgccatccacggtagcaatgaccacgaccccaagctcgaccacatccaggaggaagaagagagagggatgaagaagggctcaatgaggatacccagctttggacaatcaagggacgagggcgatcttgccttcgctaccatcatcttcctcctcttctccttgttctcgcaagcgttgtcttcctcaacggctgatgcctttctcccagcaccgacgcgacaatccttgttctcgcaagcgccattttccccaacggttgtcgcctttctcctagcaccgacacggaaatccttgttctcgcaagtgtcgtcttcctcaatggccatcgcctttctctcagcaccgacgcggcaatccttgttctcgcaagtgtcgtcttccccaatggccatcgcctttctcccagcactgacacggcaagtaaagctccaatgccaggatccaacgaccaattctctaagccaccagatccagcatcctttaacccatcggacccggggccacgatctctagtgacgctgagacatggcgggccgcgatggcgatgagcggtgaaggggacgaatcatcgaagattcaaggcccttccactttctattactaggtgattctccatgctttgctacgggatcgctaaacaatttttaatatatttttttcaacaagtaaactaagagtaaaaagaatagaaaataatgaaacgtgaagttttatcagaacttatcataaaataaacaaatgatacccgtaatttaatgtggagcatattgataagtatatgttaaatattataaaaatggtatgtatatttgttaaaatattgtagaaataatgtgatgacatgtatatttgttaaaatattgtagaaataatgtgaggggtgaaacactttgttttttttaaaaaaaataccaacaccaattttataatgagttaataacttaattataattttagaaaaacaaaggaagaaacaatagcatgggtggaaaaaaagagaaaatttgatgattttctcaacaatatgatctgttatgttaaactggaacacagaaaattccattcaactatgatttttgcatgagtttcaaagaaattaaattgatttctatatttttttatgaacaatgtgctaattaataacacaaaaataatatatacggactataaatcatgcgcgccaactggcgcgctgattttctagtgacatctatattcagattgcgccgaagtttaaggcttgctttacccttttggcaaaataagacaccgcaaaaacatgacacaatcgacggcgtgctcctcaaggctcgtgcctatgcagacgaaggtcggggctacacctcagatctggctaggagagagaaaggaggttatcgtcgctatcgccgaccgagcagcagctgatgcttgccaccactagatccgatgggggagccaccagatgtgggaatcctcgtactaggcctcgcaactgtcagcgccagatctggcggtgaagccatcggttctggaagtccagtcactgtcgaggaggaggaggaggcggtggtgagggagggggatgaggagacgaagcagcgggtggtagtggtggttagttggttgctcgcccctctgcagccgcactcgtgctcatacagtggttcgcataaccccaccgcccacgataggcgcttgatctccaccgctggtggtgcgacatagctgccgcctgtggggataaatggggagagaagatgggagtgaaggagtgagtggtggggagtgaactactaagaataaggtgcggagagatggttattttatagtgcaaagtatttcttttccaggtggctatgcaggagaacatttgcgaaatttattttcagaagcagttgtccaagaagaccactaatgaaattagggctatttttaccgacggttgttttaaaaacaagtgctagtgataatagattttcataagcggtcattaaccataagccttcggttattttttacaagcgtttcaaattttatccattggagaaaaaagatgtaatgccagaaaaaacctattttgtagtagtgtttattcccttccttgaaatatgaaggcaaagtagattagatatcatggttaatctttcagtgattggaacagatcgaccagaaaatttcagataaaccacgagggactcagggcccaaagaattacgtaatgtcaaaattgatgattcttccacatggataaaatatgggtcaaataaacagaaaccgccatgaagttggtcaacaaacaaacttcagttgactcggagcggaggatgggttgggatttaaggcggcacaccatataaggtgaaccattaacatatagcatgcctaattgagtaattattataaaatttaaaaataaattttattttttaaaagaaaaaactttcgtatagaaaactttcatgtaaaatataccacttagttatttggaaatcacgttgataaggaaaaaaaataaagtaggcttgtttagaatgcagcctgaagtatggatatgctaatgttattagggcatctacaatgttgaaaaaaaaggcagcattaaacatttaatgctactaagttttgtacctttgccattgtagagatgcactataagcatcaccaaactaaaatgcaccaccctaagcttaaggtatggtcacaagacaataaaactaagcttaaggtatggccacaagacaataaaatataggatttgctattcatactaataaaatacaacattgcattgaattgtttatttgtaatcatttggctgccatgcgggaccttttgccattttctttcttttggtgggacccagcggggcccactttattttcttacctaggccctgtttagattccaactttttttcttcaaacttttaactttttcttcacatcgaactttcctacacacaaatttctaacttttccgtcgcatcgttctaatttatttaaactttcaattttgacgtggaactaaacacacccctagtcataagcatgatacatatggatatagttgtggctctttctagtggaccccactcctattactcacggtggcataaacgttggtcttgcccttagaaatttagaaccaacctttctttttctcgggttatttaataacttaaactgggcccggatatggtagaagtttctcacggtactactggctgctaatggtcaagtaagccattattattaattaatactcctagttttttttctttaaatttaatcaaatttataaatggtatactaatatttttaatacaaaataatgtattattaaaatatatttaatagaaataatcttttgtcgtagatgatgataatttttttataaatttgatcaacttaaggaacttgggacctgttgatattgtagccaaaataaaccttaccaaattttggtattagcaagttaataatattgtcaaaattttggcaggattttttatatatttataaatttgataacaaactagacatagaactttttttggcaactttgacgaaaaaaaatgttatggttgaaaataatatcaatctgaacagtgtcttgaactaagaaaaaatcgtatgacttataatataaaacagaggaattatccggtacaacttgcctttcttagccaccactgacaaaagcattacgcaggtggtaggctaattagcaaagcttattaagacctctcgagcccagctagcaagctatcgtgctgcctggaaggtccgaagaagcggcggcgttgaatcgagtagccgacgtgccatacgcccacgccatttccgcgcctacaaatagcgagatttttccttgcggcttcttccaaatcttcagcggtctccgccttcagatacacctttgatccgcagcgatgaacgggggaagcccggtgatgacggagagagagcggcgcgcgtaccggtacgggcaggcgtcgtcgccgacggcgcgggcggtcgggcagctggggtgcatcaggaagtcgtggtccaacgactcgctctcgagctacggcggcggcgggagggccggcggcggcggcgcccaggcgtgcgtgtgcgcgcccaccacgcacccgggctccttccggtgcaagcaccaccgccaaaacgcctccaacctcggcgccgccgccgcggcgccggcccaggtggtcgacgttgacgcggacgccaagcaccaggaggcccaggagcaggaggagaaggcgacgtgagggcgaccatggtttgatcgatctggcaaacttgtgcgtgtttaataaa

SEQ ID NO: 43617 - DNA, 6406 bp, Oryza sativa
ccccatgttaaaatccgaatatatttttcactctcagctattaatataggatgaattacccccttacctaatctgaagcaatttttatcatacgccacacacgtaacaatccaattagcatttttcttttaaaaaatgatggggtccagctatcatagtctctcacctctctccctttccctttttcccgtttaaatgtccctaattgtggcattgacggcggtgaggcagccggcaggcctcagctgccacctcttctttctttcttccctattctcgaccttggcaggcgatgacaccagaaacctccggaggagacgcaaccgccgagcgcgatgttgtaggcagctgaggtaaggtgggctctccatgggaaggacaaggtgtacggcggcatcggtggtggcggagatgacacgatcgaagtagatttggttatggagctcgatgaggcgcgtggcggcgtcggtgcacgtcgcgacgggggaggaggcgagaaagagggttgcgttgcataggtgcgttgatccccactctctagccatcaagctcgacatcgtcgacaccatccacgtgctcctctccacactcccgtcgttgcttcgtgcactgctcccatttcttttcctcctctcgctatgccctgcatcgtgtccgtgtgtgtttttgagctttcttaacttttagcgccatgcgctttgctccgctttatagcaagaccgggaaagctgaggagagatggggaaacccaactgctgccggtcgggatggacaggaaaggggcggggataagcttgtgaagaagcaagcttattgccccaaaaaacaaaccgacccagcaagaaaacgtatgcgctttagctccaccctcaccctgcacgccgtctcggatgccctcctctgcaacgccatccccgtcacctccgctcactcctactccacacctacgtgtatcactcctcctactcttctcttcccatgctaatgagctcatgttcaacaccctcgcgctagcctcctggcctttctcacactttcgcggcactcgttgccacgcaatcctctgtcgaccgtcacgccgaggccatccaagcgttctcccgaatggatgagttcgacagttgtcccaccgccttcatctacaacactgccctcaaggttcatcgccgccgccgcccagctcttgtctagcaacttgctccccttcttcccctcgcgccacagtgccctctcgaccgccgctgcactcgacgcccctcaacgatacctgcctcgcccctagcaaacaaccgagagagagatgtgtgaggtatatgacaagtgggacatgtttttttaatctttttttttcgattggactgtcacgtaggcgtcacatgtataccacaggtcaaaaccgcttcggattgggttaagaagggtaattcatctagtattgatagttgagggtgaaatatgtctggatttcgggtttgaggggtaattcaaatcagggggctaattcagacttttttctggtttaaattgttgaatcttgaatatatatatatatatatatatatatatatatatatatatatatatatatatacttactctgctttaaaagaaacttgaattagtgaattcgacacctcaccttacaaatacccccttgaactttctaatattgatatgaatattctctatagtaaaacaaggatgggtcacatctcatgaaatatatatatatatatattcttatgaatttcagataatgttataatatatatatttttctatctgtactaaagtacgtgcattcagctagtagttgtaaattccattttgagccttaaacgattttcaaattatacttttgttacaaaagttttcacttacaacttccagaaattgaaaaacaactacattcgttttaaaatccaatatgaaaaaaaacaagcaggttttctgtaaagaaaaggaaaacaaatggaatatttttgctgcccctttcgtttattatggagtattttgtgattttgtcggtcgatctgtcccaaaatccaaacgaacgggggtgatggacttgcccgtttgaaacccccaaatcgcaggctccacagagaccaacggccatatccccaactttggattttggccaccgccggcgccgccgaccccacgatttccctccacactgccacccacatccgtcgtctccccccggccgctcccccgctccggtttgaaatcccctccgtgtccccagatatccgccgatcccctcttcgaaaatcggcgattgcgagtgggagttattgagaccccccccccccccccccaatcataggatactggttgatccgcgccgactcctctcgtctgctgctgctgctgctgctctgcgctctcttcgaggaggaagaagatcatcaggttagtcttggtttctactagccgtccgaacttggtttcttttgcaggcgatgttatgcatggtttcacttgatgagtctcgtcggtctcgaattctcgtagattcgttcgtttttttcgattttttttgtcatcttttggttgtgggaaaattatctggatttcttggtgcgtgctcagggttagtccgtcacctgttcgaccgatttcctgaccgaaatactcctttccctcgcaggagcacctgttccgccgcctctgtcctccgatctcacagtcccatccgcctcgccgctggtagcggcaagcaagccaaagacgccgcgggatcccaatatcccatctccacgggcagcagcgccaccgccacggctggagcaaccaaaccaagggacgcgggcacgttctactgggaaatcgccacgccgaattttgtgtgtgccaagcggttcgtgccgaagcatttgtggtccttttttttttgactcctccatattgtctataaaaaaagacttgtgatacatttactttctgatggatttgctacttagaaattctaatgcatattagttagcagttgcgtttagttgtacaccaactgctcagtgtctcagcctgcagcaatgcaactacttggaacagctattgatccaaagcttgcactattatttgaataatttttacttttgatctagaacagttgcacacattttagggttactttgcgcttaccctgatgttttctccgtgcagaagagtattagacgctcctgaagatgagaaggttctttccgttccgctcattcacaagtaatgctgggaatggcaaagcatcagcgggacatgataagaagaatgagaacaaactggatggagggactagctgtgcctcccattctcctgacacacgggcattcaggtcaagaagccggcatggaaaaccaagcagtgaggaatcatccactcctcagctcaggaggtgcatgtcattgacgtcgtcagcaattgatcgttccttgaatgaacggacaatgaacttttcaggcgatattccatgctctttctccaatagttctgatgtgcctcgacacattggggatgcggagtaagtggattaaagataaaatttacttgtgcttgaggttcccactgtctgtaacttatgcttcagcaacatcaataattaataataataactgaacactgtgtcatcccctatttggaaaattccaaacaatctgttttttcccaagtaagtggtagttttacattttaattggtttgacagagctaaaaccaagcacaaagtttggtggtgcattatagactcactatctgttactagattttttatttctagctcatgcccattgtgttactaacaaaccacttatgaaaacttattcaactttcagttaacaatgaactgtttttgaaaacttattcagctttcagtcagcaatgaactctttgcatattatcttgagcagatgtaacctttagccatgtttagccccatttaattatgtttctgtttgtcctaattgtttatcataactgtgatgctggagattttccttttaaacttactattatcatgcatggtattctatttagcatgatgactgaaggatggtagaaataaaaggttacaatctttctgtctgcaggtactatccctggtcacaagaaagacacaccaatatgggagaatacacgatagaggttccaaaaacacatggggtacaggaaagtgattcacctcagtcaagatgctactcatgctcagcaggacactctcctgttagttctcctgttgtgttaaaatgcaggccttctaaattgaccaatctttcaagcaagaatgaagttctagatctatatattgatggagagcaagagtcaaacagtctaaatgagaaacataagctaaaattacctgtcagatcctcatcatcttatttgggacggggacggccacctagaccccattctacagctccatcttcaccaaagtcttgcaaagaaatcgttgagagctatagctactcaaacatcgacatgattgatgcctgccaattagctcaggaggaaacaaagggcatatggaaggttgcatctgtgtgtgcagagcctggagatgatgcacaaatgcttgaagcatcttctgaaaaattttcacatatagaggagtgcaaatcacaaagtattgctacattggaagatatttatgatcgtttggaagatgcacaacctccatgcttttgtgacacttcaatggattatatttcaggcactacctcaagatgctttgatgcagatgtctgttgtcgtgatgactctcatggttttcatggtaataaccttgaacaagacactgatgagaagttgcttagaagagctaaagaacttgatgagtgcttcatggttcctcttgaagaaaataatgagcttaacatgctgagggataatagtttaagctcaactgacatgttgcagctgatacagactttgattgaagatagaaggcaattggcactccaattgtcttcacaaattaaggcacgtcttacagagagatttgcagccaaagagcaacataagcggtccaaggtagaattgaacaccagaactagaaggctggagaaggagaagagtgatgtgcaaagtaccttggaaatggagcttgatagaaggtcaaatgattggtcagtcaaactggcagaattccaatcagaagaacagcgattacgggaaagagtaagagagcttgcagagcagaatgtatcttttcaaagagaagttactttacttgaatcgaacagaattgatgtttctaataagataacaagtttagaactgcaaaacaaacagctcaatgacgagctacagaaagtaaagaaagagcatgatactcttttgaagtcatcggttgagttgaatgataatttaacgaaaactgcagaggaaaggaaccaaatcctggaatgcttaaaagagaagggaggtgacaataaagcattacacaaagtgattgcaaggttgcagaggatatctaatgaacaggagaaaacaataactggcctgagacagggattcaatgctgaactggaaaacaaatcccttggtactagtgaaagcatcagcaggatgcaaatggaacttatcagacttactggagtggaacaaaagctgagaagagaaattcagtcctgtaaccgtgaagttgagtctctaagggaagagaatatagctgttttaaatcgtctacaaagcagtgataacaaattaagtatttcttcagttcgtcttgaacaggagctcaacaccagagtggacaacttgcaactacagggcttatcgttgcttgatgatactagtcagctttgtgccaagttgttggactcaatgaaatctaagaggagtgagagtttcggaagtgttgatgcattagcatccattgaatacactttgagttaccagagcatacaagaaagaatcaagaatttaaaacaatgtcttcgggcaatcagatctatgttgactgaaaagcataatgaagaagaaaagattggagagagaactgaaagctgtatcttgaaacaggaccacttatccaaggtatgaagttcctagggcctttttacatttggaagtatcctatttatttttcagtcttatgggccggtggttgttggcttaagactttgttctgtagagcacaaaaaaacacttttttcaaacatatacagtgaaatttggtacagagacaatgttctcaaaatatatctggtagactctactagtacagagacaagtctcagaagctaaatctaaacctccgctttcctttttgcccttttctatgcaggatgacattgaatttaagttaaaagaagagtctatgctctgtagagtactaaaggagaagttattgtcaagagaacgagacattgaacaattgcagtcagatctagcatcttcagtt
